United States Patent 9,719,131 (METHOD FOR DETERMINING THE DEGREE OF METHYLATION OF DEFINED CYTOSINES IN GENOMIC DNA IN THE SEQUENCE CONTEXT OF 5'-CPG-3') - sequence listing, part 2

SEQ ID NO: 3076 - DNA, 657 bp, Artificial Sequence
  chemically treated genomic DNA (Homo sapiens) CpG-island No: 3076
aaactcgaacgataacgacgataaccgaaaacgataatacctcctcctcctcgccccgacgccgacgataatccgaacgaacgaccgcgcccccgataaaactactaacgaactaactatacctaaacctaacgtccgtataactaacgcgaaaaatataaacgctacgaacgccgctcacccgctccctatacgtaaacataactaacgacccgaataaaccgacgacgaacgcgaacgacaaaaaaaaaaaccaccaaatacgaactaaaacgaaacgaaacgaaaacgtaacgaccgaccttcccgcgctaaacccgactattatacgaaacgactccgcgaaaaaacgacccgccctcgcccctccgcctcgaccccttaaaaaattttccccgcgccttccccgccgaacgtcgactccgcgaaccccgaacacccgaccgcgaccccgcgaacgccttttattccgcaacgcaaacgaaacatacctcccgaacccgatcgtaaacgacccgaaaccccgcattattcctaaatcccgaacgataactacgaacgcccgacaacgaaactaaaaaactttaaaaccaaaacgtaactaaaaacgcccgcctaacaccgaaacctaaaactaaaaaaacccgaccaaatcca

SEQ ID NO: 3077 - DNA, 1050 bp, Artificial Sequence
  chemically treated genomic DNA (Homo sapiens) CpG-island No: 3077
  misc_feature (628)..(628): n is either a, c, g or t
ggcgcgggcgttttcgggagagcgtcgggcgcgttgggtttgttgaagggttttaggtttggttattcggtgatttttaaagatgggacgcgtcgcggggtttcgagggtttgaaattcgttttcgtagcgtagtttcgggcgcgttattattttcgtcgcggtcgattgcggggcgatcgttcggtttcgaagtcgggagaggagaggtcgggtttcggcgggtcgttttgggcgggcggggagcgtagtttcggagttaggtagtttttcgcgttcgtttttttcgatttttttcggtcggttcgagttcggaggggcggggcgtcgggcgggtcggggcggggttcggggaggagtcgtggttgcggcggttgtcgcgttagagtagcgttttcgttgttcggcggtttagatacggttcgagcgtcgtcgcggacgcggatagagattcgtacgggtacgggcgttgcgttggaggtttttttcgcggttcggggttgcgcgattatggcggataaggaggtcggcggtagcgacgggtttcgaggtgagcgtaggttgcgggttttgcggtcgcggttggcggggtagggagggaggaggcgcgtttggtttaacgttttttnttttttttttcgtttttttattttggggacgttcgcgttgtatttagttttggcgggcggggtcggggttagtagtagcggggtcgggggtcgggggtcggtggatcggagacggcgggcgggttatatgttttgcgtttcgttagggtgcggatttcgcggcggggattgtagttttcgttgaggcgtttggttggtttttgtttcgggtggcgttttttgcggggttggtcgcgcgtgcgggtgaggatcgtttcgcgtgtgtagttttcgcgcgatgggttgcggaggtcggcgttggttgggtaaagggttcgtcgtcgggtggtcgggtggttttagcgggtaattttcgtgatttagcgaggtaggagtgggagtttgggggaaatcggagatttggatttgttttttcgttttat

SEQ ID NO: 3078 - DNA, 1050 bp, Artificial Sequence
  chemically treated genomic DNA (Homo sapiens) CpG-island No: 3078
  misc_feature (423)..(423): n is either a, c, g or t
ataaaacgaaaaaacaaatccaaatctccgatttcccccaaactcccactcctacctcgctaaatcacgaaaattacccgctaaaaccacccgaccacccgacgacgaaccctttacccaaccaacgccgacctccgcaacccatcgcgcgaaaactacacacgcgaaacgatcctcacccgcacgcgcgaccaaccccgcaaaaaacgccacccgaaacaaaaaccaaccaaacgcctcaacgaaaactacaatccccgccgcgaaatccgcaccctaacgaaacgcaaaacatataacccgcccgccgtctccgatccaccgacccccgacccccgaccccgctactactaaccccgaccccgcccgccaaaactaaatacaacgcgaacgtccccaaaataaaaaaacgaaaaaaaaaanaaaaaacgttaaaccaaacgcgcctcctccctccctaccccgccaaccgcgaccgcaaaacccgcaacctacgctcacctcgaaacccgtcgctaccgccgacctccttatccgccataatcgcgcaaccccgaaccgcgaaaaaaacctccaacgcaacgcccgtacccgtacgaatctctatccgcgtccgcgacgacgctcgaaccgtatctaaaccgccgaacaacgaaaacgctactctaacgcgacaaccgccgcaaccacgactcctccccgaaccccgccccgacccgcccgacgccccgcccctccgaactcgaaccgaccgaaaaaaatcgaaaaaaacgaacgcgaaaaactacctaactccgaaactacgctccccgcccgcccaaaacgacccgccgaaacccgacctctcctctcccgacttcgaaaccgaacgatcgccccgcaatcgaccgcgacgaaaataataacgcgcccgaaactacgctacgaaaacgaatttcaaaccctcgaaaccccgcgacgcgtcccatctttaaaaatcaccgaataaccaaacctaaaacccttcaacaaacccaacgcgcccgacgctctcccgaaaacgcccgcgcc

SEQ ID NO: 3079 - DNA, 1050 bp, Artificial Sequence
  chemically treated genomic DNA (Homo sapiens) CpG-island No: 3079
  misc_feature (423)..(423): n is either a, c, g or t
atggggcgagggaataggtttaaattttcgattttttttaggtttttatttttgtttcgttgagttacgaaaattattcgttggggttattcggttattcggcggcgggttttttatttagttagcgtcggttttcgtagtttatcgcgcgggggttgtatacgcggggcggtttttattcgtacgcgcgattagtttcgtaggaggcgttattcgaggtagggattaattaggcgttttagcgggggttgtagttttcgtcgcggagttcgtattttggcggggcgtagaatatgtgattcgttcgtcgttttcggtttatcggttttcggttttcggtttcgttgttgttgatttcggtttcgttcgttagaattggatgtagcgcgggcgtttttaaaataaaaaggcgagagagggggngaggagcgttgggttaagcgcgttttttttttttttgtttcgttagtcgcggtcgtaggattcgtagtttgcgtttatttcggggttcgtcgttgtcgtcggtttttttgttcgttatggtcgcgtagtttcggatcgcgaggggagtttttagcgtagcgttcgtgttcgtgcgggtttttgttcgcgttcgcggcggcgttcgggtcgtgtttgagtcgtcgggtagcgggagcgttgttttgacgcggtagtcgtcgtagttacggttttttttcgggtttcgtttcggttcgttcggcgtttcgttttttcgagttcgggtcggtcgggaaaggtcggggaaggcgggcgcggggaattgtttggtttcggagttgcgtttttcgttcgtttagagcggttcgtcgaggttcggttttttttttttcggtttcgggatcgagcggtcgtttcgtagtcgatcgcggcgggggtagtggcgcgttcggggttgcgttgcgggagcggattttaggttttcggggtttcgcggcgcgttttatttttggaagttatcgaatggttaggtttggagttttttagtaagtttagcgcgttcggcgttttttcgaggacgttcgcgtt

SEQ ID NO: 3080 - DNA, 1050 bp, Artificial Sequence
  chemically treated genomic DNA (Homo sapiens) CpG-island No: 3080
  misc_feature (628)..(628): n is either a, c, g or t
aacgcgaacgtcctcgaaaaaacgccgaacgcgctaaacttactaaaaaactccaaacctaaccattcgataacttccaaaaataaaacgcgccgcgaaaccccgaaaacctaaaatccgctcccgcaacgcaaccccgaacgcgccactacccccgccgcgatcgactacgaaacgaccgctcgatcccgaaaccgaaaaaaaaaaaaccgaacctcgacgaaccgctctaaacgaacgaaaaacgcaactccgaaaccaaacaattccccgcgcccgccttccccgacctttcccgaccgacccgaactcgaaaaaacgaaacgccgaacgaaccgaaacgaaacccgaaaaaaaaccgtaactacgacgactaccgcgtcaaaacaacgctcccgctacccgacgactcaaacacgacccgaacgccgccgcgaacgcgaacaaaaacccgcacgaacacgaacgctacgctaaaaactcccctcgcgatccgaaactacgcgaccataacgaacaaaaaaaccgacgacaacgacgaaccccgaaataaacgcaaactacgaatcctacgaccgcgactaacgaaacaaaaaaaaaaaaaacgcgcttaacccaacgctcctcnccccctctctcgcctttttattttaaaaacgcccgcgctacatccaattctaacgaacgaaaccgaaatcaacaacaacgaaaccgaaaaccgaaaaccgataaaccgaaaacgacgaacgaatcacatattctacgccccgccaaaatacgaactccgcgacgaaaactacaacccccgctaaaacgcctaattaatccctacctcgaataacgcctcctacgaaactaatcgcgcgtacgaataaaaaccgccccgcgtatacaacccccgcgcgataaactacgaaaaccgacgctaactaaataaaaaacccgccgccgaataaccgaataaccccaacgaataattttcgtaactcaacgaaacaaaaataaaaacctaaaaaaaatcgaaaatttaaacctattccctcgccccat

SEQ ID NO: 3081 - DNA, 1200 bp, Artificial Sequence
  chemically treated genomic DNA (Homo sapiens) CpG-island No: 3081
gcggcgtggggagggggatttaggtcgggggttcgggtggcgcgtttttttttattttcgaggcggtaggagtagcgcggcgcgaggatattttcgggtcgtcggtgtttttgagtttttcggcggcgcgttgttttaggaaagttttcggtttgtcgtttttcgggttgttggaaagtttcggcggttgtagggttttggtagttaggcgttaagcgtcgcgcggggcgggtacggttgcggggtcgggtcgcgttcggttggagtgtttagtgtaagacgttcggacgggtagggtagggttttaaggttacgtataaagagattcgttttcgtcggttcggggtttcggacgtcgtagagcgcgcggataagacgcgggtggggcggagattggtttcgacgttcggtttagattttcgttcggatttcgattttagggataggattttgttcggatcgttgttcggaatgcgttttatatttgtagtttcgtttttagtttcggtttcgattcgaggttttagtttcgggttttatatttcgtttattggtttaggtttatttggagcgtagcgtgggcggtttcgtagcgcggtttcggattttagaagggttttttcgggttcgttggcgcgcggggagcggcgtttttagggcgcggcgcggtgcggcgcggcgcgggtcgtagtttacgcggtcgtaattcggatcggtgcgggggtcgttttttttttttaggtttagcgcgtaattcgagatttcgggttagttttttcgtttttacgcggttcgtgcgtaaagcggatcgggtcggcgacgcgaattttcgtttcgttttatttgatagtaaatttttttattggtcgagagattcggcgcggtacggtaatcggcgtcgattgggcggatgcgcggagatgacggtttgttattgggttttcgggatgttagtttcggcggatgatcggttttttcgcggaggggtcgcggtttcgtatttgttcgaatttttgcggcggcggtggtagggtacgcgggatcgtttttttttagtcgatttacgagaatatttttcgattatttagtttcgagtagggattggtagagtcggcgtttttttttcggattttggtcgcgtagttttcgttattatttttagtttataggtatttttttttagcgtttgttattcgttgt

SEQ ID NO: 3082 - DNA, 1200 bp, Artificial Sequence
  chemically treated genomic DNA (Homo sapiens) CpG-island No: 3082
acaacgaataacaaacgctaaaaaaaaatacctataaactaaaaataataacgaaaactacgcgaccaaaatccgaaaaaaaaacgccgactctaccaatccctactcgaaactaaataatcgaaaaatattctcgtaaatcgactaaaaaaaaacgatcccgcgtaccctaccaccgccgccgcaaaaattcgaacaaatacgaaaccgcgacccctccgcgaaaaaaccgatcatccgccgaaactaacatcccgaaaacccaataacaaaccgtcatctccgcgcatccgcccaatcgacgccgattaccgtaccgcgccgaatctctcgaccaataaaaaaatttactatcaaataaaacgaaacgaaaattcgcgtcgccgacccgatccgctttacgcacgaaccgcgtaaaaacgaaaaaactaacccgaaatctcgaattacgcgctaaacctaaaaaaaaaaaacgacccccgcaccgatccgaattacgaccgcgtaaactacgacccgcgccgcgccgcaccgcgccgcgccctaaaaacgccgctccccgcgcgccaacgaacccgaaaaaacccttctaaaatccgaaaccgcgctacgaaaccgcccacgctacgctccaaataaacctaaaccaataaacgaaatataaaacccgaaactaaaacctcgaatcgaaaccgaaactaaaaacgaaactacaaatataaaacgcattccgaacaacgatccgaacaaaatcctatccctaaaatcgaaatccgaacgaaaatctaaaccgaacgtcgaaaccaatctccgccccacccgcgtcttatccgcgcgctctacgacgtccgaaaccccgaaccgacgaaaacgaatctctttatacgtaaccttaaaaccctaccctacccgtccgaacgtcttacactaaacactccaaccgaacgcgacccgaccccgcaaccgtacccgccccgcgcgacgcttaacgcctaactaccaaaaccctacaaccgccgaaactttccaacaacccgaaaaacgacaaaccgaaaactttcctaaaacaacgcgccgccgaaaaactcaaaaacaccgacgacccgaaaatatcctcgcgccgcgctactcctaccgcctcgaaaataaaaaaaaacgcgccacccgaacccccgacctaaatccccctccccacgccgc

SEQ ID NO: 3083 - DNA, 1200 bp, Artificial Sequence
  chemically treated genomic DNA (Homo sapiens) CpG-island No: 3083
gtagcgagtagtaggcgttgaagaaggatatttgtgaattgggagtggtggcggaggttacgcggttagagttcggggaaggggcgtcggttttgttagtttttgttcggggttggatggtcgggggatgttttcgtaagtcggttgggagggagcggtttcgcgtattttgttatcgtcgtcgtagaggttcgggtaggtgcggggtcgcggttttttcgcgagggggtcggttattcgtcgggattgatatttcggaggtttaatggtaagtcgttattttcgcgtattcgtttaatcggcgtcggttgtcgtgtcgcgtcgggtttttcgattaatgggaaaatttgttgttagatggggcggggcggagattcgcgtcgtcggttcggttcgttttgcgtacgggtcgcgtgagggcgggagggttggttcggggtttcgggttgcgcgttgggtttggagggagggggcggttttcgtatcggttcgagttgcggtcgcgtggattgcgattcgcgtcgcgtcgtatcgcgtcgcgttttgggaacgtcgtttttcgcgcgttaacggattcggggaagtttttttggggttcgaggtcgcgttgcggggtcgtttacgttgcgttttaggtaagtttgagttagtgggcggggtgtgggattcggggttggggtttcgggtcggagtcgggattgggggcggggttgtagatatgggacgtatttcgggtagcggttcggatagggttttatttttggagtcgagattcgggcgagggtttgggtcggacgtcggagttaattttcgttttattcgcgttttgttcgcgcgttttgcggcgttcgagatttcgggtcggcgggggcgggtttttttgtgcgtggttttggggttttattttattcgttcgggcgttttgtattgagtattttagtcgagcgcggttcgatttcgtagtcgtgttcgtttcgcgcgacgtttggcgtttagttgttagggttttgtagtcgtcgaaattttttaatagttcgaggggcggtaggtcgggaatttttttggggtagcgcgtcgtcgggaagtttaggggtatcgacggttcggaggtgttttcgcgtcgcgttgtttttgtcgtttcgggggtgagagagggcgcgttattcggattttcggtttgggtttttttttttacgtcgt

SEQ ID NO: 3084 - DNA, 1200 bp, Artificial Sequence
  chemically treated genomic DNA (Homo sapiens) CpG-island No: 3084
acgacgtaaaaaaaaaaacccaaaccgaaaatccgaataacgcgccctctctcacccccgaaacgacaaaaacaacgcgacgcgaaaacacctccgaaccgtcgatacccctaaacttcccgacgacgcgctaccccaaaaaaattcccgacctaccgcccctcgaactattaaaaaatttcgacgactacaaaaccctaacaactaaacgccaaacgtcgcgcgaaacgaacacgactacgaaatcgaaccgcgctcgactaaaatactcaatacaaaacgcccgaacgaataaaataaaaccccaaaaccacgcacaaaaaaacccgcccccgccgacccgaaatctcgaacgccgcaaaacgcgcgaacaaaacgcgaataaaacgaaaattaactccgacgtccgacccaaaccctcgcccgaatctcgactccaaaaataaaaccctatccgaaccgctacccgaaatacgtcccatatctacaaccccgcccccaatcccgactccgacccgaaaccccaaccccgaatcccacaccccgcccactaactcaaacttacctaaaacgcaacgtaaacgaccccgcaacgcgacctcgaaccccaaaaaaacttccccgaatccgttaacgcgcgaaaaacgacgttcccaaaacgcgacgcgatacgacgcgacgcgaatcgcaatccacgcgaccgcaactcgaaccgatacgaaaaccgccccctccctccaaacccaacgcgcaacccgaaaccccgaaccaaccctcccgccctcacgcgacccgtacgcaaaacgaaccgaaccgacgacgcgaatctccgccccgccccatctaacaacaaattttcccattaatcgaaaaacccgacgcgacacgacaaccgacgccgattaaacgaatacgcgaaaataacgacttaccattaaacctccgaaatatcaatcccgacgaataaccgaccccctcgcgaaaaaaccgcgaccccgcacctacccgaacctctacgacgacgataacaaaatacgcgaaaccgctccctcccaaccgacttacgaaaacatcccccgaccatccaaccccgaacaaaaactaacaaaaccgacgccccttccccgaactctaaccgcgtaacctccgccaccactcccaattcacaaatatccttcttcaacgcctactactcgctac

SEQ ID NO: 3085 - DNA, 1054 bp, Artificial Sequence
  chemically treated genomic DNA (Homo sapiens) CpG-island No: 3085
acggcggcggtggcgggatcgttagtttcgggaagtatagcggttaatgggttttcggcgttttttcgacgtttatagcgtgaggacgtgcgaaaatgcgttttttagcggcggttgtttttcgtcgtttatgtgtttattgtgggcgagggtacgggtagttcggatttatcgtgcggttcgggtcggggtttcgcgggcggcggcggttgttggtgttgtagtggcgcggtggcggcggaggtcgaggtgatgagtagtcgttggaagcggttgggcgggcggtagggtatttttaggtcggtcgttagtttggttttgttggcgttggtgaggcgtttgaggtgtacgagtagttgtggttggtcgcggcggaagtgcgggttgtggaagtgatggagcggtttattgtttgtcggtttgtcgtttttcggttcgtttagtattattttgcggaagtcgtagaggttgagttggcggatgaagttggtgaagttggtggttttgaagagttcgggttcggtttcggttttcgtagtttcgttatcgtttttcggttcgggcgggttgagtagttcggtttcgaagagcggttgatcgataagtagtttttcgtcgcggtcgttttagcggatggagcggtagcgcgggttgtttattaggcgttatagtttggcggggaagttgttggggttgatgggggtggagagtagcgtttttatcgtttcgtcgggtcggggtttcgtttttcgagtttagtttttttatatcgttttcgattttttttcggttttcgtttcgttttgttcgtttttgtcggcgtttattcgtcgcgtattagggatcgttggcgtacgaggtttcgcggcgttttttagcgcggttaatggggtttcgagttttcgttacgcggcgtgggtatttttttttcggcggtcgcgtgttttagttcggttcgtcggacgtttgcgggattcgggtaggagttttttttttaggcgtttttagattttaggtcgggaaggttgtttgtcggggtgttttaagttttgat

SEQ ID NO: 3086 - DNA, 1054 bp, Artificial Sequence
  chemically treated genomic DNA (Homo sapiens) CpG-island No: 3086
atcaaaacttaaaacaccccgacaaacaaccttcccgacctaaaatctaaaaacgcctaaaaaaaaaactcctacccgaatcccgcaaacgtccgacgaaccgaactaaaacacgcgaccgccgaaaaaaaaatacccacgccgcgtaacgaaaactcgaaaccccattaaccgcgctaaaaaacgccgcgaaacctcgtacgccaacgatccctaatacgcgacgaataaacgccgacaaaaacgaacaaaacgaaacgaaaaccgaaaaaaaatcgaaaacgatataaaaaaactaaactcgaaaaacgaaaccccgacccgacgaaacgataaaaacgctactctccacccccatcaaccccaacaacttccccgccaaactataacgcctaataaacaacccgcgctaccgctccatccgctaaaacgaccgcgacgaaaaactacttatcgatcaaccgctcttcgaaaccgaactactcaacccgcccgaaccgaaaaacgataacgaaactacgaaaaccgaaaccgaacccgaactcttcaaaaccaccaacttcaccaacttcatccgccaactcaacctctacgacttccgcaaaataatactaaacgaaccgaaaaacgacaaaccgacaaacaataaaccgctccatcacttccacaacccgcacttccgccgcgaccaaccacaactactcgtacacctcaaacgcctcaccaacgccaacaaaaccaaactaacgaccgacctaaaaataccctaccgcccgcccaaccgcttccaacgactactcatcacctcgacctccgccgccaccgcgccactacaacaccaacaaccgccgccgcccgcgaaaccccgacccgaaccgcacgataaatccgaactacccgtaccctcgcccacaataaacacataaacgacgaaaaacaaccgccgctaaaaaacgcattttcgcacgtcctcacgctataaacgtcgaaaaaacgccgaaaacccattaaccgctatacttcccgaaactaacgatcccgccaccgccgccgt

SEQ ID NO: 3087 - DNA, 1054 bp, Artificial Sequence
  chemically treated genomic DNA (Homo sapiens) CpG-island No: 3087
gttaggatttagaatatttcggtagatagttttttcggtttgaagtttgggaacgtttggggaaggggtttttgttcgggtttcgtaggcgttcggcgggtcgagttggggtacgcggtcgtcgagggggaggtgtttacgtcgcgtggcgggaattcgaggttttattggtcgcgttgggaggcgtcgcggggtttcgtgcgttaacggtttttggtacgcggcggatgggcgtcggtaggagcgggtagggcgaggcgaaggtcggggagggatcgagaacggtgtgggagagttaggttcggggggcgaggtttcggttcggcggggcgatggaggcgttgttttttatttttattaattttaataattttttcgttaagttgtggcgtttggtgaatagttcgcgttatcgttttattcgttgggacggtcgcggcgaggggttgtttatcgattagtcgtttttcgaggtcgagttgtttagttcgttcgggtcggggggcggtggcgggattgcgggggtcggggtcgagttcgagttttttaaaattattagttttattagttttattcgttagtttaatttttacggttttcgtaaggtggtgttgggcgggtcggggggcggtaaatcggtaggtaatgggtcgttttattatttttataattcgtattttcgtcgcgattagttatagttgttcgtgtattttaagcgttttattagcgttaataaggttaagttggcggtcggtttggaggtgttttgtcgttcgtttaatcgtttttagcggttgtttattatttcggttttcgtcgttatcgcgttattgtagtattagtagtcgtcgtcgttcgcggggtttcggttcgagtcgtacggtgagttcggattgttcgtgttttcgtttatagtgggtatatgggcggcggggagtaatcgtcgttggagggcgtattttcgtacgtttttacgttatgggcgtcggaaaggcgtcggggatttattggtcgttgtgtttttcgagattggcggtttcgttatcgtcgtcgt

SEQ ID NO: 3088 - DNA, 1054 bp, Artificial Sequence
  chemically treated genomic DNA (Homo sapiens) CpG-island No: 3088
acgacgacgataacgaaaccgccaatctcgaaaaacacaacgaccaataaatccccgacgcctttccgacgcccataacgtaaaaacgtacgaaaatacgccctccaacgacgattactccccgccgcccatatacccactataaacgaaaacacgaacaatccgaactcaccgtacgactcgaaccgaaaccccgcgaacgacgacgactactaatactacaataacgcgataacgacgaaaaccgaaataataaacaaccgctaaaaacgattaaacgaacgacaaaacacctccaaaccgaccgccaacttaaccttattaacgctaataaaacgcttaaaatacacgaacaactataactaatcgcgacgaaaatacgaattataaaaataataaaacgacccattacctaccgatttaccgccccccgacccgcccaacaccaccttacgaaaaccgtaaaaattaaactaacgaataaaactaataaaactaataattttaaaaaactcgaactcgaccccgacccccgcaatcccgccaccgccccccgacccgaacgaactaaacaactcgacctcgaaaaacgactaatcgataaacaacccctcgccgcgaccgtcccaacgaataaaacgataacgcgaactattcaccaaacgccacaacttaacgaaaaaattattaaaattaataaaaataaaaaacaacgcctccatcgccccgccgaaccgaaacctcgccccccgaacctaactctcccacaccgttctcgatccctccccgaccttcgcctcgccctacccgctcctaccgacgcccatccgccgcgtaccaaaaaccgttaacgcacgaaaccccgcgacgcctcccaacgcgaccaataaaacctcgaattcccgccacgcgacgtaaacacctccccctcgacgaccgcgtaccccaactcgacccgccgaacgcctacgaaacccgaacaaaaaccccttccccaaacgttcccaaacttcaaaccgaaaaaactatctaccgaaatattctaaatcctaac

SEQ ID NO: 3089 - DNA, 515 bp, Artificial Sequence
  chemically treated genomic DNA (Homo sapiens) CpG-island No: 3089
cgacgtatcgtcgttcggtagtagtgttagtttgtgttcggggtcggcgacggcgttttttattttgtatagtcgcggttgcggtgtcgcgggtttttttgtagtcgttcgggagcgatcggttttgcgtattttagttttgtttcgcgttcgttcgtttgtttgtttgttttattatggttgtagttcgggcggggtcggtttcgtttggatagcgttcgagcgattcgcggcggagttgcgcgtcgatttcgtagtatcgtcgttattttttcgttttttcgagtgcggatcgttgcgggaggggttcggcggcgggggcggagcgagtcggtttcggggcggggtttgtattttagttgttagcggtgtcggcgcgaagtgggtcggggtgtttagttgggggtcggtttcgtagttcgcgattttcggatgcgtagagtatgtagagttatttaggatagagcggggagttttagtttttcgttttcgggttgtattggatatttggtttt

SEQ ID NO: 3090 - DNA, 515 bp, Artificial Sequence
  chemically treated genomic DNA (Homo sapiens) CpG-island No: 3090
aaaaccaaatatccaatacaacccgaaaacgaaaaactaaaactccccgctctatcctaaataactctacatactctacgcatccgaaaatcgcgaactacgaaaccgacccccaactaaacaccccgacccacttcgcgccgacaccgctaacaactaaaatacaaaccccgccccgaaaccgactcgctccgcccccgccgccgaacccctcccgcaacgatccgcactcgaaaaaacgaaaaaataacgacgatactacgaaatcgacgcgcaactccgccgcgaatcgctcgaacgctatccaaacgaaaccgaccccgcccgaactacaaccataataaaacaaacaaacaaacgaacgaacgcgaaacaaaactaaaatacgcaaaaccgatcgctcccgaacgactacaaaaaaacccgcgacaccgcaaccgcgactatacaaaataaaaaacgccgtcgccgaccccgaacacaaactaacactactaccgaacgacgatacgtcg

SEQ ID NO: 3091 - DNA, 515 bp, Artificial Sequence
  chemically treated genomic DNA (Homo sapiens) CpG-island No: 3091
agagttaggtgtttagtgtagttcggggacgaggagttgaggtttttcgttttgttttgggtgattttgtatattttgcgtattcgggggtcgcgggttgcgaggtcggtttttagttgggtatttcgatttatttcgcgtcggtatcgttagtagttgaggtataggtttcgtttcggggtcgattcgtttcgttttcgtcgtcgggtttttttcgtagcggttcgtattcggggaggcgggagggtgacggcggtgttgcgaggtcggcgcgtagtttcgtcgcgggtcgttcgggcgttgtttaggcggagtcggtttcgttcgggttgtagttatggtaaggtaggtaggtaggcgggcgggcgcggggtagggttggggtgcgtagggtcggtcgttttcgggcggttgtaaggggattcgcggtatcgtagtcgcggttgtgtagggtgggaggcgtcgtcgtcggtttcgggtataggttggtattgttgtcgggcggcggtgcgtcg

SEQ ID NO: 3092 - DNA, 515 bp, Artificial Sequence
  chemically treated genomic DNA (Homo sapiens) CpG-island No: 3092
cgacgcaccgccgcccgacaacaataccaacctatacccgaaaccgacgacgacgcctcccaccctacacaaccgcgactacgataccgcgaatccccttacaaccgcccgaaaacgaccgaccctacgcaccccaaccctaccccgcgcccgcccgcctacctacctaccttaccataactacaacccgaacgaaaccgactccgcctaaacaacgcccgaacgacccgcgacgaaactacgcgccgacctcgcaacaccgccgtcaccctcccgcctccccgaatacgaaccgctacgaaaaaaacccgacgacgaaaacgaaacgaatcgaccccgaaacgaaacctatacctcaactactaacgataccgacgcgaaataaatcgaaatacccaactaaaaaccgacctcgcaacccgcgacccccgaatacgcaaaatatacaaaatcacccaaaacaaaacgaaaaacctcaactcctcgtccccgaactacactaaacacctaactct

SEQ ID NO: 3093 - DNA, 670 bp, Artificial Sequence
  chemically treated genomic DNA (Homo sapiens) CpG-island No: 3093
tcggaggattttaggggatttcgttttgttttttgtaatttcgggtgttttttcggtcgcgacgatcgggcggggtggggttcgtcgttatttatttattagtttcgtttttcggacgggcgcgtcgttaatgagattagtaatttaaaaattagttagttgcgtcggcggcggaggcgcggggttatttttaagtcgagtcggggtgggacggcgcgtttggcgatcgcgtattgagattgtcgtgtcggattttcgagtcggagtcgagcgcgtcgaggtcggggttatggagaaagcgcggtcgttgtgggttaattcgttatagttcgtgttcgtttgtatttcgtacgtcgtgggtttgggtaacgtgtggcgattttcgtatttgtgttagatgtacggcggaggtgagtgtttatcgcgtttcggttttagtttaattttgtgcgcgttttcgtcgtgtgtgcgagtcggggttagatttaagttatagaacggtatattgaggtcgggaaagcgagcgtgatttgttcgaagttatagattcgggagtgtttttaggatatttcgtttcggagtcggagtttttttttaagtcgtttttttaagttttcgggaatttttcgttttatttcgggggcggttaagtttttaatttttatttttg

SEQ ID NO: 3094 - DNA, 670 bp, Artificial Sequence
  chemically treated genomic DNA (Homo sapiens) CpG-island No: 3094
caaaaataaaaattaaaaacttaaccgcccccgaaataaaacgaaaaattcccgaaaacttaaaaaaacgacttaaaaaaaaactccgactccgaaacgaaatatcctaaaaacactcccgaatctataacttcgaacaaatcacgctcgctttcccgacctcaatataccgttctataacttaaatctaaccccgactcgcacacacgacgaaaacgcgcacaaaattaaactaaaaccgaaacgcgataaacactcacctccgccgtacatctaacacaaatacgaaaatcgccacacgttacccaaacccacgacgtacgaaatacaaacgaacacgaactataacgaattaacccacaacgaccgcgctttctccataaccccgacctcgacgcgctcgactccgactcgaaaatccgacacgacaatctcaatacgcgatcgccaaacgcgccgtcccaccccgactcgacttaaaaataaccccgcgcctccgccgccgacgcaactaactaatttttaaattactaatctcattaacgacgcgcccgtccgaaaaacgaaactaataaataaataacgacgaaccccaccccgcccgatcgtcgcgaccgaaaaaacacccgaaattacaaaaaacaaaacgaaatcccctaaaatcctccga

SEQ ID NO: 3095 - DNA, 670 bp, Artificial Sequence
  chemically treated genomic DNA (Homo sapiens) CpG-island No: 3095
taagggtgagggttgggggtttggtcgttttcgggatggggcgaggggttttcgagggtttgggagggcggtttgggagagagtttcggtttcggaacgaggtgttttgggaatattttcgggtttgtaatttcggataaattacgttcgttttttcggttttagtgtgtcgttttgtaatttgggtttaatttcggttcgtatatacggcggggacgcgtatagagttgggttggggtcggggcgcggtgggtatttattttcgtcgtatatttggtataggtacgggaatcgttatacgttgtttaggtttacggcgtacgagatgtaggcgaatacgaattgtagcgagttggtttatagcggtcgcgttttttttatggtttcggtttcggcgcgttcggtttcggttcgggggttcggtacggtagttttagtgcgcggtcgttaggcgcgtcgttttatttcggttcggtttgggggtggtttcgcgttttcgtcgtcgacgtagttagttggtttttaaattgttaattttattaacggcgcgttcgttcgagaggcgaggttggtaaatggatgacggcgagttttatttcgttcgatcgtcgcggtcgggaaggtattcgagattgtagaggatagggcggagttttttggggtttttcgg

SEQ ID NO: 3096 - DNA, 670 bp, Artificial Sequence
  chemically treated genomic DNA (Homo sapiens) CpG-island No: 3096
ccgaaaaaccccaaaaaactccgccctatcctctacaatctcgaataccttcccgaccgcgacgatcgaacgaaataaaactcgccgtcatccatttaccaacctcgcctctcgaacgaacgcgccgttaataaaattaacaatttaaaaaccaactaactacgtcgacgacgaaaacgcgaaaccacccccaaaccgaaccgaaataaaacgacgcgcctaacgaccgcgcactaaaactaccgtaccgaacccccgaaccgaaaccgaacgcgccgaaaccgaaaccataaaaaaaacgcgaccgctataaaccaactcgctacaattcgtattcgcctacatctcgtacgccgtaaacctaaacaacgtataacgattcccgtacctataccaaatatacgacgaaaataaatacccaccgcgccccgaccccaacccaactctatacgcgtccccgccgtatatacgaaccgaaattaaacccaaattacaaaacgacacactaaaaccgaaaaaacgaacgtaatttatccgaaattacaaacccgaaaatattcccaaaacacctcgttccgaaaccgaaactctctcccaaaccgccctcccaaaccctcgaaaacccctcgccccatcccgaaaacgaccaaacccccaaccctcaccctta

SEQ ID NO: 3097 - DNA, 773 bp, Artificial Sequence
  chemically treated genomic DNA (Homo sapiens) CpG-island No: 3097
aagacgtcgaagattacggtaagcgatagtacgtagagtacggcgatttgcgttattcgcgatatttataggttgcgttcgtcgggcgttagtttcgcggggatttcgtcgttggcggttagcggtgcgttttttggatagtagtttagttacgtgtttagttcgtgggtgcggttttttagggcggtttcggcgtcgtcgtttacgtcgtttattttttttaagtcgttgtggtttaggaaggtcgcgtttatcgtcgcgcggcgtcgggggtttcggcgcgtagtttcgggtgtattgggttgttcgtcggggttcgcgtttttagggacgtttcggatttttcggatcggtttttgcggtacggggaggggacgaaggcgggaggttggttgtttgcgcgttttcgggtcgtttatttttgggtatcgggcgggaagcgatcgttcggaggagcgagtaataggcggcgtaggagttggagtcggagaatttagtgtgtttagcggtcgttcgttgggtttttcgcgcgtttggtcgttttttttttagtaacggttcggtttcgtttcgtcggttttcgcggtattttcgaggggcgggaatttcgtcgcgggcgtagttttttcggagtttcggtgttggagggggtcgggagattcggtagtttttgttcgcgggtcggcgaaattttatttttttttggtattcgttgttcgtttttggttagaaaatttttttaaggtgtttattttaggatttgatatttttag

SEQ ID NO: 3098 - DNA, 773 bp, Artificial Sequence
  chemically treated genomic DNA (Homo sapiens) CpG-island No: 3098
ctaaaaatatcaaatcctaaaataaacaccttaaaaaaattttctaaccaaaaacgaacaacgaataccaaaaaaaaataaaatttcgccgacccgcgaacaaaaactaccgaatctcccgaccccctccaacaccgaaactccgaaaaaactacgcccgcgacgaaattcccgcccctcgaaaataccgcgaaaaccgacgaaacgaaaccgaaccgttactaaaaaaaaaacgaccaaacgcgcgaaaaacccaacgaacgaccgctaaacacactaaattctccgactccaactcctacgccgcctattactcgctcctccgaacgatcgcttcccgcccgatacccaaaaataaacgacccgaaaacgcgcaaacaaccaacctcccgccttcgtcccctccccgtaccgcaaaaaccgatccgaaaaatccgaaacgtccctaaaaacgcgaaccccgacgaacaacccaatacacccgaaactacgcgccgaaacccccgacgccgcgcgacgataaacgcgaccttcctaaaccacaacgacttaaaaaaaataaacgacgtaaacgacgacgccgaaaccgccctaaaaaaccgcacccacgaactaaacacgtaactaaactactatccaaaaaacgcaccgctaaccgccaacgacgaaatccccgcgaaactaacgcccgacgaacgcaacctataaatatcgcgaataacgcaaatcgccgtactctacgtactatcgcttaccgtaatcttcgacgtctt

SEQ ID NO: 3099 - DNA, 773 bp, Artificial Sequence
  chemically treated genomic DNA (Homo sapiens) CpG-island No: 3099
ttaagggtattaaattttggaatgggtattttggagaggttttttagttaagaacggatagcgggtgttaggagggggtggagtttcgtcggttcgcggatagaggttgtcggatttttcgattttttttagtatcgggatttcggggaggttgcgttcgcggcgggattttcgtttttcggagatgtcgcggggatcggcggggcggggtcgggtcgttgttaggggaggggcggttaggcgcgcgaggaatttagcgggcgatcgttaagtatattaggtttttcggttttagtttttgcgtcgtttgttgttcgttttttcgggcggtcgtttttcgttcggtgtttaggggtaggcggttcgagagcgcgtaggtagttagtttttcgttttcgtttttttttcgtatcgtaggagtcggttcgaggggttcggagcgtttttgagagcgcggatttcggcgagtagtttagtgtattcgggattgcgcgtcgagattttcggcgtcgcgcggcgatgaacgcgatttttttgaattatagcggtttggaggaggtggacggcgtgggcggcggcgtcggggtcgttttgggaaatcgtatttacgggttgggtacgtggttgggttgttgtttagggggcgtatcgttggtcgttagcgacggggttttcgcggggttggcgttcgacgagcgtagtttgtgggtgtcgcgggtggcgtagatcgtcgtgttttgcgtgttgtcgtttatcgtggttttcggcgtttt

SEQ ID NO: 3100 - DNA, 773 bp, Artificial Sequence
  chemically treated genomic DNA (Homo sapiens) CpG-island No: 3100
aaaacgccgaaaaccacgataaacgacaacacgcaaaacacgacgatctacgccacccgcgacacccacaaactacgctcgtcgaacgccaaccccgcgaaaaccccgtcgctaacgaccaacgatacgccccctaaacaacaacccaaccacgtacccaacccgtaaatacgatttcccaaaacgaccccgacgccgccgcccacgccgtccacctcctccaaaccgctataattcaaaaaaatcgcgttcatcgccgcgcgacgccgaaaatctcgacgcgcaatcccgaatacactaaactactcgccgaaatccgcgctctcaaaaacgctccgaacccctcgaaccgactcctacgatacgaaaaaaaaacgaaaacgaaaaactaactacctacgcgctctcgaaccgcctacccctaaacaccgaacgaaaaacgaccgcccgaaaaaacgaacaacaaacgacgcaaaaactaaaaccgaaaaacctaatatacttaacgatcgcccgctaaattcctcgcgcgcctaaccgcccctcccctaacaacgacccgaccccgccccgccgatccccgcgacatctccgaaaaacgaaaatcccgccgcgaacgcaacctccccgaaatcccgatactaaaaaaaatcgaaaaatccgacaacctctatccgcgaaccgacgaaactccaccccctcctaacacccgctatccgttcttaactaaaaaacctctccaaaatacccattccaaaatttaatacccttaa

SEQ ID NO: 3101 - DNA, 533 bp, Artificial Sequence
  chemically treated genomic DNA (Homo sapiens) CpG-island No: 3101
cgggcgtttggcggtttttgttgagtgggggtgggattttcgaggaaagggggcggtttttttaagcgtataaggatacgggtcgttttaattcgggacgaagggtttaagcgttacgaggacgtttttattttcgaggggttttaacggaggttttttcgcggcgtcgagtcgaggtttcggcgtgggggtagcgagaggcgcgtttaggaagcgtacggggtagtttcggagttacgtggtcggtttttgcgtttagaaggttcgagtttatttatttagttacgcgtcgcggtcgaaaagggagggtattgcggagattaagtttaaaaggggtttgggcggggcggtattaattaaaaagttgtcggaaggttttttcgggtttagtattcgtttcgttcgcggggttcggaggttttcgcgcgttttttgtcggcggttcgggtttttttcgttttgggtttttttttttattttatacggtttcggtttttatttggtttcggtttttattttgtttcggttttcga

SEQ ID NO: 3102 - DNA, 533 bp, Artificial Sequence
  chemically treated genomic DNA (Homo sapiens) CpG-island No: 3102
tcgaaaaccgaaacaaaataaaaaccgaaaccaaataaaaaccgaaaccgtataaaataaaaaaaaaaacccaaaacgaaaaaaacccgaaccgccgacaaaaaacgcgcgaaaacctccgaaccccgcgaacgaaacgaatactaaacccgaaaaaaccttccgacaactttttaattaataccgccccgcccaaaccccttttaaacttaatctccgcaataccctcccttttcgaccgcgacgcgtaactaaataaataaactcgaaccttctaaacgcaaaaaccgaccacgtaactccgaaactaccccgtacgcttcctaaacgcgcctctcgctacccccacgccgaaacctcgactcgacgccgcgaaaaaacctccgttaaaacccctcgaaaataaaaacgtcctcgtaacgcttaaacccttcgtcccgaattaaaacgacccgtatccttatacgcttaaaaaaaccgccccctttcctcgaaaatcccacccccactcaacaaaaaccgccaaacgcccg

SEQ ID NO: 3103 - DNA, 533 bp, Artificial Sequence
  chemically treated genomic DNA (Homo sapiens) CpG-island No: 3103
tcggaggtcggggtaaagtgggagtcggggttaagtgggagtcggggtcgtgtggggtgggggggggggtttaaggcggggaaggttcgggtcgtcgatagggggcgcgcgagggttttcgggtttcgcgggcggggcgggtgttggattcggaggggtttttcggtaattttttggttggtgtcgtttcgtttaggttttttttaaatttgattttcgtagtgtttttttttttcggtcgcggcgcgtgattgggtaagtgggttcggattttttggacgtaggagtcgattacgtggtttcggggttatttcgtgcgttttttaggcgcgtttttcgttgtttttacgtcgaggtttcggttcggcgtcgcggggaagttttcgttagggtttttcgggggtgggggcgttttcgtggcgtttgggtttttcgtttcgggttaggacggttcgtgtttttgtgcgtttgaaggggtcgtttttttttttcgaggattttatttttatttagtagaagtcgttaggcgttcg

SEQ ID NO: 3104 - DNA, 533 bp, Artificial Sequence
  chemically treated genomic DNA (Homo sapiens) CpG-island No: 3104
cgaacgcctaacgacttctactaaataaaaataaaatcctcgaaaaaaaaaaacgaccccttcaaacgcacaaaaacacgaaccgtcctaacccgaaacgaaaaacccaaacgccacgaaaacgcccccacccccgaaaaaccctaacgaaaacttccccgcgacgccgaaccgaaacctcgacgtaaaaacaacgaaaaacgcgcctaaaaaacgcacgaaataaccccgaaaccacgtaatcgactcctacgtccaaaaaatccgaacccacttacccaatcacgcgccgcgaccgaaaaaaaaaaacactacgaaaatcaaatttaaaaaaaacctaaacgaaacgacaccaaccaaaaaattaccgaaaaacccctccgaatccaacacccgccccgcccgcgaaacccgaaaaccctcgcgcgccccctatcgacgacccgaaccttccccgccttaaacccccccccccaccccacacgaccccgactcccacttaaccccgactcccactttaccccgacctccga

SEQ ID NO: 3105 - DNA, 684 bp, Artificial Sequence
  chemically treated genomic DNA (Homo sapiens) CpG-island No: 3105
taaagcgcgttaattttaattttttttttttttattttttttatcgcggagttcggggcgagtttggggagtagacgtaatagattgtagaatgcgagagcgcggagttcgtttttttcgcgcgcggttcgcggtttatcgtttcggtttgtgcgggtgtttagattttcgtttttcgggttcgtttaagtcggttatttagatgtagtttataggatcgcgggcgtgcgagtcgcggcggtttttcggttcggagttagtttattttttttttcgaggatcgtcgtaggaagcgaggcgacgggcggcgcggtttcgtatcggtttgcgcgttcggggcgaggaaagacgcgatttcggcggattttaatagtttttagttcggtcggttgtagggagagacgggggcggggggcggtttggacgcgattcggaggatttttcggatttttttagattttcgtgggcggatacgattttagattttcgggttcgaatttttttttataattaggagaggattggagcgatattttttttttatttttttttggcgtcgggttcggtttttttagttgagttcgtcggagggttcgggggttggcggtaattcgagttgtagttagagacgttaaattcggagtggcggttgcgagtttagggggtgtgggtgttttttttttt

SEQ ID NO: 3106 - DNA, 684 bp, Artificial Sequence
  chemically treated genomic DNA (Homo sapiens) CpG-island No: 3106
aaaaaaaaaaacacccacaccccctaaactcgcaaccgccactccgaatttaacgtctctaactacaactcgaattaccgccaacccccgaaccctccgacgaactcaactaaaaaaaccgaacccgacgccaaaaaaaaataaaaaaaaaatatcgctccaatcctctcctaattataaaaaaaaattcgaacccgaaaatctaaaatcgtatccgcccacgaaaatctaaaaaaatccgaaaaatcctccgaatcgcgtccaaaccgccccccgcccccgtctctccctacaaccgaccgaactaaaaactattaaaatccgccgaaatcgcgtctttcctcgccccgaacgcgcaaaccgatacgaaaccgcgccgcccgtcgcctcgcttcctacgacgatcctcgaaaaaaaaaataaactaactccgaaccgaaaaaccgccgcgactcgcacgcccgcgatcctataaactacatctaaataaccgacttaaacgaacccgaaaaacgaaaatctaaacacccgcacaaaccgaaacgataaaccgcgaaccgcgcgcgaaaaaaacgaactccgcgctctcgcattctacaatctattacgtctactccccaaactcgccccgaactccgcgataaaaaaaataaaaaaaaaaaaaattaaaattaacgcgcttta

SEQ ID NO: 3107 - DNA, 684 bp, Artificial Sequence
  chemically treated genomic DNA (Homo sapiens) CpG-island No: 3107
ggggagaggagtatttatattttttggattcgtagtcgttatttcgggtttggcgtttttggttgtagttcgagttatcgttagttttcgagtttttcggcgagtttagttgaggggatcgagttcggcgttagaaaagggtggggggagggtgtcgttttagtttttttttggttataaagaagggttcgaattcgaaggtttggggtcgtgttcgtttacggaaatttagagggattcgagggatttttcggatcgcgtttaggtcgtttttcgttttcgtttttttttgtagtcggtcgggttgggggttgttgggattcgtcgggatcgcgttttttttcgtttcgggcgcgtaggtcggtgcggggtcgcgtcgttcgtcgtttcgttttttgcggcggttttcgggaagggaagtggattgatttcgggtcggggagtcgtcgcggttcgtacgttcgcggttttgtgagttgtatttaaatggtcggtttaggcgagttcggagggcgggggtttgggtattcgtataggtcggggcggtgggtcgcgggtcgcgcgcggagggagcgggtttcgcgttttcgtattttgtaatttgttgcgtttgttttttaggttcgtttcgggtttcgcggtaaagggggtgggagaaggagggattgaggttggcgcgttttg

SEQ ID NO: 3108 - DNA, 684 bp, Artificial Sequence
  chemically treated genomic DNA (Homo sapiens) CpG-island No: 3108
caaaacgcgccaacctcaatccctccttctcccaccccctttaccgcgaaacccgaaacgaacctaaaaaacaaacgcaacaaattacaaaatacgaaaacgcgaaacccgctccctccgcgcgcgacccgcgacccaccgccccgacctatacgaatacccaaacccccgccctccgaactcgcctaaaccgaccatttaaatacaactcacaaaaccgcgaacgtacgaaccgcgacgactccccgacccgaaatcaatccacttcccttcccgaaaaccgccgcaaaaaacgaaacgacgaacgacgcgaccccgcaccgacctacgcgcccgaaacgaaaaaaaacgcgatcccgacgaatcccaacaacccccaacccgaccgactacaaaaaaaaacgaaaacgaaaaacgacctaaacgcgatccgaaaaatccctcgaatccctctaaatttccgtaaacgaacacgaccccaaaccttcgaattcgaacccttctttataaccaaaaaaaaactaaaacgacaccctccccccacccttttctaacgccgaactcgatcccctcaactaaactcgccgaaaaactcgaaaactaacgataactcgaactacaaccaaaaacgccaaacccgaaataacgactacgaatccaaaaaatataaatactcctctcccc

SEQ ID NO: 3109 - DNA, 607 bp, Artificial Sequence
  chemically treated genomic DNA (Homo sapiens) CpG-island No: 3109
tagtcgtcgtcgtcgtcgtcgttttttcggcgttcgcgtcggttgtttcgtcgtaaatgattcgagagagatatatatattcgcgttcgttcgtttttttttttcgttcgggatttagcgtttattcgggtagaagcgggcgtcgagtttggcgcgtttatttttattttttttagatttttcgtggttacgtggttttcgagcgcgcggtttatagttcgcgcgttacggagatttttcgatttttagtttttttttttttgtttacgtgtttatttcgtatttttagtttggcggcgcgcgcggttttttaatgagattcgggttaagggtcgatttcgcgatttcgttcgtttttattttatgtttgattttttttttttaacgtcggttagcgttgggattcgaatggggtcggttagttgcggcgggaggagtttttattttttttagttgcgtttttttagggtagacgttatcgtagttattgatgtttttttttaaaggatgtacgttttttatcgggcgtcggaggtgttttgtagtcgtttttttagaggcgcgggtagggggtattttatttttatttttagagttcgttgggtat

SEQ ID NO: 3110 - DNA, 607 bp, Artificial Sequence
  chemically treated genomic DNA (Homo sapiens) CpG-island No: 3110
atacccaacgaactctaaaaataaaaataaaataccccctacccgcgcctctaaaaaaacgactacaaaacacctccgacgcccgataaaaaacgtacatcctttaaaaaaaaacatcaataactacgataacgtctaccctaaaaaaacgcaactaaaaaaaataaaaactcctcccgccgcaactaaccgaccccattcgaatcccaacgctaaccgacgttaaaaaaaaaaaatcaaacataaaataaaaacgaacgaaatcgcgaaatcgacccttaacccgaatctcattaaaaaaccgcgcgcgccgccaaactaaaaatacgaaataaacacgtaaacaaaaaaaaaaaaactaaaaatcgaaaaatctccgtaacgcgcgaactataaaccgcgcgctcgaaaaccacgtaaccacgaaaaatctaaaaaaaataaaaataaacgcgccaaactcgacgcccgcttctacccgaataaacgctaaatcccgaacgaaaaaaaaaaacgaacgaacgcgaatatatatatctctctcgaatcatttacgacgaaacaaccgacgcgaacgccgaaaaaacgacgacgacgacgacgacta

SEQ ID NO: 3111 - DNA, 607 bp, Artificial Sequence
  chemically treated genomic DNA (Homo sapiens) CpG-island No: 3111
gtgtttagcgaattttgggggtgggggtagggtgttttttattcgcgtttttggaagagcggttgtaaaatattttcggcgttcggtggggagcgtgtattttttgaaaagggatattagtgattgcggtggcgtttattttggagaaacgtagttgagggaggtggaggtttttttcgtcgtagttggtcggttttattcgggttttagcgttagtcggcgttgggaaggaaaaattaaatataaaataggggcgagcggaatcgcgaggtcggtttttggttcgagttttattaaggagtcgcgcgcgtcgttaggttaggaatgcggaatggatacgtggatagaggagggggagttaggagtcggggagttttcgtggcgcgcgagttgtgggtcgcgcgttcgggggttacgtgattacggggaatttgggaggggtgggagtgagcgcgttaagttcggcgttcgtttttgttcgggtgggcgttgaatttcggacggaggaggagggcgggcgagcgcgagtgtgtgtgtttttttcgagttatttacggcggagtagtcggcgcgagcgtcgaggaggcggcgacggcggcggcggttg

SEQ ID NO: 3112 - DNA, 607 bp, Artificial Sequence
  chemically treated genomic DNA (Homo sapiens) CpG-island No: 3112
caaccgccgccgccgtcgccgcctcctcgacgctcgcgccgactactccgccgtaaataactcgaaaaaaacacacacactcgcgctcgcccgccctcctcctccgtccgaaattcaacgcccacccgaacaaaaacgaacgccgaacttaacgcgctcactcccacccctcccaaattccccgtaatcacgtaacccccgaacgcgcgacccacaactcgcgcgccacgaaaactccccgactcctaactccccctcctctatccacgtatccattccgcattcctaacctaacgacgcgcgcgactccttaataaaactcgaaccaaaaaccgacctcgcgattccgctcgcccctattttatatttaatttttccttcccaacgccgactaacgctaaaacccgaataaaaccgaccaactacgacgaaaaaaacctccacctccctcaactacgtttctccaaaataaacgccaccgcaatcactaatatcccttttcaaaaaatacacgctccccaccgaacgccgaaaatattttacaaccgctcttccaaaaacgcgaataaaaaacaccctacccccacccccaaaattcgctaaacac

SEQ ID NO: 3113 - DNA, 613 bp, Artificial Sequence
  chemically treated genomic DNA (Homo sapiens) CpG-island No: 3113
tttcgtgtataagtagggtacgagtcgtattcgtcgcggtgattagagtttgtggattcgttcgcgggatatcgtttgtaagtgttttaaaattaagttttttaagaagtatttgttgttgggtaacgcggaggatttttcggattagagcggtatcgtggtcgataaaagtagtttggtgatttagtggcgggatacgtgggcgcggcggttgcgtaagttttagtagcgtgagaagaagggtaagtgtaagaaggtttagcgtcgaggtagcgggcgggcgggcgggcgggcgttagggcggggtcgagcgagagcgggcgttttggttcggtcgtcgcggatttggttcgcgagggtttttttaggtggggggagggagggggcggggtcgtacggcgcggggggcgggattttcggcggtttttttttttatttttattttgcgcgttttgggcgggagtcgcgtgtacgcggggcggggtgcgtcgtcggtcgggttttggagaaatgacgagacgtagttattttacggggttttttttagagtagagacgcgtttttttgggtttgggcgcggtcgtcgtggaggggttgggggtagtttgttttg

SEQ ID NO: 3114 - DNA, 613 bp, Artificial Sequence
  chemically treated genomic DNA (Homo sapiens) CpG-island No: 3114
caaaacaaactacccccaacccctccacgacgaccgcgcccaaacccaaaaaaacgcgtctctactctaaaaaaaaccccgtaaaataactacgtctcgtcatttctccaaaacccgaccgacgacgcaccccgccccgcgtacacgcgactcccgcccaaaacgcgcaaaataaaaataaaaaaaaaaaccgccgaaaatcccgccccccgcgccgtacgaccccgccccctccctccccccacctaaaaaaaccctcgcgaaccaaatccgcgacgaccgaaccaaaacgcccgctctcgctcgaccccgccctaacgcccgcccgcccgcccgcccgctacctcgacgctaaaccttcttacacttacccttcttctcacgctactaaaacttacgcaaccgccgcgcccacgtatcccgccactaaatcaccaaactacttttatcgaccacgataccgctctaatccgaaaaatcctccgcgttacccaacaacaaatacttcttaaaaaacttaattttaaaacacttacaaacgatatcccgcgaacgaatccacaaactctaatcaccgcgacgaatacgactcgtaccctacttatacacgaaa

SEQ ID NO: 3115 - DNA, 613 bp, Artificial Sequence
  chemically treated genomic DNA (Homo sapiens) CpG-island No: 3115
tagggtaggttgtttttagtttttttacggcggtcgcgtttaggtttagggaagcgcgtttttgttttggaaggagtttcgtgaggtagttacgtttcgttatttttttagggttcggtcggcggcgtatttcgtttcgcgtgtacgcggttttcgtttagagcgcgtagggtgggggtagggggaggggtcgtcgagggtttcgtttttcgcgtcgtgcggtttcgttttttttttttttttatttgggaaagttttcgcgggttaagttcgcggcggtcgggttaaggcgttcgttttcgttcggtttcgttttggcgttcgttcgttcgttcgttcgttgtttcggcgttaggtttttttgtatttgtttttttttttacgttgttggaatttgcgtagtcgtcgcgtttacgtgtttcgttattggattattaggttgtttttatcggttacgatgtcgttttggttcggagagtttttcgcgttgtttagtagtaggtattttttgaggggtttgattttgggatatttgtaggcgatgtttcgcgagcggatttataggttttggttatcgcggcggatgcggttcgtgttttgtttatatacggag

SEQ ID NO: 3116 - DNA, 613 bp, Artificial Sequence
  chemically treated genomic DNA (Homo sapiens) CpG-island No: 3116
ctccgtatataaacaaaacacgaaccgcatccgccgcgataaccaaaacctataaatccgctcgcgaaacatcgcctacaaatatcccaaaatcaaacccctcaaaaaatacctactactaaacaacgcgaaaaactctccgaaccaaaacgacatcgtaaccgataaaaacaacctaataatccaataacgaaacacgtaaacgcgacgactacgcaaattccaacaacgtaaaaaaaaaaacaaatacaaaaaaacctaacgccgaaacaacgaacgaacgaacgaacgaacgccaaaacgaaaccgaacgaaaacgaacgccttaacccgaccgccgcgaacttaacccgcgaaaactttcccaaataaaaaaaaaaaaaaaacgaaaccgcacgacgcgaaaaacgaaaccctcgacgacccctccccctacccccaccctacgcgctctaaacgaaaaccgcgtacacgcgaaacgaaatacgccgccgaccgaaccctaaaaaaataacgaaacgtaactacctcacgaaactccttccaaaacaaaaacgcgcttccctaaacctaaacgcgaccgccgtaaaaaaactaaaaacaacctacccta

SEQ ID NO: 3117 - DNA, 782 bp, Artificial Sequence
  chemically treated genomic DNA (Homo sapiens) CpG-island No: 3117
cgcgggggaagtcggcgcgggcgtattttttaggtagtttttcgttaggtacgggtaggaagttgaggttcggggggaaggtgcgtagtaggtcgaggatgtagtggcgttcgtcgttgttaatgatgtttttgtattcgatcgaggagtagagttttattttttcgttacggtcgttgagtatttggtgtcgtaggattttgaggggtcgattcgtgcgttttagtagttttaggtatcgcgggtgtgatattacggttttgtcgaagtcgatggagtcgtagatgacgttttgtttttggtttcgttttaggatgtcggggatgatggattgggtcgtgattcggtagtcgcggtaatttattattatcgtgtttagcgtgtatagtttttttacgtttatcgcgttgtacgtgcggacgttatttaggtcgttggtgggcgttacgtaggtcgttacgtttttttcgaagtttttgtagtggtttcggacgtcgaagtttaggttgaagaagatgttgttttagatgaatatttgtattttggttttttcgttggggttgatggttattacgttgtcgttaatgacggttatggcgtttttggtggttgtcgcggtgaagtcgttgtgtatttggcgggggtcgaggagggtagggttagaggtcgcgtttataagagtttgtatttatttggttaagcgtacgtatttagatcgcggaggtaatcgggtttgttttggaaatttaaggattcggagttttagtttttttatatgtaga

SEQ ID NO: 3118 - DNA, 782 bp, Artificial Sequence
  chemically treated genomic DNA (Homo sapiens) CpG-island No: 3118
tctacatataaaaaaactaaaactccgaatccttaaatttccaaaacaaacccgattacctccgcgatctaaatacgtacgcttaaccaaataaatacaaactcttataaacgcgacctctaaccctaccctcctcgacccccgccaaatacacaacgacttcaccgcgacaaccaccaaaaacgccataaccgtcattaacgacaacgtaataaccatcaaccccaacgaaaaaaccaaaatacaaatattcatctaaaacaacatcttcttcaacctaaacttcgacgtccgaaaccactacaaaaacttcgaaaaaaacgtaacgacctacgtaacgcccaccaacgacctaaataacgtccgcacgtacaacgcgataaacgtaaaaaaactatacacgctaaacacgataataataaattaccgcgactaccgaatcacgacccaatccatcatccccgacatcctaaaacgaaaccaaaaacaaaacgtcatctacgactccatcgacttcgacaaaaccgtaatatcacacccgcgatacctaaaactactaaaacgcacgaatcgacccctcaaaatcctacgacaccaaatactcaacgaccgtaacgaaaaaataaaactctactcctcgatcgaatacaaaaacatcattaacaacgacgaacgccactacatcctcgacctactacgcaccttccccccgaacctcaacttcctacccgtacctaacgaaaaactacctaaaaaatacgcccgcgccgacttcccccgcg

SEQ ID NO: 3119 - DNA, 782 bp, Artificial Sequence
  chemically treated genomic DNA (Homo sapiens) CpG-island No: 3119
tttatatatgaggaaattgaggtttcgggtttttgggtttttaaggtaggttcggttgttttcgcggtttaggtgcgtgcgtttggttaggtggatgtaggtttttgtgggcgcggtttttaattttgtttttttcgattttcgttaggtgtatagcgattttatcgcggtagttattaggggcgttatggtcgttattgacggtaacgtgatggttattaattttagcgaggagattaagatgtagatgtttatttggaataatattttttttagtttgggtttcgacgttcgagattattataaggatttcgggggggacgtggcggtttacgtggcgtttattaacgatttgaatggcgttcgtacgtataacgcggtggacgtggaggggttgtatacgttgggtacggtggtggtggattatcgcggttatcgggttacggtttagtttattattttcggtattttggagcgggattaggagtagagcgttatttacggttttatcgatttcggtaagatcgtggtgttatattcgcggtatttggagttgttggagcgtacgagtcggttttttaagattttgcggtattaggtgtttaacgatcgtgacgaggaggtggagttttgtttttcggtcgagtgtaagggtattattggtaacgacgggcgttattatattttcgatttgttgcgtatttttttttcggattttaattttttgttcgtgtttggcgaggagttgtttgaggaatgcgttcgcgtcggtttttttcgcg

SEQ ID NO: 3120 - DNA, 782 bp, Artificial Sequence
  chemically treated genomic DNA (Homo sapiens) CpG-island No: 3120
cgcgaaaaaaaccgacgcgaacgcattcctcaaacaactcctcgccaaacacgaacaaaaaattaaaatccgaaaaaaaaatacgcaacaaatcgaaaatataataacgcccgtcgttaccaataatacccttacactcgaccgaaaaacaaaactccacctcctcgtcacgatcgttaaacacctaataccgcaaaatcttaaaaaaccgactcgtacgctccaacaactccaaataccgcgaatataacaccacgatcttaccgaaatcgataaaaccgtaaataacgctctactcctaatcccgctccaaaataccgaaaataataaactaaaccgtaacccgataaccgcgataatccaccaccaccgtacccaacgtatacaacccctccacgtccaccgcgttatacgtacgaacgccattcaaatcgttaataaacgccacgtaaaccgccacgtcccccccgaaatccttataataatctcgaacgtcgaaacccaaactaaaaaaaatattattccaaataaacatctacatcttaatctcctcgctaaaattaataaccatcacgttaccgtcaataacgaccataacgcccctaataactaccgcgataaaatcgctatacacctaacgaaaatcgaaaaaaacaaaattaaaaaccgcgcccacaaaaacctacatccacctaaccaaacgcacgcacctaaaccgcgaaaacaaccgaacctaccttaaaaacccaaaaacccgaaacctcaatttcctcatatataaa

SEQ ID NO: 3121 - DNA, 882 bp, Artificial Sequence
  chemically treated genomic DNA (Homo sapiens) CpG-island No: 3121
tcgtaaacgtcggagcgattttagtttagagagtttttatgttcgggcgtagagggggtggggtcgtcgattttttcggtttgcggcggcggcgtatttcgaaatcgcgtgtgcgcgtacgtgttttcgcgatgaggcgcgcgtgtgttcgtcgagggtgttagtcgaggttgttttttacgggatcgtacgtgcgaaattcgggtcgtagtcgggggcgattgtgaaggtgatttttagcgcgggggcgattcggtgaaggttttagcgagatataatcgggttcgacgcggagggaaggcggcgattttcgcggagtttcgaattcgttcgttttggttcggcgtttttcgtttagcggttcgttggttttggtttcgtttatcggtcgcgttcggtcgttttttgttttcggtttgcgagtcgtgttttcgggcgttgtcggtcggggcggtcgtcggtaattcgttcgttttgataattatggtggcgggagcgggcgttcgtttcggttgttcgcgtcgttcgtcgcgttattaatttaagtgttttgcgcgtcgcggttgttgagggaaggacggagttatcggtttacgtggtgcgcgtcgtggtttttgatttcgtcgtcgtttttttgttttattttcgcgttcggtttagtttacggcggttcgcgagggataaaacgcgtcgcgtttggtttttcgtttacggacgcggtgattttttagaacgttttaaaggtaacgtattttgatttaaggtttagggaggttgggcgttttcgcggggcggggtttcggggagattttttgttgttcgttgttcgtcgggcgggtattgtgattttgggtggagattggtttggttttgttatggtta

SEQ ID NO: 3122 - DNA, 882 bp, Artificial Sequence
  chemically treated genomic DNA (Homo sapiens) CpG-island No: 3122
taaccataacaaaaccaaaccaatctccacccaaaatcacaatacccgcccgacgaacaacgaacaacaaaaaatctccccgaaaccccgccccgcgaaaacgcccaacctccctaaaccttaaatcaaaatacgttacctttaaaacgttctaaaaaatcaccgcgtccgtaaacgaaaaaccaaacgcgacgcgttttatccctcgcgaaccgccgtaaactaaaccgaacgcgaaaataaaacaaaaaaacgacgacgaaatcaaaaaccacgacgcgcaccacgtaaaccgataactccgtccttccctcaacaaccgcgacgcgcaaaacacttaaattaataacgcgacgaacgacgcgaacaaccgaaacgaacgcccgctcccgccaccataattatcaaaacgaacgaattaccgacgaccgccccgaccgacaacgcccgaaaacacgactcgcaaaccgaaaacaaaaaacgaccgaacgcgaccgataaacgaaaccaaaaccaacgaaccgctaaacgaaaaacgccgaaccaaaacgaacgaattcgaaactccgcgaaaatcgccgccttccctccgcgtcgaacccgattatatctcgctaaaaccttcaccgaatcgcccccgcgctaaaaatcaccttcacaatcgcccccgactacgacccgaatttcgcacgtacgatcccgtaaaaaacaacctcgactaacaccctcgacgaacacacgcgcgcctcatcgcgaaaacacgtacgcgcacacgcgatttcgaaatacgccgccgccgcaaaccgaaaaaatcgacgaccccaccccctctacgcccgaacataaaaactctctaaactaaaatcgctccgacgtttacga

SEQ ID NO: 3123 - DNA, 882 bp, Artificial Sequence
  chemically treated genomic DNA (Homo sapiens) CpG-island No: 3123
tagttatggtagaattagattagtttttatttaaggttatagtgttcgttcgacgggtagcgagtagtagggagttttttcgaggtttcgtttcgcgagggcgtttagtttttttgggttttgagttagagtgcgttgtttttaagacgttttggaaagttatcgcgttcgtgggcggggaattaggcgcggcgcgttttgtttttcgcgggtcgtcgtgggttgggtcgggcgcgagggtggggtagggaaacggcggcggggttaaaggttacggcgcgtattacgtgggtcggtgatttcgttttttttttagtagtcgcggcgcgtagggtatttgggttagtggcgcggcgggcggcgcggatagtcgaggcggacgttcgttttcgttattatggttattaagacggacgagttgtcggcggtcgtttcggtcgatagcgttcgggaatacggttcgtaggtcgggggtaaggggcggtcgggcgcggtcggtgagcggggttagggttagcgggtcgttgggcggggggcgtcggattagggcgggcgggttcgggatttcgcggggatcgtcgtttttttttcgcgtcgggttcggttgtatttcgttggggtttttatcgggtcgttttcgcgttgaaggttatttttatagtcgttttcggttgcggttcgggtttcgtacgtgcggtttcgtggagggtagtttcggttggtattttcggcgggtatacgcgcgttttatcgcggggatacgtgcgcgtatacgcggtttcggggtgcgtcgtcgtcgtagatcgaaagaatcggcggttttattttttttgcgttcgagtatgggagttttttgagttggggtcgtttcgacgtttgcgg

SEQ ID NO: 3124 - DNA, 882 bp, Artificial Sequence
  chemically treated genomic DNA (Homo sapiens) CpG-island No: 3124
ccgcaaacgtcgaaacgaccccaactcaaaaaactcccatactcgaacgcaaaaaaaataaaaccgccgattctttcgatctacgacgacgacgcaccccgaaaccgcgtatacgcgcacgtatccccgcgataaaacgcgcgtatacccgccgaaaataccaaccgaaactaccctccacgaaaccgcacgtacgaaacccgaaccgcaaccgaaaacgactataaaaataaccttcaacgcgaaaacgacccgataaaaaccccaacgaaatacaaccgaacccgacgcgaaaaaaaaacgacgatccccgcgaaatcccgaacccgcccgccctaatccgacgccccccgcccaacgacccgctaaccctaaccccgctcaccgaccgcgcccgaccgccccttacccccgacctacgaaccgtattcccgaacgctatcgaccgaaacgaccgccgacaactcgtccgtcttaataaccataataacgaaaacgaacgtccgcctcgactatccgcgccgcccgccgcgccactaacccaaataccctacgcgccgcgactactaaaaaaaaaacgaaatcaccgacccacgtaatacgcgccgtaacctttaaccccgccgccgtttccctaccccaccctcgcgcccgacccaacccacgacgacccgcgaaaaacaaaacgcgccgcgcctaattccccgcccacgaacgcgataactttccaaaacgtcttaaaaacaacgcactctaactcaaaacccaaaaaaactaaacgccctcgcgaaacgaaacctcgaaaaaactccctactactcgctacccgtcgaacgaacactataaccttaaataaaaactaatctaattctaccataacta

SEQ ID NO: 3125 - DNA, 886 bp, Artificial Sequence
  chemically treated genomic DNA (Homo sapiens) CpG-island No: 3125
ttcgttcggtttcgcggaggaattttcgcgcgaggagagggttcgaagttttggaaacgtcgggaagtataaaaggttggcggttcggggatttggggggagtcggggtcgtttcgtttcgttttttggaggaggggcggttgtttttcgattcgggatttgtttgcggggatcgagttgcgtttttggtcggtttttttcgttcgtttcgcgttatttcggttagtttggcgtttatttcgggttttcgggcgcgttgggttggttgggcgcgggttgcgggtcggttcggttcgggggtttttggggaggcggttggcgcgggttgcgggcgttgggtcgtagcggtttgcgtgtatagaggaagagcgcggggtcgggtatggggtcggcgtcgtcgagggcgtcggtttcgcggttttaggcggtttagtttcggtcggggtttttggcggcggtttcgtgggtagtaggcgggcggcgggttcgtagtgcgcggcggcgtggtttgggttcggcggtggcgtcggggttcgggcgcggggtttgtagtttttggcgcgtcgcgtgtagttggtaggagaggtaggcggtcgtttcggtgtgtttttgtagttcggtgtttagtacggtggcgcggtggttgcggcggcgtagtttttttaggaagcggcgtttttcggtgcgtaggttgtagcgtagcgcggatattagcgtttcgcgttgcgttatttttcgtcgtagtttcgcgttggtcgtagtacgcgtttttagttgcgattttagcgcgcggtatttgttttttagttttcgggacgtcgtttttggaacggggtagaggttagaggtgacggtttttttttggtttggaatagaatttgtacgg

SEQ ID NO: 3126 - DNA, 886 bp, Artificial Sequence
  chemically treated genomic DNA (Homo sapiens) CpG-island No: 3126
ccgtacaaattctattccaaaccaaaaaaaaaccgtcacctctaacctctaccccgttccaaaaacgacgtcccgaaaactaaaaaacaaataccgcgcgctaaaatcgcaactaaaaacgcgtactacgaccaacgcgaaactacgacgaaaaataacgcaacgcgaaacgctaatatccgcgctacgctacaacctacgcaccgaaaaacgccgcttcctaaaaaaactacgccgccgcaaccaccgcgccaccgtactaaacaccgaactacaaaaacacaccgaaacgaccgcctacctctcctaccaactacacgcgacgcgccaaaaactacaaaccccgcgcccgaaccccgacgccaccgccgaacccaaaccacgccgccgcgcactacgaacccgccgcccgcctactacccacgaaaccgccgccaaaaaccccgaccgaaactaaaccgcctaaaaccgcgaaaccgacgccctcgacgacgccgaccccatacccgaccccgcgctcttcctctatacacgcaaaccgctacgacccaacgcccgcaacccgcgccaaccgcctccccaaaaacccccgaaccgaaccgacccgcaacccgcgcccaaccaacccaacgcgcccgaaaacccgaaataaacgccaaactaaccgaaataacgcgaaacgaacgaaaaaaaccgaccaaaaacgcaactcgatccccgcaaacaaatcccgaatcgaaaaacaaccgcccctcctccaaaaaacgaaacgaaacgaccccgactccccccaaatccccgaaccgccaaccttttatacttcccgacgtttccaaaacttcgaaccctctcctcgcgcgaaaattcctccgcgaaaccgaacgaa

SEQ ID NO: 3127 - DNA, 886 bp, Artificial Sequence
  chemically treated genomic DNA (Homo sapiens) CpG-island No: 3127
tcgtgtaggttttgttttaagttagggggagatcgttatttttggtttttgtttcgttttagaggcggcgtttcgggagttggagagtaagtgtcgcgcgttggagtcgtagttggaggcgcgtgttgcggttaacgcggagttgcggcgggaggtggcgtagcgcgaggcgttggtgttcgcgttgcgttgtagtttgcgtatcgaggagcgtcgttttttggaggagttgcgtcgtcgtagttatcgcgttatcgtgttgggtatcgagttgtagaagtatatcgaggcggtcgtttattttttttgttagttgtacgcggcgcgttagagattgtaggtttcgcgttcgggtttcggcgttatcgtcgagtttaggttacgtcgtcgcgtattgcgagttcgtcgttcgtttgttgtttacgaggtcgtcgttaagggtttcggtcgggattgggtcgtttgggatcgcggggtcggcgttttcgacgacgtcgattttatgttcgatttcgcgttttttttttatgtacgtaggtcgttgcggtttagcgttcgtagttcgcgttagtcgtttttttaggagttttcggatcgagtcggttcgtagttcgcgtttagttagtttagcgcgttcggggattcggagtaggcgttaggttggtcggggtgacgcgggacggacggggagggtcggttagggacgtagttcggttttcgtaggtaggtttcgggtcggagggtagtcgttttttttttaggaagcggggcgaggcggtttcggttttttttaaattttcgaatcgttagttttttgtatttttcgacgtttttaaagtttcgagtttttttttcgcgcgagagttttttcgcggggtcgagcggg

SEQ ID NO: 3128 - DNA, 886 bp, Artificial Sequence
  chemically treated genomic DNA (Homo sapiens) CpG-island No: 3128
cccgctcgaccccgcgaaaaaactctcgcgcgaaaaaaaaactcgaaactttaaaaacgtcgaaaaatacaaaaaactaacgattcgaaaatttaaaaaaaaccgaaaccgcctcgccccgcttcctaaaaaaaaaacgactaccctccgacccgaaacctacctacgaaaaccgaactacgtccctaaccgaccctccccgtccgtcccgcgtcaccccgaccaacctaacgcctactccgaatccccgaacgcgctaaactaactaaacgcgaactacgaaccgactcgatccgaaaactcctaaaaaaacgactaacgcgaactacgaacgctaaaccgcaacgacctacgtacataaaaaaaaaacgcgaaatcgaacataaaatcgacgtcgtcgaaaacgccgaccccgcgatcccaaacgacccaatcccgaccgaaacccttaacgacgacctcgtaaacaacaaacgaacgacgaactcgcaatacgcgacgacgtaacctaaactcgacgataacgccgaaacccgaacgcgaaacctacaatctctaacgcgccgcgtacaactaacaaaaaaaataaacgaccgcctcgatatacttctacaactcgatacccaacacgataacgcgataactacgacgacgcaactcctccaaaaaacgacgctcctcgatacgcaaactacaacgcaacgcgaacaccaacgcctcgcgctacgccacctcccgccgcaactccgcgttaaccgcaacacgcgcctccaactacgactccaacgcgcgacacttactctccaactcccgaaacgccgcctctaaaacgaaacaaaaaccaaaaataacgatctccccctaacttaaaacaaaacctacacga

SEQ ID NO: 3129 - DNA, 707 bp, Artificial Sequence
  chemically treated genomic DNA (Homo sapiens) CpG-island No: 3129
gcgtggcgggaggtggcggggttcgatttcgggtcgttttggacgttcggtagtgttaggtagggttcgggtttgggcggtggaggataatttttgttagtagttcgtcgcgagttttgttcgtttttcgcgcgttgcggtgtttagtttcgcgttagttttttcgggggagttggagtttggtcgcgttgtttttttttggggtcgtttcggcgtttatattttttacgtttatcgatcggtttttttattttcgggatttgggagttatcggtcggcggggttttgggttcgggtcgggttgggtgggggcggcgtttttttttttacgttagttgcgttcggggatttgtagcgttcgtttcggttgcggcgttattagttgttgggaggttgcggggtagtcgggtcggggtttcggggggttcgggggcgtcgaaggggggtcgggggcgggttcgaggcgtaaatatttagtaacgtgatcggaattggcgaacgagtcggaggggtgcggggggcgggagagagaaagggggaggggagggatttgagacgggcggggaggggtcgtgggcggggcggggggaggggaggtcggcggcgcgcggtcggggggagggggaatttcgggagtttcgagagtttcgggaatcgggtttgaggtttttagcgggtcgttgggttcgcggagttggttttggttg

SEQ ID NO: 3130 - DNA, 707 bp, Artificial Sequence
  chemically treated genomic DNA (Homo sapiens) CpG-island No: 3130
caaccaaaaccaactccgcgaacccaacgacccgctaaaaacctcaaacccgattcccgaaactctcgaaactcccgaaattccccctccccccgaccgcgcgccgccgacctcccctccccccgccccgcccacgacccctccccgcccgtctcaaatccctcccctccccctttctctctcccgccccccgcacccctccgactcgttcgccaattccgatcacgttactaaatatttacgcctcgaacccgcccccgaccccccttcgacgcccccgaaccccccgaaaccccgacccgactaccccgcaacctcccaacaactaataacgccgcaaccgaaacgaacgctacaaatccccgaacgcaactaacgtaaaaaaaaaaacgccgcccccacccaacccgacccgaacccaaaaccccgccgaccgataactcccaaatcccgaaaataaaaaaaccgatcgataaacgtaaaaaatataaacgccgaaacgaccccaaaaaaaaacaacgcgaccaaactccaactcccccgaaaaaactaacgcgaaactaaacaccgcaacgcgcgaaaaacgaacaaaactcgcgacgaactactaacaaaaattatcctccaccgcccaaacccgaaccctacctaacactaccgaacgtccaaaacgacccgaaatcgaaccccgccacctcccgccacgc

SEQ ID NO: 3131 - DNA, 707 bp, Artificial Sequence
  chemically treated genomic DNA (Homo sapiens) CpG-island No: 3131
tagttaaagttagtttcgcgagtttagcggttcgttgggggttttaggttcggttttcggggttttcggggttttcggggtttttttttttttcgatcgcgcgtcgtcggtttttttttttttcgtttcgtttacggttttttttcgttcgttttaggttttttttttttttttttttttttttcgtttttcgtattttttcggttcgttcgttagtttcggttacgttgttgggtgtttacgtttcgagttcgttttcgattttttttcggcgttttcgagtttttcggagtttcggttcgattgtttcgtagttttttagtagttgatggcgtcgtagtcggggcgggcgttgtagattttcgggcgtagttagcgtggggggaagagcgtcgtttttatttagttcggttcggatttagggtttcgtcggtcggtgatttttaggtttcgaaggtgaggaggtcggtcggtgggcgtggggggtgtgggcgtcggagcggttttaggggggagtagcgcggttaagttttagttttttcgggagggttggcgcggggttgggtatcgtagcgcgcgggaggcggataggattcgcggcgggttgttggtagaagttgttttttatcgtttagattcgggttttgtttggtattgtcgggcgtttagagcggttcgaggtcgagtttcgttatttttcgttacgt

SEQ ID NO: 3132 - DNA, 707 bp, Artificial Sequence
  chemically treated genomic DNA (Homo sapiens) CpG-island No: 3132
acgtaacgaaaaataacgaaactcgacctcgaaccgctctaaacgcccgacaataccaaacaaaacccgaatctaaacgataaaaaacaacttctaccaacaacccgccgcgaatcctatccgcctcccgcgcgctacgatacccaaccccgcgccaaccctcccgaaaaaactaaaacttaaccgcgctactcccccctaaaaccgctccgacgcccacaccccccacgcccaccgaccgacctcctcaccttcgaaacctaaaaatcaccgaccgacgaaaccctaaatccgaaccgaactaaataaaaacgacgctcttccccccacgctaactacgcccgaaaatctacaacgcccgccccgactacgacgccatcaactactaaaaaactacgaaacaatcgaaccgaaactccgaaaaactcgaaaacgccgaaaaaaaatcgaaaacgaactcgaaacgtaaacacccaacaacgtaaccgaaactaacgaacgaaccgaaaaaatacgaaaaacgaaaaaaaaaaaaaaaaaaaaaaaaaacctaaaacgaacgaaaaaaaaccgtaaacgaaacgaaaaaaaaaaaaaccgacgacgcgcgatcgaaaaaaaaaaaaaccccgaaaaccccgaaaaccccgaaaaccgaacctaaaacccccaacgaaccgctaaactcgcgaaactaactttaacta

SEQ ID NO: 3133 - DNA, 761 bp, Artificial Sequence
  chemically treated genomic DNA (Homo sapiens) CpG-island No: 3133
tttcgcgcgttagtaggattcggggaattagatttcgtttagtgttttttagaaattcggtttttcggcgcggcggggagagattcggacggggagaggtcgttgtttcgttcgttttgcggggtcggcgttgattcggttttagtcgtttttaggggcggggtttgagcgtcgcgtttttttcgcgtttttttcgcgtttttttcgcgtttttttcgcgagcgcgtttcggatattcgtttgcggtagtcgagttttttttatcgtgcggttcgcggagggtagggagcggtcgggcgaggtatggcgggtcgtcgggcgtcgggggagaagcgttggtagttggtgcgttggtgagtgggcgtcgggcggcgcggggtttaatgcgggagcgaatttcgaggttcggtcggcgcgggaagtagcggggcgcgggtttaaagtttcgtttcgggttgaggttgcggggttcgggtgggcggaggggcgtcggttgtttggtttttattatttttttcggtttttattatttcgcgttttcgcgtcgggtttttgcggttttttaaagagatgggcgacggggattttgtgcgagtcgttaggttttgggggaatttcgtttttttttcgcgggggcgttttttttttgtattttattttttacgttcgtacggggttttcgttttttttttcgttttttttaggttttttatttgtgttttttttcgttttttttgttattcggggtagggttttggatt

SEQ ID NO: 3134 - DNA, 761 bp, Artificial Sequence
  chemically treated genomic DNA (Homo sapiens) CpG-island No: 3134
aatccaaaaccctaccccgaataacaaaaaaaacgaaaaaaaacacaaataaaaaacctaaaaaaaacgaaaaaaaaaacgaaaaccccgtacgaacgtaaaaaataaaatacaaaaaaaaaacgcccccgcgaaaaaaaaacgaaattcccccaaaacctaacgactcgcacaaaatccccgtcgcccatctctttaaaaaaccgcaaaaacccgacgcgaaaacgcgaaataataaaaaccgaaaaaaataataaaaaccaaacaaccgacgcccctccgcccacccgaaccccgcaacctcaacccgaaacgaaactttaaacccgcgccccgctacttcccgcgccgaccgaacctcgaaattcgctcccgcattaaaccccgcgccgcccgacgcccactcaccaacgcaccaactaccaacgcttctcccccgacgcccgacgacccgccatacctcgcccgaccgctccctaccctccgcgaaccgcacgataaaaaaaactcgactaccgcaaacgaatatccgaaacgcgctcgcgaaaaaaacgcgaaaaaaacgcgaaaaaaacgcgaaaaaaacgcgacgctcaaaccccgcccctaaaaacgactaaaaccgaatcaacgccgaccccgcaaaacgaacgaaacaacgacctctccccgtccgaatctctccccgccgcgccgaaaaaccgaatttctaaaaaacactaaacgaaatctaattccccgaatcctactaacgcgcgaaa

SEQ ID NO: 3135 - DNA, 761 bp, Artificial Sequence
  chemically treated genomic DNA (Homo sapiens) CpG-island No: 3135
agtttagagttttgtttcgggtggtagaaggaacggagggaggtataaatgggaaatttgaagggggcgaaggggaaggcggaagtttcgtgcgagcgtgaaaggtgaagtgtagggaaagggcgttttcgcgggagggggacggggtttttttaaagtttgacggttcgtatagggttttcgtcgtttatttttttggagagtcgtagagattcggcgcggggacgcggggtggtggggatcggagggggtggtggggattaggtagtcggcgttttttcgtttattcgggtttcgtagttttagttcgggacgaaattttgggttcgcgtttcgttgtttttcgcgtcggtcgggtttcggggttcgttttcgtattaggtttcgcgtcgttcggcgtttatttattagcgtattagttgttagcgtttttttttcggcgttcggcggttcgttatgtttcgttcggtcgttttttgtttttcgcgggtcgtacggtggaggaggttcggttgtcgtaggcgggtgttcggggcgcgttcgcggggagggcgcggggagggcgcggggagggcgcggggagggcgcggcgtttagatttcgtttttggaggcggttggagtcgggttagcgtcggtttcgtagaacgggcgggatagcggttttttttcgttcgggttttttttcgtcgcgtcgaggagtcgggtttttggggagtattgggcggagtttggtttttcgagttttattgacgcgcggag

SEQ ID NO: 3136 - DNA, 761 bp, Artificial Sequence
  chemically treated genomic DNA (Homo sapiens) CpG-island No: 3136
ctccgcgcgtcaataaaactcgaaaaaccaaactccgcccaatactccccaaaaacccgactcctcgacgcgacgaaaaaaaacccgaacgaaaaaaaaccgctatcccgcccgttctacgaaaccgacgctaacccgactccaaccgcctccaaaaacgaaatctaaacgccgcgccctccccgcgccctccccgcgccctccccgcgccctccccgcgaacgcgccccgaacacccgcctacgacaaccgaacctcctccaccgtacgacccgcgaaaaacaaaaaacgaccgaacgaaacataacgaaccgccgaacgccgaaaaaaaaacgctaacaactaatacgctaataaataaacgccgaacgacgcgaaacctaatacgaaaacgaaccccgaaacccgaccgacgcgaaaaacaacgaaacgcgaacccaaaatttcgtcccgaactaaaactacgaaacccgaataaacgaaaaaacgccgactacctaatccccaccaccccctccgatccccaccaccccgcgtccccgcgccgaatctctacgactctccaaaaaaataaacgacgaaaaccctatacgaaccgtcaaactttaaaaaaaccccgtccccctcccgcgaaaacgccctttccctacacttcacctttcacgctcgcacgaaacttccgccttccccttcgcccccttcaaatttcccatttatacctccctccgttccttctaccacccgaaacaaaactctaaact

SEQ ID NO: 3137 - DNA, 740 bp, Artificial Sequence
  chemically treated genomic DNA (Homo sapiens) CpG-island No: 3137
ggtgttcgttttttcgtttttttttcgcggttgcgttaggcgattcgtaggtagcggtatagggattagggcgcgtttcgggtggcggaggcgcggcgagggcgggagtacgaggatttcggattttggatcggcgcgggtttcggttgcgcgtgcgcggcggcggcggcgaggggcgttaggtgtgcgggcggtggcggttgcggagggcgcggttttgtgcgttggggtcggtcggggtgcgcgcgtgcgcggtaggattgttgcgagggatttcgtcgtttcggaggaggaggaggaggaggaggaggaggaggagggggttgggtcgagggagggggcgatcgcggggattgaggtgtttttcgtttcgggtttagaggtagtcgcgcgttaggcggcgtagaaggttagtggtttcggggttgggatttcgtagttagtttggatcgggacgtgagttttggtgtgattgacggggaatcggagcgtgtgtggagtgtgaacgcgtgtgtttgtagatagatatcggtacgtatggacggcgcgagtcggtattgcgtttcggaggagttattcggcgttataggttgtgttggggaggtggggtgatcgtttttagaaattttcgcgggcggggcgttgtatatacgtttatttatagggtgtgtgtgcgtgcgtgaggtgtgtagtttttgttaggatttggcgagagaagttgatcgggatggaggttagag

SEQ ID NO: 3138 - DNA, 740 bp, Artificial Sequence
  chemically treated genomic DNA (Homo sapiens) CpG-island No: 3138
ctctaacctccatcccgatcaacttctctcgccaaatcctaacaaaaactacacacctcacgcacgcacacacaccctataaataaacgtatatacaacgccccgcccgcgaaaatttctaaaaacgatcaccccacctccccaacacaacctataacgccgaataactcctccgaaacgcaataccgactcgcgccgtccatacgtaccgatatctatctacaaacacacgcgttcacactccacacacgctccgattccccgtcaatcacaccaaaactcacgtcccgatccaaactaactacgaaatcccaaccccgaaaccactaaccttctacgccgcctaacgcgcgactacctctaaacccgaaacgaaaaacacctcaatccccgcgatcgccccctccctcgacccaaccccctcctcctcctcctcctcctcctcctcctcctccgaaacgacgaaatccctcgcaacaatcctaccgcgcacgcgcgcaccccgaccgaccccaacgcacaaaaccgcgccctccgcaaccgccaccgcccgcacacctaacgcccctcgccgccgccgccgcgcacgcgcaaccgaaacccgcgccgatccaaaatccgaaatcctcgtactcccgccctcgccgcgcctccgccacccgaaacgcgccctaatccctataccgctacctacgaatcgcctaacgcaaccgcgaaaaaaaaacgaaaaaacgaacacc

SEQ ID NO: 3139 - DNA, 740 bp, Artificial Sequence
  chemically treated genomic DNA (Homo sapiens) CpG-island No: 3139
ttttgatttttatttcggttagtttttttcgttagattttgataggggttgtatattttacgtacgtatatatattttataggtggacgtgtgtgtagcgtttcgttcgcgggggtttttgaggacggttattttatttttttagtatagtttgtgacgtcggatggttttttcggaacgtagtatcggttcgcgtcgtttatacgtgtcgatgtttgtttgtaaatatacgcgtttatattttatatacgtttcgatttttcgttagttatattaggatttacgtttcgatttaggttggttgcggaattttagtttcggggttattgattttttgcgtcgtttggcgcgcggttgtttttggattcggagcgaagggtattttagttttcgcggtcgttttttttttcggtttagtttttttttttttttttttttttttttttttttttttcggggcggcggggtttttcgtagtagttttgtcgcgtacgcgcgtatttcggtcggttttagcgtataaagtcgcgtttttcgtagtcgttatcgttcgtatatttggcgtttttcgtcgtcgtcgtcgcgtacgcgtagtcggagttcgcgtcgatttagggttcggggttttcgtgttttcgttttcgtcgcgttttcgttattcggggcgcgttttggtttttgtgtcgttgtttgcggatcgtttggcgtagtcgcggagagggggcggaggggcgggtatt

SEQ ID NO: 3140 - DNA, 740 bp, Artificial Sequence
  chemically treated genomic DNA (Homo sapiens) CpG-island No: 3140
aatacccgcccctccgccccctctccgcgactacgccaaacgatccgcaaacaacgacacaaaaaccaaaacgcgccccgaataacgaaaacgcgacgaaaacgaaaacacgaaaaccccgaaccctaaatcgacgcgaactccgactacgcgtacgcgacgacgacgacgaaaaacgccaaatatacgaacgataacgactacgaaaaacgcgactttatacgctaaaaccgaccgaaatacgcgcgtacgcgacaaaactactacgaaaaaccccgccgccccgaaaaaaaaaaaaaaaaaaaaaaaaaaaaaaaaaaaaactaaaccgaaaaaaaaaacgaccgcgaaaactaaaatacccttcgctccgaatccaaaaacaaccgcgcgccaaacgacgcaaaaaatcaataaccccgaaactaaaattccgcaaccaacctaaatcgaaacgtaaatcctaatataactaacgaaaaatcgaaacgtatataaaatataaacgcgtatatttacaaacaaacatcgacacgtataaacgacgcgaaccgatactacgttccgaaaaaaccatccgacgtcacaaactatactaaaaaaataaaataaccgtcctcaaaaacccccgcgaacgaaacgctacacacacgtccacctataaaatatatatacgtacgtaaaatatacaacccctatcaaaatctaacgaaaaaaactaaccgaaataaaaatcaaaa

SEQ ID NO: 3141 - DNA, 533 bp, Artificial Sequence
  chemically treated genomic DNA (Homo sapiens) CpG-island No: 3141
atagagcgtatattttcgtttttcgattttttttagagagagatggggtttcgttcgggttcggagtttatcgttttttttttagggcggatttcggttcgcggggtatttggttttgcgcgggtagtagttaggtttcggtcggaggattttgtagagtagtttgtatagtcggggttcggcggtttcgtacgtcgcgtttagtttttcgcgtatggttcggttttttaggcgtagtttcgttggttttacgcgttttttagcgttcgcgttttatcgttcggagtttgtagttttcgtttcgggggcggggcgagtcgagtagcggcgggggttttttatttacgcgatgtttcgggtcgagttgtttttttttttttgtttttttcggcgatttcgggatttaagtatttaggggttcgtagtcggcgtttgtcgcggagtttggatggtattggattgtgtttgggttaagatgttcgggtcgtgttgggtttcgtgtttgtttattttttataaaatcgtaataaagt

SEQ ID NO: 3142 - DNA, 533 bp, Artificial Sequence
  chemically treated genomic DNA (Homo sapiens) CpG-island No: 3142
actttattacgattttataaaaaataaacaaacacgaaacccaacacgacccgaacatcttaacccaaacacaatccaataccatccaaactccgcgacaaacgccgactacgaacccctaaatacttaaatcccgaaatcgccgaaaaaaacaaaaaaaaaaaaacaactcgacccgaaacatcgcgtaaataaaaaacccccgccgctactcgactcgccccgcccccgaaacgaaaactacaaactccgaacgataaaacgcgaacgctaaaaaacgcgtaaaaccaacgaaactacgcctaaaaaaccgaaccatacgcgaaaaactaaacgcgacgtacgaaaccgccgaaccccgactatacaaactactctacaaaatcctccgaccgaaacctaactactacccgcgcaaaaccaaataccccgcgaaccgaaatccgccctaaaaaaaaaacgataaactccgaacccgaacgaaaccccatctctctctaaaaaaaatcgaaaaacgaaaatatacgctctat

SEQ ID NO: 3143 - DNA, 533 bp, Artificial Sequence
  chemically treated genomic DNA (Homo sapiens) CpG-island No: 3143
gttttattgcgattttatggggaataaataaatacgaggtttaatacgattcgggtattttagtttagatatagtttagtgttatttaaatttcgcggtagacgtcggttgcgggtttttgggtgtttgggtttcgggatcgtcggggaaggtagggaaggaggggtagttcggttcgggatatcgcgtgggtgaagagttttcgtcgttgttcggttcgtttcgttttcggggcgggggttgtaggtttcgagcgataaagcgcgggcgttgggaggcgcgtggagttagcggagttgcgtttaaggagtcgggttatgcgcgaggggttgggcgcggcgtgcgaggtcgtcgggtttcggttgtgtaggttgttttgtaggatttttcggtcgaagtttgattgttgttcgcgtagagttaggtatttcgcgggtcgaagttcgttttgggagggaagcggtgggtttcgagttcgggcggggttttatttttttttgggagaaatcggagggcggggatgtgcgttttgt

SEQ ID NO: 3144 - DNA, 533 bp, Artificial Sequence
  chemically treated genomic DNA (Homo sapiens) CpG-island No: 3144
acaaaacgcacatccccgccctccgatttctcccaaaaaaaaataaaaccccgcccgaactcgaaacccaccgcttccctcccaaaacgaacttcgacccgcgaaatacctaactctacgcgaacaacaatcaaacttcgaccgaaaaatcctacaaaacaacctacacaaccgaaacccgacgacctcgcacgccgcgcccaacccctcgcgcataacccgactccttaaacgcaactccgctaactccacgcgcctcccaacgcccgcgctttatcgctcgaaacctacaacccccgccccgaaaacgaaacgaaccgaacaacgacgaaaactcttcacccacgcgatatcccgaaccgaactacccctccttccctaccttccccgacgatcccgaaacccaaacacccaaaaacccgcaaccgacgtctaccgcgaaatttaaataacactaaactatatctaaactaaaatacccgaatcgtattaaacctcgtatttatttattccccataaaatcgcaataaaac

SEQ ID NO: 3145 - DNA, 625 bp, Artificial Sequence
  chemically treated genomic DNA (Homo sapiens) CpG-island No: 3145
ttcgttttttaaggttttttttttttttttttatttagttttagtcgcgcggggatattaatttatttttattttcgagaatagcgcggttaggtgttttagaggtgtcgcgggtaggttttcgtagattattgcgtcgcggaagttgtcgggttttggaggttcgggttcggtgcgaaggaaaaaaagcgttttagcgttagttaggttcgatttaggttttatttttagttcggggcgtattgttaggtttttgggttcgggtcgtattattagtagcggtcgcggtttttcggtagtatcgcggtttaggaaggtttggagtagttgtttcgttttagtatttttcgcgtaacgtttttaggcgttcgtagtcggtcgtaggtttatggttacgtaggtttttaggagtcgtagtcgtcggtcggcgtcgggttttttattcgcgtttttcgtcgcgagcgcggttcgttttttcgcgagtcgtatcgcgcgcggtttttagttgtatcggtttttttagcgacggggacgcggttaggatttatttttttgttttttttttattgggtacggatttttggtttcgttttttttaggttaataaggtaggaggtgtacgcgg

SEQ ID NO: 3146 - DNA, 625 bp, Artificial Sequence
  chemically treated genomic DNA (Homo sapiens) CpG-island No: 3146
ccgcgtacacctcctaccttattaacctaaaaaaaacgaaaccaaaaatccgtacccaataaaaaaaaaacaaaaaaataaatcctaaccgcgtccccgtcgctaaaaaaaccgatacaactaaaaaccgcgcgcgatacgactcgcgaaaaaacgaaccgcgctcgcgacgaaaaacgcgaataaaaaacccgacgccgaccgacgactacgactcctaaaaacctacgtaaccataaacctacgaccgactacgaacgcctaaaaacgttacgcgaaaaatactaaaacgaaacaactactccaaaccttcctaaaccgcgatactaccgaaaaaccgcgaccgctactaataatacgacccgaacccaaaaacctaacaatacgccccgaactaaaaataaaacctaaatcgaacctaactaacgctaaaacgctttttttccttcgcaccgaacccgaacctccaaaacccgacaacttccgcgacgcaataatctacgaaaacctacccgcgacacctctaaaacacctaaccgcgctattctcgaaaataaaaataaattaatatccccgcgcgactaaaactaaataaaaaaaaaaaaaaaaaaccttaaaaaacgaa

SEQ ID NO: 3147 - DNA, 625 bp, Artificial Sequence
  chemically treated genomic DNA (Homo sapiens) CpG-island No: 3147
tcgcgtatattttttattttattagtttggaaggggcgggattaggggttcgtgtttaataggaagggagtagaggagtgagttttggtcgcgttttcgtcgttagggaaatcgatgtagttggaggtcgcgcgcgatgcggttcgcggaggagcgggtcgcgttcgcggcggagaacgcggatggggaattcggcgtcgatcgacgattgcgatttttggggatttacgtggttatgagtttgcggtcggttgcgggcgtttgggagcgttgcgcggggagtgttgaggcggagtagttgttttaggtttttttgggtcgcgatgttgtcgaggggtcgcggtcgttgttggtggtgcggttcgggtttaggggtttggtaatacgtttcgggttggaggtgggatttgagtcgggtttggttggcgttaaggcgttttttttttttcgtatcgggttcgagtttttagggttcgatagttttcgcggcgtagtggtttgcggggatttgttcgcggtatttttggagtatttagtcgcgttgttttcggaggtgagggtgggttagtgttttcgcgcggttaaagttgggtgggggaggggaggaggagttttaagggacgga

SEQ ID NO: 3148 - DNA, 625 bp, Artificial Sequence
  chemically treated genomic DNA (Homo sapiens) CpG-island No: 3148
tccgtcccttaaaactcctcctcccctcccccacccaactttaaccgcgcgaaaacactaacccaccctcacctccgaaaacaacgcgactaaatactccaaaaataccgcgaacaaatccccgcaaaccactacgccgcgaaaactatcgaaccctaaaaactcgaacccgatacgaaaaaaaaaaaacgccttaacgccaaccaaacccgactcaaatcccacctccaacccgaaacgtattaccaaacccctaaacccgaaccgcaccaccaacaacgaccgcgacccctcgacaacatcgcgacccaaaaaaacctaaaacaactactccgcctcaacactccccgcgcaacgctcccaaacgcccgcaaccgaccgcaaactcataaccacgtaaatccccaaaaatcgcaatcgtcgatcgacgccgaattccccatccgcgttctccgccgcgaacgcgacccgctcctccgcgaaccgcatcgcgcgcgacctccaactacatcgatttccctaacgacgaaaacgcgaccaaaactcactcctctactcccttcctattaaacacgaacccctaatcccgccccttccaaactaataaaataaaaaatatacgcga

SEQ ID NO: 3149 - DNA, 681 bp, Artificial Sequence
  chemically treated genomic DNA (Homo sapiens) CpG-island No: 3149
atgttgacggtgttttatagttatataggacgcgaggatgttgatagtgttttatagttatataggacgcgaggatgttgacggtgttttatagtcgtataggatcgaggatgttgacggtgttttatagttatataggacgcgaggatgttgacggtgttttatagtcgtataggatcgaggatgttgacggtgttttatagttatataggacgcgaggatgttgacggtgttttatagttatataggacgcgaggatgttgacggtgttttatagtcgtataggacgcgaggatgttgacggtgttttatagttatataggacgcgaggatgttgatagtgttttatagtcgtataggacgcgaggatgttgatagtgttttatagtcgtataggacgcgaggatgttgatagtgttttatagtcgtataggacgcgaggatgttgacggtgttttatagtcgtataggacgcgaggatgttgatagtgttttatagtcgtataggacgcgaggatgttgatagtgttttatagtcgtataggacgcgaggatgttgatagtgttttatagtcgtataggacgcgaggatgttgatagtgttttatagtcgtataggacgcgaggatgttgatagtgttttatagttatataggacgtaaggatgttgacggtgtttta

SEQ ID NO: 3150 - DNA, 681 bp, Artificial Sequence
  chemically treated genomic DNA (Homo sapiens) CpG-island No: 3150
taaaacaccgtcaacatccttacgtcctatataactataaaacactatcaacatcctcgcgtcctatacgactataaaacactatcaacatcctcgcgtcctatacgactataaaacactatcaacatcctcgcgtcctatacgactataaaacactatcaacatcctcgcgtcctatacgactataaaacactatcaacatcctcgcgtcctatacgactataaaacaccgtcaacatcctcgcgtcctatacgactataaaacactatcaacatcctcgcgtcctatacgactataaaacactatcaacatcctcgcgtcctatacgactataaaacactatcaacatcctcgcgtcctatataactataaaacaccgtcaacatcctcgcgtcctatacgactataaaacaccgtcaacatcctcgcgtcctatataactataaaacaccgtcaacatcctcgcgtcctatataactataaaacaccgtcaacatcctcgatcctatacgactataaaacaccgtcaacatcctcgcgtcctatataactataaaacaccgtcaacatcctcgatcctatacgactataaaacaccgtcaacatcctcgcgtcctatataactataaaacactatcaacatcctcgcgtcctatataactataaaacaccgtcaacat

SEQ ID NO: 3151 - DNA, 681 bp, Artificial Sequence
  chemically treated genomic DNA (Homo sapiens) CpG-island No: 3151
tgaggtatcgttagtatttttgcgttttgtgtggttgtgaggtattgttagtattttcgcgttttgtgcggttgtgaggtattgttagtattttcgcgttttgtgcggttgtgaggtattgttagtattttcgcgttttgtgcggttgtgaggtattgttagtattttcgcgttttgtgcggttgtgaggtattgttagtattttcgcgttttgtgcggttgtgaggtatcgttagtattttcgcgttttgtgcggttgtgaggtattgttagtattttcgcgttttgtgcggttgtgaggtattgttagtattttcgcgttttgtgcggttgtgaggtattgttagtattttcgcgttttgtgtggttgtgaggtatcgttagtattttcgcgttttgtgcggttgtgaggtatcgttagtattttcgcgttttgtgtggttgtgaggtatcgttagtattttcgcgttttgtgtggttgtgaggtatcgttagtattttcggttttgtgcggttgtgaggtatcgttagtattttcgcgttttgtgtggttgtgaggtatcgttagtattttcggttttgtgcggttgtgaggtatcgttagtattttcgcgttttgtgtggttgtgaggtattgttagtattttcgcgttttgtgtggttgtgaggtatcgttagtat

SEQ ID NO: 3152 - DNA, 681 bp, Artificial Sequence
  chemically treated genomic DNA (Homo sapiens) CpG-island No: 3152
atactaacgatacctcacaaccacacaaaacgcgaaaatactaacaatacctcacaaccacacaaaacgcgaaaatactaacgatacctcacaaccgcacaaaaccgaaaatactaacgatacctcacaaccacacaaaacgcgaaaatactaacgatacctcacaaccgcacaaaaccgaaaatactaacgatacctcacaaccacacaaaacgcgaaaatactaacgatacctcacaaccacacaaaacgcgaaaatactaacgatacctcacaaccgcacaaaacgcgaaaatactaacgatacctcacaaccacacaaaacgcgaaaatactaacaatacctcacaaccgcacaaaacgcgaaaatactaacaatacctcacaaccgcacaaaacgcgaaaatactaacaatacctcacaaccgcacaaaacgcgaaaatactaacgatacctcacaaccgcacaaaacgcgaaaatactaacaatacctcacaaccgcacaaaacgcgaaaatactaacaatacctcacaaccgcacaaaacgcgaaaatactaacaatacctcacaaccgcacaaaacgcgaaaatactaacaatacctcacaaccgcacaaaacgcgaaaatactaacaatacctcacaaccacacaaaacgcaaaaatactaacgatacctca

SEQ ID NO: 3153 - DNA, 1002 bp, Artificial Sequence
  chemically treated genomic DNA (Homo sapiens) CpG-island No: 3153
gggcgcggagagcgtacgaagcgtttagggggtttgcggtttcgcggcggggggttatgttaagggagaacgcgacgacgcgagggggagggacggagggtatttcgaagtcggggatcgttaagtcggagttagtggagtggggcgaagtcggcgagttggaaattttttgtaatcgtttatttttagtttttggcgttcggttggttttttggcggtttggcgggcggttgcgtagggttgggatttgtgttggatcgttaggttttcgaagagatggtcgttatttttgtcgtggtcgcgggcgtcgttagaggggcggcggcggtcggcgttggtagtggttgggcgcgcgggggcgttatggggtaggtttcgcgggaagtgggggaagtagttagagatttgttggatggggcggatggggtcggggtatacgtcgatggttatatgtttttggatgtaaacggtcgtttttttttcgcgtcgtcgggggttatataggtagcgtttcgtcgttttcgtacggtttggttcggagcgattttcgtcgggggcggtttagtaggttcggtatggcgcggcggggttttcgcgaaggttagcgcgagtgagtgttaggggcgggcgggtagggggtcggtttagttcgtgttattcggtagtaattacgtagcgtgagtgtgcgggttgtttaggtagcgcggagcggagagagttgcgtggggttatatttattcgtatttatatcggcggatacgtcggtttgggatttcgtgcgcgtattttttcgggataagcggggagttagtaggatagggatttacggatcgtatatttatttatacgtttttgtaggtgttagtatatgcggggtttcgttcgtttttacgggatatacgaaggtgtgtaaggataatgtaagtgtacgtatacgtgtgtagatacgtagtggaagtatttattcgtttatatttgtaagatatatatatatataaatat

SEQ ID NO: 3154 - DNA, 1002 bp, Artificial Sequence
  chemically treated genomic DNA (Homo sapiens) CpG-island No: 3154
atatttatatatatatatatcttacaaatataaacgaataaatacttccactacgtatctacacacgtatacgtacacttacattatccttacacaccttcgtatatcccgtaaaaacgaacgaaaccccgcatatactaacacctacaaaaacgtataaataaatatacgatccgtaaatccctatcctactaactccccgcttatcccgaaaaaatacgcgcacgaaatcccaaaccgacgtatccgccgatataaatacgaataaatataaccccacgcaactctctccgctccgcgctacctaaacaacccgcacactcacgctacgtaattactaccgaataacacgaactaaaccgaccccctacccgcccgcccctaacactcactcgcgctaaccttcgcgaaaaccccgccgcgccataccgaacctactaaaccgcccccgacgaaaatcgctccgaaccaaaccgtacgaaaacgacgaaacgctacctatataacccccgacgacgcgaaaaaaaaacgaccgtttacatccaaaaacatataaccatcgacgtataccccgaccccatccgccccatccaacaaatctctaactacttcccccacttcccgcgaaacctaccccataacgcccccgcgcgcccaaccactaccaacgccgaccgccgccgcccctctaacgacgcccgcgaccacgacaaaaataacgaccatctcttcgaaaacctaacgatccaacacaaatcccaaccctacgcaaccgcccgccaaaccgccaaaaaaccaaccgaacgccaaaaactaaaaataaacgattacaaaaaatttccaactcgccgacttcgccccactccactaactccgacttaacgatccccgacttcgaaataccctccgtccctccccctcgcgtcgtcgcgttctcccttaacataaccccccgccgcgaaaccgcaaaccccctaaacgcttcgtacgctctccgcgccc

SEQ ID NO: 3155 - DNA, 1002 bp, Artificial Sequence
  chemically treated genomic DNA (Homo sapiens) CpG-island No: 3155
atgtttgtgtgtgtgtgtgttttataggtatgagcgagtggatgtttttattacgtgtttgtatacgtgtgcgtgtatttgtattgtttttgtatattttcgtgtgtttcgtgagagcgaacggagtttcgtatgtgttggtatttgtaggaacgtgtgagtgagtgtgcgattcgtgggtttttgttttgttggtttttcgtttgtttcgagggagtgcgcgtacggggttttaggtcggcgtgttcgtcggtgtgagtgcgagtgagtgtggttttacgtagtttttttcgtttcgcgttgtttgggtagttcgtatatttacgttgcgtggttgttgtcgggtgatacgggttgggtcggttttttgttcgttcgtttttggtatttattcgcgttggttttcgcggaggtttcgtcgcgttatgtcgggtttgttgagtcgttttcggcgggggtcgtttcgggttaggtcgtgcgggggcggcgaggcgttgtttgtatgattttcggcggcgcggggaaaaggcgatcgtttgtatttaggagtatgtggttatcgacgtgtgtttcggttttattcgttttatttagtagatttttggttattttttttatttttcgcgggatttgttttatgacgttttcgcgcgtttagttattgttagcgtcggtcgtcgtcgtttttttgacggcgttcgcgattacgataaggatggcgattattttttcggaagtttaacgatttagtataggttttagttttgcgtagtcgttcgttaagtcgttagaggattagtcgaacgttaaaggttaggagtggacgattgtaggaagtttttaattcgtcgatttcgttttattttattggtttcggtttggcggttttcggtttcggggtgtttttcgtttttttttttcgcgtcgtcgcgtttttttttggtataatttttcgtcgcggggtcgtagattttttaagcgtttcgtgcgtttttcgcgttt

SEQ ID NO: 3156 - DNA, 1002 bp, Artificial Sequence
  chemically treated genomic DNA (Homo sapiens) CpG-island No: 3156
aaacgcgaaaaacgcacgaaacgcttaaaaaatctacgaccccgcgacgaaaaattataccaaaaaaaaacgcgacgacgcgaaaaaaaaaaacgaaaaacaccccgaaaccgaaaaccgccaaaccgaaaccaataaaataaaacgaaatcgacgaattaaaaacttcctacaatcgtccactcctaacctttaacgttcgactaatcctctaacgacttaacgaacgactacgcaaaactaaaacctatactaaatcgttaaacttccgaaaaaataatcgccatccttatcgtaatcgcgaacgccgtcaaaaaaacgacgacgaccgacgctaacaataactaaacgcgcgaaaacgtcataaaacaaatcccgcgaaaaataaaaaaaataaccaaaaatctactaaataaaacgaataaaaccgaaacacacgtcgataaccacatactcctaaatacaaacgatcgccttttccccgcgccgccgaaaatcatacaaacaacgcctcgccgcccccgcacgacctaacccgaaacgacccccgccgaaaacgactcaacaaacccgacataacgcgacgaaacctccgcgaaaaccaacgcgaataaataccaaaaacgaacgaacaaaaaaccgacccaacccgtatcacccgacaacaaccacgcaacgtaaatatacgaactacccaaacaacgcgaaacgaaaaaaactacgtaaaaccacactcactcgcactcacaccgacgaacacgccgacctaaaaccccgtacgcgcactccctcgaaacaaacgaaaaaccaacaaaacaaaaacccacgaatcgcacactcactcacacgttcctacaaataccaacacatacgaaactccgttcgctctcacgaaacacacgaaaatatacaaaaacaatacaaatacacgcacacgtatacaaacacgtaataaaaacatccactcgctcatacctataaaacacacacacacacaaacat

SEQ ID NO: 3157 - DNA, 1977 bp, Artificial Sequence
  chemically treated genomic DNA (Homo sapiens) CpG-island No: 3157
tggtcgcgaaggttagagaaggtaatggtaggggaggttagtttttgtcgcgggtcggttgtagagcggacgtttcgttttgttttcggtttttttttcgttcgtcgggttcgtcgtgtcgaataattgttgttcggagttttcgtgacgcggagttttaattgttgcgattcggaagaagcgaaaaggagtttttttcgtttcgtattttgagcgttcgggcgtgtaaacgtgggtggcggagagcggttgttttttttttttttgtttttttttttttcgcggcgttttcgtgtgtgcgggtgtgtgagtgcgtgtgtttttttcgtttattttcgtatacgtttcggtattagtgtaggcggcgagtcggcggtttttcgttcgttcgtttcggtagttgcgttttcgtttcgtttcgtcgtcgtcgtcgtcgtcgtcgtcgtcgtttttgtagtcgtagtcgggtatggtgagtgagtgaggtttagtcgtcgcgcgttttttcggttcgtcgtcggattttagttttaatcggtttcgttttagggagttagtttgcggcgggagcgcgttgcggggtcgggcggttgggggattcgggcggtcgagttgcgtttggaggggcggttcgtgcgttttcggttttaggcgcgtagggtcgcgggatttcgttttgggagcgggttttacgtttttttcggtttcgagttttttttttcgagggttgcgcgtatttttttcgttcgtttgttcgcggttttttttttgttttcggagcgttagtcgttttatttcgtgatcggtttttcgttttgtttcgtaggattcgttcggacgggattacgtcgtcgtcgtcgtcgtcgtcgttcggagtcgcgtttcgggttttgtttgagtcgagtcgcgcgcggggtcgtagttatcgtcggcgggggatggggttgtttaggaggcgcgtcgagttcgtagggggagcgcggagtcggcgcgtagtttgagagttcgagtagttcgcgtcgggtcggttcgtgcgtatcgcgcgtcgtcgtcgttattgtcgttcgcgtttcgatggcgttatcgtttcggagtcgttgatcgtttagcgtttttagttcggttcgcgcggcgggtttttcgagttcggttcgtcgggggagcggtttgtcgcggaagttttttcgcgttttttcgttcggtttcgttatggcgttgcggcgttttttgttgttgttgttgttttcgttggagtttttggatttgttgtttagcgtttacggagttcgcggtcgcgtcgttaatcggattttgagtgtaggcggcgttgtcgtcgggggtcggagggtcgggggcgttttggtacggggcggtcgcgagttgaacggtatcgttcgggcgttcggaatttcggaggcgggaagtcggcgggggtagttcgcggcggttgtggcggcggcggttagcgcggtcgttatttacgagacgtgttggggttattacgacgtgagcggttagtacgataaggagttcgagtgtaataatagcgagagcggttatttgtattgttgcggtatttgttattatcgtttttgttgtaagaagcgttacgagaagttggattagcgttagtgtattaattattagagttcggtgtgggtatagacgtttagtattaaggtggtgtcgtcggggttcgagaataagtacgattcggagaaggataagattaattttatcgtttatattatttgcggggtgatcgttttcgttatcgtggtcggcgttttcgttaaggttttttacgataaggtttatcgttttttacgggagatgaatatttataggtgagagcgtcgcgtgtcgcgcgtttcggttttttcgcggttttatttttttagtttgttttttttgttttttttattttcggtattattatatttttttaggttttttagttatttttattatcgtttt

SEQ ID NO: 3158 - DNA, 1977 bp, Artificial Sequence
  chemically treated genomic DNA (Homo sapiens) CpG-island No: 3158
aaaacgataataaaaataactaaaaaacctaaaaaaatataataataccgaaaataaaaaaaacaaaaaaaacaaactaaaaaaataaaaccgcgaaaaaaccgaaacgcgcgacacgcgacgctctcacctataaatattcatctcccgtaaaaaacgataaaccttatcgtaaaaaaccttaacgaaaacgccgaccacgataacgaaaacgatcaccccgcaaataatataaacgataaaattaatcttatccttctccgaatcgtacttattctcgaaccccgacgacaccaccttaatactaaacgtctatacccacaccgaactctaataattaatacactaacgctaatccaacttctcgtaacgcttcttacaacaaaaacgataataacaaataccgcaacaatacaaataaccgctctcgctattattacactcgaactccttatcgtactaaccgctcacgtcgtaataaccccaacacgtctcgtaaataacgaccgcgctaaccgccgccgccacaaccgccgcgaactacccccgccgacttcccgcctccgaaattccgaacgcccgaacgataccgttcaactcgcgaccgccccgtaccaaaacgcccccgaccctccgacccccgacgacaacgccgcctacactcaaaatccgattaacgacgcgaccgcgaactccgtaaacgctaaacaacaaatccaaaaactccaacgaaaacaacaacaacaacaaaaaacgccgcaacgccataacgaaaccgaacgaaaaaacgcgaaaaaacttccgcgacaaaccgctcccccgacgaaccgaactcgaaaaacccgccgcgcgaaccgaactaaaaacgctaaacgatcaacgactccgaaacgataacgccatcgaaacgcgaacgacaataacgacgacgacgcgcgatacgcacgaaccgacccgacgcgaactactcgaactctcaaactacgcgccgactccgcgctccccctacgaactcgacgcgcctcctaaacaaccccatcccccgccgacgataactacgaccccgcgcgcgactcgactcaaacaaaacccgaaacgcgactccgaacgacgacgacgacgacgacgacgtaatcccgtccgaacgaatcctacgaaacaaaacgaaaaaccgatcacgaaataaaacgactaacgctccgaaaacaaaaaaaaaaccgcgaacaaacgaacgaaaaaaatacgcgcaaccctcgaaaaaaaaaactcgaaaccgaaaaaaacgtaaaacccgctcccaaaacgaaatcccgcgaccctacgcgcctaaaaccgaaaacgcacgaaccgcccctccaaacgcaactcgaccgcccgaatcccccaaccgcccgaccccgcaacgcgctcccgccgcaaactaactccctaaaacgaaaccgattaaaactaaaatccgacgacgaaccgaaaaaacgcgcgacgactaaacctcactcactcaccatacccgactacgactacaaaaacgacgacgacgacgacgacgacgacgacgaaacgaaacgaaaacgcaactaccgaaacgaacgaacgaaaaaccgccgactcgccgcctacactaataccgaaacgtatacgaaaataaacgaaaaaaacacacgcactcacacacccgcacacacgaaaacgccgcgaaaaaaaaaaaaacaaaaaaaaaaaaaacaaccgctctccgccacccacgtttacacgcccgaacgctcaaaatacgaaacgaaaaaaactccttttcgcttcttccgaatcgcaacaattaaaactccgcgtcacgaaaactccgaacaacaattattcgacacgacgaacccgacgaacgaaaaaaaaaccgaaaacaaaacgaaacgtccgctctacaaccgacccgcgacaaaaactaacctcccctaccattaccttctctaaccttcgcgacca

SEQ ID NO: 3159 - DNA, 1977 bp, Artificial Sequence
  chemically treated genomic DNA (Homo sapiens) CpG-island No: 3159
ggagcgatggtggaaatgattagagggtttggggaggtgtgatgatgtcgagagtgaagaggataggggaagtaagttgagagggtgaggtcgcggggagatcggggcgcgcggtacgcggcgtttttatttgtggatgtttatttttcgtggagggcggtgggttttgtcgtaggagattttggcgaagacgtcggttacgatgacgaaggcgattatttcgtaggtgatgtagacggtgaagttggttttgttttttttcgggtcgtatttgttttcgggtttcggcgatattattttggtgttgggcgtttgtatttatatcgggttttggtagttggtgtattggcgttggtttagtttttcgtggcgttttttgtagtagaagcggtagtagtaggtatcgtagtagtataggtagtcgttttcgttgttgttatattcgaattttttgtcgtattggtcgtttacgtcgtagtagttttagtacgtttcgtaggtgacggtcgcgttggtcgtcgtcgttatagtcgtcgcgggttgttttcgtcggtttttcgttttcgggatttcgggcgttcgggcggtgtcgtttagttcgcggtcgtttcgtgttagggcgttttcggtttttcggttttcgacggtagcgtcgtttgtatttagggttcggttggcggcgcggtcgcgggtttcgtggacgttgggtagtaggtttagggattttagcgagagtagtagtagtagtaggaggcgtcgtagcgttatggcggggtcgggcgggagggcgcggggaggttttcgcggtaggtcgttttttcggcgggtcgggttcggaggattcgtcgcgcgggtcgggttggaggcgttgagcggttagcggtttcggggcgatggcgttatcgaggcgcgggcggtagtggcggcggcggcgcgcggtgcgtacggatcggttcggcgcgggttgttcgggtttttaggttgcgcgtcggtttcgcgttttttttgcgggttcggcgcgttttttgggtagttttatttttcgtcggcggtgattgcggtttcgcgcgcggttcggtttaggtaggattcgaagcgcggtttcgggcggcggcggcggcggcggcggcgtggtttcgttcgggcgggttttgcgggataagacggggagtcggttacggggtggggcgattggcgtttcgggagtaggaggagaatcgcgggtaggcgggcggggagggtgcgcgtagttttcgaggagagagattcggagtcgggaggggcgtagagttcgtttttaagacggggtttcgcggttttgcgcgtttggaatcgagagcgtacgggtcgtttttttaggcgtagttcggtcgttcgggttttttagtcgttcggtttcgtagcgcgttttcgtcgtaggttggttttttgggacggagtcggttgaggttggggttcggcggcgagtcgggagagcgcgcggcggttggattttatttatttattatgttcggttgcgattgtagaggcggcggcggcggcggcggcggcggcggcggggcgaggcgggaacgtagttgtcggagcgagcgagcggagagtcgtcggttcgtcgtttgtattagtgtcggaacgtgtgcgagagtgagcgagggagatatacgtatttatatattcgtatatacgggagcgtcgcgaggggaggggggataggggaggggagggtagtcgtttttcgttatttacgtttgtacgttcgggcgtttagggtgcggggcgggggggattttttttcgtttttttcggatcgtagtagttgaagtttcgcgttacgaaagtttcggatagtagttattcgatacggcgaattcggcgggcgaagagggggtcgggagtagggcggaacgttcgttttgtagtcggttcgcggtagggattgattttttttgttattgttttttttagttttcgcgatta

SEQ ID NO: 3160 - DNA, 1977 bp, Artificial Sequence
  chemically treated genomic DNA (Homo sapiens) CpG-island No: 3160
taatcgcgaaaactaaaaaaaacaataacaaaaaaaatcaatccctaccgcgaaccgactacaaaacgaacgttccgccctactcccgaccccctcttcgcccgccgaattcgccgtatcgaataactactatccgaaactttcgtaacgcgaaacttcaactactacgatccgaaaaaaacgaaaaaaaatcccccccgccccgcaccctaaacgcccgaacgtacaaacgtaaataacgaaaaacgactaccctcccctcccctatcccccctcccctcgcgacgctcccgtatatacgaatatataaatacgtatatctccctcgctcactctcgcacacgttccgacactaatacaaacgacgaaccgacgactctccgctcgctcgctccgacaactacgttcccgcctcgccccgccgccgccgccgccgccgccgccgccgcctctacaatcgcaaccgaacataataaataaataaaatccaaccgccgcgcgctctcccgactcgccgccgaaccccaacctcaaccgactccgtcccaaaaaaccaacctacgacgaaaacgcgctacgaaaccgaacgactaaaaaacccgaacgaccgaactacgcctaaaaaaacgacccgtacgctctcgattccaaacgcgcaaaaccgcgaaaccccgtcttaaaaacgaactctacgcccctcccgactccgaatctctctcctcgaaaactacgcgcaccctccccgcccgcctacccgcgattctcctcctactcccgaaacgccaatcgccccaccccgtaaccgactccccgtcttatcccgcaaaacccgcccgaacgaaaccacgccgccgccgccgccgccgccgcccgaaaccgcgcttcgaatcctacctaaaccgaaccgcgcgcgaaaccgcaatcaccgccgacgaaaaataaaactacccaaaaaacgcgccgaacccgcaaaaaaaacgcgaaaccgacgcgcaacctaaaaacccgaacaacccgcgccgaaccgatccgtacgcaccgcgcgccgccgccgccactaccgcccgcgcctcgataacgccatcgccccgaaaccgctaaccgctcaacgcctccaacccgacccgcgcgacgaatcctccgaacccgacccgccgaaaaaacgacctaccgcgaaaacctccccgcgccctcccgcccgaccccgccataacgctacgacgcctcctactactactactactctcgctaaaatccctaaacctactacccaacgtccacgaaacccgcgaccgcgccgccaaccgaaccctaaatacaaacgacgctaccgtcgaaaaccgaaaaaccgaaaacgccctaacacgaaacgaccgcgaactaaacgacaccgcccgaacgcccgaaatcccgaaaacgaaaaaccgacgaaaacaacccgcgacgactataacgacgacgaccaacgcgaccgtcacctacgaaacgtactaaaactactacgacgtaaacgaccaatacgacaaaaaattcgaatataacaacaacgaaaacgactacctatactactacgatacctactactaccgcttctactacaaaaaacgccacgaaaaactaaaccaacgccaatacaccaactaccaaaacccgatataaatacaaacgcccaacaccaaaataatatcgccgaaacccgaaaacaaatacgacccgaaaaaaaacaaaaccaacttcaccgtctacatcacctacgaaataatcgccttcgtcatcgtaaccgacgtcttcgccaaaatctcctacgacaaaacccaccgccctccacgaaaaataaacatccacaaataaaaacgccgcgtaccgcgcgccccgatctccccgcgacctcaccctctcaacttacttcccctatcctcttcactctcgacatcatcacacctccccaaaccctctaatcatttccaccatcgctcc

SEQ ID NO: 3161 - DNA, 682 bp, Artificial Sequence
  chemically treated genomic DNA (Homo sapiens) CpG-island No: 3161
gattttcgcgggttttcgagtttcgcggtttcgggtatcgtggtgtgcgttcggggcgtgttttagtttttggttcgttttttttcgtttttttttcggaattacgttcgtttttcgcgtacgtagttcgtcggttttgtagcgtcgtaggatagggcgggattggggtgggaggtcgttggttggttggcgggttgcggaaggcggggttcgtgtgcgtattagcgcgttttcgtttagcgttgtttttgcgcgcgtagttggtcggttcgcggcggtgttgcgcggattcggcgtcggggttcggtatggcgggggtcggggttaagtcgggtcggattcggatttaaatgtttttgttttttttcgcgttgttggttttgttgttagttgcgtttagcgttttttttttaggtcggtgagggttttcggtcgcgtcggcggcggcggcggcggcgggagggagggggcggagaggaggaagaaagattgaggagggggcgcgcgttttattgaggcgcgtgaggtagagtgggtagggtggagggagggggcgcgcggcgaggggagggatcgtgaggaggcgcgtggttcgagtttttagggatgggttgcgagttggggagattgaggaagcgggcggggtttgaggaaatgttgaggttaggaattgaataggagt

SEQ ID NO: 3162 - DNA, 682 bp, Artificial Sequence
  chemically treated genomic DNA (Homo sapiens) CpG-island No: 3162
actcctattcaattcctaacctcaacatttcctcaaaccccgcccgcttcctcaatctccccaactcgcaacccatccctaaaaactcgaaccacgcgcctcctcacgatccctcccctcgccgcgcgccccctccctccaccctacccactctacctcacgcgcctcaataaaacgcgcgccccctcctcaatctttcttcctcctctccgccccctccctcccgccgccgccgccgccgccgacgcgaccgaaaaccctcaccgacctaaaaaaaaaacgctaaacgcaactaacaacaaaaccaacaacgcgaaaaaaaacaaaaacatttaaatccgaatccgacccgacttaaccccgacccccgccataccgaaccccgacgccgaatccgcgcaacaccgccgcgaaccgaccaactacgcgcgcaaaaacaacgctaaacgaaaacgcgctaatacgcacacgaaccccgccttccgcaacccgccaaccaaccaacgacctcccaccccaatcccgccctatcctacgacgctacaaaaccgacgaactacgtacgcgaaaaacgaacgtaattccgaaaaaaaaacgaaaaaaaacgaaccaaaaactaaaacacgccccgaacgcacaccacgatacccgaaaccgcgaaactcgaaaacccgcgaaaatc

SEQ ID NO: 3163 - DNA, 682 bp, Artificial Sequence
  chemically treated genomic DNA (Homo sapiens) CpG-island No: 3163
atttttatttagtttttggttttagtatttttttagatttcgttcgtttttttagtttttttaattcgtagtttatttttgggagttcgggttacgcgtttttttacgattttttttttcgtcgcgcgttttttttttttattttatttattttgttttacgcgttttagtaaggcgcgcgttttttttttagtttttttttttttttttcgttttttttttttcgtcgtcgtcgtcgtcgtcggcgcggtcgggaatttttatcggtttagaaagagggcgttaagcgtaattagtagtaagattaatagcgcggagaagaatagaggtatttaggttcgggttcggttcggtttggtttcggttttcgttatgtcgggtttcgacgtcggattcgcgtagtatcgtcgcgggtcgattagttgcgcgcgtaggagtaacgttgagcgaggacgcgttggtgcgtatacgagtttcgtttttcgtagttcgttagttaattaacggttttttattttagtttcgttttgttttacgacgttgtagggtcgacgggttgcgtgcgcgaggagcgggcgtggtttcgggaggagggcgagggggagcggattaagagttgaaatacgtttcgggcgtatattacggtgttcggaatcgcggggttcggggattcgcgggggtt

SEQ ID NO: 3164 - DNA, 682 bp, Artificial Sequence
  chemically treated genomic DNA (Homo sapiens) CpG-island No: 3164
aacccccgcgaatccccgaaccccgcgattccgaacaccgtaatatacgcccgaaacgtatttcaactcttaatccgctccccctcgccctcctcccgaaaccacgcccgctcctcgcgcacgcaacccgtcgaccctacaacgtcgtaaaacaaaacgaaactaaaataaaaaaccgttaattaactaacgaactacgaaaaacgaaactcgtatacgcaccaacgcgtcctcgctcaacgttactcctacgcgcgcaactaatcgacccgcgacgatactacgcgaatccgacgtcgaaacccgacataacgaaaaccgaaaccaaaccgaaccgaacccgaacctaaatacctctattcttctccgcgctattaatcttactactaattacgcttaacgccctctttctaaaccgataaaaattcccgaccgcgccgacgacgacgacgacgacgaaaaaaaaaaaacgaaaaaaaaaaaaaaaaactaaaaaaaaaacgcgcgccttactaaaacgcgtaaaacaaaataaataaaataaaaaaaaaaaacgcgcgacgaaaaaaaaaatcgtaaaaaaacgcgtaacccgaactcccaaaaataaactacgaattaaaaaaactaaaaaaacgaacgaaatctaaaaaaatactaaaaccaaaaactaaataaaaat

SEQ ID NO: 3165 - DNA, 748 bp, Artificial Sequence
  chemically treated genomic DNA (Homo sapiens) CpG-island No: 3165
ttattcgggtcggagggttttcgcggaattagacgttttgtttcgaggtaggtttttttcgcggcgttatagttttttcggttttgatttcgttagtcggtaggtttttaagtcgatcgcgaagattttttttttttcgttcgttcgtttttttttcgtttttttttcgtttttagtttaggattttttaatttagagttcggttcggattttagtcgtttagtttttgaattgtttacgtcgcggttagtagtttttatatttcggcgttttttagggtttgtatcggttcgggggcggagttacgtatttaggcgaagagcgcggtcgtcgcgggggcggttttcgaggcgttgggttcgcgttttatgcgaggacgtttcgtcggcgttttcgggagggacggtacgggggcggcgtttgtcgggggtaggtgagcgtcggagtcggatcggggacgcgtgatgggtagggcgcggggcggggtttgtggtgggaagcggttcgtaggtcgggagagagggtgcggtcgggttttcgggttattggggattagtggtgggcggggtcggacgatagtttcggagtcgttttttagttagttcgtttcggcggcgttcgtagcgttttcgttcgtagttttttgtttcgttgggttttttagtttttcgtttttattttttcgtattttttatttttagttataattttatgttttatgtaggtgtattgcgcgttatagtttata

SEQ ID NO: 3166 - DNA, 748 bp, Artificial Sequence
  chemically treated genomic DNA (Homo sapiens) CpG-island No: 3166
tataaactataacgcgcaatacacctacataaaacataaaattataactaaaaataaaaaatacgaaaaaataaaaacgaaaaactaaaaaacccaacgaaacaaaaaactacgaacgaaaacgctacgaacgccgccgaaacgaactaactaaaaaacgactccgaaactatcgtccgaccccgcccaccactaatccccaataacccgaaaacccgaccgcaccctctctcccgacctacgaaccgcttcccaccacaaaccccgccccgcgccctacccatcacgcgtccccgatccgactccgacgctcacctacccccgacaaacgccgcccccgtaccgtccctcccgaaaacgccgacgaaacgtcctcgcataaaacgcgaacccaacgcctcgaaaaccgcccccgcgacgaccgcgctcttcgcctaaatacgtaactccgcccccgaaccgatacaaaccctaaaaaacgccgaaatataaaaactactaaccgcgacgtaaacaattcaaaaactaaacgactaaaatccgaaccgaactctaaattaaaaaatcctaaactaaaaacgaaaaaaaaacgaaaaaaaaacgaacgaacgaaaaaaaaaaaatcttcgcgatcgacttaaaaacctaccgactaacgaaatcaaaaccgaaaaaactataacgccgcgaaaaaaacctacctcgaaacaaaacgtctaattccgcgaaaaccctccgacccgaataa

SEQ ID NO: 3167 - DNA, 748 bp, Artificial Sequence
  chemically treated genomic DNA (Homo sapiens) CpG-island No: 3167
tgtgaattgtggcgcgtagtgtatttgtatgaaatatgaaattatgattaaaaataaagagtacgagggggtaggagcgagaggttgagaggtttagcgagataggaggttgcgggcggagacgttgcgagcgtcgtcggggcgggttgattgggaggcggtttcggggttgtcgttcggtttcgtttattattgatttttagtggttcgaaggttcggtcgtattttttttttcggtttgcgggtcgttttttattatagatttcgtttcgcgttttatttattacgcgttttcggttcggtttcggcgtttatttattttcggtaggcgtcgttttcgtgtcgtttttttcggaagcgtcggcggagcgttttcgtatggagcgcgagtttagcgtttcggaggtcgttttcgcggcggtcgcgtttttcgtttgggtacgtgatttcgttttcgggtcggtgtaggttttgaggggcgtcgagatgtgggagttgttggtcgcggcgtgggtagtttaggggttgggcggttgaggttcgagtcgggttttgggttgaaggattttgggttgggagcggagggggagcggaggaggagcgggcgggcggggaaggaagggttttcgcggtcgatttaggggtttgtcggttggcggggttagggtcggaggggttgtggcgtcgcgggaagaatttgtttcggggtagagcgtttggtttcgcgagagtttttcggttcgaatag

SEQ ID NO: 3168 - DNA, 748 bp, Artificial Sequence
  chemically treated genomic DNA (Homo sapiens) CpG-island No: 3168
ctattcgaaccgaaaaactctcgcgaaaccaaacgctctaccccgaaacaaattcttcccgcgacgccacaacccctccgaccctaaccccgccaaccgacaaacccctaaatcgaccgcgaaaacccttccttccccgcccgcccgctcctcctccgctccccctccgctcccaacccaaaatccttcaacccaaaacccgactcgaacctcaaccgcccaacccctaaactacccacgccgcgaccaacaactcccacatctcgacgcccctcaaaacctacaccgacccgaaaacgaaatcacgtacccaaacgaaaaacgcgaccgccgcgaaaacgacctccgaaacgctaaactcgcgctccatacgaaaacgctccgccgacgcttccgaaaaaaacgacacgaaaacgacgcctaccgaaaataaataaacgccgaaaccgaaccgaaaacgcgtaataaataaaacgcgaaacgaaatctataataaaaaacgacccgcaaaccgaaaaaaaaaatacgaccgaaccttcgaaccactaaaaatcaataataaacgaaaccgaacgacaaccccgaaaccgcctcccaatcaacccgccccgacgacgctcgcaacgtctccgcccgcaacctcctatctcgctaaacctctcaacctctcgctcctaccccctcgtactctttatttttaatcataatttcatatttcatacaaatacactacgcgccacaattcaca

SEQ ID NO: 3169 - DNA, 1113 bp, Artificial Sequence
  chemically treated genomic DNA (Homo sapiens) CpG-island No: 3169
gtttttatcgtttttttttcggaggtcgttaaataatttgggtatataaaacgttgagtgtggtcgcggcgtagcgcgcgttaacgagttcgggtcggcgggagtagaggaagggcggggcgttcggcgggaacggggagggattttttatttcgcggtataggtgcgagcgcggcggttttatttatttattcgatgaagtagttggcgttttttttcgtgaagttttttttttagtcgcggggtaggtttgcggaaacgttagaaaagtcgggttaaatttgggtcgtcgttgcgcgcgttttttattcgtcggttcggcgtttatttgagcggattatgtggttcgagttgacgggtttttcggtgcgcgggtgtagttaggtcgtgtagcggagttggttattgcgggtagagaggtgtatttgttagcgtcgttatagttcgtcgggtgttcgttcggttttcgttttcgcgtttttattcgcgttttcgcgttttcgggttttcgcgtcgtatttgatgaagaagacgcggttatttcggtatatttcgtaggattaatgtttaggtaaagtgtttcgttcgatcgtcgtcgtcgttatgttcgtcgagcgcggatcgtcgcggggtgggggggagggggcgggggcgcgggtaggggcgggggcgggggcggtggcgggggttcggtttgcgcgtggttcggcggcgtcgcgaggcgtttatttaggcgcgggttttttagggagcgatcgttcggtcgggttttggcgttcggagttcgtagtcgtttcggttaatttagcgcggtgttcgcggtttttgttttcgcgtttttttcgtttttagtttgttggtatcggcgtttttttttgttttcgaggtcgggagattcgggcggcgcggggggtcgttggcgggggtcgttggcgggcgcgtttgggtagtttcggggcgcgcggttggattcgattaatttcgaaaacggcgagcgttcgaacgtttagtaaattttagtcgattcgtattatagaatttttcgattcgggaatttcgtttgtgtgtgaattaagttaatatttaggtttttgttatatttttagttttttt

SEQ ID NO: 3170 - DNA, 1113 bp, Artificial Sequence
  chemically treated genomic DNA (Homo sapiens) CpG-island No: 3170
aaaaaaactaaaaatataacaaaaacctaaatattaacttaattcacacacaaacgaaattcccgaatcgaaaaattctataatacgaatcgactaaaatttactaaacgttcgaacgctcgccgttttcgaaattaatcgaatccaaccgcgcgccccgaaactacccaaacgcgcccgccaacgacccccgccaacgaccccccgcgccgcccgaatctcccgacctcgaaaacaaaaaaaaacgccgataccaacaaactaaaaacgaaaaaaacgcgaaaacaaaaaccgcgaacaccgcgctaaattaaccgaaacgactacgaactccgaacgccaaaacccgaccgaacgatcgctccctaaaaaacccgcgcctaaataaacgcctcgcgacgccgccgaaccacgcgcaaaccgaacccccgccaccgcccccgcccccgcccctacccgcgcccccgccccctcccccccaccccgcgacgatccgcgctcgacgaacataacgacgacgacgatcgaacgaaacactttacctaaacattaatcctacgaaatataccgaaataaccgcgtcttcttcatcaaatacgacgcgaaaacccgaaaacgcgaaaacgcgaataaaaacgcgaaaacgaaaaccgaacgaacacccgacgaactataacgacgctaacaaatacacctctctacccgcaataaccaactccgctacacgacctaactacacccgcgcaccgaaaaacccgtcaactcgaaccacataatccgctcaaataaacgccgaaccgacgaataaaaaacgcgcgcaacgacgacccaaatttaacccgacttttctaacgtttccgcaaacctaccccgcgactaaaaaaaaaacttcacgaaaaaaaacgccaactacttcatcgaataaataaataaaaccgccgcgctcgcacctataccgcgaaataaaaaatccctccccgttcccgccgaacgccccgcccttcctctactcccgccgacccgaactcgttaacgcgcgctacgccgcgaccacactcaacgttttatatacccaaattatttaacgacctccgaaaaaaaaacgataaaaac

SEQ ID NO: 3171 - DNA, 1113 bp, Artificial Sequence
  chemically treated genomic DNA (Homo sapiens) CpG-island No: 3171
aaggaggttgggaatatggtaggaatttgagtgttaatttggtttatatataagcggagttttcgggtcgggaagttttgtggtgcgggtcggttggggtttattgagcgttcgggcgttcgtcgttttcggagttggtcgggtttaatcgcgcgtttcgaagttgtttaggcgcgttcgttagcggttttcgttagcggtttttcgcgtcgttcgggtttttcggtttcgggggtaaaggggagcgtcggtgttagtaggttgggggcggggaaggcgcggggataaaggtcgcgggtatcgcgttgggttggtcggagcggttgcgaatttcgggcgttaggattcggtcgggcggtcgttttttgaggagttcgcgtttggatggacgtttcgcggcgtcgtcgggttacgcgtaggtcgagttttcgttatcgttttcgttttcgtttttgttcgcgttttcgtttttttttttttatttcgcggcggttcgcgttcggcgaatatggcggcggcgacggtcgggcgggatattttatttgagtattggttttacggggtgtgtcgggatggtcgcgttttttttattaagtgcggcgcgaggattcggggacgcggggacgcgggtgggggcgcgggggcgggggtcgggcgggtattcggcgggttgtggcggcgttaataggtgtatttttttgttcgtagtgattagtttcgttgtacgatttggttgtattcgcgtatcggggagttcgttaattcgggttatatgattcgtttaggtgggcgtcgggtcggcgggtggggggcgcgcgtagcggcggtttaagtttgattcgatttttttggcgttttcgtagatttgtttcgcggttgggaggagggttttacggaggagggcgttagttattttatcgagtgagtgagtggggtcgtcgcgttcgtatttgtgtcgcggggtggggggttttttttcgttttcgtcgggcgtttcgttttttttttgttttcgtcggttcgggttcgttggcgcgcgttgcgtcgcggttatatttaacgttttgtgtgtttaagttgtttggcggttttcgagaggaaggcggtgggggt

SEQ ID NO: 3172 - DNA, 1113 bp, Artificial Sequence
  chemically treated genomic DNA (Homo sapiens) CpG-island No: 3172
acccccaccgccttcctctcgaaaaccgccaaacaacttaaacacacaaaacgttaaatataaccgcgacgcaacgcgcgccaacgaacccgaaccgacgaaaacaaaaaaaaaacgaaacgcccgacgaaaacgaaaaaaaaccccccaccccgcgacacaaatacgaacgcgacgaccccactcactcactcgataaaataactaacgccctcctccgtaaaaccctcctcccaaccgcgaaacaaatctacgaaaacgccaaaaaaatcgaatcaaacttaaaccgccgctacgcgcgccccccacccgccgacccgacgcccacctaaacgaatcatataacccgaattaacgaactccccgatacgcgaatacaaccaaatcgtacaacgaaactaatcactacgaacaaaaaaatacacctattaacgccgccacaacccgccgaatacccgcccgacccccgcccccgcgcccccacccgcgtccccgcgtccccgaatcctcgcgccgcacttaataaaaaaaacgcgaccatcccgacacaccccgtaaaaccaatactcaaataaaatatcccgcccgaccgtcgccgccgccatattcgccgaacgcgaaccgccgcgaaataaaaaaaaaaaaacgaaaacgcgaacaaaaacgaaaacgaaaacgataacgaaaactcgacctacgcgtaacccgacgacgccgcgaaacgtccatccaaacgcgaactcctcaaaaaacgaccgcccgaccgaatcctaacgcccgaaattcgcaaccgctccgaccaacccaacgcgatacccgcgacctttatccccgcgccttccccgcccccaacctactaacaccgacgctcccctttacccccgaaaccgaaaaacccgaacgacgcgaaaaaccgctaacgaaaaccgctaacgaacgcgcctaaacaacttcgaaacgcgcgattaaacccgaccaactccgaaaacgacgaacgcccgaacgctcaataaaccccaaccgacccgcaccacaaaacttcccgacccgaaaactccgcttatatataaaccaaattaacactcaaattcctaccatattcccaacctcctt

SEQ ID NO: 3173 - DNA, 546 bp, Artificial Sequence
  chemically treated genomic DNA (Homo sapiens) CpG-island No: 3173
gaacggtggttcgttttaggtatttagggttcgggaaagaggcgcgggtagtacgcgcgggttacgtgggcgatgcgggcgtgcgtttttgtattcgcgggagggggatggggaaaaggggcggggtcggcgtttgatttttcgtgaagtttagcgcggggaaggatcggaatttcgggcgggcggtttgttgataatatggcggttggagttgtttgggtatttcgaggaggcggtggggtttattttcggaagaagggttttttttcgcgttagtgtagcggtttttttggattcggaagttcgggtcggttgttgaatgaggggagtcgggtttttttcgcgttagttttttcgtatttttcgtttcgattcgggtttcgttatgtttttttttcggcggaaaggtagttgagggggcgtcggcggggagttaggtcgggttttaggggcggcggtggggtaggtgggtttgcgagggttttttttaaggcggtagtaaggtttttagcgagtttcgatttcggcgtagatgttttttgagtg

SEQ ID NO: 3174 - DNA, 546 bp, Artificial Sequence
  chemically treated genomic DNA (Homo sapiens) CpG-island No: 3174
cactcaaaaaacatctacgccgaaatcgaaactcgctaaaaaccttactaccgccttaaaaaaaaccctcgcaaacccacctaccccaccgccgcccctaaaacccgacctaactccccgccgacgccccctcaactacctttccgccgaaaaaaaaacataacgaaacccgaatcgaaacgaaaaatacgaaaaaactaacgcgaaaaaaacccgactcccctcattcaacaaccgacccgaacttccgaatccaaaaaaaccgctacactaacgcgaaaaaaaacccttcttccgaaaataaaccccaccgcctcctcgaaatacccaaacaactccaaccgccatattatcaacaaaccgcccgcccgaaattccgatccttccccgcgctaaacttcacgaaaaatcaaacgccgaccccgccccttttccccatccccctcccgcgaatacaaaaacgcacgcccgcatcgcccacgtaacccgcgcgtactacccgcgcctctttcccgaaccctaaatacctaaaacgaaccaccgttc

SEQ ID NO: 3175 - DNA, 546 bp, Artificial Sequence
  chemically treated genomic DNA (Homo sapiens) CpG-island No: 3175
tatttagggggtatttgcgtcgaggtcgaggttcgttgaaggttttgttgtcgttttggggaaagttttcgtaggtttatttgttttatcgtcgtttttgaggttcggtttgatttttcgtcggcgtttttttagttattttttcgtcggaagaaggatatggcggggttcgggtcgggacggagggtgcggggggattggcgcggggagggttcggttttttttatttagtaatcggttcggattttcgggtttagaggggtcgttgtattagcgcgaaaagggatttttttttcgggagtgggttttatcgttttttcgggatgtttaggtagttttagtcgttatattattaataagtcgttcgttcggagtttcggttttttttcgcgttaggttttacgggaggttaagcgtcggtttcgttttttttttttatttttttttcgcgggtgtaggggcgtacgttcgtatcgtttacgtgattcgcgcgtgttattcgcgtttttttttcgggttttgggtgtttggagcgagttatcgttt

SEQ ID NO: 3176 - DNA, 546 bp, Artificial Sequence
  chemically treated genomic DNA (Homo sapiens) CpG-island No: 3176
aaacgataactcgctccaaacacccaaaacccgaaaaaaaaacgcgaataacacgcgcgaatcacgtaaacgatacgaacgtacgcccctacacccgcgaaaaaaaaataaaaaaaaaaaacgaaaccgacgcttaacctcccgtaaaacctaacgcgaaaaaaaaccgaaactccgaacgaacgacttattaataatataacgactaaaactacctaaacatcccgaaaaaacgataaaacccactcccgaaaaaaaaatcccttttcgcgctaatacaacgacccctctaaacccgaaaatccgaaccgattactaaataaaaaaaaccgaaccctccccgcgccaatccccccgcaccctccgtcccgacccgaaccccgccatatccttcttccgacgaaaaaataactaaaaaaacgccgacgaaaaatcaaaccgaacctcaaaaacgacgataaaacaaataaacctacgaaaactttccccaaaacgacaacaaaaccttcaacgaacctcgacctcgacgcaaataccccctaaata

SEQ ID NO: 3177 - DNA, 522 bp, Artificial Sequence
  chemically treated genomic DNA (Homo sapiens) CpG-island No: 3177
gagttttacgaggagaattacgagggcggtaaggagtgttatcgggtttttaacgagtttatcggggattttgacgagtttttaagtaagtcggattatagtagtatcgagaagattaagattatcggagttacgtatatggcggcgttagggttgaatatcgcgtaggtttaggacggtagttattcgtaggagtatttgtagattttgttcgagttcgttaaggagatgatgcgcgtggtggacgattttaataataatatgttgtggtttaattttaagtttcgcgtcggttttaattatgggttttttacggtcggggttatcggtattattaagttgttgtacgatatttggggagatatcgttaatatcgttagtaggatggatattatcggcgtggagtgtcgtatttaggtgagcgaagagagttatcgcgttttgagtaagatgggttatgatttcgattatagagggatcgtgaatgttaaggggaaaggttagatgaagatttatttgtat

SEQ ID NO: 3178 - DNA, 522 bp, Artificial Sequence
  chemically treated genomic DNA (Homo sapiens) CpG-island No: 3178
atacaaataaatcttcatctaacctttccccttaacattcacgatccctctataatcgaaatcataacccatcttactcaaaacgcgataactctcttcgctcacctaaatacgacactccacgccgataatatccatcctactaacgatattaacgatatctccccaaatatcgtacaacaacttaataataccgataaccccgaccgtaaaaaacccataattaaaaccgacgcgaaacttaaaattaaaccacaacatattattattaaaatcgtccaccacgcgcatcatctccttaacgaactcgaacaaaatctacaaatactcctacgaataactaccgtcctaaacctacgcgatattcaaccctaacgccgccatatacgtaactccgataatcttaatcttctcgatactactataatccgacttacttaaaaactcgtcaaaatccccgataaactcgttaaaaacccgataacactccttaccgccctcgtaattctcctcgtaaaactc

SEQ ID NO: 3179 - DNA, 522 bp, Artificial Sequence
  chemically treated genomic DNA (Homo sapiens) CpG-island No: 3179
gtataggtaggtttttatttggtttttttttttgatatttacggtttttttgtagtcgaagttatagtttattttgtttaagacgcggtagtttttttcgtttatttggatgcggtattttacgtcggtggtgtttattttgttggcgatgttgacggtgtttttttagatgtcgtatagtagtttggtggtgtcgatgatttcggtcgtgaggggtttatggttgaagtcgacgcggagtttgaagttgaattatagtatgttgttgttgaagtcgtttattacgcgtattatttttttggcgaattcgaataggatttgtaggtgtttttgcgggtggttgtcgttttgggtttgcgcggtgtttagttttgacgtcgttatgtacgtggtttcgatggttttgattttttcgatgttgttgtagttcggtttgtttaggagttcgttaaagttttcgatgagttcgttgaggattcggtagtattttttgtcgttttcgtagtttttttcgtagaattt

SEQ ID NO: 3180 - DNA, 522 bp, Artificial Sequence
  chemically treated genomic DNA (Homo sapiens) CpG-island No: 3180
aaattctacgaaaaaaactacgaaaacgacaaaaaatactaccgaatcctcaacgaactcatcgaaaactttaacgaactcctaaacaaaccgaactacaacaacatcgaaaaaatcaaaaccatcgaaaccacgtacataacgacgtcaaaactaaacaccgcgcaaacccaaaacgacaaccacccgcaaaaacacctacaaatcctattcgaattcgccaaaaaaataatacgcgtaataaacgacttcaacaacaacatactataattcaacttcaaactccgcgtcgacttcaaccataaacccctcacgaccgaaatcatcgacaccaccaaactactatacgacatctaaaaaaacaccgtcaacatcgccaacaaaataaacaccaccgacgtaaaataccgcatccaaataaacgaaaaaaactaccgcgtcttaaacaaaataaactataacttcgactacaaaaaaaccgtaaatatcaaaaaaaaaaaccaaataaaaacctacctatac

SEQ ID NO: 3181 - DNA, 778 bp, Artificial Sequence
  chemically treated genomic DNA (Homo sapiens) CpG-island No: 3181
ggcggtaggtgaagttttcggaggcggttgggttattggggttagagagcggggaggcggcggcggtatttgagttttaggatttcgcgtcgttggcggggtttgggggatcgggtaggtaggggacgtattgcggcggtaggaggcgttttcgggtatcgttttcgggtagtttttgattcgttaggcgtagtgtttcggttagagtttagatgtagttgtaggcgaagcgtagcgtttcgattttggtgagtttggtgtcgtcggggaacgagggtagtacgttgcgtagtgcgtttagggtcgcgtttaagttgtgtatgcggttgcgttcgcgatcgttggttttgacgcgtcggtttttgcgtagcgagtgtagtagcgtttcggagcggattcgcgttcggtcgcggcgtcgtcgttttttttgttcgtcgttttgtgtttttggaattttagacgttcgggagatattgggcgcgtttttgcgggtcggcgcgggcggtttcgaagcggaggttgtttgttggagtttggtatagtttttttcgtcggtgaggaagtcggataggttattgtcgttgttgttggcgtagtcgaggtcggagatgtaggttttaaggcgggttggtatcgttgcgttgtgtaggatcgacggatagatagaaaggcgtttagagcgttgtagttcggattgagggtagagtcgttagggcgtatttacgtttttaatagtttggggttgttattttgtgttagttgcgggtgcgagagtttg

SEQ ID NO: 3182 - DNA, 778 bp, Artificial Sequence
  chemically treated genomic DNA (Homo sapiens) CpG-island No: 3182
caaactctcgcacccgcaactaacacaaaataacaaccccaaactattaaaaacgtaaatacgccctaacgactctaccctcaatccgaactacaacgctctaaacgcctttctatctatccgtcgatcctacacaacgcaacgataccaacccgccttaaaacctacatctccgacctcgactacgccaacaacaacgacaataacctatccgacttcctcaccgacgaaaaaaactataccaaactccaacaaacaacctccgcttcgaaaccgcccgcgccgacccgcaaaaacgcgcccaatatctcccgaacgtctaaaattccaaaaacacaaaacgacgaacaaaaaaaacgacgacgccgcgaccgaacgcgaatccgctccgaaacgctactacactcgctacgcaaaaaccgacgcgtcaaaaccaacgatcgcgaacgcaaccgcatacacaacttaaacgcgaccctaaacgcactacgcaacgtactaccctcgttccccgacgacaccaaactcaccaaaatcgaaacgctacgcttcgcctacaactacatctaaactctaaccgaaacactacgcctaacgaatcaaaaactacccgaaaacgatacccgaaaacgcctcctaccgccgcaatacgtcccctacctacccgatcccccaaaccccgccaacgacgcgaaatcctaaaactcaaataccgccgccgcctccccgctctctaaccccaataacccaaccgcctccgaaaacttcacctaccgcc

SEQ ID NO: 3183 - DNA, 778 bp, Artificial Sequence
  chemically treated genomic DNA (Homo sapiens) CpG-island No: 3183
taggttttcgtattcgtaattggtatagagtaataattttaggttgttgggaacgtaagtgcgttttggcggttttgtttttagttcgggttgtagcgttttgagcgtttttttatttgttcgtcggttttgtatagcgtaacgatgttagttcgttttgagatttgtattttcgatttcgattgcgttagtagtagcggtagtgatttattcggtttttttatcgacgaggaagattgtgttagattttaataggtagttttcgtttcggggtcgttcgcgtcggttcgtaggggcgcgtttaatatttttcgggcgtttgaggttttaggggtataggacgacgagtaggagaggcggcggcgtcgcggtcggacgcgggttcgtttcgaggcgttgttgtattcgttgcgtaggagtcggcgcgttaaggttaacgatcgcgagcgtaatcgtatgtataatttgaacgcggttttggacgtattgcgtagcgtgttgttttcgtttttcgacgatattaagtttattaaaatcgagacgttgcgtttcgtttataattatatttgggttttggtcgagatattgcgtttggcggattaagggttgttcggaggcggtgttcgggagcgttttttgtcgtcgtagtgcgttttttgtttgttcggttttttaagtttcgttagcgacgcggagttttggggtttaggtgtcgtcgtcgttttttcgttttttgattttagtagtttagtcgttttcgaagattttatttatcgtt

SEQ ID NO: 3184 - DNA, 778 bp, Artificial Sequence
  chemically treated genomic DNA (Homo sapiens) CpG-island No: 3184
aacgataaataaaatcttcgaaaacgactaaactactaaaatcaaaaaacgaaaaaacgacgacgacacctaaaccccaaaactccgcgtcgctaacgaaacttaaaaaaccgaacaaacaaaaaacgcactacgacgacaaaaaacgctcccgaacaccgcctccgaacaacccttaatccgccaaacgcaatatctcgaccaaaacccaaatataattataaacgaaacgcaacgtctcgattttaataaacttaatatcgtcgaaaaacgaaaacaacacgctacgcaatacgtccaaaaccgcgttcaaattatacatacgattacgctcgcgatcgttaaccttaacgcgccgactcctacgcaacgaatacaacaacgcctcgaaacgaacccgcgtccgaccgcgacgccgccgcctctcctactcgtcgtcctatacccctaaaacctcaaacgcccgaaaaatattaaacgcgcccctacgaaccgacgcgaacgaccccgaaacgaaaactacctattaaaatctaacacaatcttcctcgtcgataaaaaaaccgaataaatcactaccgctactactaacgcaatcgaaatcgaaaatacaaatctcaaaacgaactaacatcgttacgctatacaaaaccgacgaacaaataaaaaaacgctcaaaacgctacaacccgaactaaaaacaaaaccgccaaaacgcacttacgttcccaacaacctaaaattattactctataccaattacgaatacgaaaaccta

SEQ ID NO: 3185 - DNA, 526 bp, Artificial Sequence
  chemically treated genomic DNA (Homo sapiens) CpG-island No: 3185
ttacgcgttcggtcggttttttgagtgatgtcgtcggcgattagattagttcgtgtgagtatcgagtgtggtatacgattggttttaggattttttaagtattcggcgtaataatgggcgttttttttttttgttattttcgttttcgcggtagttcgggtgaatggagcgaggcggtaggttattttcgtgtagcgttcgggtatttgtataatttatgttcgcgggaggtcgttatcgttttttttttaattcggagtgtgttcgtaattatcgtcggttaatcggcggcgtcgcgcggtttcgggagtcggttcgggttaagttggttagggcgtttttaggtagtgaaatagaggcggggtcggcgggcgattagcggtcgaggtacgttttttttggggcgggttgggcgtttttcgttggggtgggacggggaggcggggcgcgagcgcgaaagtgtgagtcgtttagtgagttgcggaaatttggagggtatttggagtttgggttcgtattttttttt

SEQ ID NO: 3186 - DNA, 526 bp, Artificial Sequence
  chemically treated genomic DNA (Homo sapiens) CpG-island No: 3186
aaaaaaaaatacgaacccaaactccaaataccctccaaatttccgcaactcactaaacgactcacactttcgcgctcgcgccccgcctccccgtcccaccccaacgaaaaacgcccaacccgccccaaaaaaaacgtacctcgaccgctaatcgcccgccgaccccgcctctatttcactacctaaaaacgccctaaccaacttaacccgaaccgactcccgaaaccgcgcgacgccgccgattaaccgacgataattacgaacacactccgaattaaaaaaaaaacgataacgacctcccgcgaacataaattatacaaatacccgaacgctacacgaaaataacctaccgcctcgctccattcacccgaactaccgcgaaaacgaaaataacaaaaaaaaaaaacgcccattattacgccgaatacttaaaaaatcctaaaaccaatcgtataccacactcgatactcacacgaactaatctaatcgccgacgacatcactcaaaaaaccgaccgaacgcgtaa

SEQ ID NO: 3187 - DNA, 526 bp, Artificial Sequence
  chemically treated genomic DNA (Homo sapiens) CpG-island No: 3187
gagaggggatgcgaatttaaattttaagtattttttaggttttcgtaatttattgggcggtttatattttcgcgttcgcgtttcgttttttcgttttattttagcgaggggcgtttagttcgttttaagaggagcgtgtttcggtcgttaatcgttcgtcgatttcgtttttgttttattgtttggagacgttttggttagtttagttcgagtcgattttcggggtcgcgcgacgtcgtcgattggtcggcggtaattacgggtatatttcgggttgggggaggggcgatggcggtttttcgcgagtataaattatgtaaatattcgggcgttgtacggggatgatttgtcgtttcgttttatttattcgggttgtcgcgggggcggaggtggtaagggaggggggcgtttattgttgcgtcgggtatttaaggggttttgaggttagtcgtgtgttatattcggtgtttatacgagttgatttgatcgtcggcgatattatttaggagatcggtcgggcgcgtgg

SEQ ID NO: 3188 - DNA, 526 bp, Artificial Sequence
  chemically treated genomic DNA (Homo sapiens) CpG-island No: 3188
ccacgcgcccgaccgatctcctaaataatatcgccgacgatcaaatcaactcgtataaacaccgaatataacacacgactaacctcaaaaccccttaaatacccgacgcaacaataaacgcccccctcccttaccacctccgcccccgcgacaacccgaataaataaaacgaaacgacaaatcatccccgtacaacgcccgaatatttacataatttatactcgcgaaaaaccgccatcgcccctcccccaacccgaaatatacccgtaattaccgccgaccaatcgacgacgtcgcgcgaccccgaaaatcgactcgaactaaactaaccaaaacgtctccaaacaataaaacaaaaacgaaatcgacgaacgattaacgaccgaaacacgctcctcttaaaacgaactaaacgcccctcgctaaaataaaacgaaaaaacgaaacgcgaacgcgaaaatataaaccgcccaataaattacgaaaacctaaaaaatacttaaaatttaaattcgcatcccctctc

SEQ ID NO: 3189 - DNA, 634 bp, Artificial Sequence
  chemically treated genomic DNA (Homo sapiens) CpG-island No: 3189
ttttcgtatttatcgtttatacgcgcggtgtatagcgttagtagtagtaggagtagcgcggtcgttaggagttttatgttgatcggaggggcgcggcgtgggagtagggatatggggagggcgttggttcgtcggagcggcggttcggagacgttatttagttttgttcggttttttttgttcggggcgcgtttttcggttttgttggtttcggttgcgtcgtcggtggatgtttagggttgtttgtggtcgtgcgttgcgttttgcgtttgttttcgcgttttttttatagttttttttcgttcgttttggttttttttaaattcgtttttgttttcgtagcgagcgagtttattaatatgtagaattattcggtgatttattgagattttttaatgtggtgaggggaggagatttttttagttcgttcgtcgttcgtttcgggaaaggattcgttatcgtagcggcgtatattcggagttacgcgcgtatacgtatatatatattcgttattttttcgtttatataatacgtcgttttcgtatatttgtatatttatattatagcgcgtatatatttttagcgtttcgttttgtttttggggagtttagacggtggagaggttgttgaaggg

SEQ ID NO: 3190 - DNA, 634 bp, Artificial Sequence
  chemically treated genomic DNA (Homo sapiens) CpG-island No: 3190
cccttcaacaacctctccaccgtctaaactccccaaaaacaaaacgaaacgctaaaaatatatacgcgctataatataaatatacaaatatacgaaaacgacgtattatataaacgaaaaaataacgaatatatatatacgtatacgcgcgtaactccgaatatacgccgctacgataacgaatcctttcccgaaacgaacgacgaacgaactaaaaaaatctcctcccctcaccacattaaaaaatctcaataaatcaccgaataattctacatattaataaactcgctcgctacgaaaacaaaaacgaatttaaaaaaaaccaaaacgaacgaaaaaaaactataaaaaaaacgcgaaaacaaacgcaaaacgcaacgcacgaccacaaacaaccctaaacatccaccgacgacgcaaccgaaaccaacaaaaccgaaaaacgcgccccgaacaaaaaaaaccgaacaaaactaaataacgtctccgaaccgccgctccgacgaaccaacgccctccccatatccctactcccacgccgcgcccctccgatcaacataaaactcctaacgaccgcgctactcctactactactaacgctatacaccgcgcgtataaacgataaatacgaaaa

SEQ ID NO: 3191 - DNA, 634 bp, Artificial Sequence
  chemically treated genomic DNA (Homo sapiens) CpG-island No: 3191
ttttttagtagtttttttatcgtttgggttttttaaaggtagagcgggacgttggaaatgtgtgcgcgttgtggtatgggtgtgtaagtgtgcgaaggcggcgtgttgtgtgagcgagagggtagcggatgtgtgtgtgcgtgtgcgcgcgtggtttcgggtgtgcgtcgttgcgatagcgggttttttttcggggcgggcgacgggcgggttgggaaggttttttttttttattatattgagaaattttagtgagttatcgagtggttttgtatattaatgagttcgttcgttgcgagggtaggagcggatttaaaagaggttagggcgggcggagggaggttgtggagagagcgcggagataagcgtagagcgtagcgtacggttatagatagttttgggtatttatcgacggcgtagtcggagttagtagagtcggaaggcgcgtttcgggtagagaaagtcgagtagagttgggtggcgttttcgggtcgtcgtttcgacgggttagcgttttttttatgtttttgtttttacgtcgcgttttttcggttagtatgaggtttttggcggtcgcgttgtttttgttgttgttggcgttgtatatcgcgcgtgtggacggtgagtgcgggga

SEQ ID NO: 3192 - DNA, 634 bp, Artificial Sequence
  chemically treated genomic DNA (Homo sapiens) CpG-island No: 3192
tccccgcactcaccgtccacacgcgcgatatacaacgccaacaacaacaaaaacaacgcgaccgccaaaaacctcatactaaccgaaaaaacgcgacgtaaaaacaaaaacataaaaaaaacgctaacccgtcgaaacgacgacccgaaaacgccacccaactctactcgactttctctacccgaaacgcgccttccgactctactaactccgactacgccgtcgataaatacccaaaactatctataaccgtacgctacgctctacgcttatctccgcgctctctccacaacctccctccgcccgccctaacctcttttaaatccgctcctaccctcgcaacgaacgaactcattaatatacaaaaccactcgataactcactaaaatttctcaatataataaaaaaaaaaaaccttcccaacccgcccgtcgcccgccccgaaaaaaaacccgctatcgcaacgacgcacacccgaaaccacgcgcgcacacgcacacacacatccgctaccctctcgctcacacaacacgccgccttcgcacacttacacacccataccacaacgcgcacacatttccaacgtcccgctctacctttaaaaaacccaaacgataaaaaaactactaaaaaa

SEQ ID NO: 3193 - DNA, 534 bp, Artificial Sequence
  chemically treated genomic DNA (Homo sapiens) CpG-island No: 3193
tacgatcgtttcggttgttttttcgggttcgtttttattttagttcggtttttgcggtttagagtgacgttggttgtttggacgttttttatttcggtttaggagtttcgggaggcgttatatgtcgttgttagtattatagagagttcgtagtcgaaagcgcgagattaatttttgggatagcggttagaaaggtcgtcgcgatgtttcgagtggtcgagtattcgaggaagttttgagttggttaattagaagggagttcggtcggaaagacggcgttgtagagaggaagtgtagggcggaggcgtattcggggttagcggggcggtgacgtgcggtaagggtatggggatgtgggtttaggttttcgtgggggatgtttttggcgtttttaagtcgaggtaggggatcgtaggtggcgaagcgagttattcggaagcgggattttcgggaagtggggttggagcggttttagggaagtaagaggattttgtagatcgtgaggtcgcgaattaggaaaggtttttttaggtt

SEQ ID NO: 3194 - DNA, 534 bp, Artificial Sequence
  chemically treated genomic DNA (Homo sapiens) CpG-island No: 3194
aacctaaaaaaacctttcctaattcgcgacctcacgatctacaaaatcctcttacttccctaaaaccgctccaaccccacttcccgaaaatcccgcttccgaataactcgcttcgccacctacgatcccctacctcgacttaaaaacgccaaaaacatcccccacgaaaacctaaacccacatccccatacccttaccgcacgtcaccgccccgctaaccccgaatacgcctccgccctacacttcctctctacaacgccgtctttccgaccgaactcccttctaattaaccaactcaaaacttcctcgaatactcgaccactcgaaacatcgcgacgacctttctaaccgctatcccaaaaattaatctcgcgctttcgactacgaactctctataatactaacaacgacatataacgcctcccgaaactcctaaaccgaaataaaaaacgtccaaacaaccaacgtcactctaaaccgcaaaaaccgaactaaaataaaaacgaacccgaaaaaacaaccgaaacgatcgta

SEQ ID NO: 3195 - DNA, 534 bp, Artificial Sequence
  chemically treated genomic DNA (Homo sapiens) CpG-island No: 3195
ggtttggagaagttttttttggttcgcggttttacggtttgtaaggtttttttatttttttgaagtcgttttagttttatttttcgaaggtttcgttttcgggtggttcgtttcgttatttgcggttttttgtttcggtttgggaacgttaaggatattttttacggaagtttgggtttatatttttatgtttttgtcgtacgttatcgtttcgttggtttcgaatacgttttcgttttgtattttttttttgtagcgtcgttttttcggtcgggtttttttttaattggttagtttagagttttttcgggtattcggttattcggggtatcgcggcggtttttttagtcgttgttttaagggttggtttcgcgttttcggttgcgagttttttgtggtgttggtagcgatatgtggcgtttttcgggatttttgggtcgaggtaagggacgtttaagtaattagcgttattttgggtcgtaaagatcgaattggagtgggggcgggttcgaggaaatagtcgaagcgatcgtg

SEQ ID NO: 3196 - DNA, 534 bp, Artificial Sequence
  chemically treated genomic DNA (Homo sapiens) CpG-island No: 3196
cacgatcgcttcgactatttcctcgaacccgcccccactccaattcgatctttacgacccaaaataacgctaattacttaaacgtcccttacctcgacccaaaaatcccgaaaaacgccacatatcgctaccaacaccacaaaaaactcgcaaccgaaaacgcgaaaccaacccttaaaacaacgactaaaaaaaccgccgcgataccccgaataaccgaatacccgaaaaaactctaaactaaccaattaaaaaaaaacccgaccgaaaaaacgacgctacaaaaaaaaaatacaaaacgaaaacgtattcgaaaccaacgaaacgataacgtacgacaaaaacataaaaatataaacccaaacttccgtaaaaaatatccttaacgttcccaaaccgaaacaaaaaaccgcaaataacgaaacgaaccacccgaaaacgaaaccttcgaaaaataaaactaaaacgacttcaaaaaaataaaaaaaccttacaaaccgtaaaaccgcgaaccaaaaaaaacttctccaaacc

SEQ ID NO: 3197 - DNA, 750 bp, Artificial Sequence
  chemically treated genomic DNA (Homo sapiens) CpG-island No: 3197
ggagtatttgtagcgtggcggtggtcgagcgcggaggttcgttattgtttttgattagtattattagtttgtgtttggttacgtcgcgttcgtttagtagtttggcggtgcgtatttcgttattgtgcgtttatacgtcgaatagttcgggtttcgtggttttgagtagttggtacgatagttaggcgttttggttcgagtcgtcgtttatcgttattattttggttattaggtagttcggttcggtcgttcggggtattagttcggtgtagggcgcggagtcgttttgtagcgggtatagtacgaagggcgagttgtcgttggcgtttagtattagtattcgtattagcgtttcgttgtttagcgtcgggaagtcgcggtttgtggcgtttacgcggaattcgaaagtttgtagggtttcgtagtttagcgattggagagcgaataggtggtcgttgttcgtgttaatggagattagggaggtgaggggtaggtgcgggtttcggggcggtagtagcgagtaggtgatttgggcgttggtgttcgagtttttgtttgtggcgttgatattgtcgatgtgtagggcggggttgttgttttcgcggacgaatagggtgtaggaggtttgggtgaaggcgggggcgttgttattgacgttcgatattagtacggttatgttttgttcggtttttagttttggagtttttaagtttgtgatggtgatggtgatgttgtattcggttttggttt

SEQ ID NO: 3198 - DNA, 750 bp, Artificial Sequence
  chemically treated genomic DNA (Homo sapiens) CpG-island No: 3198
aaaccaaaaccgaatacaacatcaccatcaccatcacaaacttaaaaactccaaaactaaaaaccgaacaaaacataaccgtactaatatcgaacgtcaataacaacgcccccgccttcacccaaacctcctacaccctattcgtccgcgaaaacaacaaccccgccctacacatcgacaatatcaacgccacaaacaaaaactcgaacaccaacgcccaaatcacctactcgctactaccgccccgaaacccgcacctacccctcacctccctaatctccattaacacgaacaacgaccacctattcgctctccaatcgctaaactacgaaaccctacaaactttcgaattccgcgtaaacgccacaaaccgcgacttcccgacgctaaacaacgaaacgctaatacgaatactaatactaaacgccaacgacaactcgcccttcgtactatacccgctacaaaacgactccgcgccctacaccgaactaataccccgaacgaccgaaccgaactacctaataaccaaaataataacgataaacgacgactcgaaccaaaacgcctaactatcgtaccaactactcaaaaccacgaaacccgaactattcgacgtataaacgcacaataacgaaatacgcaccgccaaactactaaacgaacgcgacgtaaccaaacacaaactaataatactaatcaaaaacaataacgaacctccgcgctcgaccaccgccacgctacaaatactcc

SEQ ID NO: 3199 - DNA, 750 bp, Artificial Sequence
  chemically treated genomic DNA (Homo sapiens) CpG-island No: 3199
agattagagtcgagtataatattattattattattatagatttggggattttaaggttgaaaatcgagtagagtataatcgtgttggtgtcggacgttaatgataacgttttcgtttttatttaaattttttatattttgttcgttcgcgagaataatagtttcgttttgtatatcggtagtgttagcgttatagatagagattcgggtattaacgtttaggttatttattcgttgttgtcgtttcgggattcgtatttgttttttatttttttggtttttattaatacggataacggttatttgttcgttttttagtcgttggattacgaggttttgtaggttttcgagtttcgcgtgggcgttatagatcgcggtttttcggcgttgagtagcgaggcgttggtgcgagtgttggtgttggacgttaacgataattcgtttttcgtgttgtattcgttgtagaacggtttcgcgttttgtatcgagttggtgtttcgggcggtcgagtcgggttatttggtgattaaggtggtggcggtggacggcgattcgggttagaacgtttggttgtcgtattagttgtttaaggttacggagttcgggttgttcggcgtgtgggcgtataatggcgaggtgcgtatcgttaggttgttgagcgagcgcgacgtggttaagtataggttagtggtgttggttaaggataatggcgagttttcgcgttcggttatcgttacgttgtaagtgtttt

SEQ ID NO: 3200 - DNA, 750 bp, Artificial Sequence
  chemically treated genomic DNA (Homo sapiens) CpG-island No: 3200
aaaacacttacaacgtaacgataaccgaacgcgaaaactcgccattatccttaaccaacaccactaacctatacttaaccacgtcgcgctcgctcaacaacctaacgatacgcacctcgccattatacgcccacacgccgaacaacccgaactccgtaaccttaaacaactaatacgacaaccaaacgttctaacccgaatcgccgtccaccgccaccaccttaatcaccaaataacccgactcgaccgcccgaaacaccaactcgatacaaaacgcgaaaccgttctacaacgaatacaacacgaaaaacgaattatcgttaacgtccaacaccaacactcgcaccaacgcctcgctactcaacgccgaaaaaccgcgatctataacgcccacgcgaaactcgaaaacctacaaaacctcgtaatccaacgactaaaaaacgaacaaataaccgttatccgtattaataaaaaccaaaaaaataaaaaacaaatacgaatcccgaaacgacaacaacgaataaataacctaaacgttaatacccgaatctctatctataacgctaacactaccgatatacaaaacgaaactattattctcgcgaacgaacaaaatataaaaaatttaaataaaaacgaaaacgttatcattaacgtccgacaccaacacgattatactctactcgattttcaaccttaaaatccccaaatctataataataataataatattatactcgactctaatct

SEQ ID NO: 3201 - DNA, 537 bp, Artificial Sequence
  chemically treated genomic DNA (Homo sapiens) CpG-island No: 3201
taattgttacgatagttaggcgttttggttcgagttatcgtttatcgttattattttggttattaggtagttcggttcggcggttcgttcggggtattagttcggtgtagggcgcggagtcgttttgtagcgggaatagtacgaagagtgagttgtcgttggcgtttagtattagtacgcgtattagcgtttcgttgtttagcgtcgtggagtcgcggtttgaagcgtttacgcggaattcgaatttttgtagggtttcgtagtttagcgatttgagggcgaataggtggtcgttgtttgtgttgatggagattagggaggcgaggggtaggtgcgggtttcggggcggtagtagcgagtaggtgatttggatgttggtgttcgagtttttgcggtgttgacgttgttaatatgtagggcggggttgttgttttcgcggacgaatagggtgtaggaggtttaggtgaaggtgggggttttgttattgacgtaggagattagtatcgttatgttgtattcggtttttagtttaggagt

SEQ ID NO: 3202 - DNA, 537 bp, Artificial Sequence
  chemically treated genomic DNA (Homo sapiens) CpG-island No: 3202
actcctaaactaaaaaccgaatacaacataacgatactaatctcctacgtcaataacaaaacccccaccttcacctaaacctcctacaccctattcgtccgcgaaaacaacaaccccgccctacatattaacaacgtcaacaccgcaaaaactcgaacaccaacatccaaatcacctactcgctactaccgccccgaaacccgcacctacccctcgcctccctaatctccatcaacacaaacaacgaccacctattcgccctcaaatcgctaaactacgaaaccctacaaaaattcgaattccgcgtaaacgcttcaaaccgcgactccacgacgctaaacaacgaaacgctaatacgcgtactaatactaaacgccaacgacaactcactcttcgtactattcccgctacaaaacgactccgcgccctacaccgaactaataccccgaacgaaccgccgaaccgaactacctaataaccaaaataataacgataaacgataactcgaaccaaaacgcctaactatcgtaacaatta

SEQ ID NO: 3203 - DNA, 537 bp, Artificial Sequence
  chemically treated genomic DNA (Homo sapiens) CpG-island No: 3203
atttttaggttgaaaatcgagtataatataacggtgttggttttttacgttaatgataaagtttttatttttatttaaattttttatattttgttcgttcgcgagaataatagtttcgttttgtatattggtagcgttagtatcgtagagattcgggtattaatatttaggttatttattcgttgttgtcgtttcggaattcgtatttgtttttcgtttttttggtttttattaatatagataacggttatttgttcgtttttaggtcgttggattacgaggttttgtaggagttcgagtttcgcgtgggcgttttagatcgcggttttacggcgttgagtagcgaggcgttggtgcgcgtgttggtgttggacgttaacgatagtttatttttcgtgttgttttcgttgtagaacggtttcgcgttttgtatcgagttgatgtttcgggcgggtcgtcgagtcgggttatttggtgattaaggtggtggcggtggacggtgattcgggttagaacgtttggttgtcgtagtagttg

SEQ ID NO: 3204 - DNA, 537 bp, Artificial Sequence
  chemically treated genomic DNA (Homo sapiens) CpG-island No: 3204
caactactacgacaaccaaacgttctaacccgaatcaccgtccaccgccaccaccttaatcaccaaataacccgactcgacgacccgcccgaaacatcaactcgatacaaaacgcgaaaccgttctacaacgaaaacaacacgaaaaataaactatcgttaacgtccaacaccaacacgcgcaccaacgcctcgctactcaacgccgtaaaaccgcgatctaaaacgcccacgcgaaactcgaactcctacaaaacctcgtaatccaacgacctaaaaacgaacaaataaccgttatctatattaataaaaaccaaaaaaacgaaaaacaaatacgaattccgaaacgacaacaacgaataaataacctaaatattaatacccgaatctctacgatactaacgctaccaatatacaaaacgaaactattattctcgcgaacgaacaaaatataaaaaatttaaataaaaataaaaactttatcattaacgtaaaaaaccaacaccgttatattatactcgattttcaacctaaaaat

SEQ ID NO: 3205 - DNA, 524 bp, Artificial Sequence
  chemically treated genomic DNA (Homo sapiens) CpG-island No: 3205
ggaggttcgttattgtttttgattagtattattagtttgtgtttggtcgcgtcgcgttcgtttagtagtttggcggtgcgtttttcgttattgtgcgtttatacgtcgaatagttcgggtttcgtggttttgagtagttggtacgatagttaggcgttttggttcgagtcgtcgtttatcgttattattttggttattaggtagttcggttcggtcgttcgaggtattagttcggtgtagggcgtcgagtcgttttgtagcgggtatagtacgaagggcgagttgtcgttggcgtttagtattagtacgcgtattagtatttcgttgtttagcgtcggggagtcgtggtttgcggcgtttacgcgaaattcgaatttttgtagggtttcgtagtttaaagatttgagggcgaataggtggtcgttgttcgcgttgatggagattagggaggtgaggggtaggtgcgggttttggggcggtagtagcgagtaggtgatttgggcgttggtgtttgagtttttgtt

SEQ ID NO: 3206 - DNA, 524 bp, Artificial Sequence
  chemically treated genomic DNA (Homo sapiens) CpG-island No: 3206
aacaaaaactcaaacaccaacgcccaaatcacctactcgctactaccgccccaaaacccgcacctacccctcacctccctaatctccatcaacgcgaacaacgaccacctattcgccctcaaatctttaaactacgaaaccctacaaaaattcgaatttcgcgtaaacgccgcaaaccacgactccccgacgctaaacaacgaaatactaatacgcgtactaatactaaacgccaacgacaactcgcccttcgtactatacccgctacaaaacgactcgacgccctacaccgaactaatacctcgaacgaccgaaccgaactacctaataaccaaaataataacgataaacgacgactcgaaccaaaacgcctaactatcgtaccaactactcaaaaccacgaaacccgaactattcgacgtataaacgcacaataacgaaaaacgcaccgccaaactactaaacgaacgcgacgcgaccaaacacaaactaataatactaatcaaaaacaataacgaacctcc

SEQ ID NO: 3207 - DNA, 524 bp, Artificial Sequence
  chemically treated genomic DNA (Homo sapiens) CpG-island No: 3207
gatagagatttaggtattaacgtttaggttatttattcgttgttgtcgttttaggattcgtatttgttttttatttttttggtttttattaacgcggataacggttatttattcgtttttaggtttttggattacgaggttttgtaggagttcgggtttcgcgtgggcgtcgtagattacggtttttcggcgttgagtagcgaggtgttggtgcgcgtgttggtgttggacgttaacgataattcgtttttcgtgttgtattcgttgtagaacggttcggcgttttgtatcgagttggtatttcgggcggtcgagtcgggttatttggtgattaaggtggtggcggtggacggcgattcgggttagaacgtttggttgtcgtattagttgtttaaggttacggagttcgggttgttcggcgtgtgggcgtataatggcgaggggcgtatcgttaggttgttgagcgagcgcgacgcggttaagtataggttggtggtgttggttaaggataatggcgagttttt

SEQ ID NO: 3208 - DNA, 524 bp, Artificial Sequence
  chemically treated genomic DNA (Homo sapiens) CpG-island No: 3208
aaaaactcgccattatccttaaccaacaccaccaacctatacttaaccgcgtcgcgctcgctcaacaacctaacgatacgcccctcgccattatacgcccacacgccgaacaacccgaactccgtaaccttaaacaactaatacgacaaccaaacgttctaacccgaatcgccgtccaccgccaccaccttaatcaccaaataacccgactcgaccgcccgaaataccaactcgatacaaaacgccgaaccgttctacaacgaatacaacacgaaaaacgaattatcgttaacgtccaacaccaacacgcgcaccaacacctcgctactcaacgccgaaaaaccgtaatctacgacgcccacgcgaaacccgaactcctacaaaacctcgtaatccaaaaacctaaaaacgaataaataaccgttatccgcgttaataaaaaccaaaaaaataaaaaacaaatacgaatcctaaaacgacaacaacgaataaataacctaaacgttaatacctaaatctctatc

SEQ ID NO: 3209 - DNA, 768 bp, Artificial Sequence
  chemically treated genomic DNA (Homo sapiens) CpG-island No: 3209
gtagcgtggcggtggtcgagcgaggaggttcgttattgtttttgattagtattattagtttgtgtttggtcgcgtcgcgttcgtttagtagtttggcggtgcgtatttcgttattgtgcgtttatacgtcgaatagttcgggtttcgtggttttgagtagttggtacgatagttaggcgttttggttcgagtcgtcgtttatcgttattattttggttattaggtagttcggttcggtcgttcggggtattagttcggtgtagggcgcggagtcgttttgtagcgggtatagtacgaagggcgagttgtcgttggcgtttagtattagtacgcgtattagcgtttcgttgtttaacgtcggggattcgcggtttgtggcgtttacgcgaaattcgaatttttgtagggtttcgtagtttagcgatttgagggtaaataggtggttattgttcgcgttgatggagattaaggaggcgaggggtaggtgtcggttttggggcggtagtagcgagtagttgatttgggcgttggtgtttgagtttttgtttgtggcgttgacgttgtcgatgtgtagggcggggttgttgttttcgcggacgaatagggtgtaggaggtttgggtgaaggtgggggcgttgttattgacgttagagagtagtacggttatgttgtattcggtttttagtttgggtgtttttaagtttgtgacggtgatcgtgatgttgtattcggtttggttttttttgtttagtgtttttttagaaatta

SEQ ID NO: 3210 - DNA, 768 bp, Artificial Sequence
  chemically treated genomic DNA (Homo sapiens) CpG-island No: 3210
taatttctaaaaaaacactaaacaaaaaaaaccaaaccgaatacaacatcacgatcaccgtcacaaacttaaaaacacccaaactaaaaaccgaatacaacataaccgtactactctctaacgtcaataacaacgcccccaccttcacccaaacctcctacaccctattcgtccgcgaaaacaacaaccccgccctacacatcgacaacgtcaacgccacaaacaaaaactcaaacaccaacgcccaaatcaactactcgctactaccgccccaaaaccgacacctacccctcgcctccttaatctccatcaacgcgaacaataaccacctatttaccctcaaatcgctaaactacgaaaccctacaaaaattcgaatttcgcgtaaacgccacaaaccgcgaatccccgacgttaaacaacgaaacgctaatacgcgtactaatactaaacgccaacgacaactcgcccttcgtactatacccgctacaaaacgactccgcgccctacaccgaactaataccccgaacgaccgaaccgaactacctaataaccaaaataataacgataaacgacgactcgaaccaaaacgcctaactatcgtaccaactactcaaaaccacgaaacccgaactattcgacgtataaacgcacaataacgaaatacgcaccgccaaactactaaacgaacgcgacgcgaccaaacacaaactaataatactaatcaaaaacaataacgaacctcctcgctcgaccaccgccacgctac

SEQ ID NO: 3211 - DNA, 768 bp, Artificial Sequence
  chemically treated genomic DNA (Homo sapiens) CpG-island No: 3211
tagtttttgaaaaagtattggatagagagagttaagtcgagtataatattacgattatcgttatagatttggggatatttaggttgaaaatcgagtataatataatcgtgttgttttttgacgttaatgataacgtttttatttttatttaaattttttatattttgttcgttcgcgagaataatagtttcgttttgtatatcggtagcgttagcgttatagatagagatttaggtattaacgtttaggttaattattcgttgttgtcgttttaggatcggtatttgtttttcgtttttttggtttttattaacgcggataatggttatttgtttgtttttaggtcgttggattacgaggttttataggagttcgagtttcgcgtgggcgttatagatcgcgggttttcggcgttgagtagcgaggcgttggtgcgcgtgttggtgttggacgttaacgataattcgtttttcgtgttgtattcgttgtagaacggtttcgcgttttgtatcgagttggtgtttcgggcggtcgagtcgggttatttggtgattaaggtggtggcggtggacggcgattcgggttagaacgtttggttgtcgtattagttgtttaaggttacggagttcgggttgttcggcgtgtgggcgtataatggcgaggtgcgtatcgttaggttgttgagcgagcgcgacgcggttaagtataggttggtggtgttggttaaggataatggcgagttttttcgttcggttatcgttacgttgt

SEQ ID NO: 3212 - DNA, 768 bp, Artificial Sequence
  chemically treated genomic DNA (Homo sapiens) CpG-island No: 3212
acaacgtaacgataaccgaacgaaaaaactcgccattatccttaaccaacaccaccaacctatacttaaccgcgtcgcgctcgctcaacaacctaacgatacgcacctcgccattatacgcccacacgccgaacaacccgaactccgtaaccttaaacaactaatacgacaaccaaacgttctaacccgaatcgccgtccaccgccaccaccttaatcaccaaataacccgactcgaccgcccgaaacaccaactcgatacaaaacgcgaaaccgttctacaacgaatacaacacgaaaaacgaattatcgttaacgtccaacaccaacacgcgcaccaacgcctcgctactcaacgccgaaaacccgcgatctataacgcccacgcgaaactcgaactcctataaaacctcgtaatccaacgacctaaaaacaaacaaataaccattatccgcgttaataaaaaccaaaaaaacgaaaaacaaataccgatcctaaaacgacaacaacgaataattaacctaaacgttaatacctaaatctctatctataacgctaacgctaccgatatacaaaacgaaactattattctcgcgaacgaacaaaatataaaaaatttaaataaaaataaaaacgttatcattaacgtcaaaaaacaacacgattatattatactcgattttcaacctaaatatccccaaatctataacgataatcgtaatattatactcgacttaactctctctatccaatactttttcaaaaacta

SEQ ID NO: 3213 - DNA, 774 bp, Artificial Sequence
  chemically treated genomic DNA (Homo sapiens) CpG-island No: 3213
tgtagcgtggcggtggtcgagcgcggaggttcgttattgtttttgattagtattattagtttgtgtttggtcgcgtcgcgttcgtttagtagtttggcggtgcgtatttcgttattgtgcgtttatacgtcgaatagttcgggtttcgtggttttgagtagttggtacgatagttaggcgttttggttcgagttatcgtttatcgttattattttggttattaggtagttcggttcggtcgtttagggtattagttcggtgtagggcgcggagtcgttttgtagcgggtatagtacgaagggcgagttgtcgttggcgtttagtattagtacgcgtattagcgtttcgttgtttaaagtcggggagtcgtggtttgtggcgtttacgcggaattggaatttttgtagggtttcgtagtttagcgatttgagggtaaataggtggtcgttgttcgcgttgatggagattagggaggcgaggggtaggtgcgggttttgggacggtagtagcgagtagttgatttgggcgttggtgttcgagtttttgtttgtggcgttgatgttgtcgatgtgtagggcggggttgttgttttcgcggacgaatagggcgtaggaagtttgggtgaaggcgggggcgttgttattgacgtcggagattagtacggttatgttgtgttcggtttttagtttgggggtttttaagtcggtgacggtgatggtgatgttgtattcggttttgttttttttgtttagcggtttttttgtttttaaagtg

SEQ ID NO: 3214 - DNA, 774 bp, Artificial Sequence
  chemically treated genomic DNA (Homo sapiens) CpG-island No: 3214
cactttaaaaacaaaaaaaccgctaaacaaaaaaaacaaaaccgaatacaacatcaccatcaccgtcaccgacttaaaaacccccaaactaaaaaccgaacacaacataaccgtactaatctccgacgtcaataacaacgcccccgccttcacccaaacttcctacgccctattcgtccgcgaaaacaacaaccccgccctacacatcgacaacatcaacgccacaaacaaaaactcgaacaccaacgcccaaatcaactactcgctactaccgtcccaaaacccgcacctacccctcgcctccctaatctccatcaacgcgaacaacgaccacctatttaccctcaaatcgctaaactacgaaaccctacaaaaattccaattccgcgtaaacgccacaaaccacgactccccgactttaaacaacgaaacgctaatacgcgtactaatactaaacgccaacgacaactcgcccttcgtactatacccgctacaaaacgactccgcgccctacaccgaactaataccctaaacgaccgaaccgaactacctaataaccaaaataataacgataaacgataactcgaaccaaaacgcctaactatcgtaccaactactcaaaaccacgaaacccgaactattcgacgtataaacgcacaataacgaaatacgcaccgccaaactactaaacgaacgcgacgcgaccaaacacaaactaataatactaatcaaaaacaataacgaacctccgcgctcgaccaccgccacgctaca

SEQ ID NO: 3215 - DNA, 774 bp, Artificial Sequence
  chemically treated genomic DNA (Homo sapiens) CpG-island No: 3215
tattttggaaatagagagatcgttggatagagagagtagagtcgagtataatattattattatcgttatcgatttggggatttttaggttaaaaatcgagtataatataatcgtgttggttttcgacgttaatgataacgttttcgtttttatttaaattttttacgttttgttcgttcgcgagaataatagtttcgttttgtatatcggtagtattagcgttatagatagagattcgggtattaacgtttaggttaattattcgttgttgtcgttttaggattcgtatttgtttttcgtttttttggtttttattaacgcggataacggttatttgtttgtttttaggtcgttggattacgaggttttgtaggggttttagtttcgcgtgggcgttatagattacggtttttcggttttgagtagcgaggcgttggtgcgcgtgttggtgttggacgttaacgataattcgtttttcgtgttgtattcgttgtagaacggtttcgcgttttgtatcgagttggtgttttgggcggtcgagtcgggttatttggtgattaaggtggtggcggtggacggtgattcgggttagaacgtttggttgtcgtattagttgtttaaggttacggagttcgggttattcggcgtgtgggcgtataatggcgaggtgcgtatcgttaggttgttgagcgagcgcgacgcggttaagtataggttggtggtgttggttaaggataatggcgagttttcgcgttcggttatcgttacgttgta

SEQ ID NO: 3216 - DNA, 774 bp, Artificial Sequence
  chemically treated genomic DNA (Homo sapiens) CpG-island No: 3216
tacaacgtaacgataaccgaacgcgaaaactcgccattatccttaaccaacaccaccaacctatacttaaccgcgtcgcgctcgctcaacaacctaacgatacgcacctcgccattatacgcccacacgccgaataacccgaactccgtaaccttaaacaactaatacgacaaccaaacgttctaacccgaatcaccgtccaccgccaccaccttaatcaccaaataacccgactcgaccgcccaaaacaccaactcgatacaaaacgcgaaaccgttctacaacgaatacaacacgaaaaacgaattatcgttaacgtccaacaccaacacgcgcaccaacgcctcgctactcaaaaccgaaaaaccgtaatctataacgcccacgcgaaactaaaacccctacaaaacctcgtaatccaacgacctaaaaacaaacaaataaccgttatccgcgttaataaaaaccaaaaaaacgaaaaacaaatacgaatcctaaaacgacaacaacgaataattaacctaaacgttaatacccgaatctctatctataacgctaatactaccgatatacaaaacgaaactattattctcgcgaacgaacaaaacgtaaaaaatttaaataaaaacgaaaacgttatcattaacgtcgaaaaccaacacgattatattatactcgatttttaacctaaaaatccccaaatcgataacgataataataatattatactcgactctactctctctatccaacgatctctctatttccaaaata

SEQ ID NO: 3217 - DNA, 770 bp, Artificial Sequence
  chemically treated genomic DNA (Homo sapiens) CpG-island No: 3217
cgtggcggtggtcgagcgaggaggttcgttattgtttttgataagtattacgagtttgtgtttggttgcgtcgcgttcgtttagtagtttggcggtgcgtatttttttattgtgcgtttatatatcgaatagttcgggtttcgtggttttgagtagttggtacgatagttaggcgttttggttcgagtcgtcgtttatcgttattattttggttattaggtagttcggttcggtcgttcggggtattagttcggtgtagggcgcggagtcgttttgtagcgggtatagtacgaagggcgagttgtcgttggcgtttagtattagtacgcgtattagcgtttttttgtttagcgcgggggagtcgcggtttgtggcgtttacgcggaattcgaaagtttgtagggtttcgtagtttagcgatttgagggcgaataggtggtcgttgttcgcgttgatggagattagggaggcgaggggtaggtgcgggttttggggcggtagtagcgagtaggtgatttgggcgttggtgttcgagtttttgtttgtggcgttgacgttgtcgatgtgtagggcggggttgttgttttcgcggacgaatagggtgtaggaggtttgggtgaaggcgggggcgttgttattgacgtcggagattaggatcgttatgttgtgttcggtttttagtttgggtgtttttaagttagtgacggtgatagtgatgttgtattcggttttgatttttttgtttagcgcgttttttgtaattaggatgt

SEQ ID NO: 3218 - DNA, 770 bp, Artificial Sequence
  chemically treated genomic DNA (Homo sapiens) CpG-island No: 3218
acatcctaattacaaaaaacgcgctaaacaaaaaaatcaaaaccgaatacaacatcactatcaccgtcactaacttaaaaacacccaaactaaaaaccgaacacaacataacgatcctaatctccgacgtcaataacaacgcccccgccttcacccaaacctcctacaccctattcgtccgcgaaaacaacaaccccgccctacacatcgacaacgtcaacgccacaaacaaaaactcgaacaccaacgcccaaatcacctactcgctactaccgccccaaaacccgcacctacccctcgcctccctaatctccatcaacgcgaacaacgaccacctattcgccctcaaatcgctaaactacgaaaccctacaaactttcgaattccgcgtaaacgccacaaaccgcgactcccccgcgctaaacaaaaaaacgctaatacgcgtactaatactaaacgccaacgacaactcgcccttcgtactatacccgctacaaaacgactccgcgccctacaccgaactaataccccgaacgaccgaaccgaactacctaataaccaaaataataacgataaacgacgactcgaaccaaaacgcctaactatcgtaccaactactcaaaaccacgaaacccgaactattcgatatataaacgcacaataaaaaaatacgcaccgccaaactactaaacgaacgcgacgcaaccaaacacaaactcgtaatacttatcaaaaacaataacgaacctcctcgctcgaccaccgccacg

SEQ ID NO: 3219 - DNA, 770 bp, Artificial Sequence
  chemically treated genomic DNA (Homo sapiens) CpG-island No: 3219
atattttaattatagaaggcgcgttggatagagagattagagtcgagtataatattattattatcgttattgatttggggatatttaggttgaaaatcgagtataatataacggttttggttttcgacgttaatgataacgttttcgtttttatttaaattttttatattttgttcgttcgcgagaataatagtttcgttttgtatatcggtagcgttagcgttatagatagagattcgggtattaacgtttaggttatttattcgttgttgtcgttttaagattcgtatttgtttttcgtttttttggtttttattaacgcggataacggttatttgttcgtttttaggtcgttggattacgaggttttgtaggttttcgagtttcgcgtgggcgttatagatcgcggttttttcgcgttgagtagagaggcgttggtgcgcgtgttggtgttggacgttaacgataattcgtttttcgtgttgtattcgttgtagaacggtttcgcgttttgtatcgagttggtgtttcgggcggtcgagtcgggttatttggtgattaaggtggtggcggtggacggcgattcgggttagaacgtttggttgtcgtattagttgtttaaggttacggagttcgggttgttcggtgtgtgggcgtataatggggaggtgcgtatcgttaggttgttgagcgagcgcgacgtagttaagtataggttcgtggtgtttgttaaggataatggcgagttttttcgttcggttatcgttacg

SEQ ID NO: 3220 - DNA, 770 bp, Artificial Sequence
  chemically treated genomic DNA (Homo sapiens) CpG-island No: 3220
cgtaacgataaccgaacgaaaaaactcgccattatccttaacaaacaccacgaacctatacttaactacgtcgcgctcgctcaacaacctaacgatacgcacctccccattatacgcccacacaccgaacaacccgaactccgtaaccttaaacaactaatacgacaaccaaacgttctaacccgaatcgccgtccaccgccaccaccttaatcaccaaataacccgactcgaccgcccgaaacaccaactcgatacaaaacgcgaaaccgttctacaacgaatacaacacgaaaaacgaattatcgttaacgtccaacaccaacacgcgcaccaacgcctctctactcaacgcgaaaaaaccgcgatctataacgcccacgcgaaactcgaaaacctacaaaacctcgtaatccaacgacctaaaaacgaacaaataaccgttatccgcgttaataaaaaccaaaaaaacgaaaaacaaatacgaatcttaaaacgacaacaacgaataaataacctaaacgttaatacccgaatctctatctataacgctaacgctaccgatatacaaaacgaaactattattctcgcgaacgaacaaaatataaaaaatttaaataaaaacgaaaacgttatcattaacgtcgaaaaccaaaaccgttatattatactcgattttcaacctaaatatccccaaatcaataacgataataataatattatactcgactctaatctctctatccaacgcgccttctataattaaaatat

SEQ ID NO: 3221 - DNA, 798 bp, Artificial Sequence
  chemically treated genomic DNA (Homo sapiens) CpG-island No: 3221
ttcgcgttaggttttcggcgcgttagatttcggttttgcgttttttattttttgtttcgttacgtttttaattgtagatttaattcgggttttttcgaaagtagtaaggagtttcggggtgggttttatgtttcgtgatgtttcgcgtttgggaacggatgaaggggtgttagtaattttcgtcgttttcgttgtcgattcgggtttatacgaggtttattcgggattagtttttgcggtcggttaattttagcggttggatcgatttcggggttcggagcgaggtttatatagtatcggtttagggagttagggcgcgggtcgagtaaaagcgcgcgacgttgggcgggtgtgggggtggggaggggcggaggagggagtaacgtttcgggaggcggggttaggaatcggttgattcggtttttgtttttcgattttttcggagcgggtgtttattcgggagtcggacggaggaggtcggggtcggtcgagttcggaaggggggaggggagcgtagtcggagatcgaggttgagattttttcggttttttttttttaaatcgatttttaattttcgtttttgagcgtgggagaacgcggtagatagatagatgtttttcgttttttattttatttagtttcgtaatttatattcgttgttaaagagtggggagcgggaatggatatattcgggaacgattgtacgttttgcgggcgttcggggaagaaggtagcgtagtataaaattttttttgcggttattttttattttattttgtatttgagtttttgcgggga

SEQ ID NO: 3222 - DNA, 798 bp, Artificial Sequence
  chemically treated genomic DNA (Homo sapiens) CpG-island No: 3222
tccccgcaaaaactcaaatacaaaataaaataaaaaataaccgcaaaaaaaattttatactacgctaccttcttccccgaacgcccgcaaaacgtacaatcgttcccgaatatatccattcccgctccccactctttaacaacgaatataaattacgaaactaaataaaataaaaaacgaaaaacatctatctatctaccgcgttctcccacgctcaaaaacgaaaattaaaaatcgatttaaaaaaaaaaaaccgaaaaaatctcaacctcgatctccgactacgctcccctccccccttccgaactcgaccgaccccgacctcctccgtccgactcccgaataaacacccgctccgaaaaaatcgaaaaacaaaaaccgaatcaaccgattcctaaccccgcctcccgaaacgttactccctcctccgcccctccccacccccacacccgcccaacgtcgcgcgcttttactcgacccgcgccctaactccctaaaccgatactatataaacctcgctccgaaccccgaaatcgatccaaccgctaaaattaaccgaccgcaaaaactaatcccgaataaacctcgtataaacccgaatcgacaacgaaaacgacgaaaattactaacaccccttcatccgttcccaaacgcgaaacatcacgaaacataaaacccaccccgaaactccttactactttcgaaaaaacccgaattaaatctacaattaaaaacgtaacgaaacaaaaaataaaaaacgcaaaaccgaaatctaacgcgccgaaaacctaacgcgaa

SEQ ID NO: 3223 - DNA, 798 bp, Artificial Sequence
  chemically treated genomic DNA (Homo sapiens) CpG-island No: 3223
ttttcgtaagaatttaggtgtaggatggggtgggaggtgatcgtaggagaggttttgtgttgcgttgttttttttttcgggcgttcgtaggacgtgtagtcgttttcgggtgtatttattttcgttttttattttttggtaacgagtgtgaattgcggaattggataggataaggggcgggagatatttgtttgtttgtcgcgtttttttacgtttaggaacgagggttggaagtcgatttaggggaaaggaatcgaaaaggttttagtttcggttttcgattgcgttttttttttttttttcgggttcgatcggtttcggtttttttcgttcggttttcgggtaaatattcgtttcggagaggtcggaaaatagagatcggattagtcggtttttggtttcgtttttcggggcgttgttttttttttcgtttttttttatttttatattcgtttagcgtcgcgcgtttttgttcgattcgcgttttagttttttaggtcggtattgtgtgggtttcgtttcggatttcggggtcggtttagtcgttgggattagtcgatcgtagggattaatttcggatgagtttcgtgtaaattcggatcgatagcggggacggcgggggttgttggtatttttttattcgtttttagacgcggagtattacggggtatagagtttatttcgaggttttttgttgttttcggagagattcgagttggatttgtagttgggggcgtggcggggtaggagatgaagaacgtagggtcgggatttgacgcgtcgagagtttggcgcggg

SEQ ID NO: 3224 - DNA, 798 bp, Artificial Sequence
  chemically treated genomic DNA (Homo sapiens) CpG-island No: 3224
cccgcgccaaactctcgacgcgtcaaatcccgaccctacgttcttcatctcctaccccgccacgcccccaactacaaatccaactcgaatctctccgaaaacaacaaaaaacctcgaaataaactctataccccgtaatactccgcgtctaaaaacgaataaaaaaataccaacaacccccgccgtccccgctatcgatccgaatttacacgaaactcatccgaaattaatccctacgatcgactaatcccaacgactaaaccgaccccgaaatccgaaacgaaacccacacaataccgacctaaaaaactaaaacgcgaatcgaacaaaaacgcgcgacgctaaacgaatataaaaataaaaaaaaacgaaaaaaaaaacaacgccccgaaaaacgaaaccaaaaaccgactaatccgatctctattttccgacctctccgaaacgaatatttacccgaaaaccgaacgaaaaaaaccgaaaccgatcgaacccgaaaaaaaaaaaaaaaacgcaatcgaaaaccgaaactaaaaccttttcgattcctttcccctaaatcgacttccaaccctcgttcctaaacgtaaaaaaacgcgacaaacaaacaaatatctcccgccccttatcctatccaattccgcaattcacactcgttaccaaaaaataaaaaacgaaaataaatacacccgaaaacgactacacgtcctacgaacgcccgaaaaaaaaaacaacgcaacacaaaacctctcctacgatcacctcccaccccatcctacacctaaattcttacgaaaa

SEQ ID NO: 3225 - DNA, 714 bp, Artificial Sequence
  chemically treated genomic DNA (Homo sapiens) CpG-island No: 3225
atagtcgtatcgttacgaataggagtatcgagaggaggaagagcgaagatatcgaggttaacgttattattaggtagacggtgagcgagttggtttggttcggggtcgttttcgggagtcgtaggtagggttgggagaagtcgtttattaggagtacgtgtagcgtggcggtggtcgagcgcggaggttcgttattgtttttgattagtattattagtttttgtttggttgcgtcgcgttcgtttagtagtttggcggtacgtatttcgttattgtgcgtttatacgtcgaatagttcgggtttcgtggttttgagtagttggtacgatagttaggcgttttggttcgagtcgtcgtttatcgttattattttggttattaggtagttcggttcggtcgttcggggtaacggttcggtgtagggcgcggagttgttttgtagcgggtatagtacgaagggcgagttgtcgttggcgtttagtattagtacgcgtattagcgtttcgttgtttagcgcgggggagtcgcggtttgtggcgtttacgcggaattcgaacgtttgtagggtttcgtagtttagggatttgagggtaaataggtggtcgttgttcgcgttgatggagattagggaggcgaggggtaggtgcgggttttgggacggtagtagggagtagatgatttgggcgttggtgttcgagtttttgtttgtggcgt

SEQ ID NO: 3226 - DNA, 714 bp, Artificial Sequence
  chemically treated genomic DNA (Homo sapiens) CpG-island No: 3226
acgccacaaacaaaaactcgaacaccaacgcccaaatcatctactccctactaccgtcccaaaacccgcacctacccctcgcctccctaatctccatcaacgcgaacaacgaccacctatttaccctcaaatccctaaactacgaaaccctacaaacgttcgaattccgcgtaaacgccacaaaccgcgactcccccgcgctaaacaacgaaacgctaatacgcgtactaatactaaacgccaacgacaactcgcccttcgtactatacccgctacaaaacaactccgcgccctacaccgaaccgttaccccgaacgaccgaaccgaactacctaataaccaaaataataacgataaacgacgactcgaaccaaaacgcctaactatcgtaccaactactcaaaaccacgaaacccgaactattcgacgtataaacgcacaataacgaaatacgtaccgccaaactactaaacgaacgcgacgcaaccaaacaaaaactaataatactaatcaaaaacaataacgaacctccgcgctcgaccaccgccacgctacacgtactcctaataaacgacttctcccaaccctacctacgactcccgaaaacgaccccgaaccaaaccaactcgctcaccgtctacctaataataacgttaacctcgatatcttcgctcttcctcctctcgatactcctattcgtaacgatacgactat

SEQ ID NO: 3227 - DNA, 714 bp, Artificial Sequence
  chemically treated genomic DNA (Homo sapiens) CpG-island No: 3227
gcgttatagatagagattcgggtattaacgtttaggttatttattttttgttgtcgttttaggattcgtatttgtttttcgtttttttggtttttattaacgcggataacggttatttgtttgtttttaggtttttggattacgaggttttgtaggcgttcgagtttcgcgtgggcgttatagatcgcggttttttcgcgttgagtagcgaggcgttggtgcgcgtgttggtgttggacgttaacgataattcgtttttcgtgttgtattcgttgtagaatagtttcgcgttttgtatcgagtcgttgtttcgggcggtcgagtcgggttatttggtgattaaggtggtggcggtggacggcgattcgggttagaacgtttggttgtcgtattagttgtttaaggttacggagttcgggttattcggcgtgtgggcgtataatggcgaggtgcgtatcgttaggttgttgagcgagcgcgacgtagttaagtagaggttggtggtgttggttaaggataatggcgagttttcgcgttcggttatcgttacgttgtacgtgtttttggtggacggttttttttagttttatttgcggttttcggaggcggtttcggattaggttaattcgtttatcgtttatttggtggtggcgttggtttcggtgttttcgtttttttttttttcggtgtttttgttcgtggcggtgcggttgt

SEQ ID NO: 3228 - DNA, 714 bp, Artificial Sequence
  chemically treated genomic DNA (Homo sapiens) CpG-island No: 3228
acaaccgcaccgccacgaacaaaaacaccgaaaaaaaaaaaaacgaaaacaccgaaaccaacgccaccaccaaataaacgataaacgaattaacctaatccgaaaccgcctccgaaaaccgcaaataaaactaaaaaaaaccgtccaccaaaaacacgtacaacgtaacgataaccgaacgcgaaaactcgccattatccttaaccaacaccaccaacctctacttaactacgtcgcgctcgctcaacaacctaacgatacgcacctcgccattatacgcccacacgccgaataacccgaactccgtaaccttaaacaactaatacgacaaccaaacgttctaacccgaatcgccgtccaccgccaccaccttaatcaccaaataacccgactcgaccgcccgaaacaacgactcgatacaaaacgcgaaactattctacaacgaatacaacacgaaaaacgaattatcgttaacgtccaacaccaacacgcgcaccaacgcctcgctactcaacgcgaaaaaaccgcgatctataacgcccacgcgaaactcgaacgcctacaaaacctcgtaatccaaaaacctaaaaacaaacaaataaccgttatccgcgttaataaaaaccaaaaaaacgaaaaacaaatacgaatcctaaaacgacaacaaaaaataaataacctaaacgttaatacccgaatctctatctataacgc

SEQ ID NO: 3229 - DNA, 547 bp, Artificial Sequence
  chemically treated genomic DNA (Homo sapiens) CpG-island No: 3229
agcgtggcggtggtcgagcgcggaggttcgttattgtttttgataagtattattagtttgtgtttggttgcgtttcgttcgtttagtagtttggcggtgcgtatttcgttattgtgcgtttatacgtcgaatagatcgagtttcgtggttttgagtagttggtacgatagttaggcgttttggttcgagtcgtcgtttatcgttattattttggttattaggtagttcggttcggtcgttcggggtattagttcggtgtagggcgcggagtcgttttgtagcgggtataatacgaagggcgagttgtcgttggcgtttagtattagtaagcgtattagcgtttcgttgtttaacgtcggggagtcgcggtttgtggcgtttacgcggaattcgaaagattgtagggtttcgtagtttagcgatttgagggtaaataggtggtcgttgttcgcgttgatggagattagggaagagaggggtaggtgcgggttttggggcggtagtagcgagtaggtgatttgggcgttgatgtttgagtttttgtttg

SEQ ID NO: 3230 - DNA, 547 bp, Artificial Sequence
  chemically treated genomic DNA (Homo sapiens) CpG-island No: 3230
caaacaaaaactcaaacatcaacgcccaaatcacctactcgctactaccgccccaaaacccgcacctacccctctcttccctaatctccatcaacgcgaacaacgaccacctatttaccctcaaatcgctaaactacgaaaccctacaatctttcgaattccgcgtaaacgccacaaaccgcgactccccgacgttaaacaacgaaacgctaatacgcttactaatactaaacgccaacgacaactcgcccttcgtattatacccgctacaaaacgactccgcgccctacaccgaactaataccccgaacgaccgaaccgaactacctaataaccaaaataataacgataaacgacgactcgaaccaaaacgcctaactatcgtaccaactactcaaaaccacgaaactcgatctattcgacgtataaacgcacaataacgaaatacgcaccgccaaactactaaacgaacgaaacgcaaccaaacacaaactaataatacttatcaaaaacaataacgaacctccgcgctcgaccaccgccacgct

SEQ ID NO: 3231 - DNA, 547 bp, Artificial Sequence
  chemically treated genomic DNA (Homo sapiens) CpG-island No: 3231
tagatagagatttaggtattaacgtttaggttatttattcgttgttgtcgttttaggattcgtatttgttttttttttttttggtttttattaacgcggataacggttatttgtttgtttttaggtcgttggattacgaggttttgtagtttttcgagtttcgcgtgggcgttatagatcgcggtttttcggcgttgagtagcgaggcgttggtgcgtttgttggtgttggacgttaacgataattcgtttttcgtgttgtattcgttgtagaacggtttcgcgttttgtatcgagttggtgtttcgggcggtcgagtcgggttatttggtgattaaggtggtggcggtggacggcgattcgggttagaacgtttggttgtcgtattagttgtttaaggttacggagttcggtttgttcggcgtgtgggcgtataatggcgaggtgcgtatcgttaggttgttgagcgagcgagacgtagttaagtataggttggtggtgtttgttaaggataatggcgagttttcgcgttcggttatcgttacgtt

SEQ ID NO: 3232 - DNA, 547 bp, Artificial Sequence
  chemically treated genomic DNA (Homo sapiens) CpG-island No: 3232
aacgtaacgataaccgaacgcgaaaactcgccattatccttaacaaacaccaccaacctatacttaactacgtctcgctcgctcaacaacctaacgatacgcacctcgccattatacgcccacacgccgaacaaaccgaactccgtaaccttaaacaactaatacgacaaccaaacgttctaacccgaatcgccgtccaccgccaccaccttaatcaccaaataacccgactcgaccgcccgaaacaccaactcgatacaaaacgcgaaaccgttctacaacgaatacaacacgaaaaacgaattatcgttaacgtccaacaccaacaaacgcaccaacgcctcgctactcaacgccgaaaaaccgcgatctataacgcccacgcgaaactcgaaaaactacaaaacctcgtaatccaacgacctaaaaacaaacaaataaccgttatccgcgttaataaaaaccaaaaaaaaaaaaaacaaatacgaatcctaaaacgacaacaacgaataaataacctaaacgttaatacctaaatctctatcta

SEQ ID NO: 3233 - DNA, 749 bp, Artificial Sequence
  chemically treated genomic DNA (Homo sapiens) CpG-island No: 3233
acgtgtagcgtggcggtggtcgagcgcggaggttcgttattgtttttgattagtattattagtttgtgtttggtcgcgtcgcgttcgtttagtagtttggcggtgcgtatttcgttattgtgcgtttatatgttgaatagttcgggtttcgtggttttgagtagttggtacgatagttaggcgttttggttcgagtcgtcgtttatcgttattattttggttattaggtagttcggttcggtcgttcggggtattagttcggtgtaaggcgtcgagtcgttttgtagcggatatagtacgaagggcgagttgtcgttggcgtttagtattagtacgcgtattagcgtttcgttgtttagcgtcggggagtcgcggtttgtggtttttacgcggaattcgaacgtttgtagggtttcgtagtttagcgatttgagggtaaataggtggtcgttgttcgcgttgatggagattagggaggcgaggcgtaggtgtgggttttggggcggtagtagcgagtaggtgatttgggcgttggtgtttgagtttttgtttgtggcgttgatattgtcgatgtgtagggcggggttgttgttttttcggacgaatagggtgtaggaggtttgggtgaaggcgggggcgttgttattgacgtcggagattaggatcgttatgttgtgttcggtttttagtttgggtgtttttatgtcggtgatagtgatggtgatgttgtattcggtttggtttttttt

SEQ ID NO: 3234 - DNA, 749 bp, Artificial Sequence
  chemically treated genomic DNA (Homo sapiens) CpG-island No: 3234
aaaaaaaaccaaaccgaatacaacatcaccatcactatcaccgacataaaaacacccaaactaaaaaccgaacacaacataacgatcctaatctccgacgtcaataacaacgcccccgccttcacccaaacctcctacaccctattcgtccgaaaaaacaacaaccccgccctacacatcgacaatatcaacgccacaaacaaaaactcaaacaccaacgcccaaatcacctactcgctactaccgccccaaaacccacacctacgcctcgcctccctaatctccatcaacgcgaacaacgaccacctatttaccctcaaatcgctaaactacgaaaccctacaaacgttcgaattccgcgtaaaaaccacaaaccgcgactccccgacgctaaacaacgaaacgctaatacgcgtactaatactaaacgccaacgacaactcgcccttcgtactatatccgctacaaaacgactcgacgccttacaccgaactaataccccgaacgaccgaaccgaactacctaataaccaaaataataacgataaacgacgactcgaaccaaaacgcctaactatcgtaccaactactcaaaaccacgaaacccgaactattcaacatataaacgcacaataacgaaatacgcaccgccaaactactaaacgaacgcgacgcgaccaaacacaaactaataatactaatcaaaaacaataacgaacctccgcgctcgaccaccgccacgctacacgt

SEQ ID NO: 3235 - DNA, 749 bp, Artificial Sequence
  chemically treated genomic DNA (Homo sapiens) CpG-island No: 3235
agagagagttaagtcgagtataatattattattattgttatcgatatggggatatttaggttgaaaatcgagtataatataacggttttggttttcgacgttaatgataacgttttcgtttttatttaaattttttatattttgttcgttcgagagaataatagtttcgttttgtatatcggtagtgttagcgttatagatagagatttaggtattaacgtttaggttatttattcgttgttgtcgttttagaatttatatttgcgtttcgtttttttggtttttattaacgcggataacggttatttgtttgtttttaggtcgttggattacgaggttttgtaggcgttcgagtttcgcgtgggagttatagatcgcggtttttcggcgttgagtagcgaggcgttggtgcgcgtgttggtgttggacgttaacgataattcgtttttcgtgttgtattcgttgtagaacggttcggcgttttgtatcgagttggtgtttcgggcggtcgagtcgggttatttggtgattaaggtggtggcggtggacggcgattcgggttagaacgtttggttgtcgtattagttgtttaaggttacggagttcgggttgtttagtatgtgggcgtataatggcgaggtgcgtatcgttaggttgttgagcgagcgcgacgcggttaagtataggttggtggtgttggttaaggataatggcgagttttcgcgttcggttatcgttacgttgtacgt

SEQ ID NO: 3236 - DNA, 749 bp, Artificial Sequence
  chemically treated genomic DNA (Homo sapiens) CpG-island No: 3236
acgtacaacgtaacgataaccgaacgcgaaaactcgccattatccttaaccaacaccaccaacctatacttaaccgcgtcgcgctcgctcaacaacctaacgatacgcacctcgccattatacgcccacatactaaacaacccgaactccgtaaccttaaacaactaatacgacaaccaaacgttctaacccgaatcgccgtccaccgccaccaccttaatcaccaaataacccgactcgaccgcccgaaacaccaactcgatacaaaacgccgaaccgttctacaacgaatacaacacgaaaaacgaattatcgttaacgtccaacaccaacacgcgcaccaacgcctcgctactcaacgccgaaaaaccgcgatctataactcccacgcgaaactcgaacgcctacaaaacctcgtaatccaacgacctaaaaacaaacaaataaccgttatccgcgttaataaaaaccaaaaaaacgaaacgcaaatataaattctaaaacgacaacaacgaataaataacctaaacgttaatacctaaatctctatctataacgctaacactaccgatatacaaaacgaaactattattctctcgaacgaacaaaatataaaaaatttaaataaaaacgaaaacgttatcattaacgtcgaaaaccaaaaccgttatattatactcgattttcaacctaaatatccccatatcgataacaataataataatattatactcgacttaactctctct

SEQ ID NO: 3237 - DNA, 738 bp, Artificial Sequence
  chemically treated genomic DNA (Homo sapiens) CpG-island No: 3237
cgagcgcggaggttcgttattgtttttgataagtattacgagtttgtgtttggttgcgtcgcgttcgtttagtagtttggcggtgcgtatttcgttattgtgcgtttatacgtcgaatagtttaggtttcgtggttttgagtagttggtacgatagttaggcgttttggttcgagtcgtcgtttatcgttattattttggttattaggtagttcggttcggtcgttcggggtattagttcggtgtagggcgcggagttattttgtagcgggtatagtacgaagggcgagttgtcgttggtgtttagtattagtacgcgtattagcgtttcgttgtttaaagtcggagaatcgcggtttgaggcgtttacgcggaattcgaacgtttgtagggtttcgtagtttagcgatttgagggcgaataggtggtcgttgtttgcgttgatggagattagggaggcgaggggtaggtgcgggttttggggcggtagtagcgagtaggtgatttgggcgttggtgttcgagtttttgtttgtggcgttgatattgtcgatgtgtagggcggggttgttgttttcgcggacgaatagggtgtaggaggtttgggtgaaggcgggggcgttgttattgacgtcggagatttgtacggttatgttttgttgggtttttagtttgggtgtttttaagttagtgacggcgatggtgatgttgtatttagcgttggtttttcggtttagtgg

SEQ ID NO: 3238 - DNA, 738 bp, Artificial Sequence
  chemically treated genomic DNA (Homo sapiens) CpG-island No: 3238
ccactaaaccgaaaaaccaacgctaaatacaacatcaccatcgccgtcactaacttaaaaacacccaaactaaaaacccaacaaaacataaccgtacaaatctccgacgtcaataacaacgcccccgccttcacccaaacctcctacaccctattcgtccgcgaaaacaacaaccccgccctacacatcgacaatatcaacgccacaaacaaaaactcgaacaccaacgcccaaatcacctactcgctactaccgccccaaaacccgcacctacccctcgcctccctaatctccatcaacgcaaacaacgaccacctattcgccctcaaatcgctaaactacgaaaccctacaaacgttcgaattccgcgtaaacgcctcaaaccgcgattctccgactttaaacaacgaaacgctaatacgcgtactaatactaaacaccaacgacaactcgcccttcgtactatacccgctacaaaataactccgcgccctacaccgaactaataccccgaacgaccgaaccgaactacctaataaccaaaataataacgataaacgacgactcgaaccaaaacgcctaactatcgtaccaactactcaaaaccacgaaacctaaactattcgacgtataaacgcacaataacgaaatacgcaccgccaaactactaaacgaacgcgacgcaaccaaacacaaactcgtaatacttatcaaaaacaataacgaacctccgcgctcg

SEQ ID NO: 3239 - DNA, 738 bp, Artificial Sequence
  chemically treated genomic DNA (Homo sapiens) CpG-island No: 3239
ttattggatcgagagattagcgttgagtataatattattatcgtcgttattgatttggggatatttaggttgaaaatttagtagaatataatcgtgtaggttttcgacgttaatgataacgttttcgtttttatttaaattttttatattttgttcgttcgcgagaataatagtttcgttttgtatatcggtagtgttagcgttatagatagagattcgggtattaacgtttaggttatttattcgttgttgtcgttttaggattcgtatttgtttttcgtttttttggtttttattaacgtagataacggttatttgttcgtttttaggtcgttggattacgaggttttgtaggcgttcgagtttcgcgtgggcgttttagatcgcggtttttcggttttgagtagcgaggcgttggtgcgcgtgttggtgttggatattaacgataattcgtttttcgtgttgtattcgttgtagaatggtttcgcgttttgtatcgagttggtgtttcgggcggtcgagtcgggttatttggtgattaaggtggtggcggtggacggcgattcgggttagaacgtttggttgtcgtattagttgtttaaggttacggagtttgggttgttcggcgtgtgggcgtataatggcgaggtgcgtatcgttaggttgttgagcgagcgcgacgtagttaagtataggttcgtggtgtttgttaaggataatggcgagttttcgcgttcg

SEQ ID NO: 3240 - DNA, 738 bp, Artificial Sequence
  chemically treated genomic DNA (Homo sapiens) CpG-island No: 3240
cgaacgcgaaaactcgccattatccttaacaaacaccacgaacctatacttaactacgtcgcgctcgctcaacaacctaacgatacgcacctcgccattatacgcccacacgccgaacaacccaaactccgtaaccttaaacaactaatacgacaaccaaacgttctaacccgaatcgccgtccaccgccaccaccttaatcaccaaataacccgactcgaccgcccgaaacaccaactcgatacaaaacgcgaaaccattctacaacgaatacaacacgaaaaacgaattatcgttaatatccaacaccaacacgcgcaccaacgcctcgctactcaaaaccgaaaaaccgcgatctaaaacgcccacgcgaaactcgaacgcctacaaaacctcgtaatccaacgacctaaaaacgaacaaataaccgttatctacgttaataaaaaccaaaaaaacgaaaaacaaatacgaatcctaaaacgacaacaacgaataaataacctaaacgttaatacccgaatctctatctataacgctaacactaccgatatacaaaacgaaactattattctcgcgaacgaacaaaatataaaaaatttaaataaaaacgaaaacgttatcattaacgtcgaaaacctacacgattatattctactaaattttcaacctaaatatccccaaatcaataacgacgataataatattatactcaacgctaatctctcgatccaataa

SEQ ID NO: 3241 - DNA, 546 bp, Artificial Sequence
  chemically treated genomic DNA (Homo sapiens) CpG-island No: 3241
gcgtggcggtggtcgagcgcggaggttcgttattgtttttgattagtattattagtttgtgtttggtcgcgtcgcgttcgtttagtagtttggcggtgcgtatttcgttattgtgcgtttatacgtcgaatagttcgggtttcgtggttttgagtagttggtacgatagttaggcgttttggttcgagtcgtcgtttatcgttattattttggttattaggtagttcggtttagtcgttcggggtattagttcggtgtagggcgcggagtcgttttgtagcgggtatagtacgaagggcgagttgtcgttggcgtttagtattagtacgcgtattagcgtttcgttgtttaaagtcggggagttacggtttgtggcgtttacgcggaattcgaacgtttgtagggtttcgtagtttagcgatttgagggtaaataggtggtcgttgttcgcgttgatggagattagggaagagaggggtaggtgcgggttttggggcggtagtagcgagtaggttatttgggcgttggtgtttgagtttttgtttg

SEQ ID NO: 3242 - DNA, 546 bp, Artificial Sequence
  chemically treated genomic DNA (Homo sapiens) CpG-island No: 3242
caaacaaaaactcaaacaccaacgcccaaataacctactcgctactaccgccccaaaacccgcacctacccctctcttccctaatctccatcaacgcgaacaacgaccacctatttaccctcaaatcgctaaactacgaaaccctacaaacgttcgaattccgcgtaaacgccacaaaccgtaactccccgactttaaacaacgaaacgctaatacgcgtactaatactaaacgccaacgacaactcgcccttcgtactatacccgctacaaaacgactccgcgccctacaccgaactaataccccgaacgactaaaccgaactacctaataaccaaaataataacgataaacgacgactcgaaccaaaacgcctaactatcgtaccaactactcaaaaccacgaaacccgaactattcgacgtataaacgcacaataacgaaatacgcaccgccaaactactaaacgaacgcgacgcgaccaaacacaaactaataatactaatcaaaaacaataacgaacctccgcgctcgaccaccgccacgc

SEQ ID NO: 3243 - DNA, 546 bp, Artificial Sequence
  chemically treated genomic DNA (Homo sapiens) CpG-island No: 3243
tagatagagatttaggtattaacgtttaggtaatttattcgttgttgtcgttttaggattcgtatttgttttttttttttttggtttttattaacgcggataacggttatttgtttgtttttaggtcgttggattacgaggttttgtaggcgttcgagtttcgcgtgggcgttatagatcgtggtttttcggttttgagtagcgaggcgttggtgcgcgtgttggtgttggacgttaacgataattcgtttttcgtgttgtattcgttgtagaacggtttcgcgttttgtatcgagttggtgtttcgggcggttgagtcgggttatttggtgattaaggtggtggcggtggacggcgattcgggttagaacgtttggttgtcgtattagttgtttaaggttacggagttcgggttgttcggcgtgtgggcgtataatggcgaagtgcgtatcgttaggttgttgagcgagcgcgacgcggttaagtataggttggtggtgttggttaaggataatggcgagttttcgcgttcggttatcgttacgt

SEQ ID NO: 3244 - DNA, 546 bp, Artificial Sequence
  chemically treated genomic DNA (Homo sapiens) CpG-island No: 3244
acgtaacgataaccgaacgcgaaaactcgccattatccttaaccaacaccaccaacctatacttaaccgcgtcgcgctcgctcaacaacctaacgatacgcacttcgccattatacgcccacacgccgaacaacccgaactccgtaaccttaaacaactaatacgacaaccaaacgttctaacccgaatcgccgtccaccgccaccaccttaatcaccaaataacccgactcaaccgcccgaaacaccaactcgatacaaaacgcgaaaccgttctacaacgaatacaacacgaaaaacgaattatcgttaacgtccaacaccaacacgcgcaccaacgcctcgctactcaaaaccgaaaaaccacgatctataacgcccacgcgaaactcgaacgcctacaaaacctcgtaatccaacgacctaaaaacaaacaaataaccgttatccgcgttaataaaaaccaaaaaaaaaaaaaacaaatacgaatcctaaaacgacaacaacgaataaattacctaaacgttaatacctaaatctctatcta

SEQ ID NO: 3245 - DNA, 797 bp, Artificial Sequence
  chemically treated genomic DNA (Homo sapiens) CpG-island No: 3245
tgtagcgtggcggtggtcgagcgcggaggttcgttattgtttttgattagtattattagtttttgtttggtagcgtcgcgtttttttagtagtttggcggtgcgtatttcgttattgtgcgtttatacgtcgaatagttcgggtttcgtggttttgagtagttggtacgatagttaggcgttttggttcgagtcgtcgtttatcgttattattttggttattaggtagttcggttcggtcgttcggggtattagttcggtgtagggcgcggagtcgttttgtagcgggtatagtacgaagggcgagttgtcgttggcgtttagtattagtacgcgtattagcgtttcgttgtttaacgtcggggagtcgcggtttgcggcgtttacgcggaattcgaacgtttgtagggtttcgtagtttagcgattggagagcgaataggtggtcgttgttcgcgttgatggagattagggaggcgaggggtaggtgcgggttttggggcggtagtagcgagtaggtgatttgggcgttggtgttcgagtttttgtttgtggcgttgacgttgtcgatgtgtagggcggggttgttgttttcgcggacgaatagggtgtaggaggtttgggtgaaggcgggggcgttgttattgacgtcggagattagtacggttatgttgtgttcggtttttagtttgggtgtttcgaagtcggtgacggtgatggtgatgttgtattcggatttggtttttcggtttagggtcgtgtttattattagagtgtaaaagtttttaatagaaggttt

SEQ ID NO: 3246 - DNA, 797 bp, Artificial Sequence
  chemically treated genomic DNA (Homo sapiens) CpG-island No: 3246
aaaccttctattaaaaacttttacactctaataataaacacgaccctaaaccgaaaaaccaaatccgaatacaacatcaccatcaccgtcaccgacttcgaaacacccaaactaaaaaccgaacacaacataaccgtactaatctccgacgtcaataacaacgcccccgccttcacccaaacctcctacaccctattcgtccgcgaaaacaacaaccccgccctacacatcgacaacgtcaacgccacaaacaaaaactcgaacaccaacgcccaaatcacctactcgctactaccgccccaaaacccgcacctacccctcgcctccctaatctccatcaacgcgaacaacgaccacctattcgctctccaatcgctaaactacgaaaccctacaaacgttcgaattccgcgtaaacgccgcaaaccgcgactccccgacgttaaacaacgaaacgctaatacgcgtactaatactaaacgccaacgacaactcgcccttcgtactatacccgctacaaaacgactccgcgccctacaccgaactaataccccgaacgaccgaaccgaactacctaataaccaaaataataacgataaacgacgactcgaaccaaaacgcctaactatcgtaccaactactcaaaaccacgaaacccgaactattcgacgtataaacgcacaataacgaaatacgcaccgccaaactactaaaaaaacgcgacgctaccaaacaaaaactaataatactaatcaaaaacaataacgaacctccgcgctcgaccaccgccacgctaca

SEQ ID NO: 3247 - DNA, 797 bp, Artificial Sequence
  chemically treated genomic DNA (Homo sapiens) CpG-island No: 3247
aaattttttgttgagaatttttatattttggtgataagtacggttttggatcgggagattagattcgaatataatattattattatcgttatcgatttcgggatatttaggttgaaaatcgagtataatataatcgtgttggttttcgacgttaatgataacgttttcgtttttatttaaattttttatattttgttcgttcgcgagaataatagtttcgttttgtatatcggtagcgttagcgttatagatagagattcgggtattaacgtttaggttatttattcgttgttgtcgttttaggattcgtatttgtttttcgtttttttggtttttattaacgcggataacggttatttgttcgttttttagtcgttggattacgaggttttgtaggcgttcgagtttcgcgtgggcgtcgtagatcgcggtttttcggcgttgagtagcgaggcgttggtgcgcgtgttggtgttggacgttaacgataattcgtttttcgtgttgtattcgttgtagaacggtttcgcgttttgtatcgagttggtgtttcgggcggtcgagtcgggttatttggtgattaaggtggtggcggtggacggcgattcgggttagaacgtttggttgtcgtattagttgtttaaggttacggagttcgggttgttcggcgtgtgggcgtataatggcgaggtgcgtatcgttaggttgttgagggagcgcgacgttgttaagtagaggttggtggtgttggttaaggataatggcgagttttcgcgttcggttatcgttacgttgta

SEQ ID NO: 3248 - DNA, 797 bp, Artificial Sequence
  chemically treated genomic DNA (Homo sapiens) CpG-island No: 3248
tacaacgtaacgataaccgaacgcgaaaactcgccattatccttaaccaacaccaccaacctctacttaacaacgtcgcgctccctcaacaacctaacgatacgcacctcgccattatacgcccacacgccgaacaacccgaactccgtaaccttaaacaactaatacgacaaccaaacgttctaacccgaatcgccgtccaccgccaccaccttaatcaccaaataacccgactcgaccgcccgaaacaccaactcgatacaaaacgcgaaaccgttctacaacgaatacaacacgaaaaacgaattatcgttaacgtccaacaccaacacgcgcaccaacgcctcgctactcaacgccgaaaaaccgcgatctacgacgcccacgcgaaactcgaacgcctacaaaacctcgtaatccaacgactaaaaaacgaacaaataaccgttatccgcgttaataaaaaccaaaaaaacgaaaaacaaatacgaatcctaaaacgacaacaacgaataaataacctaaacgttaatacccgaatctctatctataacgctaacgctaccgatatacaaaacgaaactattattctcgcgaacgaacaaaatataaaaaatttaaataaaaacgaaaacgttatcattaacgtcgaaaaccaacacgattatattatactcgattttcaacctaaatatcccgaaatcgataacgataataataatattatattcgaatctaatctcccgatccaaaaccgtacttatcaccaaaatataaaaattctcaacaaaaaattt

SEQ ID NO: 3249 - DNA, 602 bp, Artificial Sequence
  chemically treated genomic DNA (Homo sapiens) CpG-island No: 3249
cgcgaaatatttttacgggtcggcgaggttgacgcgttgcgttttatcgtattaattagtcgggcgtggtgcgggcgtcgggaagattgggcggggcgaaggtattatttttcgatggggtcggcgttgtgcgttttttagtcgaggtggggcgttgtggaagagcggtagttttcggtcggttttttttttttttcggttgtcggcgttagtacgttttgttttcgttggtcgcgttgggatggtcgttatagttgtaggtgttgttagtgtttagcgttggtttttgtcgggcgttgagggtagtttagtttttttgtttgttcggttcgtttgtgcgtggtatttaagggtattagtattttcgcggtcggtagtatgggtcgggagttacggtgaggtagagcgtcgagcgggttagcgggcgagcggttttttggggtcgtgagaagaggcgggagttgaggtggtcgtcgggttaggtttggcgcggttttacgtgcggttagcgttgtttcgcgagtattggaagggttgggggatttcggttgagggaatggttgtgtttgggttagcgacggttttttttgtattattattag

SEQ ID NO: 3250 - DNA, 602 bp, Artificial Sequence
  chemically treated genomic DNA (Homo sapiens) CpG-island No: 3250
ctaataataatacaaaaaaaaccgtcgctaacccaaacacaaccattccctcaaccgaaatcccccaacccttccaatactcgcgaaacaacgctaaccgcacgtaaaaccgcgccaaacctaacccgacgaccacctcaactcccgcctcttctcacgaccccaaaaaaccgctcgcccgctaacccgctcgacgctctacctcaccgtaactcccgacccatactaccgaccgcgaaaatactaatacccttaaataccacgcacaaacgaaccgaacaaacaaaaaaactaaactaccctcaacgcccgacaaaaaccaacgctaaacactaacaacacctacaactataacgaccatcccaacgcgaccaacgaaaacaaaacgtactaacgccgacaaccgaaaaaaaaaaaaaaccgaccgaaaactaccgctcttccacaacgccccacctcgactaaaaaacgcacaacgccgaccccatcgaaaaataataccttcgccccgcccaatcttcccgacgcccgcaccacgcccgactaattaatacgataaaacgcaacgcgtcaacctcgccgacccgtaaaaatatttcgcg

SEQ ID NO: 3251 - DNA, 602 bp, Artificial Sequence
  chemically treated genomic DNA (Homo sapiens) CpG-island No: 3251
ttgatggtagtgtaggggaagtcgtcgttggtttaaatataattatttttttagtcgaggttttttagtttttttaatgttcgcggggtagcgttgatcgtacgtggggtcgcgttaggtttggttcggcggttattttaattttcgtttttttttacgattttaagaagtcgttcgttcgttagttcgttcggcgttttgttttatcgtgattttcgatttatgttgtcgatcgcgggaatattggtgtttttgagtattacgtataggcgaatcggataaataaggaggttgagttgtttttaacgttcggtaaagattagcgttaaatattagtagtatttatagttgtggcggttattttagcgcggttaacgaaaataggacgtgttggcgtcggtagtcgaaggaagagaaaagtcgatcggaagttgtcgtttttttatagcgttttatttcgattggaggacgtatagcgtcggttttatcgaaaggtgatgttttcgtttcgtttagttttttcggcgttcgtattacgttcggttgattagtgcgatggagcgtagcgcgttagtttcgtcggttcgtgagggtgtttcgcg

SEQ ID NO: 3252 - DNA, 602 bp, Artificial Sequence
  chemically treated genomic DNA (Homo sapiens) CpG-island No: 3252
cgcgaaacaccctcacgaaccgacgaaactaacgcgctacgctccatcgcactaatcaaccgaacgtaatacgaacgccgaaaaaactaaacgaaacgaaaacatcacctttcgataaaaccgacgctatacgtcctccaatcgaaataaaacgctataaaaaaacgacaacttccgatcgacttttctcttccttcgactaccgacgccaacacgtcctattttcgttaaccgcgctaaaataaccgccacaactataaatactactaatatttaacgctaatctttaccgaacgttaaaaacaactcaacctccttatttatccgattcgcctatacgtaatactcaaaaacaccaatattcccgcgatcgacaacataaatcgaaaatcacgataaaacaaaacgccgaacgaactaacgaacgaacgacttcttaaaatcgtaaaaaaaaacgaaaattaaaataaccgccgaaccaaacctaacgcgaccccacgtacgatcaacgctaccccgcgaacattaaaaaaactaaaaaacctcgactaaaaaaataattatatttaaaccaacgacgacttcccctacactaccatcaa

SEQ ID NO: 3253 - DNA, 648 bp, Artificial Sequence
  chemically treated genomic DNA (Homo sapiens) CpG-island No: 3253
agtaggcgtacggtgatgggtacggtgttgacgatgcgtcgtatggatattacgttgtcgggtacgtattcgtagaggtagtcgcgttcgtcgtgaaggtagaagagcgttttttggattcgtcgcgtcgtttcgtcgtcgatgcggttttgttcgcgtttcgttttcgtttgcgtttgtatcgttagtagttgcgcgttttcgttttcggcgtttttcggtagttacggtttgcgcgttatttcgcggtataataggtcgtcgcggttttgtatcgtatcgtgtaggaattgtagtttggtgcggcggtttataatgggtatagagaagggtagcgtgatagtgcggttgaggaagaggtagtcgttatcggtcgtgttttttatgttgttcgcgttttttaggtacgcggttaggatgttggggtttacgattaggatgaagatgaagggcgcgtggttgtcggatagtagcgtgttgatggcgttgagtacgtttattacgcgtttcgggtagtacgtgtttagttcggtgatttttagtattacgcgtagtttgcgtcgttggtagatttttaggaagtataggaagtcggtgagtagttttatttttttttttatttcgtatatgaaatttagttggttgtcg

SEQ ID NO: 3254 - DNA, 648 bp, Artificial Sequence
  chemically treated genomic DNA (Homo sapiens) CpG-island No: 3254
cgacaaccaactaaatttcatatacgaaataaaaaaaaaaataaaactactcaccgacttcctatacttcctaaaaatctaccaacgacgcaaactacgcgtaatactaaaaatcaccgaactaaacacgtactacccgaaacgcgtaataaacgtactcaacgccatcaacacgctactatccgacaaccacgcgcccttcatcttcatcctaatcgtaaaccccaacatcctaaccgcgtacctaaaaaacgcgaacaacataaaaaacacgaccgataacgactacctcttcctcaaccgcactatcacgctacccttctctatacccattataaaccgccgcaccaaactacaattcctacacgatacgatacaaaaccgcgacgacctattataccgcgaaataacgcgcaaaccgtaactaccgaaaaacgccgaaaacgaaaacgcgcaactactaacgatacaaacgcaaacgaaaacgaaacgcgaacaaaaccgcatcgacgacgaaacgacgcgacgaatccaaaaaacgctcttctaccttcacgacgaacgcgactacctctacgaatacgtacccgacaacgtaatatccatacgacgcatcgtcaacaccgtacccatcaccgtacgcctact

SEQ ID NO: 3255 - DNA, 648 bp, Artificial Sequence
  chemically treated genomic DNA (Homo sapiens) CpG-island No: 3255
cggtagttagttgggttttatgtgcgaggtgaagaaggaggtggagttgtttatcgattttttgtgttttttggagatttattagcggcgtaggttgcgcgtggtgttggaggttatcgggttggatacgtgttattcggagcgcgtggtgggcgtgtttaacgttattaatacgttgttgttcgatagttacgcgttttttatttttattttggtcgtggattttagtattttggtcgcgtgtttagagagcgcgggtaatatgaagggtacggtcgataacggttattttttttttaatcgtattgttacgttgtttttttttgtgtttattatgggtcgtcgtattaagttgtagtttttgtacgatgcggtgtagagtcgcgacgatttgttgtatcgcgagatgacgcgtaagtcgtggttgtcgggggacgtcgggggcgagagcgcgtagttgttggcggtgtaggcgtaggcggggacggagcgcgggtagggtcgtatcgacgacgaggcggcgcggcgaatttaggaggcgtttttttgtttttacgacgagcgcgattgtttttacgagtacgtgttcgataacgtggtgtttatgcggcgtatcgttaatatcgtgtttattatcgtgcgtttgtt

SEQ ID NO: 3256 - DNA, 648 bp, Artificial Sequence
  chemically treated genomic DNA (Homo sapiens) CpG-island No: 3256
aacaaacgcacgataataaacacgatattaacgatacgccgcataaacaccacgttatcgaacacgtactcgtaaaaacaatcgcgctcgtcgtaaaaacaaaaaaacgcctcctaaattcgccgcgccgcctcgtcgtcgatacgaccctacccgcgctccgtccccgcctacgcctacaccgccaacaactacgcgctctcgcccccgacgtcccccgacaaccacgacttacgcgtcatctcgcgatacaacaaatcgtcgcgactctacaccgcatcgtacaaaaactacaacttaatacgacgacccataataaacacaaaaaaaaacaacgtaacaatacgattaaaaaaaaaataaccgttatcgaccgtacccttcatattacccgcgctctctaaacacgcgaccaaaatactaaaatccacgaccaaaataaaaataaaaaacgcgtaactatcgaacaacaacgtattaataacgttaaacacgcccaccacgcgctccgaataacacgtatccaacccgataacctccaacaccacgcgcaacctacgccgctaataaatctccaaaaaacacaaaaaatcgataaacaactccacctccttcttcacctcgcacataaaacccaactaactaccg

SEQ ID NO: 3257 - DNA, 871 bp, Artificial Sequence
  chemically treated genomic DNA (Homo sapiens) CpG-island No: 3257
attttttacgcgatattagtcgttcgatttttttgcgttggtttacgaataggtgtttgtttatcgagtatacggttatgagtagtttcgagttcgatagtgtggtggtcgcgtcgttaaatattttgagtaggttgtcgttcgggttgtcgtggtttagcgcgtggtcgtttagtgataagtagagtagttttatatttaggtttagcgtcgttagtagcgttagtagttttaggtatacgcggcgtcgataatgttattcgttttggtagtagttttgtttggtggtcggtttgttgtttagtatcgagtatacgttgaagggtagtgcgttatagtggcggcggatgttttcgtataacgtggttattaggtcggtttatagtttgtcggtgttcgcgtattgttaggcgttaaagcggatgaaaaggaattgtacgtttttgcgtcgtaggtgtatttcggtgatgatgggttgtaggaatattaggtattatagtagttgcgggacgttttagtcgtttacggtacgcggtcgttattgtacgtgttgtagtttttcgttttcgcgttgcgcggttttttgttgtattagcgttgcgggaagggagttcgggagtcgcgtgagtcgtagattcgtcggggtgggcggggtttagtacgggtagggcggagcgtttttggagaggcgaggggcgtttagtagaggcgaggggttggaagcgagtcgcggtcgttttttaaagagttggaagtcggtgtagaagcgggggcgtggagaggtttggagtcgggtttggatcggaagcggtttgaaggttaggttgtggggtcgggatgggtagaggtagagtcggtagaggagagatgg

SEQ ID NO: 3258 - DNA, 871 bp, Artificial Sequence
  chemically treated genomic DNA (Homo sapiens) CpG-island No: 3258
ccatctctcctctaccgactctacctctacccatcccgaccccacaacctaaccttcaaaccgcttccgatccaaacccgactccaaacctctccacgcccccgcttctacaccgacttccaactctttaaaaaacgaccgcgactcgcttccaacccctcgcctctactaaacgcccctcgcctctccaaaaacgctccgccctacccgtactaaaccccgcccaccccgacgaatctacgactcacgcgactcccgaactcccttcccgcaacgctaatacaacaaaaaaccgcgcaacgcgaaaacgaaaaactacaacacgtacaataacgaccgcgtaccgtaaacgactaaaacgtcccgcaactactataatacctaatattcctacaacccatcatcaccgaaatacacctacgacgcaaaaacgtacaattccttttcatccgctttaacgcctaacaatacgcgaacaccgacaaactataaaccgacctaataaccacgttatacgaaaacatccgccgccactataacgcactacccttcaacgtatactcgatactaaacaacaaaccgaccaccaaacaaaactactaccaaaacgaataacattatcgacgccgcgtatacctaaaactactaacgctactaacgacgctaaacctaaatataaaactactctacttatcactaaacgaccacgcgctaaaccacgacaacccgaacgacaacctactcaaaatatttaacgacgcgaccaccacactatcgaactcgaaactactcataaccgtatactcgataaacaaacacctattcgtaaaccaacgcaaaaaaatcgaacgactaatatcgcgtaaaaaat

SEQ ID NO: 3259 - DNA, 871 bp, Artificial Sequence
  chemically treated genomic DNA (Homo sapiens) CpG-island No: 3259
ttattttttttttgtcggttttatttttgtttatttcgattttatagtttggtttttagatcgttttcggtttaagttcggttttaggtttttttacgttttcgtttttgtatcggtttttagttttttaaggagcggtcgcggttcgtttttagtttttcgtttttgttgggcgtttttcgtttttttaggagcgtttcgttttgttcgtattaggtttcgtttatttcggcgggtttgcggtttacgcggttttcgggtttttttttcgtagcgttgatgtagtaggaggtcgcgtagcgcgagagcgaggagttgtagtacgtgtagtggcggtcgcgtgtcgtgagcggttggggcgtttcgtagttattgtggtatttggtgtttttgtagtttattattatcgaggtgtatttgcggcgtaggaacgtgtagtttttttttattcgttttagcgtttggtagtacgcgggtatcgataagttgtgggtcggtttggtgattacgttgtgcgagggtattcgtcgttattatggcgtattgttttttagcgtgtattcggtgttgggtaataagtcggttattaggtaggattgttgttagagcgagtggtattgtcggcgtcgcgtgtgtttggggttgttggcgttgttggcggcgttgggtttgggtgtggggttgttttatttgttattgggcggttacgcgttgggttacggtagttcgagcggtagtttgtttaaggtgtttggcggcgcggttattatattgtcgggttcggggttgtttatggtcgtgtattcggtgggtaagtatttgttcgtaagttagcgtaagaagatcgagcggttggtgtcgcgtgaaaagt

SEQ ID NO: 3260 - DNA, 871 bp, Artificial Sequence
  chemically treated genomic DNA (Homo sapiens) CpG-island No: 3260
acttttcacgcgacaccaaccgctcgatcttcttacgctaacttacgaacaaatacttacccaccgaatacacgaccataaacaaccccgaacccgacaatataataaccgcgccgccaaacaccttaaacaaactaccgctcgaactaccgtaacccaacgcgtaaccgcccaataacaaataaaacaaccccacacccaaacccaacgccgccaacaacgccaacaaccccaaacacacgcgacgccgacaataccactcgctctaacaacaatcctacctaataaccgacttattacccaacaccgaatacacgctaaaaaacaatacgccataataacgacgaataccctcgcacaacgtaatcaccaaaccgacccacaacttatcgatacccgcgtactaccaaacgctaaaacgaataaaaaaaaactacacgttcctacgccgcaaatacacctcgataataataaactacaaaaacaccaaataccacaataactacgaaacgccccaaccgctcacgacacgcgaccgccactacacgtactacaactcctcgctctcgcgctacgcgacctcctactacatcaacgctacgaaaaaaaaacccgaaaaccgcgtaaaccgcaaacccgccgaaataaacgaaacctaatacgaacaaaacgaaacgctcctaaaaaaacgaaaaacgcccaacaaaaacgaaaaactaaaaacgaaccgcgaccgctccttaaaaaactaaaaaccgatacaaaaacgaaaacgtaaaaaaacctaaaaccgaacttaaaccgaaaacgatctaaaaaccaaactataaaatcgaaataaacaaaaataaaaccgacaaaaaaaaaataa

SEQ ID NO: 3261 - DNA, 759 bp, Artificial Sequence
  chemically treated genomic DNA (Homo sapiens) CpG-island No: 3261
cggaagcggtatcgataggaagataatcgggatcgtttgagattcggagttttcggtcgagggttagtgttcggttggtttcggttaagatttttgggttaaaggttatcgtattttcgtttacgagttgggtcggtatttcgcgtaggtttagatttgggtagaggtgggggatttggtagtattcggtttaagtatgatcgggtttgagttgggtttgattacgtcgaattggatttggttacgaagagtttgttcgatgagttcgggagaattcggttacgttcgattgagttcgggagatttcggataagttcgagtttgttcgtttaagttcggttacgttcggtttgtttcgaataagttcgggtgacgttcgggtcgggtcgggtatgttcggttacgttcggttatatgagggttagttcgggtattttcgattaagatcggtcgcgttcggtttgtttcgttcgattttagcgggtttagtagtatcgggatgaattttacggttagtcgaaggggcggggttttttaatttttttttggttcgtttggggtgcgtcgtgggcgttgtggtgtaatgggagacgtttttaggggcggattggaggcggcggataatttagatttgtttttcgagggggaggtatgcggatcgcgattttttatttttttttcggttttttttaagggttttagaaaagcgcgtttgtggataaatagggaaattgaggttaggagcggttatagggcgtg

SEQ ID NO: 3262 - DNA, 759 bp, Artificial Sequence
  chemically treated genomic DNA (Homo sapiens) CpG-island No: 3262
cacgccctataaccgctcctaacctcaatttccctatttatccacaaacgcgcttttctaaaacccttaaaaaaaaccgaaaaaaaaataaaaaatcgcgatccgcatacctccccctcgaaaaacaaatctaaattatccgccgcctccaatccgcccctaaaaacgtctcccattacaccacaacgcccacgacgcaccccaaacgaaccaaaaaaaaattaaaaaaccccgccccttcgactaaccgtaaaattcatcccgatactactaaacccgctaaaatcgaacgaaacaaaccgaacgcgaccgatcttaatcgaaaatacccgaactaaccctcatataaccgaacgtaaccgaacatacccgacccgacccgaacgtcacccgaacttattcgaaacaaaccgaacgtaaccgaacttaaacgaacaaactcgaacttatccgaaatctcccgaactcaatcgaacgtaaccgaattctcccgaactcatcgaacaaactcttcgtaaccaaatccaattcgacgtaatcaaacccaactcaaacccgatcatacttaaaccgaatactaccaaatcccccacctctacccaaatctaaacctacgcgaaataccgacccaactcgtaaacgaaaatacgataacctttaacccaaaaatcttaaccgaaaccaaccgaacactaaccctcgaccgaaaactccgaatctcaaacgatcccgattatcttcctatcgataccgcttccg

SEQ ID NO: 3263 - DNA, 759 bp, Artificial Sequence
  chemically treated genomic DNA (Homo sapiens) CpG-island No: 3263
tacgttttgtggtcgtttttggttttagtttttttatttgtttatagacgcgtttttttggaatttttggggagagtcgagagaggggtagggggtcgcgattcgtatgtttttttttcgaggggtagatttgggttattcgtcgtttttagttcgtttttaagagcgttttttattgtattatagcgtttacggcgtattttagacgggttagggaagggttaagaagtttcgttttttcggttggtcgtggggtttatttcggtgttgttaaattcgttggagtcggacggaataggtcgagcgcggtcggttttagtcggagatgttcgaattagtttttatgtagtcggacgtgatcgaatatgttcgattcggttcgagcgttattcggatttgttcgaagtagatcgagcgtaatcggatttaggcgaataagttcgaatttattcgaagtttttcgagtttaatcggacgtagtcgaattttttcgaatttatcgaataaatttttcgtgattaagtttaattcgacgtgattagatttaatttagattcggttatatttggatcgaatgttgttaaattttttatttttatttagatttgagtttacgcggggtgtcgatttagttcgtggacggggatacggtgatttttgatttaaaagttttggtcgggattagtcggatattggttttcggtcgggagtttcgagttttaggcggtttcggttgtttttttgtcggtgtcgttttcg

SEQ ID NO: 3264 - DNA, 759 bp, Artificial Sequence
  chemically treated genomic DNA (Homo sapiens) CpG-island No: 3264
cgaaaacgacaccgacaaaaaaacaaccgaaaccgcctaaaactcgaaactcccgaccgaaaaccaatatccgactaatcccgaccaaaacttttaaatcaaaaatcaccgtatccccgtccacgaactaaatcgacaccccgcgtaaactcaaatctaaataaaaataaaaaatttaacaacattcgatccaaatataaccgaatctaaattaaatctaatcacgtcgaattaaacttaatcacgaaaaatttattcgataaattcgaaaaaattcgactacgtccgattaaactcgaaaaacttcgaataaattcgaacttattcgcctaaatccgattacgctcgatctacttcgaacaaatccgaataacgctcgaaccgaatcgaacatattcgatcacgtccgactacataaaaactaattcgaacatctccgactaaaaccgaccgcgctcgacctattccgtccgactccaacgaatttaacaacaccgaaataaaccccacgaccaaccgaaaaaacgaaacttcttaacccttccctaacccgtctaaaatacgccgtaaacgctataatacaataaaaaacgctcttaaaaacgaactaaaaacgacgaataacccaaatctacccctcgaaaaaaaaacatacgaatcgcgaccccctacccctctctcgactctccccaaaaattccaaaaaaacgcgtctataaacaaataaaaaaactaaaaccaaaaacgaccacaaaacgta

SEQ ID NO: 3265 - DNA, 925 bp, Artificial Sequence
  chemically treated genomic DNA (Homo sapiens) CpG-island No: 3265
gcggggcggggggcggcggcggcgtagtcggtaggaggcgtagcgttcgttcgtagcgcggggaggtgggaggggagcggggcggggagcggggcgggcgggagggagaggggagcgcgtcggagacgcgcgcgtttagtttatttttcgcgttcgtcgtcgttcggataataaatagtagttttgcgcggggcgatgttcgagtcggtgtcgtcgttttcgcgtcgcgtagtttcggtcgttaggttttagttcgtttcggttttcgttaggtcgcgtttttttttttttttttttttcgcgcgttattcgcgttcgttttcgttcggtatcgcggatttattcggatttcggcggggagatggagtgagtaggcgcgttcgggtcgcggggttgggggttcggagtttcgggagtcggggaggggggaggttttttttttcgcgttttattgggggcgtcgttgttttcgcgaggagtaggaggcggcgcggggttgttggggtcgtagcgtagtcgggaagagattcgggttgggtcgcgtttgtcgggaggttttttcgttttcggatttcggttgtttatttatcggcgcgtggggattcgggtagcggcggttcgggttagtttaggacgcggggagggggaggttcgcgttttcgttcgcgtttcgttcgcgtttttagggcgagtttcggttttcggttatttgtgggtggtttcggggagatggagcgatttttttttagattgtatcggttcggtttcgcgtttacgtatttttttttcgttttagtttgagcgtacggtttttggcgttttggacgcgcgcgcgggtcggtgttttttattttcgttttttttaagggtttttaggggtgttttgagtttttcgttattgcgtaggtttcgagttatcgttgga

SEQ ID NO: 3266 - DNA, 925 bp, Artificial Sequence
  chemically treated genomic DNA (Homo sapiens) CpG-island No: 3266
tccaacgataactcgaaacctacgcaataacgaaaaactcaaaacacccctaaaaacccttaaaaaaaacgaaaataaaaaacaccgacccgcgcgcgcgtccaaaacgccaaaaaccgtacgctcaaactaaaacgaaaaaaaaatacgtaaacgcgaaaccgaaccgatacaatctaaaaaaaaatcgctccatctccccgaaaccacccacaaataaccgaaaaccgaaactcgccctaaaaacgcgaacgaaacgcgaacgaaaacgcgaacctccccctccccgcgtcctaaactaacccgaaccgccgctacccgaatccccacgcgccgataaataaacaaccgaaatccgaaaacgaaaaaacctcccgacaaacgcgacccaacccgaatctcttcccgactacgctacgaccccaacaaccccgcgccgcctcctactcctcgcgaaaacaacgacgcccccaataaaacgcgaaaaaaaaaacctcccccctccccgactcccgaaactccgaacccccaaccccgcgacccgaacgcgcctactcactccatctccccgccgaaatccgaataaatccgcgataccgaacgaaaacgaacgcgaataacgcgcgaaaaaaaaaaaaaaaaaaaaacgcgacctaacgaaaaccgaaacgaactaaaacctaacgaccgaaactacgcgacgcgaaaacgacgacaccgactcgaacatcgccccgcgcaaaactactatttattatccgaacgacgacgaacgcgaaaaataaactaaacgcgcgcgtctccgacgcgctcccctctccctcccgcccgccccgctccccgccccgctcccctcccacctccccgcgctacgaacgaacgctacgcctcctaccgactacgccgccgccgccccccgccccgc

SEQ ID NO: 3267 - DNA, 925 bp, Artificial Sequence
  chemically treated genomic DNA (Homo sapiens) CpG-island No: 3267
tttagcggtaattcgggatttgcgtagtggcggggggtttaggatatttttggaggtttttgggaagggcgggggtggggggtatcggttcgcgcgcgcgtttagggcgttaggagtcgtgcgtttagattggggcgggggaagggtgcgtgagcgcgaggtcggatcggtgtaatttggggaggggtcgttttattttttcggggttatttataggtggtcgagagtcgaggttcgttttggagacgcgggcggggcgcgggcggagacgcgagttttttttttttcgcgttttggattggttcgagtcgtcgttgttcgggtttttacgcgtcggtgggtgggtagtcggggttcgggagcggggaggtttttcggtaggcgcggtttagttcgagttttttttcggttgcgttgcggttttagtagtttcgcgtcgttttttgtttttcgcgggggtagcgacgtttttaatggggcgcgagagagggggtttttttttttttcggttttcggagtttcgggtttttagtttcgcggttcgagcgcgtttatttattttattttttcgtcgaggttcgggtgggttcgcggtgtcgggcgggggcgggcgcgggtggcgcgcgggggaggggaggggagggggacgcggtttggcgggggtcggggcgggttaaggtttggcggtcggggttgcgcggcgcgggggcggcggtatcggttcgggtatcgtttcgcgtaaagttgttgtttattgttcgggcggcggcgggcgcggggggtgggttgggcgcgcgcgttttcggcgcgtttttttttttttttcgttcgtttcgtttttcgtttcgttttttttttattttttcgcgttgcgagcgggcgttgcgttttttgtcggttgcgtcgtcgtcgtttttcgtttcgt

SEQ ID NO: 3268 - DNA, 925 bp, Artificial Sequence
  chemically treated genomic DNA (Homo sapiens) CpG-island No: 3268
acgaaacgaaaaacgacgacgacgcaaccgacaaaaaacgcaacgcccgctcgcaacgcgaaaaaataaaaaaaaaacgaaacgaaaaacgaaacgaacgaaaaaaaaaaaaaaacgcgccgaaaacgcgcgcgcccaacccaccccccgcgcccgccgccgcccgaacaataaacaacaactttacgcgaaacgatacccgaaccgataccgccgcccccgcgccgcgcaaccccgaccgccaaaccttaacccgccccgacccccgccaaaccgcgtccccctcccctcccctcccccgcgcgccacccgcgcccgcccccgcccgacaccgcgaacccacccgaacctcgacgaaaaaataaaataaataaacgcgctcgaaccgcgaaactaaaaacccgaaactccgaaaaccgaaaaaaaaaaaaaccccctctctcgcgccccattaaaaacgtcgctacccccgcgaaaaacaaaaaacgacgcgaaactactaaaaccgcaacgcaaccgaaaaaaaactcgaactaaaccgcgcctaccgaaaaacctccccgctcccgaaccccgactacccacccaccgacgcgtaaaaacccgaacaacgacgactcgaaccaatccaaaacgcgaaaaaaaaaaaactcgcgtctccgcccgcgccccgcccgcgtctccaaaacgaacctcgactctcgaccacctataaataaccccgaaaaaataaaacgacccctccccaaattacaccgatccgacctcgcgctcacgcacccttcccccgccccaatctaaacgcacgactcctaacgccctaaacgcgcgcgcgaaccgataccccccacccccgcccttcccaaaaacctccaaaaatatcctaaaccccccgccactacgcaaatcccgaattaccgctaaa

SEQ ID NO: 3269 - DNA, 839 bp, Artificial Sequence
  chemically treated genomic DNA (Homo sapiens) CpG-island No: 3269
cgtggttatatttcgtttaatttttttaatttgtgacgtggagcgttttgtcggtttgattttggttattcggcgtcgggggcgggtttatatttttttcggatggaagtttttttttgggcgggcgtttttcggacgtttagacggggatttttttttttttttttagtcgtagcgcgggggagaaattttcgatttttttcgttcgtttaggtcgttttaggttcgaagtttcggttttttttaatttttttaagtataggtcgggggcgggagatgttgcgtcggttttattttcgcgcgtcgggtttcggcgttgttatggggacggcgcggttgttacggcgatcgtttttcgcgggtttttttatttattatcggggcggcggcgttcgggtttggggaggggcgaggggggcgtattttgcgtgttttggggaaaggcgagggggcgtttaggttcggggaggggcgaggggggcgtcgggtttggggaggggcgaggggggcgtcgggtttggggaggggtaaggggggcgtattttgcgtgttttggggaaaggcgagggggcgttcgggtttggggagaggtgaggggggcgtcgggtttggggaggggcgagaggggcgttcgggtttggggagagtgaagggggcgtcgggtttggggaggggcgaggggggcgtcgggtttggggaggggcgaggggggcgttcgtgattgcgggggttaggggggcgcgttttggggaggggtttgcgttttggggttgtttttcgcgcgttttttgttcgttcgtttgatattttttcgttttggtcggtcgggtagggatagg

SEQ ID NO: 3270 - DNA, 839 bp, Artificial Sequence
  chemically treated genomic DNA (Homo sapiens) CpG-island No: 3270
cctatccctacccgaccgaccaaaacgaaaaaatatcaaacgaacgaacaaaaaacgcgcgaaaaacaaccccaaaacgcaaacccctccccaaaacgcgcccccctaacccccgcaatcacgaacgcccccctcgcccctccccaaacccgacgcccccctcgcccctccccaaacccgacgcccccttcactctccccaaacccgaacgcccctctcgcccctccccaaacccgacgcccccctcacctctccccaaacccgaacgccccctcgcctttccccaaaacacgcaaaatacgccccccttacccctccccaaacccgacgcccccctcgcccctccccaaacccgacgcccccctcgcccctccccgaacctaaacgccccctcgcctttccccaaaacacgcaaaatacgcccccctcgcccctccccaaacccgaacgccgccgccccgataataaataaaaaaacccgcgaaaaacgatcgccgtaacaaccgcgccgtccccataacaacgccgaaacccgacgcgcgaaaataaaaccgacgcaacatctcccgcccccgacctatacttaaaaaaattaaaaaaaaccgaaacttcgaacctaaaacgacctaaacgaacgaaaaaaatcgaaaatttctcccccgcgctacgactaaaaaaaaaaaaaaaaatccccgtctaaacgtccgaaaaacgcccgcccaaaaaaaaacttccatccgaaaaaaatataaacccgcccccgacgccgaataaccaaaatcaaaccgacaaaacgctccacgtcacaaattaaaaaaattaaacgaaatataaccacg

SEQ ID NO: 3271 - DNA, 839 bp, Artificial Sequence
  chemically treated genomic DNA (Homo sapiens) CpG-island No: 3271
tttgtttttgttcggtcggttagggcgggggaatgttaggcgggcgggtagggaacgcgcgggaagtagttttagggcgtaggtttttttttaggacgcgtttttttggttttcgtagttacgggcgtttttttcgtttttttttagattcggcgtttttttcgtttttttttagattcggcgttttttttattttttttaggttcgggcgtttttttcgtttttttttagattcggcgttttttttatttttttttaggttcgggcgttttttcgtttttttttaggatacgtaggatgcgttttttttgtttttttttagattcggcgtttttttcgtttttttttagattcggcgtttttttcgttttttttcgggtttggacgttttttcgtttttttttaggatacgtaggatgcgtttttttcgtttttttttagattcgggcgtcgtcgtttcggtgatggatggaggggttcgcgggaggcggtcgtcgtggtaatcgcgtcgtttttatggtaacgtcgaggttcggcgcgcgggggtggggtcggcgtagtatttttcgttttcggtttgtgtttggggggattggggggggtcgaggtttcgggtttggggcggtttagacgggcgggaggggtcgggaatttttttttcgcgttgcggttgggggaggggaggggggttttcgtttgggcgttcggggggcgttcgtttaggaaggggtttttattcgggaggggtgtggattcgttttcgacgtcgggtagttaaggttaggtcgatagaacgttttacgttatagattggaaaaattaagcgaaatatgattacg

SEQ ID NO: 3272 - DNA, 839 bp, Artificial Sequence
  chemically treated genomic DNA (Homo sapiens) CpG-island No: 3272
cgtaatcatatttcgcttaatttttccaatctataacgtaaaacgttctatcgacctaaccttaactacccgacgtcgaaaacgaatccacacccctcccgaataaaaaccccttcctaaacgaacgccccccgaacgcccaaacgaaaacccccctcccctcccccaaccgcaacgcgaaaaaaaaattcccgacccctcccgcccgtctaaaccgccccaaacccgaaacctcgaccccccccaatccccccaaacacaaaccgaaaacgaaaaatactacgccgaccccacccccgcgcgccgaacctcgacgttaccataaaaacgacgcgattaccacgacgaccgcctcccgcgaacccctccatccatcaccgaaacgacgacgcccgaatctaaaaaaaaacgaaaaaaacgcatcctacgtatcctaaaaaaaaacgaaaaaacgtccaaacccgaaaaaaaacgaaaaaaacgccgaatctaaaaaaaaacgaaaaaaacgccgaatctaaaaaaaaacaaaaaaaacgcatcctacgtatcctaaaaaaaaacgaaaaaacgcccgaacctaaaaaaaaataaaaaaaacgccgaatctaaaaaaaaacgaaaaaaacgcccgaacctaaaaaaaataaaaaaaacgccgaatctaaaaaaaaacgaaaaaaacgccgaatctaaaaaaaaacgaaaaaaacgcccgtaactacgaaaaccaaaaaaacgcgtcctaaaaaaaaacctacgccctaaaactacttcccgcgcgttccctacccgcccgcctaacattcccccgccctaaccgaccgaacaaaaacaaa

SEQ ID NO: 3273 - DNA, 544 bp, Artificial Sequence
  chemically treated genomic DNA (Homo sapiens) CpG-island No: 3273
tgtcgttgttttaggtgttcgcgtaggtagtggtacgggtcgtgttggaagataattcgagttcggtggattttgcggatttgtcggcgttgttcggcgtttttttggttttcgagggtatacggggttatttgatggaggttaagttagttaacgcgtgttattttatcgaggtttcgcgattgggtaatcgttttttgggcgttatcgtgttgattcgtcgttacgattgtattttcgattttaaggtgttgaacgtttagcgcgtcggtttcgaggcggttatcgtgtataacgtttatttcgacgatttcgtgagtatgatttacgtttacgaggatttgaggggttagatcgttatttttttagtgttcgtgagcgaggtcgtttcgtaggatttgcgggttattttgggttgtaataagtcggtttacgcgttgtttttgttcgacgatttatcgtgttacgatttgggttgttatttcgtgttgatcgtgttttgggtgttgggttgtattttggttttggtcgtattagttttttt

SEQ ID NO: 3274 - DNA, 544 bp, Artificial Sequence
  chemically treated genomic DNA (Homo sapiens) CpG-island No: 3274
aaaaaaactaatacgaccaaaaccaaaatacaacccaacacccaaaacacgatcaacacgaaataacaacccaaatcgtaacacgataaatcgtcgaacaaaaacaacgcgtaaaccgacttattacaacccaaaataacccgcaaatcctacgaaacgacctcgctcacgaacactaaaaaaataacgatctaacccctcaaatcctcgtaaacgtaaatcatactcacgaaatcgtcgaaataaacgttatacacgataaccgcctcgaaaccgacgcgctaaacgttcaacaccttaaaatcgaaaatacaatcgtaacgacgaatcaacacgataacgcccaaaaaacgattacccaatcgcgaaacctcgataaaataacacgcgttaactaacttaacctccatcaaataaccccgtataccctcgaaaaccaaaaaaacgccgaacaacgccgacaaatccgcaaaatccaccgaactcgaattatcttccaacacgacccgtaccactacctacgcgaacacctaaaacaacgaca

SEQ ID NO: 3275 - DNA, 544 bp, Artificial Sequence
  chemically treated genomic DNA (Homo sapiens) CpG-island No: 3275
aagaaggttgatacgattagggttagggtatagtttagtatttaggatacggttagtacggggtgatagtttaggtcgtggtacggtgggtcgtcgggtaggagtagcgcgtgggtcgatttgttgtagtttaggatgattcgtaggttttgcgaggcggtttcgtttacgaatattgaggggatggcgatttggttttttaagttttcgtagacgtgggttatgtttacgaggtcgtcggagtggacgttgtgtacgatggtcgtttcgaagtcggcgcgttgggcgtttagtattttgaggtcgaaggtgtagtcgtagcggcggattagtacgatggcgtttagagagcggttgtttagtcgcggggtttcgatgggatggtacgcgttggttggtttgatttttattaggtagtttcgtatgttttcgggggttagggggacgtcgaatagcgtcggtagattcgtaaagtttatcgagttcgagttgttttttagtacggttcgtattattgtttgcgcgggtatttggagtagcgata

SEQ ID NO: 3276 - DNA, 544 bp, Artificial Sequence
  chemically treated genomic DNA (Homo sapiens) CpG-island No: 3276
tatcgctactccaaatacccgcgcaaacaataatacgaaccgtactaaaaaacaactcgaactcgataaactttacgaatctaccgacgctattcgacgtccccctaacccccgaaaacatacgaaactacctaataaaaatcaaaccaaccaacgcgtaccatcccatcgaaaccccgcgactaaacaaccgctctctaaacgccatcgtactaatccgccgctacgactacaccttcgacctcaaaatactaaacgcccaacgcgccgacttcgaaacgaccatcgtacacaacgtccactccgacgacctcgtaaacataacccacgtctacgaaaacttaaaaaaccaaatcgccatcccctcaatattcgtaaacgaaaccgcctcgcaaaacctacgaatcatcctaaactacaacaaatcgacccacgcgctactcctacccgacgacccaccgtaccacgacctaaactatcaccccgtactaaccgtatcctaaatactaaactataccctaaccctaatcgtatcaaccttctt

SEQ ID NO: 3277 - DNA, 1045 bp, Artificial Sequence
  chemically treated genomic DNA (Homo sapiens) CpG-island No: 3277
gcgaagcgggtcggaagtttcgtagtttttattttagaattcgcgtttcggaatttggattttcgatcgggttttgcggtttcgattttcgtagcgagtttagcgtcggggaataggattcggttttttagttttcgttcggggatattaggttttttgggcgaacggttaggtttttcgggattagcgcgttggaagattcgcggcggggacgttttttcggtcgtttcgtgtcgggttttacgtaagggtagtcggggcgtttcgtagtgggaacgcgaggagatcgattacggggcgagatagtcgttagggcgttcgcgtcgttcgttttaagttcgtattagttcgttacgaattcggaggatcgcgggttagagcggtttcgttagcgcgtaaagttttgtgggttatacgtttcggcgtttcgcgtttcgcggtatggcgggagttgtggtttagttgcgggggtcgcgcgggagttgtcgggagttgtgggcggggtgggtgcgcgcgtagtggtagggttagtgagttgtattcgcggaaaaggagggggagcggttggttagttgcgttttgcgggtcgagaatgttattagtagggatggcggcgttttgagtgttgagcgcggtttcgatcgggattttttatttttgatttattttcgtaggtcgagtttcgattttcgattcgtcgtcgtagttcgcggtttcgatttttgattcgttttcgtagttcgcggtttcgatttttgattcgtttttttagttagattttttacgttcgattcgttttcgtagtttatggtttatcggttcggtagtggacgtagagtttcggtttcgtttttttttcggatttttcggattcgtttttcgttttttttgtagagtcgagggttttggtttagtttcgtatttttttcgatcgtgttcgatttagttcgggtgtgttgtattcgaaataggttttcgggggtcgtcgggtttgtgggtgatcgtgtaggttaggatttttttttttttagtcgtgataattata

SEQ ID NO: 3278 - DNA, 1045 bp, Artificial Sequence
  chemically treated genomic DNA (Homo sapiens) CpG-island No: 3278
tataattatcacgactaaaaaaaaaaaaatcctaacctacacgatcacccacaaacccgacgacccccgaaaacctatttcgaatacaacacacccgaactaaatcgaacacgatcgaaaaaaatacgaaactaaaccaaaaccctcgactctacaaaaaaaacgaaaaacgaatccgaaaaatccgaaaaaaaaacgaaaccgaaactctacgtccactaccgaaccgataaaccataaactacgaaaacgaatcgaacgtaaaaaatctaactaaaaaaacgaatcaaaaatcgaaaccgcgaactacgaaaacgaatcaaaaatcgaaaccgcgaactacgacgacgaatcgaaaatcgaaactcgacctacgaaaataaatcaaaaataaaaaatcccgatcgaaaccgcgctcaacactcaaaacgccgccatccctactaataacattctcgacccgcaaaacgcaactaaccaaccgctccccctccttttccgcgaatacaactcactaaccctaccactacgcgcgcacccaccccgcccacaactcccgacaactcccgcgcgacccccgcaactaaaccacaactcccgccataccgcgaaacgcgaaacgccgaaacgtataacccacaaaactttacgcgctaacgaaaccgctctaacccgcgatcctccgaattcgtaacgaactaatacgaacttaaaacgaacgacgcgaacgccctaacgactatctcgccccgtaatcgatctcctcgcgttcccactacgaaacgccccgactacccttacgtaaaacccgacacgaaacgaccgaaaaaacgtccccgccgcgaatcttccaacgcgctaatcccgaaaaacctaaccgttcgcccaaaaaacctaatatccccgaacgaaaactaaaaaaccgaatcctattccccgacgctaaactcgctacgaaaatcgaaaccgcaaaacccgatcgaaaatccaaattccgaaacgcgaattctaaaataaaaactacgaaacttccgacccgcttcgc

SEQ ID NO: 3279 - DNA, 1045 bp, Artificial Sequence
  chemically treated genomic DNA (Homo sapiens) CpG-island No: 3279
tgtggttgttacgattgggaagggggagattttggtttgtacggttatttataggttcgacggttttcgggagtttgtttcgggtgtagtatattcgggttggatcgagtacggtcggggaggatgcggggttgggttaaggttttcggttttgtagggaggacggagagcgggttcggggggttcggggagggaacggggtcgaggttttgcgtttattgtcgggtcgatgggttatgggttgcgagggcgggtcgggcgtagagggtttggttgggagggcgggttagaggtcggggtcgcgggttgcgagggcgggttagaggtcggggtcgcgggttgcgacggcgggtcgggagtcggggttcggtttgcgagggtgggttaagggtagggggtttcggtcggggtcgcgtttagtatttaaagcgtcgttatttttgttgatgatattttcgattcgtagggcgtagttgattagtcgtttttttttttttttcgcgggtgtagtttattggttttgttattgcgcgcgtatttatttcgtttatagttttcggtagttttcgcgcggttttcgtagttgaattataattttcgttatgtcgcggagcgcggggcgtcggggcgtgtggtttataaggttttgcgcgttggcggggtcgttttagttcgcggtttttcgagttcgtggcgggttgatgcgggtttggggcgggcggcgcggacgttttggcggttgtttcgtttcgtggtcggttttttcgcgtttttattgcggggcgtttcggttgtttttgcgtggggttcggtacggggcggtcgagggggcgttttcgtcgcgagttttttagcgcgttggtttcgggaggtttggtcgttcgtttaaggagtttggtgttttcgggcggagattgggaagtcgggttttgtttttcggcgttgggttcgttgcgggggtcggggtcgtagggttcggtcggggatttaggtttcgggacgcggattttggagtaggggttgcggggttttcggttcgtttcgt

SEQ ID NO: 3280 - DNA, 1045 bp, Artificial Sequence
  chemically treated genomic DNA (Homo sapiens) CpG-island No: 3280
acgaaacgaaccgaaaaccccgcaacccctactccaaaatccgcgtcccgaaacctaaatccccgaccgaaccctacgaccccgacccccgcaacgaacccaacgccgaaaaacaaaacccgacttcccaatctccgcccgaaaacaccaaactccttaaacgaacgaccaaacctcccgaaaccaacgcgctaaaaaactcgcgacgaaaacgccccctcgaccgccccgtaccgaaccccacgcaaaaacaaccgaaacgccccgcaataaaaacgcgaaaaaaccgaccacgaaacgaaacaaccgccaaaacgtccgcgccgcccgccccaaacccgcatcaacccgccacgaactcgaaaaaccgcgaactaaaacgaccccgccaacgcgcaaaaccttataaaccacacgccccgacgccccgcgctccgcgacataacgaaaattataattcaactacgaaaaccgcgcgaaaactaccgaaaactataaacgaaataaatacgcgcgcaataacaaaaccaataaactacacccgcgaaaaaaaaaaaaaaacgactaatcaactacgccctacgaatcgaaaatatcatcaacaaaaataacgacgctttaaatactaaacgcgaccccgaccgaaaccccctacccttaacccaccctcgcaaaccgaaccccgactcccgacccgccgtcgcaacccgcgaccccgacctctaacccgccctcgcaacccgcgaccccgacctctaacccgccctcccaaccaaaccctctacgcccgacccgccctcgcaacccataacccatcgacccgacaataaacgcaaaacctcgaccccgttccctccccgaaccccccgaacccgctctccgtcctccctacaaaaccgaaaaccttaacccaaccccgcatcctccccgaccgtactcgatccaacccgaatatactacacccgaaacaaactcccgaaaaccgtcgaacctataaataaccgtacaaaccaaaatctcccccttcccaatcgtaacaaccaca

SEQ ID NO: 3281 - DNA, 1088 bp, Artificial Sequence
  chemically treated genomic DNA (Homo sapiens) CpG-island No: 3281
gtaaaacgatttgggtgttagaaggagagcgcgtcggtttcggtttacgtgagcgtcgcggtcgagttcgtttagaggatcgcggatcgggatagttgcgttcgcggttttcgcgttaggtcgggatttattcgggtcgggcgcgtcgcggatttcgcggcggtcgtttttttttttttttttttttttttatttaataaaatggcggcggtaggaagtgtcgggcgtttcggttcgtttttcgttcgttttcgatcgtcggtttcgtcgcggcgttcgcgttttttattcgcgtttcgtcggttagtttaagttcgggttcgacggtattaaaggtaggatagtcgcgagcgatttcgtcgtttcgatattaacggcgtaggtcgtttcggttcggaacgaacggcgcgggaggttcgtaggttcgagttcgcgtagtttcggttttttcgttttcgcgtcgcgcggatggcgtaggtggcggcgtttcggttttattacgtaatgtaggttacgcggatcgcgtcgcgagttttcgttagtcgtttagtgtcgttcgtcgttttaaagggtattagtttttatttgagacgttaggtcgtacgtcgttttcgtcggtcgttcgttcgttgtcgtcgtttttttttcgagttgtttgcgcggcgtcggggttcgttcgtcgttttgtcgagtttataggtcgcgttcgttcgcgggtatcgtcggtagtcgtcgtagtcgttgtcgtcgttattgtttcggtttttcggttgcgggagattagaataaatagtttagtcgtcgtcgtcgtcgtcgtcgtcgtcgttagcgtattgacgttatcgcgtacgttgcgcgcgcggtttcgcgtcgtcgtcgttcggtgtgcgcgtttcgttttcgcgtttagcgcgaacgagttttggagagatagtggttgcgaggtgagtgggggatatcgcggattgagggaggagatttcgtagagcgaaggagcgggttgggggaaacgggcggattgtaggttgggtttgcgggaaaagatttgaaggttgagagagatatttaaaatattaagaaaggtttga

SEQ ID NO: 3282 - DNA, 1088 bp, Artificial Sequence
  chemically treated genomic DNA (Homo sapiens) CpG-island No: 3282
tcaaacctttcttaatattttaaatatctctctcaaccttcaaatcttttcccgcaaacccaacctacaatccgcccgtttcccccaacccgctccttcgctctacgaaatctcctccctcaatccgcgatatcccccactcacctcgcaaccactatctctccaaaactcgttcgcgctaaacgcgaaaacgaaacgcgcacaccgaacgacgacgacgcgaaaccgcgcgcgcaacgtacgcgataacgtcaatacgctaacgacgacgacgacgacgacgacgacgactaaactatttattctaatctcccgcaaccgaaaaaccgaaacaataacgacgacaacgactacgacgactaccgacgatacccgcgaacgaacgcgacctataaactcgacaaaacgacgaacgaaccccgacgccgcgcaaacaactcgaaaaaaaaacgacgacaacgaacgaacgaccgacgaaaacgacgtacgacctaacgtctcaaataaaaactaataccctttaaaacgacgaacgacactaaacgactaacgaaaactcgcgacgcgatccgcgtaacctacattacgtaataaaaccgaaacgccgccacctacgccatccgcgcgacgcgaaaacgaaaaaaccgaaactacgcgaactcgaacctacgaacctcccgcgccgttcgttccgaaccgaaacgacctacgccgttaatatcgaaacgacgaaatcgctcgcgactatcctacctttaataccgtcgaacccgaacttaaactaaccgacgaaacgcgaataaaaaacgcgaacgccgcgacgaaaccgacgatcgaaaacgaacgaaaaacgaaccgaaacgcccgacacttcctaccgccgccattttattaaataaaaaaaaaaaaaaaaaaaaaaaaacgaccgccgcgaaatccgcgacgcgcccgacccgaataaatcccgacctaacgcgaaaaccgcgaacgcaactatcccgatccgcgatcctctaaacgaactcgaccgcgacgctcacgtaaaccgaaaccgacgcgctctccttctaacacccaaatcgttttac

SEQ ID NO: 3283 - DNA, 1088 bp, Artificial Sequence
  chemically treated genomic DNA (Homo sapiens) CpG-island No: 3283
ttagattttttttagtattttggatgttttttttagtttttagattttttttcgtaggtttagtttgtagttcgttcgttttttttagttcgttttttcgttttgcggggtttttttttttagttcgcggtattttttatttatttcgtagttattgtttttttagagttcgttcgcgttgggcgcgggggcggggcgcgtatatcgggcggcggcggcgcggggtcgcgcgcgtagcgtgcgcggtgacgttagtgcgttggcggcggcggcggcggcggcggcggcggttgggttgtttgttttggtttttcgtagtcgaggagtcgaagtagtggcggcggtagcggttgcggcggttgtcggcggtgttcgcgggcgagcgcggtttgtgagttcggtagagcggcgggcgggtttcggcgtcgcgtaggtagttcggggagggggcggcggtagcgggcggacggtcggcgggggcggcgtgcggtttagcgttttaggtgaggattggtgttttttggggcggcggacgatattgggcggttggcggaggttcgcggcgcggttcgcgtaatttgtattgcgtaatggggtcggggcgtcgttatttacgttattcgcgcggcgcgggggcggggaggtcggggttacgcgggttcgggtttgcgggtttttcgcgtcgttcgtttcgggtcggggcggtttgcgtcgttggtgtcggggcggcggggtcgttcgcggttgttttgtttttggtgtcgtcggattcgggtttgggttggtcggcggggcgcgggtggggggcgcgggcgtcgcggcggggtcggcggtcgggggcgggcggggggcgggtcgaggcgttcggtattttttgtcgtcgttattttgttaagtgaggaggaggaggaggaggaggaagcggtcgtcgcggggttcgcggcgcgttcggttcgggtaagtttcggtttggcgcgggggtcgcgagcgtagttgtttcggttcgcggttttttaggcgggttcggtcgcggcgtttacgtgggtcggggtcggcgcgttttttttttggtatttaggtcgttttgt

SEQ ID NO: 3284 - DNA, 1088 bp, Artificial Sequence
  chemically treated genomic DNA (Homo sapiens) CpG-island No: 3284
acaaaacgacctaaataccaaaaaaaaaacgcgccgaccccgacccacgtaaacgccgcgaccgaacccgcctaaaaaaccgcgaaccgaaacaactacgctcgcgacccccgcgccaaaccgaaacttacccgaaccgaacgcgccgcgaaccccgcgacgaccgcttcctcctcctcctcctcctcctcacttaacaaaataacgacgacaaaaaataccgaacgcctcgacccgccccccgcccgcccccgaccgccgaccccgccgcgacgcccgcgccccccacccgcgccccgccgaccaacccaaacccgaatccgacgacaccaaaaacaaaacaaccgcgaacgaccccgccgccccgacaccaacgacgcaaaccgccccgacccgaaacgaacgacgcgaaaaacccgcaaacccgaacccgcgtaaccccgacctccccgcccccgcgccgcgcgaataacgtaaataacgacgccccgaccccattacgcaatacaaattacgcgaaccgcgccgcgaacctccgccaaccgcccaatatcgtccgccgccccaaaaaacaccaatcctcacctaaaacgctaaaccgcacgccgcccccgccgaccgtccgcccgctaccgccgccccctccccgaactacctacgcgacgccgaaacccgcccgccgctctaccgaactcacaaaccgcgctcgcccgcgaacaccgccgacaaccgccgcaaccgctaccgccgccactacttcgactcctcgactacgaaaaaccaaaacaaacaacccaaccgccgccgccgccgccgccgccgccgccaacgcactaacgtcaccgcgcacgctacgcgcgcgaccccgcgccgccgccgcccgatatacgcgccccgcccccgcgcccaacgcgaacgaactctaaaaaaacaataactacgaaataaataaaaaataccgcgaactaaaaaaaaaaaccccgcaaaacgaaaaaacgaactaaaaaaaacgaacgaactacaaactaaacctacgaaaaaaaatctaaaaactaaaaaaaacatccaaaatactaaaaaaaatctaa

SEQ ID NO: 3285 - DNA, 1072 bp, Artificial Sequence
  chemically treated genomic DNA (Homo sapiens) CpG-island No: 3285
cggatgtatgtatacgtatagaaatatatagggttcggatatagttgcgcgtagataagtaaaggattacgtttacgtggaaataggtgtgcgtatacgttttcgcgtattcgcgcgtataagcgttttatatttgggaacgtgcgtatttgtttttcgttttcggtatatatatagtcgttttatattggaatatttgggcgttagcgtcgggttattcgggtacgtagggcgttacgtagggtcgcgtatacgtttttcggttatacgcgtatagttttttacgtggacgcgcgggtatatacgttcggggttcgtagtcgcgtatattcgtatttaggaaattttagttattattacgcggggttcgatcgtttttgagtatttttcgttttagtcgcgtattcgttgcgcgttcgggacgcgtatattcgcgtatatatcggttttttttgcgtacgtttcgggtttattttcgtttagagttttcggggtttttttttatttcggtttcggggtttttttacgttttttcgtcgacgtgtttatttgtttagggggcgttttcgagtcgcgtttcgcgttcgtttttaggagggttttcgcgagtcggttgtatatttcgaggcggtttcggttgtataatttggagcgagttgtttcgtttttttattttgggggcgaagaagggtcggggagtgggggaaagcgggaggcgtcgcggtttgggaggttttcgcgggttttagcgtcggtcgtattgcggtttttttcgcgcgtcgtcgtcgtcgtcggttttttttcgtttcgttttcgcggttttcggcgtttttcgcgcgtttcgggcggggtttcggggcgtacgcgggttttacgtttggttttgatttggttttgtcgggcgtgtattttttatttattttgggaagcggggtttttggagcgtggaacgggcgtcgttagtgcgcgcggcggggatcgggggtgagggagagtgagttgttcgttcggggagataagtaaggcgttaagttcggatttttagaggatatttcgtattttgtaattttaa

SEQ ID NO: 3286 - DNA, 1072 bp, Artificial Sequence
  chemically treated genomic DNA (Homo sapiens) CpG-island No: 3286
ttaaaattacaaaatacgaaatatcctctaaaaatccgaacttaacgccttacttatctccccgaacgaacaactcactctccctcacccccgatccccgccgcgcgcactaacgacgcccgttccacgctccaaaaaccccgcttcccaaaataaataaaaaatacacgcccgacaaaaccaaatcaaaaccaaacgtaaaacccgcgtacgccccgaaaccccgcccgaaacgcgcgaaaaacgccgaaaaccgcgaaaacgaaacgaaaaaaaaccgacgacgacgacgacgcgcgaaaaaaaccgcaatacgaccgacgctaaaacccgcgaaaacctcccaaaccgcgacgcctcccgctttcccccactccccgacccttcttcgcccccaaaataaaaaaacgaaacaactcgctccaaattatacaaccgaaaccgcctcgaaatatacaaccgactcgcgaaaaccctcctaaaaacgaacgcgaaacgcgactcgaaaacgccccctaaacaaataaacacgtcgacgaaaaaacgtaaaaaaaccccgaaaccgaaataaaaaaaaaccccgaaaactctaaacgaaaataaacccgaaacgtacgcaaaaaaaaccgatatatacgcgaatatacgcgtcccgaacgcgcaacgaatacgcgactaaaacgaaaaatactcaaaaacgatcgaaccccgcgtaataataactaaaatttcctaaatacgaatatacgcgactacgaaccccgaacgtatatacccgcgcgtccacgtaaaaaactatacgcgtataaccgaaaaacgtatacgcgaccctacgtaacgccctacgtacccgaataacccgacgctaacgcccaaatattccaatataaaacgactatatatataccgaaaacgaaaaacaaatacgcacgttcccaaatataaaacgcttatacgcgcgaatacgcgaaaacgtatacgcacacctatttccacgtaaacgtaatcctttacttatctacgcgcaactatatccgaaccctatatatttctatacgtatacatacatccg

SEQ ID NO: 3287 - DNA, 1072 bp, Artificial Sequence
  chemically treated genomic DNA (Homo sapiens) CpG-island No: 3287
ttggaattgtagagtacgaagtgttttttgggagttcgggtttggcgttttgtttattttttcggacgggtagtttatttttttttattttcggttttcgtcgcgcgtattggcggcgttcgttttacgttttaagaatttcgttttttagggtgggtggggggtgtacgttcgatagggttaggttagggttaggcgtggagttcgcgtgcgtttcgggatttcgttcggggcgcgcgggaggcgtcgggggtcgcggaggcggggcggggaggggtcggcggcggcggcggcgcgcggaggagatcgtagtgcggtcggcgttaggattcgcgggggttttttaggtcgcggcgtttttcgtttttttttatttttcgattttttttcgtttttaaaatgaggaaacggagtaattcgttttaagttgtgtagtcgggatcgtttcggggtgtgtagtcggttcgcggaggtttttttgggggcgggcgcggggcgcggttcgggggcgttttttgagtaggtgagtacgtcggcggggagacgtggagagatttcgaggtcggggtggggggaaatttcgagggttttaggcgggggtgggttcgggacgtgcgtaggaagggtcggtgtgtgcgcgagtgtgcgcgtttcgggcgcgtagcgggtgcgcggttggggcggagggtgtttagaggcgatcggatttcgcgtggtggtggttggggttttttgggtgcgggtgtgcgcggttacgagtttcgggcgtgtgtattcgcgcgtttacgtggagggttgtgcgcgtgtggtcgaaaagcgtgtgcgcggttttgcgtagcgttttgcgtgttcgagtggttcggcgttggcgtttaggtgttttagtgtggggcggttgtgtgtgtgtcgggggcgggggataggtgcgtacgtttttaggtgtggagcgtttgtgcgcgcggatgcgcggggacgtgtgcgtatatttgtttttacgtggacgtggttttttgtttgtttgcgcgtagttgtgttcgagttttgtgtgtttttgtgcgtgtgtatgtattcg

SEQ ID NO: 3288 - DNA, 1072 bp, Artificial Sequence
  chemically treated genomic DNA (Homo sapiens) CpG-island No: 3288
cgaatacatacacacgcacaaaaacacacaaaactcgaacacaactacgcgcaaacaaacaaaaaaccacgtccacgtaaaaacaaatatacgcacacgtccccgcgcatccgcgcgcacaaacgctccacacctaaaaacgtacgcacctatcccccgcccccgacacacacacaaccgccccacactaaaacacctaaacgccaacgccgaaccactcgaacacgcaaaacgctacgcaaaaccgcgcacacgcttttcgaccacacgcgcacaaccctccacgtaaacgcgcgaatacacacgcccgaaactcgtaaccgcgcacacccgcacccaaaaaaccccaaccaccaccacgcgaaatccgatcgcctctaaacaccctccgccccaaccgcgcacccgctacgcgcccgaaacgcgcacactcgcgcacacaccgacccttcctacgcacgtcccgaacccacccccgcctaaaaccctcgaaatttccccccaccccgacctcgaaatctctccacgtctccccgccgacgtactcacctactcaaaaaacgcccccgaaccgcgccccgcgcccgcccccaaaaaaacctccgcgaaccgactacacaccccgaaacgatcccgactacacaacttaaaacgaattactccgtttcctcattttaaaaacgaaaaaaaatcgaaaaataaaaaaaaacgaaaaacgccgcgacctaaaaaacccccgcgaatcctaacgccgaccgcactacgatctcctccgcgcgccgccgccgccgccgacccctccccgccccgcctccgcgacccccgacgcctcccgcgcgccccgaacgaaatcccgaaacgcacgcgaactccacgcctaaccctaacctaaccctatcgaacgtacaccccccacccaccctaaaaaacgaaattcttaaaacgtaaaacgaacgccgccaatacgcgcgacgaaaaccgaaaataaaaaaaaataaactacccgtccgaaaaaataaacaaaacgccaaacccgaactcccaaaaaacacttcgtactctacaattccaa

SEQ ID NO: 3289 - DNA, 551 bp, Artificial Sequence
  chemically treated genomic DNA (Homo sapiens) CpG-island No: 3289
gaacgttcgcggttttcgcgatgtttcgcgatattatttttttcgttttcgtttatttaaggatcggaagtagtaaagttcgtcgtcgcgtttttcgtttcgcgtttttttggtaattagtttttttttttttttcgtttataaggagtaagcggtataaatcgggttcgatggaggaagacgtggatacgagttttggcggcgattattatatttcgtttagttcgtttacgagtagtagtcgtaattggacggaggatatggaaggaggtagggttggtggcgggggcggagtcggtttttcggtttgagttatcgtggcgggaattacgtttttcggtagttattgcgcgggcgtcgcggggtaggaagtcggtttggagtcgcggggttttttgggaattgtagtcgtttcgagttgcgtttggttggaagtacggttcgggttcgcgttttcggatttttttggtttcgttgcggcgaaggagggtagagattgttttttgtttgatttttttgtttttcggtcgtgaatgttatatttttgtggg

SEQ ID NO: 3290 - DNA, 551 bp, Artificial Sequence
  chemically treated genomic DNA (Homo sapiens) CpG-island No: 3290
cccacaaaaatataacattcacgaccgaaaaacaaaaaaatcaaacaaaaaacaatctctaccctccttcgccgcaacgaaaccaaaaaaatccgaaaacgcgaacccgaaccgtacttccaaccaaacgcaactcgaaacgactacaattcccaaaaaaccccgcgactccaaaccgacttcctaccccgcgacgcccgcgcaataactaccgaaaaacgtaattcccgccacgataactcaaaccgaaaaaccgactccgcccccgccaccaaccctacctccttccatatcctccgtccaattacgactactactcgtaaacgaactaaacgaaatataataatcgccgccaaaactcgtatccacgtcttcctccatcgaacccgatttataccgcttactccttataaacgaaaaaaaaaaaaaaactaattaccaaaaaaacgcgaaacgaaaaacgcgacgacgaactttactacttccgatccttaaataaacgaaaacgaaaaaaataatatcgcgaaacatcgcgaaaaccgcgaacgttc

SEQ ID NO: 3291 - DNA, 551 bp, Artificial Sequence
  chemically treated genomic DNA (Homo sapiens) CpG-island No: 3291
tttatagagatgtggtatttacggtcggagggtaggagagttaggtaggggatagtttttgttttttttcgtcgtagcggaattaaagagattcgagaacgcgaattcggatcgtatttttagttaagcgtagttcgggacgattataatttttaggaggtttcgcggttttaggtcggttttttgtttcgcggcgttcgcgtagtggttgtcggaagacgtagttttcgttacggtgatttagatcggaaggtcggtttcgttttcgttattagttttatttttttttatgtttttcgtttagttgcggttgttattcgtgggcgagttgggcgaagtgtagtaatcgtcgttagggttcgtgtttacgtttttttttatcgagttcgatttgtgtcgtttgttttttatgggcgagggaaggggagaggttggttattagggagacgcggggcggggggcgcgacggcgggttttgttattttcggtttttaagtgagcgggggcgagggaggtagtatcgcgagatatcgcgggagtcgcgggcgttt

SEQ ID NO: 3292 - DNA, 551 bp, Artificial Sequence
  chemically treated genomic DNA (Homo sapiens) CpG-island No: 3292
aaacgcccgcgactcccgcgatatctcgcgatactacctccctcgcccccgctcacttaaaaaccgaaaataacaaaacccgccgtcgcgccccccgccccgcgtctccctaataaccaacctctccccttccctcgcccataaaaaacaaacgacacaaatcgaactcgataaaaaaaaacgtaaacacgaaccctaacgacgattactacacttcgcccaactcgcccacgaataacaaccgcaactaaacgaaaaacataaaaaaaaataaaactaataacgaaaacgaaaccgaccttccgatctaaatcaccgtaacgaaaactacgtcttccgacaaccactacgcgaacgccgcgaaacaaaaaaccgacctaaaaccgcgaaacctcctaaaaattataatcgtcccgaactacgcttaactaaaaatacgatccgaattcgcgttctcgaatctctttaattccgctacgacgaaaaaaaacaaaaactatcccctacctaactctcctaccctccgaccgtaaataccacatctctataaa

SEQ ID NO: 3293 - DNA, 1014 bp, Artificial Sequence
  chemically treated genomic DNA (Homo sapiens) CpG-island No: 3293
tttttttcgtagtttattatcgttttcgtttttttttcgcgtagtttattatcgtttttatttttttttcgcgtagtttattatcgttttcgtttttttttcgcgtagtttattatcgttttcgtttttttttcgtagtttattatcgttttcgtttttttttcgtagtttattatcgttttcgttttttttttgtagtttattattgttttcgtttttttttcgcgtagtttattatcgttttcgtttttttttcgcgtagtttattatcgttttcgtttttttttcgcgtagtttattatcgtttttatttttttttcgtagtttattatcgtttttatttttatttcgcgtagttcgtagtttattatcgtttttattttttttttacgtagtttattatcgtttttattttttttttgtagtttattatcgtttttatttttttttcgcgtagtttattatcgtttttatatttttttcgcgtagtttattatcgtttttatttttatttcgcgtagttcgtagtttattatcgtttttattttttttttacgtagtttattatcgtttttattttttttttgtagtttattatcgttttcgtttttttttcgtagtttatcgtttttattttttttttgtagtttattatcgtttttatttttttttcgtagtttattatcgttttcgtttttttttcgcgtagtttattatcgtttttatatttttttcgcgtagtttattatcgtttttatttttatttcgtatagttcgtagtttattatcgttttcgttttttttttacgtagtttattatcgtttttatttttttttcgcgtagtttattatcgttttcgtttttttttcgcgtagtttattatcgtttttatttttttttcgtagtttattatcgttttcgtttttttttcgcgtagtttattatcgtttttatatttttgtattgggagggttttttatttttgtttttttagtaaatttttagtgttgtag

SEQ ID NO: 3294 - DNA, 1014 bp, Artificial Sequence
  chemically treated genomic DNA (Homo sapiens) CpG-island No: 3294
ctacaacactaaaaatttactaaaaaaacaaaaataaaaaaccctcccaatacaaaaatataaaaacgataataaactacgcgaaaaaaaaacgaaaacgataataaactacgaaaaaaaaataaaaacgataataaactacgcgaaaaaaaaacgaaaacgataataaactacgcgaaaaaaaaataaaaacgataataaactacgtaaaaaaaaaacgaaaacgataataaactacgaactatacgaaataaaaataaaaacgataataaactacgcgaaaaaaatataaaaacgataataaactacgcgaaaaaaaaacgaaaacgataataaactacgaaaaaaaaataaaaacgataataaactacaaaaaaaaaataaaaacgataaactacgaaaaaaaaacgaaaacgataataaactacaaaaaaaaaataaaaacgataataaactacgtaaaaaaaaaataaaaacgataataaactacgaactacgcgaaataaaaataaaaacgataataaactacgcgaaaaaaatataaaaacgataataaactacgcgaaaaaaaaataaaaacgataataaactacaaaaaaaaaataaaaacgataataaactacgtaaaaaaaaaataaaaacgataataaactacgaactacgcgaaataaaaataaaaacgataataaactacgaaaaaaaaataaaaacgataataaactacgcgaaaaaaaaacgaaaacgataataaactacgcgaaaaaaaaacgaaaacgataataaactacgcgaaaaaaaaacgaaaacaataataaactacaaaaaaaaaacgaaaacgataataaactacgaaaaaaaaacgaaaacgataataaactacgaaaaaaaaacgaaaacgataataaactacgcgaaaaaaaaacgaaaacgataataaactacgcgaaaaaaaaataaaaacgataataaactacgcgaaaaaaaaacgaaaacgataataaactacgaaaaaaa

SEQ ID NO: 3295 - DNA, 1014 bp, Artificial Sequence
  chemically treated genomic DNA (Homo sapiens) CpG-island No: 3295
ttatagtattaagagtttgttagaagggtaggaatgaagggtttttttagtataaaggtgtgaagacggtggtgaattgcgcggggaaggggcgaagacggtggtgaattgcggggaaggggtgaagacggtggtgaattgcgcggggaaggggcgaagacggtggtgaattgcgcggggaaggggtgaagacggtggtgaattgcgtggggaaggggcgaagacggtggtgaattgcgaattgtgcggggtaggggtgaagacggtggtgaattgcgcggggaaggtgtgaagacggtggtgaattgcgcggagaaggggcgaagacggtggtgaattgcggggaaggggtgaagacggtggtgaattgtagggaaggggtgaagacggtgaattgcggggaaggggcgaagacggtggtgaattgtagggaaggggtgaagacggtggtgaattgcgtggggaaggggtgaagacggtggtgaattgcgaattgcgcggggtaggggtgaagacggtggtgaattgcgcggggaaggtgtgaagacggtggtgaattgcgcggagaaggggtgaagacggtggtgaattgtagggaaggggtgaagacggtggtgaattgcgtggggaaggggtgaagacggtggtgaattgcgaattgcgcggggtaggggtgaagacggtggtgaattgcggggaaggggtgaagacggtggtgaattgcgcggagaaggggcgaagacggtggtgaattgcgcggggaaggggcgaagacggtggtgaattgcgcggggaaggggcgaagatagtggtgaattgtagggaaggggcgaagacggtggtgaattgcggggaaggggcgaagacggtggtgaattgcggggaaggggcgaagacggtggtgaattgcgcggggaaggggcgaagacggtggtgaattgcgcggggaaggggtgaagacggtggtgaattgcgcggggaaggggcgaagacggtggtgaattgcggggaagg

SEQ ID NO: 3296 - DNA, 1014 bp, Artificial Sequence
  chemically treated genomic DNA (Homo sapiens) CpG-island No: 3296
ccttccccgcaattcaccaccgtcttcgccccttccccgcgcaattcaccaccgtcttcaccccttccccgcgcaattcaccaccgtcttcgccccttccccgcgcaattcaccaccgtcttcgccccttccccgcaattcaccaccgtcttcgccccttccccgcaattcaccaccgtcttcgccccttccctacaattcaccactatcttcgccccttccccgcgcaattcaccaccgtcttcgccccttccccgcgcaattcaccaccgtcttcgccccttctccgcgcaattcaccaccgtcttcaccccttccccgcaattcaccaccgtcttcacccctaccccgcgcaattcgcaattcaccaccgtcttcaccccttccccacgcaattcaccaccgtcttcaccccttccctacaattcaccaccgtcttcaccccttctccgcgcaattcaccaccgtcttcacaccttccccgcgcaattcaccaccgtcttcacccctaccccgcgcaattcgcaattcaccaccgtcttcaccccttccccacgcaattcaccaccgtcttcaccccttccctacaattcaccaccgtcttcgccccttccccgcaattcaccgtcttcaccccttccctacaattcaccaccgtcttcaccccttccccgcaattcaccaccgtcttcgccccttctccgcgcaattcaccaccgtcttcacaccttccccgcgcaattcaccaccgtcttcacccctaccccgcacaattcgcaattcaccaccgtcttcgccccttccccacgcaattcaccaccgtcttcaccccttccccgcgcaattcaccaccgtcttcgccccttccccgcgcaattcaccaccgtcttcaccccttccccgcaattcaccaccgtcttcgccccttccccgcgcaattcaccaccgtcttcacacctttatactaaaaaaacccttcattcctacccttctaacaaactcttaatactataa

SEQ ID NO: 3297 - DNA, 861 bp, Artificial Sequence
  chemically treated genomic DNA (Homo sapiens) CpG-island No: 3297
ttcggtttgaggggacgtaatagggggcggttgtaaggttcgttacggcgttagtttggagcggacgaaatttttgtattttgcggtgttttttttaagggtttgtggtttttagttttttcgtcgttcgtttttcggtcgttagtcggtttttaacggcgttttttttattttcgttcgttaggttcgttattttatttttttaagtttttttataaggtttcgcgtcggtttaggttcgtttgttttttgttagaaattttcgcgcgtgcgtatttaataagtcgatttcgtgtgaggcggttagttcgcgtttgcgcgttgaatgtcgcgcggaggcgagtttcggatcgtttgttttgtagagtagtttgttttgacgagtcgcgtttttagtacgtatttgcgtacgagttatttttcgtttttttttttcgtcgattgagagggcggggaaagggtcgggaagggcgtatgcgtagtggtagcgattaaggtttagtgaggcggtatcgcgcggttcgaggcgggttttgaagtattcgtttttttattcgtttttcggggttttttcgcggtgggatagtgagtagtttagggcgtcgtagtcgaggtttttttttaggtaaatcgtcgggtttgcgggggttttttatacgcgcgggcgggagacgcgttgttttttattttagtttattcgttttaggagtcggtattttcggtaaacgtttttttgaaattacgggggaagtggcgagagggcgcggggtgtttgggattggggggtaaattagagtttatcggcgggggcgggggtcgtggttaggttttaggagggggcgtagttttgggatttaggtg

SEQ ID NO: 3298 - DNA, 861 bp, Artificial Sequence
  chemically treated genomic DNA (Homo sapiens) CpG-island No: 3298
cacctaaatcccaaaactacgccccctcctaaaacctaaccacgacccccgcccccgccgataaactctaatttaccccccaatcccaaacaccccgcgccctctcgccacttcccccgtaatttcaaaaaaacgtttaccgaaaataccgactcctaaaacgaataaactaaaataaaaaacaacgcgtctcccgcccgcgcgtataaaaaacccccgcaaacccgacgatttacctaaaaaaaaacctcgactacgacgccctaaactactcactatcccaccgcgaaaaaaccccgaaaaacgaataaaaaaacgaatacttcaaaacccgcctcgaaccgcgcgataccgcctcactaaaccttaatcgctaccactacgcatacgcccttcccgaccctttccccgccctctcaatcgacgaaaaaaaaaaacgaaaaataactcgtacgcaaatacgtactaaaaacgcgactcgtcaaaacaaactactctacaaaacaaacgatccgaaactcgcctccgcgcgacattcaacgcgcaaacgcgaactaaccgcctcacacgaaatcgacttattaaatacgcacgcgcgaaaatttctaacaaaaaacaaacgaacctaaaccgacgcgaaaccttataaaaaaacttaaaaaaataaaataacgaacctaacgaacgaaaataaaaaaaacgccgttaaaaaccgactaacgaccgaaaaacgaacgacgaaaaaactaaaaaccacaaacccttaaaaaaaacaccgcaaaatacaaaaatttcgtccgctccaaactaacgccgtaacgaaccttacaaccgccccctattacgtcccctcaaaccgaa

SEQ ID NO: 3299 - DNA, 861 bp, Artificial Sequence
  chemically treated genomic DNA (Homo sapiens) CpG-island No: 3299
tatttgggttttagggttgcgtttttttttagagtttgattacgattttcgttttcgtcgatgagttttgatttattttttaattttaagtatttcgcgttttttcgttatttttttcgtggttttaggaaagcgtttgtcgaaggtatcggtttttaaggcgggtaaattgaggtaggaggtaacgcgtttttcgttcgcgcgtgtgggaagttttcgtaggttcggcgatttatttggaggaaggtttcggttgcggcgttttgaattgtttattgttttatcgcgggggaatttcggaaaacgagtgggaaaacgagtgttttaagattcgtttcgggtcgcgcggtgtcgttttattaaattttagtcgttgttattgcgtatgcgtttttttcggtttttttttcgtttttttagtcggcgggaaaaggaggcgggagatggttcgtgcgtaggtgcgtgttaggagcgcggttcgttagggtaggttgttttgtagggtaggcgattcggggttcgttttcgcgcggtatttagcgcgtaggcgcgagttggtcgttttatacggagtcggtttgttaagtgcgtacgcgcgggagtttttggtagaaagtaggcgagtttgggtcggcgcggggttttgtgggagggtttaaggaagtaaaatggcggatttggcgaacgaaggtaggggaggcgtcgttggggatcggttggcggtcggggaacgggcggcgggaggattaggggttataagtttttggggggagtatcgtagagtgtaagggtttcgttcgttttaggttagcgtcgtggcgggttttgtagtcgttttttattgcgtttttttaggtcggg

SEQ ID NO: 3300 - DNA, 861 bp, Artificial Sequence
  chemically treated genomic DNA (Homo sapiens) CpG-island No: 3300
cccgacctaaaaaaacgcaataaaaaacgactacaaaacccgccacgacgctaacctaaaacgaacgaaacccttacactctacgatactccccccaaaaacttataacccctaatcctcccgccgcccgttccccgaccgccaaccgatccccaacgacgcctcccctaccttcgttcgccaaatccgccattttacttccttaaaccctcccacaaaaccccgcgccgacccaaactcgcctactttctaccaaaaactcccgcgcgtacgcacttaacaaaccgactccgtataaaacgaccaactcgcgcctacgcgctaaataccgcgcgaaaacgaaccccgaatcgcctaccctacaaaacaacctaccctaacgaaccgcgctcctaacacgcacctacgcacgaaccatctcccgcctccttttcccgccgactaaaaaaacgaaaaaaaaaccgaaaaaaacgcatacgcaataacaacgactaaaatttaataaaacgacaccgcgcgacccgaaacgaatcttaaaacactcgttttcccactcgttttccgaaattcccccgcgataaaacaataaacaattcaaaacgccgcaaccgaaaccttcctccaaataaatcgccgaacctacgaaaacttcccacacgcgcgaacgaaaaacgcgttacctcctacctcaatttacccgccttaaaaaccgataccttcgacaaacgctttcctaaaaccacgaaaaaaataacgaaaaaacgcgaaatacttaaaattaaaaaataaatcaaaactcatcgacgaaaacgaaaatcgtaatcaaactctaaaaaaaaacgcaaccctaaaacccaaata

SEQ ID NO: 3301 - DNA, 1366 bp, Artificial Sequence
  chemically treated genomic DNA (Homo sapiens) CpG-island No: 3301
cggcgaggttgattttcgcgtcggtagtattcggttttatcgcgttgtatcggggattaaaggttcgatttcgcgtagttcgacggttttcgggataggcgttttgggttacgtgagtttagcggagattttatacggtttcgcgggtttagggtaggtcgggagagaggcggttttcgcggttcgttcgcggttttagatttagtttttcgggttcgattttataattttacgttgtagtttcgtttttttagcgtcgttattttgtggcgttttcggaagaggaagtcgggagtgtaaatttcggggtcgttgggggtcggaaggatttcgtcgaaggtgaggggtaaaaacggtttatattgtttaagacgtttttacgaagtttatcgcggcgtttgttttaatttcgagtttcgttcgttttttcggggtttggcggttaattcgtacgtagagtttcgggagcgacggcgttaaagtttaatgagcggcgcgcgcgcgttttggtcgttttttcggagggtttagttggggtaattacgttcgggacgaaggttcggtcggcggtagtttgcgtagcggttgcgtcgttcgtatagagtttttttttttcgtttcgtatttagtagttaatataaattttcgtagttttggtttatgttttcgacgcggtttattagtagtttcgtttattaggcgattatagtacgtatgcgtttagcgtattttcgttatcgattattggaagattaggcgtatacgttattattttcgcgcgtttttattggttggtttttacgagggttcgttttcgtcgttttagttggtttttcgggttgttacgatttagtttcgtggtttaatgggagttgtggttttatcgcggtgttcgacggttcggttcgcgcgtatgcgtatttcgtttttttgtttatttcgtttcgttcgcgcggtatagtaatagagaaattcggaggtgggatgggaaaattttattaggtttggtttttagtttcggttacgcgggtttcgttcgtttcgagttcgggttacggggcgttttcgtcgtttttttcgtcgttttttacgtcgaggttcgggatgtcgcggatttggcgttgtagcgttttttttagtaagggtacggcgttttttttttttttttttgggggcggcggcggtggcggcgatacggtttcgggggttggttttgggggtacgggaggttgcgtcggtacgttttttgcgtttttcgagatttttgtcgtttcgttttgcgttttttcgtttagggtatcgtttttagtttttttttgttttttttttttttcggggttgtcggtgaaagggttttcgttttgtg

SEQ ID NO: 3302 - DNA, 1366 bp, Artificial Sequence
  chemically treated genomic DNA (Homo sapiens) CpG-island No: 3302
cacaaaacgaaaaccctttcaccgacaaccccgaaaaaaaaaaaaaacaaaaaaaaactaaaaacgataccctaaacgaaaaaacgcaaaacgaaacgacaaaaatctcgaaaaacgcaaaaaacgtaccgacgcaacctcccgtacccccaaaaccaacccccgaaaccgtatcgccgccaccgccgccgcccccaaaaaaaaaaaaaaaaaacgccgtacccttactaaaaaaaacgctacaacgccaaatccgcgacatcccgaacctcgacgtaaaaaacgacgaaaaaaacgacgaaaacgccccgtaacccgaactcgaaacgaacgaaacccgcgtaaccgaaactaaaaaccaaacctaataaaattttcccatcccacctccgaatttctctattactataccgcgcgaacgaaacgaaataaacaaaaaaacgaaatacgcatacgcgcgaaccgaaccgtcgaacaccgcgataaaaccacaactcccattaaaccacgaaactaaatcgtaacaacccgaaaaaccaactaaaacgacgaaaacgaaccctcgtaaaaaccaaccaataaaaacgcgcgaaaataataacgtatacgcctaatcttccaataatcgataacgaaaatacgctaaacgcatacgtactataatcgcctaataaacgaaactactaataaaccgcgtcgaaaacataaaccaaaactacgaaaatttatattaactactaaatacgaaacgaaaaaaaaaaactctatacgaacgacgcaaccgctacgcaaactaccgccgaccgaaccttcgtcccgaacgtaattaccccaactaaaccctccgaaaaaacgaccaaaacgcgcgcgcgccgctcattaaactttaacgccgtcgctcccgaaactctacgtacgaattaaccgccaaaccccgaaaaaacgaacgaaactcgaaattaaaacaaacgccgcgataaacttcgtaaaaacgtcttaaacaatataaaccgtttttacccctcaccttcgacgaaatccttccgacccccaacgaccccgaaatttacactcccgacttcctcttccgaaaacgccacaaaataacgacgctaaaaaaacgaaactacaacgtaaaattataaaatcgaacccgaaaaactaaatctaaaaccgcgaacgaaccgcgaaaaccgcctctctcccgacctaccctaaacccgcgaaaccgtataaaatctccgctaaactcacgtaacccaaaacgcctatcccgaaaaccgtcgaactacgcgaaatcgaacctttaatccccgatacaacgcgataaaaccgaatactaccgacgcgaaaatcaacctcgccg

SEQ ID NO: 3303 - DNA, 1366 bp, Artificial Sequence
  chemically treated genomic DNA (Homo sapiens) CpG-island No: 3303
tatagggcgagaatttttttatcgatagtttcgaggaggagaaggagtaggaggaggttgagggcggtgttttggacgagggggcgtagggcgaagcggtagggatttcggagggcgtagagggcgtgtcggcgtagtttttcgtgtttttagagttagttttcggggtcgtgtcgtcgttatcgtcgtcgtttttagaggaggaggaggagggcgtcgtgtttttgttgggaggggcgttgtaacgttagattcgcggtatttcgggtttcgacgtggaggacgacgaggagggcggcgggggcgtttcgtgattcgagttcggggcgggcggagttcgcgtggtcgaagttggaaattaaatttaataaagtttttttattttattttcgggtttttttgttattgtgtcgcgcgggcggggcggggtgggtagaggggcggggtgcgtatgcgcgcgggtcgggtcgtcgggtatcgcggtgggattataatttttattaggttacggagttggatcgtagtagttcgaaaggttagttgggacggcgagggcgggttttcgtgaagattagttaatgggggcgcgcggaagtagtgacgtgtgcgtttggttttttagtagtcgatggcggaggtgcgttgaacgtatgcgtgttgtggtcgtttagtaaacggggttgttggtgggtcgcgtcgaagatatggattagggttacggaggtttgtgttggttgttgggtgcggagcggggagggaaggttttgtgcgggcgacgtagtcgttgcgtagattgtcgtcggtcgggttttcgtttcgagcgtggttgttttagttgggtttttcggagaggcggttagggcgcgcgcgcgtcgtttattgggttttggcgtcgtcgttttcggggttttgcgtgcggattggtcgttaggtttcgaggaggcgggcgggattcggggttggggtagacgtcgcggtgggtttcgtgggggcgttttagatagtgtgggtcgtttttgttttttattttcggcggagttttttcggtttttagcgatttcggggtttgtattttcggttttttttttcgaagacgttataaaatggcggcgttaggggggcggagttatagcgtggggttgtgaggtcggattcggggagttgggtttggggtcgcgggcggatcgcgggggtcgtttttttttcgatttgttttaggttcgcggggtcgtgtagggttttcgttgggtttacgtggtttagggcgtttgtttcggaagtcgtcgggttgcgcggggtcgggtttttagttttcggtgtagcgcggtggggtcgagtgttgtcggcgcgagagttagtttcgtcg

SEQ ID NO: 3304 - DNA, 1366 bp, Artificial Sequence
  chemically treated genomic DNA (Homo sapiens) CpG-island No: 3304
cgacgaaactaactctcgcgccgacaacactcgaccccaccgcgctacaccgaaaactaaaaacccgaccccgcgcaacccgacgacttccgaaacaaacgccctaaaccacgtaaacccaacgaaaaccctacacgaccccgcgaacctaaaacaaatcgaaaaaaaaacgacccccgcgatccgcccgcgaccccaaacccaactccccgaatccgacctcacaaccccacgctataactccgcccccctaacgccgccattttataacgtcttcgaaaaaaaaaaccgaaaatacaaaccccgaaatcgctaaaaaccgaaaaaactccgccgaaaataaaaaacaaaaacgacccacactatctaaaacgcccccacgaaacccaccgcgacgtctaccccaaccccgaatcccgcccgcctcctcgaaacctaacgaccaatccgcacgcaaaaccccgaaaacgacgacgccaaaacccaataaacgacgcgcgcgcgccctaaccgcctctccgaaaaacccaactaaaacaaccacgctcgaaacgaaaacccgaccgacgacaatctacgcaacgactacgtcgcccgcacaaaaccttccctccccgctccgcacccaacaaccaacacaaacctccgtaaccctaatccatatcttcgacgcgacccaccaacaaccccgtttactaaacgaccacaacacgcatacgttcaacgcacctccgccatcgactactaaaaaaccaaacgcacacgtcactacttccgcgcgcccccattaactaatcttcacgaaaacccgccctcgccgtcccaactaacctttcgaactactacgatccaactccgtaacctaataaaaattataatcccaccgcgatacccgacgacccgacccgcgcgcatacgcaccccgcccctctacccaccccgccccgcccgcgcgacacaataacaaaaaaacccgaaaataaaataaaaaaactttattaaatttaatttccaacttcgaccacgcgaactccgcccgccccgaactcgaatcacgaaacgcccccgccgccctcctcgtcgtcctccacgtcgaaacccgaaataccgcgaatctaacgttacaacgcccctcccaacaaaaacacgacgccctcctcctcctcctctaaaaacgacgacgataacgacgacacgaccccgaaaactaactctaaaaacacgaaaaactacgccgacacgccctctacgccctccgaaatccctaccgcttcgccctacgccccctcgtccaaaacaccgccctcaacctcctcctactccttctcctcctcgaaactatcgataaaaaaattctcgccctata

SEQ ID NO: 3305 - DNA, 876 bp, Artificial Sequence
  chemically treated genomic DNA (Homo sapiens) CpG-island No: 3305
gtagacggcgggtggtgagttagagggaggaggcgttcgggtcgcggagtttcggaggggttgttcgataggtggcggggtcgggacgtttatcgattaggtgttaggttttgcgcgggtcgtagcgggcgtagtagttggcggcgcggtcggtttcgtagtttacgagcggtgtgtatagttcgtcggttatttggtttagtagtagtagtagtttcgcgtcgcgggagttgtaggcgcgtatcgagtgtaggtagagtagtaggtaggtgaattatatggacgcgtataggtcgttgaggaagtggtttacggcgtagtttagtcgcgttattagggatagcggtcgcggggacggcgtcgtttcggtcgttgggggtttcgggtttatcgcggcgtcgggttcgcgttttttattttcgggtttcgcggagggtattttggttaggtttttttgggtgtcgtgggggtaggcgtcggggatttttattacgcgtcgggtatttcgcgtttcgtttttttacggtcgcgtttttatttacgttcgtcgcgttcgttttacgttcgattttgtagtcgtcgggttttagagtcgggcgattgcgtcgggcggggtagggcggggaggtttcggtgtttgagttaatcggagtcgcgtttcggggaatcgtagttaatcgttaaggagagaggagaggggcgtggtcgtagggttcgtttcgtttttacgacgggcgtttacgcggttttagcgttcgtcgggtatgagggcgaatttcgagcgcgtcgtaggagtggtcggtatttttatagattggggaaggaaatggattagagggtatcgtcggtttttatttagattcggtttttaggttt

SEQ ID NO: 3306 - DNA, 876 bp, Artificial Sequence
  chemically treated genomic DNA (Homo sapiens) CpG-island No: 3306
aaacctaaaaaccgaatctaaataaaaaccgacgataccctctaatccatttccttccccaatctataaaaataccgaccactcctacgacgcgctcgaaattcgccctcatacccgacgaacgctaaaaccgcgtaaacgcccgtcgtaaaaacgaaacgaaccctacgaccacgcccctctcctctctccttaacgattaactacgattccccgaaacgcgactccgattaactcaaacaccgaaacctccccgccctaccccgcccgacgcaatcgcccgactctaaaacccgacgactacaaaatcgaacgtaaaacgaacgcgacgaacgtaaataaaaacgcgaccgtaaaaaaacgaaacgcgaaatacccgacgcgtaataaaaatccccgacgcctacccccacgacacccaaaaaaacctaaccaaaataccctccgcgaaacccgaaaataaaaaacgcgaacccgacgccgcgataaacccgaaacccccaacgaccgaaacgacgccgtccccgcgaccgctatccctaataacgcgactaaactacgccgtaaaccacttcctcaacgacctatacgcgtccatataattcacctacctactactctacctacactcgatacgcgcctacaactcccgcgacgcgaaactactactactactaaaccaaataaccgacgaactatacacaccgctcgtaaactacgaaaccgaccgcgccgccaactactacgcccgctacgacccgcgcaaaacctaacacctaatcgataaacgtcccgaccccgccacctatcgaacaacccctccgaaactccgcgacccgaacgcctcctccctctaactcaccacccgccgtctac

SEQ ID NO: 3307 - DNA, 876 bp, Artificial Sequence
  chemically treated genomic DNA (Homo sapiens) CpG-island No: 3307
gggtttggaggtcgggtttgggtgggagtcggcggtgttttttggtttatttttttttttagtttatgggggtgtcggttatttttgcggcgcgttcggggttcgtttttatattcggcgggcgttaggatcgcgtgggcgttcgtcgtagaggcggaacgagttttgcggttacgttttttttttttttttttggcgattggttgcggtttttcggggcgcggtttcgattggtttaggtatcggaattttttcgttttgtttcgttcggcgtagtcgttcggttttggggttcggcggttgtagagtcgagcgtggggcggacgcggcggacgtgggtgagggcgcggtcgtaagagagcgggacgcggggtgttcggcgcgtggtgggggttttcggcgtttgtttttacggtatttaagaaggtttggttagggtatttttcgcggagttcgggggtggggggcgcgggttcggcgtcgcgatgggttcgggatttttagcggtcggagcggcgtcgttttcgcggtcgttgtttttggtggcgcggttgagttacgtcgtgggttatttttttaacgatttgtgcgcgtttatgtggtttatttatttgttgttttatttgtattcggtgcgcgtttatagttttcgcggcgcggggttgttgttgttgttgggttaggtggtcgacgggttgtgtatatcgttcgtgggttacgaggtcgatcgcgtcgttagttgttgcgttcgttacggttcgcgtaaggtttggtatttggtcggtaagcgtttcggtttcgttatttgtcgggtagttttttcgagatttcgcgattcgggcgttttttttttttgatttattattcgtcgtttgt

SEQ ID NO: 3308 - DNA, 876 bp, Artificial Sequence
  chemically treated genomic DNA (Homo sapiens) CpG-island No: 3308
acaaacgacgaataataaatcaaaaaaaaaaaacgcccgaatcgcgaaatctcgaaaaaactacccgacaaataacgaaaccgaaacgcttaccgaccaaataccaaaccttacgcgaaccgtaacgaacgcaacaactaacgacgcgatcgacctcgtaacccacgaacgatatacacaacccgtcgaccacctaacccaacaacaacaacaaccccgcgccgcgaaaactataaacgcgcaccgaatacaaataaaacaacaaataaataaaccacataaacgcgcacaaatcgttaaaaaaataacccacgacgtaactcaaccgcgccaccaaaaacaacgaccgcgaaaacgacgccgctccgaccgctaaaaatcccgaacccatcgcgacgccgaacccgcgccccccacccccgaactccgcgaaaaataccctaaccaaaccttcttaaataccgtaaaaacaaacgccgaaaacccccaccacgcgccgaacaccccgcgtcccgctctcttacgaccgcgccctcacccacgtccgccgcgtccgccccacgctcgactctacaaccgccgaaccccaaaaccgaacgactacgccgaacgaaacaaaacgaaaaaattccgatacctaaaccaatcgaaaccgcgccccgaaaaaccgcaaccaatcgccaaaaaaaaaaaaaaaaaacgtaaccgcaaaactcgttccgcctctacgacgaacgcccacgcgatcctaacgcccgccgaatataaaaacgaaccccgaacgcgccgcaaaaataaccgacacccccataaactaaaaaaaaaaataaaccaaaaaacaccgccgactcccacccaaacccgacctccaaaccc

SEQ ID NO: 3309 - DNA, 1344 bp, Artificial Sequence
  chemically treated genomic DNA (Homo sapiens) CpG-island No: 3309
cggcgtagcgcgtgaggcggagtttcggcgtttgcggaagatgaatgtggttttcgaggagtagaacgcggtattgtagaggtatacgtagagtatgagtagcgcgcgcgagcgtttggagtaggagttggcgttggaggagcggaggacgttggcgttgtagtagtagttttaggtcgtgcgttaggcgtttatcgttagtttcgttttattgtcggtgtcgggtgcgggttacgtttattttttagtttcgtttcggttattcggtttcgttcgttttttttttttttttttttttttttttttttttgtcgttcggcgtcgtttatcgtttcgtttttttttttttagttattcggtttcgtttatcgtttcgtttttattatttttagtttcgtttttttttcgattttcgtatttttattttatagtttcgtttggttttttttagattatattcgagtttcgtttcgcgtttcgttattcggtcggttttttgatttcgtttttatcgatcgcgtttttcggttacgatttttttcgacgcgttttcgtttattcgttttttttcgtagtttttttgtgtttttatttttcgcgtttttatcgttttttatcggttttatcgtcgttggtttttttttttcgttagttttcgattagtttgagtattgatttagttttttcgttcgttacgttacgtttttatttattttatttttttacgttttcgttatttatttttttttacgtttcgttgacgtttgagttttttttattattttagttacgttttacgcgattttagtttttcggtgttatttttattttttcgatttcgtttttttcgttcgtgattgtttttagcggattttggacgttcgtcgttttagtttcgcgtttttattttgttttcgttttcgttatttttttgtttcggtttattttagtttattttgcgtcgtttttgcgttggcggtgttcggatttttgagcgttcgcgcgattcgttttgagttattttttatcgttgtttttggagttttcgtttcgcgatttttcggtattttcgtttgattttttcgtttgttttttaggtacgggcgaaacgtttacgttgggtattttggatttttatatggttcggttttacggagttatcgagcgcgatttcgtttagtacgagaagtttatcgttcgtattaaggaaattttggtttaggtcgttaggtgtgtgtcgggcgaggcggggcggggtcggggtttaaggttcggatgtgttcgttttggggttttttaggttcgcgagggttgttgggtgggatttcgtagtttattagagat

SEQ ID NO: 3310 - DNA, 1344 bp, Artificial Sequence
  chemically treated genomic DNA (Homo sapiens) CpG-island No: 3310
atctctaataaactacgaaatcccacccaacaaccctcgcgaacctaaaaaaccccaaaacgaacacatccgaaccttaaaccccgaccccgccccgcctcgcccgacacacacctaacgacctaaaccaaaatttccttaatacgaacgataaacttctcgtactaaacgaaatcgcgctcgataactccgtaaaaccgaaccatataaaaatccaaaatacccaacgtaaacgtttcgcccgtacctaaaaaacaaacgaaaaaatcaaacgaaaataccgaaaaatcgcgaaacgaaaactccaaaaacaacgataaaaaataactcaaaacgaatcgcgcgaacgctcaaaaatccgaacaccgccaacgcaaaaacgacgcaaaataaactaaaataaaccgaaacaaaaaaataacgaaaacgaaaacaaaataaaaacgcgaaactaaaacgacgaacgtccaaaatccgctaaaaacaatcacgaacgaaaaaaacgaaatcgaaaaaataaaaataacaccgaaaaactaaaatcgcgtaaaacgtaactaaaataataaaaaaaactcaaacgtcaacgaaacgtaaaaaaaaataaataacgaaaacgtaaaaaaataaaataaataaaaacgtaacgtaacgaacgaaaaaactaaatcaatactcaaactaatcgaaaactaacgaaaaaaaaaaaccaacgacgataaaaccgataaaaaacgataaaaacgcgaaaaataaaaacacaaaaaaactacgaaaaaaaacgaataaacgaaaacgcgtcgaaaaaaatcgtaaccgaaaaacgcgatcgataaaaacgaaatcaaaaaaccgaccgaataacgaaacgcgaaacgaaactcgaatataatctaaaaaaaaccaaacgaaactataaaataaaaatacgaaaatcgaaaaaaaaacgaaactaaaaataataaaaacgaaacgataaacgaaaccgaataactaaaaaaaaaaaaacgaaacgataaacgacgccgaacgacaaaaaaaaaaaaaaaaaaaaaaaaaaaaaaaaaacgaacgaaaccgaataaccgaaacgaaactaaaaaataaacgtaacccgcacccgacaccgacaataaaacgaaactaacgataaacgcctaacgcacgacctaaaactactactacaacgccaacgtcctccgctcctccaacgccaactcctactccaaacgctcgcgcgcgctactcatactctacgtatacctctacaataccgcgttctactcctcgaaaaccacattcatcttccgcaaacgccgaaactccgcctcacgcgctacgccg

SEQ ID NO: 3311 - DNA, 1344 bp, Artificial Sequence
  chemically treated genomic DNA (Homo sapiens) CpG-island No: 3311
atttttagtaagttgcggagttttatttagtagttttcgcggatttggggaattttagggcgggtatattcgggttttgaatttcggtttcgtttcgtttcgttcggtatatatttggcgatttgggttaggatttttttgatgcggacgatgagtttttcgtgttgggcggggtcgcgttcgatggtttcgtgaagtcgggttatgtagaagtttagagtgtttagcgtgggcgtttcgttcgtgtttgggggataggcgggaaggttaggcgagggtgtcggggagtcgcggggcgggggttttaggggtagcggtagggggtgatttagggcgggtcgcgcgggcgtttagaggttcggatatcgttagcgtaggagcggcgtagggtgggttaaggtaagtcggggtaggaggatggcgaggacggggatagggtggggacgcggggttagagcggcgggcgtttagggttcgttgaggatagttacggacggagggaacgaggtcggggaggtggggatgatatcggggggttggggtcgcgtgggacgtgattggggtggtggagggggtttaggcgttagcggggcgtggggagggatgggtgacgggggcgtggggaggtggggtgaatgggaacgtggcgtggcgagcggggaggttgggttagtgtttaggttggtcgggggttggcgagggagaggggttagcgacggtggggtcggtagggagcggtgggggcgcgaagggtgggggtataaaggggttgcgggaggaagcgagtaagcggggacgcgtcgggagaggtcgtggtcgggaggcgcggtcggtgggggcgaggttagggagtcggtcgagtaacggggcgcggagcggagttcgggtgtggtttgggaagaattagacggagttatggggtaggggtgcgggggtcggggaggaggcggagttgggggtgatgagggcggggcgataggcggggtcgggtgattggggaagaggggacggggcgatgggcggcgtcgggcgataggggaaggggggaagggaggagggggggggaggcgggcggggtcgggtgatcggggcgggattgggagatgggcgtggttcgtattcggtatcggtagtgaggcgaagttggcggtgagcgtttggcgtacggtttggagttgttgttgtagcgttagcgtttttcgtttttttagcgttagtttttgttttagacgttcgcgcgcgttgtttatgttttgcgtgtgtttttgtagtatcgcgttttgtttttcgaaggttatatttatttttcgtaagcgtcgaagtttcgttttacgcgttgcgtcg

SEQ ID NO: 3312 - DNA, 1344 bp, Artificial Sequence
  chemically treated genomic DNA (Homo sapiens) CpG-island No: 3312
cgacgcaacgcgtaaaacgaaacttcgacgcttacgaaaaataaatataaccttcgaaaaacaaaacgcgatactacaaaaacacacgcaaaacataaacaacgcgcgcgaacgtctaaaacaaaaactaacgctaaaaaaacgaaaaacgctaacgctacaacaacaactccaaaccgtacgccaaacgctcaccgccaacttcgcctcactaccgataccgaatacgaaccacgcccatctcccaatcccgccccgatcacccgaccccgcccgcctccccccccctcctcccttccccccttcccctatcgcccgacgccgcccatcgccccgtcccctcttccccaatcacccgaccccgcctatcgccccgccctcatcacccccaactccgcctcctccccgacccccgcacccctaccccataactccgtctaattcttcccaaaccacacccgaactccgctccgcgccccgttactcgaccgactccctaacctcgcccccaccgaccgcgcctcccgaccacgacctctcccgacgcgtccccgcttactcgcttcctcccgcaacccctttatacccccacccttcgcgcccccaccgctccctaccgaccccaccgtcgctaacccctctccctcgccaacccccgaccaacctaaacactaacccaacctccccgctcgccacgccacgttcccattcaccccacctccccacgcccccgtcacccatccctccccacgccccgctaacgcctaaaccccctccaccaccccaatcacgtcccacgcgaccccaaccccccgatatcatccccacctccccgacctcgttccctccgtccgtaactatcctcaacgaaccctaaacgcccgccgctctaaccccgcgtccccaccctatccccgtcctcgccatcctcctaccccgacttaccttaacccaccctacgccgctcctacgctaacgatatccgaacctctaaacgcccgcgcgacccgccctaaatcaccccctaccgctacccctaaaacccccgccccgcgactccccgacaccctcgcctaaccttcccgcctatcccccaaacacgaacgaaacgcccacgctaaacactctaaacttctacataacccgacttcacgaaaccatcgaacgcgaccccgcccaacacgaaaaactcatcgtccgcatcaaaaaaatcctaacccaaatcgccaaatatataccgaacgaaacgaaacgaaaccgaaattcaaaacccgaatatacccgccctaaaattccccaaatccgcgaaaactactaaataaaactccgcaacttactaaaaat

SEQ ID NO: 3313 - DNA, 581 bp, Artificial Sequence
  chemically treated genomic DNA (Homo sapiens) CpG-island No: 3313
tttcgcgggttttttttcggtcgcggttgttttgggtaacgcgtggagtcgcgttttttgtattgatttgaatcgcgggagacgttacgttttttcgagatgtttaacgcgcgtaggcgtagttattcggagtgggtagggtttggttgggtgttgggtagggtttggcggtgtgtggggtaggcggggggcgtggtcgcgattagtcgcgcgcggcgtgggggcgtggtcgggttgcgggggtgcgcgcggtcggtcgggcgcgcgcggcggagggagggagtcgggaggtagcggaggagcgatcgtcgttatattagggatcgcggagttcgggatttcgttagcggcggtcgcggtcgggtttgcgggagttgcggaggtcggaggcgggcgttgtgcggtgttaggagaggcggggtcggcgggagttagcgagttacgggagcgagttaggtgaggcggtcggggtcggggattcgtttttcgggttttaggcggcggagtttgattgcgattttttaaaatcgggacggcggggcgggttgcgatttttattttagtttaggtttttttaggag

SEQ ID NO: 3314 - DNA, 581 bp, Artificial Sequence
  chemically treated genomic DNA (Homo sapiens) CpG-island No: 3314
ctcctaaaaaaacctaaactaaaataaaaatcgcaacccgccccgccgtcccgattttaaaaaatcgcaatcaaactccgccgcctaaaacccgaaaaacgaatccccgaccccgaccgcctcacctaactcgctcccgtaactcgctaactcccgccgaccccgcctctcctaacaccgcacaacgcccgcctccgacctccgcaactcccgcaaacccgaccgcgaccgccgctaacgaaatcccgaactccgcgatccctaatataacgacgatcgctcctccgctacctcccgactccctccctccgccgcgcgcgcccgaccgaccgcgcgcacccccgcaacccgaccacgcccccacgccgcgcgcgactaatcgcgaccacgccccccgcctaccccacacaccgccaaaccctacccaacacccaaccaaaccctacccactccgaataactacgcctacgcgcgttaaacatctcgaaaaaacgtaacgtctcccgcgattcaaatcaatacaaaaaacgcgactccacgcgttacccaaaacaaccgcgaccgaaaaaaaacccgcgaaa

SEQ ID NO: 3315 - DNA, 581 bp, Artificial Sequence
  chemically treated genomic DNA (Homo sapiens) CpG-island No: 3315
tttttggaggggtttgagttggggtgggggtcgtagttcgtttcgtcgtttcggttttggggggtcgtagttaagtttcgtcgtttagggttcggggggcgggttttcgatttcggtcgttttatttggttcgttttcgtggttcgttggttttcgtcgatttcgttttttttggtatcgtatagcgttcgttttcggttttcgtagttttcgtaggttcggtcgcggtcgtcgttgacgggatttcgggtttcgcggtttttaatatggcggcggtcgttttttcgttgtttttcggtttttttttttcgtcgcgcgcgttcggtcggtcgcgcgtattttcgtaattcgattacgtttttacgtcgcgcgcggttaatcgcggttacgtttttcgtttattttatatatcgttaggttttgtttaatatttagttaggttttgtttatttcgagtggttgcgtttgcgcgcgttgggtatttcgggaggacgtgacgtttttcgcgatttaaattaatataggaagcgcggttttacgcgttgtttagggtaatcgcggtcggaagaggattcgcgggg

SEQ ID NO: 3316 - DNA, 581 bp, Artificial Sequence
  chemically treated genomic DNA (Homo sapiens) CpG-island No: 3316
ccccgcgaatcctcttccgaccgcgattaccctaaacaacgcgtaaaaccgcgcttcctatattaatttaaatcgcgaaaaacgtcacgtcctcccgaaatacccaacgcgcgcaaacgcaaccactcgaaataaacaaaacctaactaaatattaaacaaaacctaacgatatataaaataaacgaaaaacgtaaccgcgattaaccgcgcgcgacgtaaaaacgtaatcgaattacgaaaatacgcgcgaccgaccgaacgcgcgcgacgaaaaaaaaaaaccgaaaaacaacgaaaaaacgaccgccgccatattaaaaaccgcgaaacccgaaatcccgtcaacgacgaccgcgaccgaacctacgaaaactacgaaaaccgaaaacgaacgctatacgataccaaaaaaaacgaaatcgacgaaaaccaacgaaccacgaaaacgaaccaaataaaacgaccgaaatcgaaaacccgccccccgaaccctaaacgacgaaacttaactacgaccccccaaaaccgaaacgacgaaacgaactacgacccccaccccaactcaaacccctccaaaaa

SEQ ID NO: 3317 - DNA, 509 bp, Artificial Sequence
  chemically treated genomic DNA (Homo sapiens) CpG-island No: 3317
gagagcggatgggtgagtggatgggagagtagatggttgagcggatggatgagtagatgggagagtggatgagagtagttgaggaagtggatgggtgagaggatgggagtgcggatgtttgagcggatgggagagcggatgggagagtagacggttgagcggatgggagagcggatgggagagcggatgggagagcggatgggagagcggatgggagagcggttgggagagcggttgggagagcggatgggagagcggatgagagagtggatggttgagcggatgggagagcggatgagagtggttgagggagtggatgggagagtggatgagagtggttgaggaagtggatggttgagtggatgggagagcggatgggagagtggatgagagtggttgagggagtggatgggagagcggatgggagagtagatgggagagtagatgggtgagcggatgggagagtagatgggagagtggatgagagtggttgagggagtggttggttg

SEQ ID NO: 3318 - DNA, 509 bp, Artificial Sequence
  chemically treated genomic DNA (Homo sapiens) CpG-island No: 3318
caaccaaccactccctcaaccactctcatccactctcccatctactctcccatccgctcacccatctactctcccatctactctcccatccgctctcccatccactccctcaaccactctcatccactctcccatccgctctcccatccactcaaccatccacttcctcaaccactctcatccactctcccatccactccctcaaccactctcatccgctctcccatccgctcaaccatccactctctcatccgctctcccatccgctctcccaaccgctctcccaaccgctctcccatccgctctcccatccgctctcccatccgctctcccatccgctctcccatccgctcaaccgtctactctcccatccgctctcccatccgctcaaacatccgcactcccatcctctcacccatccacttcctcaactactctcatccactctcccatctactcatccatccgctcaaccatctactctcccatccactcacccatccgctctc

SEQ ID NO: 3319 - DNA, 509 bp, Artificial Sequence
  chemically treated genomic DNA (Homo sapiens) CpG-island No: 3319
taattagttatttttttaattatttttatttatttttttatttgtttttttattcgtttatttatttgtttttttatttgtttttttattcgtttttttatttatttttttaattatttttatttatttttttattcgtttttttatttatttaattatttatttttttaattatttttatttatttttttatttatttttttaattatttttattcgtttttttattcgtttaattatttatttttttattcgtttttttattcgtttttttaatcgtttttttaatcgtttttttattcgtttttttattcgtttttttattcgtttttttattcgtttttttattcgtttaatcgtttgtttttttattcgtttttttattcgtttaagtattcgtatttttatttttttatttatttatttttttaattatttttatttatttttttatttgtttatttattcgtttaattatttgtttttttatttatttatttattcgttttt

SEQ ID NO: 3320 - DNA, 509 bp, Artificial Sequence
  chemically treated genomic DNA (Homo sapiens) CpG-island No: 3320
aaaaacgaataaataaataaataaaaaaacaaataattaaacgaataaataaacaaataaaaaaataaataaaaataattaaaaaaataaataaataaaaaaataaaaatacgaatacttaaacgaataaaaaaacgaataaaaaaacaaacgattaaacgaataaaaaaacgaataaaaaaacgaataaaaaaacgaataaaaaaacgaataaaaaaacgattaaaaaaacgattaaaaaaacgaataaaaaaacgaataaaaaaataaataattaaacgaataaaaaaacgaataaaaataattaaaaaaataaataaaaaaataaataaaaataattaaaaaaataaataattaaataaataaaaaaacgaataaaaaaataaataaaaataattaaaaaaataaataaaaaaacgaataaaaaaacaaataaaaaaacaaataaataaacgaataaaaaaacaaataaaaaaataaataaaaataattaaaaaaataactaatta

SEQ ID NO: 3321 - DNA, 628 bp, Artificial Sequence
  chemically treated genomic DNA (Homo sapiens) CpG-island No: 3321
ggagagtagatgggtgagcggatgggagagcggatgggagagtggatgagagtggttgagggagcggatgggtgagcggatgggagagcgtatgggtgagtagatgtaagagtggatgagagtggttgagggagtggatggttgagcggatgggagagtagatgggagagtggatgggtgagcggatgggagagtagatgggtgagcggatgggagagcggatgggagagcggatgggagagcgtaggggagagcggaggagagagcggaggagagtggttgagggagtggatggttgagtagaagggagagcggatgggagagcggatgggtgagtagatgggtgagcggatgggagagcgtatgggagagcgtatgggagagcggatgggagagcgtatgggagagcgtatggatgagcgtatgggagagcgtatgggtgagcggatgtaagagtggatgagagtggttgagggagtggatggttgagtagatgggagagtagatgggagagtggatgagagtggatgggaaagcggatgagagtggttgagggagtggatgggagagtagatgggtgagtggatggaaaagtggatgggattgtggatgggagagtggatgagat

SEQ ID NO: 3322 - DNA, 628 bp, Artificial Sequence
  chemically treated genomic DNA (Homo sapiens) CpG-island No: 3322
atctcatccactctcccatccacaatcccatccacttttccatccactcacccatctactctcccatccactccctcaaccactctcatccgctttcccatccactctcatccactctcccatctactctcccatctactcaaccatccactccctcaaccactctcatccactcttacatccgctcacccatacgctctcccatacgctcatccatacgctctcccatacgctctcccatccgctctcccatacgctctcccatacgctctcccatccgctcacccatctactcacccatccgctctcccatccgctctcccttctactcaaccatccactccctcaaccactctcctccgctctctcctccgctctcccctacgctctcccatccgctctcccatccgctctcccatccgctcacccatctactctcccatccgctcacccatccactctcccatctactctcccatccgctcaaccatccactccctcaaccactctcatccactcttacatctactcacccatacgctctcccatccgctcacccatccgctccctcaaccactctcatccactctcccatccgctctcccatccgctcacccatctactctcc

SEQ ID NO: 3323 - DNA, 628 bp, Artificial Sequence
  chemically treated genomic DNA (Homo sapiens) CpG-island No: 3323
attttatttatttttttatttatagttttatttatttttttatttatttatttatttgtttttttatttatttttttaattatttttattcgtttttttatttatttttatttatttttttatttgtttttttatttatttaattatttatttttttaattatttttatttatttttgtattcgtttatttatgcgtttttttatgcgtttatttatgcgtttttttatgcgtttttttattcgtttttttatgcgtttttttatgcgtttttttattcgtttatttatttgtttatttattcgtttttttattcgtttttttttttgtttaattatttatttttttaattattttttttcgttttttttttcgtttttttttgcgtttttttattcgtttttttattcgtttttttattcgtttatttatttgtttttttattcgtttatttatttatttttttatttgtttttttattcgtttaattatttatttttttaattatttttatttatttttgtatttgtttatttatgcgtttttttattcgtttatttattcgtttttttaattatttttatttatttttttattcgtttttttattcgtttatttatttgtttttt

SEQ ID NO: 3324 - DNA, 628 bp, Artificial Sequence
  chemically treated genomic DNA (Homo sapiens) CpG-island No: 3324
aaaaaacaaataaataaacgaataaaaaaacgaataaaaaaataaataaaaataattaaaaaaacgaataaataaacgaataaaaaaacgcataaataaacaaatacaaaaataaataaaaataattaaaaaaataaataattaaacgaataaaaaaacaaataaaaaaataaataaataaacgaataaaaaaacaaataaataaacgaataaaaaaacgaataaaaaaacgaataaaaaaacgcaaaaaaaaacgaaaaaaaaaacgaaaaaaaataattaaaaaaataaataattaaacaaaaaaaaaaacgaataaaaaaacgaataaataaacaaataaataaacgaataaaaaaacgcataaaaaaacgcataaaaaaacgaataaaaaaacgcataaaaaaacgcataaataaacgcataaaaaaacgcataaataaacgaatacaaaaataaataaaaataattaaaaaaataaataattaaataaataaaaaaacaaataaaaaaataaataaaaataaataaaaaaacgaataaaaataattaaaaaaataaataaaaaaacaaataaataaataaataaaaaaataaataaaactataaataaaaaaataaataaaat

SEQ ID NO: 3325 - DNA, 537 bp, Artificial Sequence
  chemically treated genomic DNA (Homo sapiens) CpG-island No: 3325
cgtaggaacgttcggtagcggacgggggggttgaaggggttagggtttcggcgcgtgtgggttcgtatttggaggttataggtcgtgtcgggttttaggttttgtagcgtgagcgcgtttttcgcgttcggtttagtcgttgtcggtagtttagtttttcgggtagggtttagggtatcggtttttcgtacggttatcgtgtatttgacgatggtttcgttgcgttcggcgggtacgggtggtagttagcggagaaggacggtttcggtcgaggcgttgtcggtcgtttttagaatttgcgggtggttacggggcgtgtttttcgggatgtttaggatttcggttgttttttcgtttaggtcgtcgcggtttcgggtcgtaagtcggaatatatacgtggtttttttgtgtacgtttgatgtcgtgtagcggttttcggagggcgggaattttagggtggttaggggcgtcgagtttttacggttaaattgtaggcggtagtttagtatttggtttttcgcggtgttagtcgggggt

SEQ ID NO: 3326 - DNA, 537 bp, Artificial Sequence
  chemically treated genomic DNA (Homo sapiens) CpG-island No: 3326
acccccgactaacaccgcgaaaaaccaaatactaaactaccgcctacaatttaaccgtaaaaactcgacgcccctaaccaccctaaaattcccgccctccgaaaaccgctacacgacatcaaacgtacacaaaaaaaccacgtatatattccgacttacgacccgaaaccgcgacgacctaaacgaaaaaacaaccgaaatcctaaacatcccgaaaaacacgccccgtaaccacccgcaaattctaaaaacgaccgacaacgcctcgaccgaaaccgtccttctccgctaactaccacccgtacccgccgaacgcaacgaaaccatcgtcaaatacacgataaccgtacgaaaaaccgataccctaaaccctacccgaaaaactaaactaccgacaacgactaaaccgaacgcgaaaaacgcgctcacgctacaaaacctaaaacccgacacgacctataacctccaaatacgaacccacacgcgccgaaaccctaaccccttcaacccccccgtccgctaccgaacgttcctacg

SEQ ID NO: 3327 - DNA, 537 bp, Artificial Sequence
  chemically treated genomic DNA (Homo sapiens) CpG-island No: 3327
gttttcggttggtatcgcggaggattaggtgttgggttatcgtttgtagtttggtcgtgaggattcgacgtttttggttattttggagttttcgtttttcgaggatcgttatacggtattaggcgtgtataagggggttacgtatgtgtttcggtttgcggttcggagtcgcggcggtttgggcgaggaggtagtcgaggttttgagtatttcggaggatacgtttcgtggttattcgtagattttggaggcggtcggtaacgtttcggtcgggatcgttttttttcgttggttgttattcgtgttcgtcgagcgtaacggggttatcgttaaatatacggtggtcgtgcgggaggtcggtgttttgggttttgttcgagagattgagttgtcggtagcggttgagtcgggcgcggagaacgcgtttacgttgtagggtttgaagttcgatacggtttatgatttttaagtgcgagtttatacgcgtcggggttttggtttttttagttttttcgttcgttatcggacgtttttgcg

SEQ ID NO: 3328 - DNA, 537 bp, Artificial Sequence
  chemically treated genomic DNA (Homo sapiens) CpG-island No: 3328
cgcaaaaacgtccgataacgaacgaaaaaactaaaaaaaccaaaaccccgacgcgtataaactcgcacttaaaaatcataaaccgtatcgaacttcaaaccctacaacgtaaacgcgttctccgcgcccgactcaaccgctaccgacaactcaatctctcgaacaaaacccaaaacaccgacctcccgcacgaccaccgtatatttaacgataaccccgttacgctcgacgaacacgaataacaaccaacgaaaaaaaacgatcccgaccgaaacgttaccgaccgcctccaaaatctacgaataaccacgaaacgtatcctccgaaatactcaaaacctcgactacctcctcgcccaaaccgccgcgactccgaaccgcaaaccgaaacacatacgtaacccccttatacacgcctaataccgtataacgatcctcgaaaaacgaaaactccaaaataaccaaaaacgtcgaatcctcacgaccaaactacaaacgataacccaacacctaatcctccgcgataccaaccgaaaac

SEQ ID NO: 3329 - DNA, 557 bp, Artificial Sequence
  chemically treated genomic DNA (Homo sapiens) CpG-island No: 3329
gagggcgttatttcgagagcgacggcgggttattcggggcgggttgaggtaggttgtagtttcgtttcgggttttgggttttatttttcggttttattttcgtcgggtaagcgtttgtaggcggcgttgtcgtaaattaggcggtttgtttgtcgtattacgtaagatggcggtcgcggcggtgaacggggcggtaggtttttcgagtttcgggttcgcggtaatttcgggcgttgttttgtaggtcgcgatcggtatgtacgagtaatttaagggcgagtggaatcgtaaaagttttaattttagtaagtgcggggaagagttgggtcgatttaaggtaaagtcggtaggtttaggaaatcgagtgttgcgggcgtgggaggcgttacgaggtgtttggatttaattaagtttcgggtcgcggaagttatttcggtgttagcgagattgaggcgggttgggggattcgatggggtgaaagatttggaatagttaaagtgggggttcggagggcgttaagaagcgagagagggatagggagcgttgatggttacgtt

SEQ ID NO: 3330 - DNA, 557 bp, Artificial Sequence
  chemically treated genomic DNA (Homo sapiens) CpG-island No: 3330
aacgtaaccatcaacgctccctatccctctctcgcttcttaacgccctccgaacccccactttaactattccaaatctttcaccccatcgaatcccccaacccgcctcaatctcgctaacaccgaaataacttccgcgacccgaaacttaattaaatccaaacacctcgtaacgcctcccacgcccgcaacactcgatttcctaaacctaccgactttaccttaaatcgacccaactcttccccgcacttactaaaattaaaacttttacgattccactcgcccttaaattactcgtacataccgatcgcgacctacaaaacaacgcccgaaattaccgcgaacccgaaactcgaaaaacctaccgccccgttcaccgccgcgaccgccatcttacgtaatacgacaaacaaaccgcctaatttacgacaacgccgcctacaaacgcttacccgacgaaaataaaaccgaaaaataaaacccaaaacccgaaacgaaactacaacctacctcaacccgccccgaataacccgccgtcgctctcgaaataacgccctc

SEQ ID NO: 3331 - DNA, 557 bp, Artificial Sequence
  chemically treated genomic DNA (Homo sapiens) CpG-island No: 3331
ggcgtgattattaacgttttttgtttttttttcgttttttgacgtttttcgagtttttattttggttgttttaaattttttattttatcggattttttagttcgttttagtttcgttggtatcgaggtggttttcgcggttcgggatttggttgggtttagatatttcgtagcgttttttacgttcgtaatattcggttttttgggtttgtcgattttattttgagtcgatttagttttttttcgtatttgttaagattggggtttttacggttttattcgtttttgagttgttcgtatatgtcggtcgcggtttgtagaatagcgttcgaggttgtcgcgggttcggagttcgagaagtttgtcgtttcgtttatcgtcgcggtcgttattttgcgtgatgcggtaagtagatcgtttgatttacggtagcgtcgtttataaacgtttgttcggcggaagtggggtcgagaggtggagtttaaggttcggggcggggttataatttgttttagttcgtttcgggtagttcgtcgtcgttttcgaggtggcgttttt

SEQ ID NO: 3332 - DNA, 557 bp, Artificial Sequence
  chemically treated genomic DNA (Homo sapiens) CpG-island No: 3332
aaaaacgccacctcgaaaacgacgacgaactacccgaaacgaactaaaacaaattataaccccgccccgaaccttaaactccacctctcgaccccacttccgccgaacaaacgtttataaacgacgctaccgtaaatcaaacgatctacttaccgcatcacgcaaaataacgaccgcgacgataaacgaaacgacaaacttctcgaactccgaacccgcgacaacctcgaacgctattctacaaaccgcgaccgacatatacgaacaactcaaaaacgaataaaaccgtaaaaaccccaatcttaacaaatacgaaaaaaaactaaatcgactcaaaataaaatcgacaaacccaaaaaaccgaatattacgaacgtaaaaaacgctacgaaatatctaaacccaaccaaatcccgaaccgcgaaaaccacctcgataccaacgaaactaaaacgaactaaaaaatccgataaaataaaaaatttaaaacaaccaaaataaaaactcgaaaaacgtcaaaaaacgaaaaaaaaacaaaaaacgttaataatcacgcc

SEQ ID NO: 3333 - DNA, 715 bp, Artificial Sequence
  chemically treated genomic DNA (Homo sapiens) CpG-island No: 3333
gcggtcgcggttacgaggattatcggcgtttcgggttattcgcgtttttcgttttgtttatttgcgtcgtgcgtttcgttaagatcggcgcgttgaggggcgttgttttgggttttttagcggtattatttgtttttttgatcgaggttgcgtttttagcgtttttcgttcgtttatttttcggttcgggtttattttttgcgtttgttaaggttttttcggaagcggaggaggtagcgcgttgcgtgtattgtcgcgcgttttttcgtcgtagagtagacgggcgtggcggtcgttgcgtagaggtttcggattcgggtcgttttttggtgcgtcgtttaagttgtttgtggtgcgtcgagagtttgttttattattgtttgtcggacgtcgagggcgatttttcggattcgtgcgtttgcgagtcgggttattcgcgtttcgtcgcgcgttgggtcgcgttggtcgcgttttttttggtagtgttttgtttttgttgttacgcgtttttgcgcgcgtgttattgggtcgtagcgcgatgcggttgcgtcggttgcgggggtcgttacgaggaggttgcgcggtgaggacggtttggtgggttttttagtcggttcgaggatttaaaattgagggtttaggatttcggatttcgttcggatttaaaatttaaatttaggtatattcggaatttggagtttgagtttggattgag

SEQ ID NO: 3334 - DNA, 715 bp, Artificial Sequence
  chemically treated genomic DNA (Homo sapiens) CpG-island No: 3334
ctcaatccaaactcaaactccaaattccgaatatacctaaatttaaattttaaatccgaacgaaatccgaaatcctaaaccctcaattttaaatcctcgaaccgactaaaaaacccaccaaaccgtcctcaccgcgcaacctcctcgtaacgacccccgcaaccgacgcaaccgcatcgcgctacgacccaataacacgcgcgcaaaaacgcgtaacaacaaaaacaaaacactaccaaaaaaaacgcgaccaacgcgacccaacgcgcgacgaaacgcgaataacccgactcgcaaacgcacgaatccgaaaaatcgccctcgacgtccgacaaacaataataaaacaaactctcgacgcaccacaaacaacttaaacgacgcaccaaaaaacgacccgaatccgaaacctctacgcaacgaccgccacgcccgtctactctacgacgaaaaaacgcgcgacaatacacgcaacgcgctacctcctccgcttccgaaaaaaccttaacaaacgcaaaaaataaacccgaaccgaaaaataaacgaacgaaaaacgctaaaaacgcaacctcgatcaaaaaaacaaataataccgctaaaaaacccaaaacaacgcccctcaacgcgccgatcttaacgaaacgcacgacgcaaataaacaaaacgaaaaacgcgaataacccgaaacgccgataatcctcgtaaccgcgaccgc

SEQ ID NO: 3335 - DNA, 715 bp, Artificial Sequence
  chemically treated genomic DNA (Homo sapiens) CpG-island No: 3335
tttaatttaaatttaagttttaagtttcggatgtgtttaggtttgggttttaggttcgaacggagttcggggttttggatttttaattttgggttttcgggtcggttaggggatttattaggtcgtttttatcgcgtagttttttcgtggcgattttcgtagtcggcgtagtcgtatcgcgttgcgatttagtggtacgcgcgtaggggcgcgtagtagtagaggtagggtattgttagggagagcgcggttagcgcggtttagcgcgcggcggggcgcgggtggttcggttcgtaggcgtacgggttcgagaagtcgttttcggcgttcgataggtagtggtagagtaagttttcggcgtattataggtagtttagacggcgtattaggaggcgattcgggttcggggtttttgcgtagcggtcgttacgttcgtttgttttgcgacggaagagcgcgcggtaatgtacgtagcgcgttgtttttttcgttttcggggaggttttggtaggcgtagaggatgggttcgggtcggggggtgggcgagcggggggcgttgggggcgtagtttcggttaaaggggtaggtagtgtcgttgggggatttagggtagcgttttttaacgcgtcggttttggcgaagcgtacgacgtaggtggatagggcgaggggcgcgggtggttcggagcgtcggtaattttcgtagtcgcggtcgt

SEQ ID NO: 3336 - DNA, 715 bp, Artificial Sequence
  chemically treated genomic DNA (Homo sapiens) CpG-island No: 3336
acgaccgcgactacgaaaattaccgacgctccgaaccacccgcgcccctcgccctatccacctacgtcgtacgcttcgccaaaaccgacgcgttaaaaaacgctaccctaaatcccccaacgacactacctacccctttaaccgaaactacgcccccaacgccccccgctcgcccaccccccgacccgaacccatcctctacgcctaccaaaacctccccgaaaacgaaaaaaacaacgcgctacgtacattaccgcgcgctcttccgtcgcaaaacaaacgaacgtaacgaccgctacgcaaaaaccccgaacccgaatcgcctcctaatacgccgtctaaactacctataatacgccgaaaacttactctaccactacctatcgaacgccgaaaacgacttctcgaacccgtacgcctacgaaccgaaccacccgcgccccgccgcgcgctaaaccgcgctaaccgcgctctccctaacaataccctacctctactactacgcgcccctacgcgcgtaccactaaatcgcaacgcgatacgactacgccgactacgaaaatcgccacgaaaaaactacgcgataaaaacgacctaataaatcccctaaccgacccgaaaacccaaaattaaaaatccaaaaccccgaactccgttcgaacctaaaacccaaacctaaacacatccgaaacttaaaacttaaatttaaattaaa

SEQ ID NO: 3337 - DNA, 507 bp, Artificial Sequence
  chemically treated genomic DNA (Homo sapiens) CpG-island No: 3337
gtcgggtcggggcggggagaggcggggttaggttatggagtaatcgcgcggatcgcggagttagtgatcgtttttttttttcggggcgtagttcgggggtttttaagtcggcggtttcggcgtttttgcggtagatagggcggtattcgcggtttttttttttcgttgcgcgattttcgttgtcgggtcgggtttgcgcgtaggtgcggagttgcgattttcgtttcgaggcggagttagttcggtttttagcggtttagttttcgcgtttagtttgtcgtattagttaggcgtttgtttttgcgttcgtgtgttcgttcgtcggttcgttcgcgttacgattagggttttcgggggttaataagggggcgtcggtatttcgtcgtatagaggcggtttttgtttcggtatgaagtttcgtagggataagttgtatatttcggcgttgattttcgagtgagtgttgggtagggcgggggtatgcggggtgtagggaggataggatga

SEQ ID NO: 3338 - DNA, 507 bp, Artificial Sequence
  chemically treated genomic DNA (Homo sapiens) CpG-island No: 3338
tcatcctatcctccctacaccccgcatacccccgccctacccaacactcactcgaaaatcaacgccgaaatatacaacttatccctacgaaacttcataccgaaacaaaaaccgcctctatacgacgaaataccgacgcccccttattaacccccgaaaaccctaatcgtaacgcgaacgaaccgacgaacgaacacacgaacgcaaaaacaaacgcctaactaatacgacaaactaaacgcgaaaactaaaccgctaaaaaccgaactaactccgcctcgaaacgaaaatcgcaactccgcacctacgcgcaaacccgacccgacaacgaaaatcgcgcaacgaaaaaaaaaaaccgcgaataccgccctatctaccgcaaaaacgccgaaaccgccgacttaaaaacccccgaactacgccccgaaaaaaaaaaacgatcactaactccgcgatccgcgcgattactccataacctaaccccgcctctccccgccccgacccgac

SEQ ID NO: 3339 - DNA, 507 bp, Artificial Sequence
  chemically treated genomic DNA (Homo sapiens) CpG-island No: 3339
ttattttgttttttttgtatttcgtatattttcgttttgtttaatatttattcgagggttagcgtcgggatgtgtagtttgtttttgcgggattttatgtcgaggtagaggtcgtttttgtgcggcggggtatcgacgtttttttgttggttttcggaagttttgatcgtggcgcgagcggatcgacggacggatatacggacgtagggatagacgtttggttggtgcggtagattagacgcgggggttgggtcgttgggggtcgggttggtttcgtttcggggcggggatcgtagtttcgtatttgcgcgtaggttcggttcggtagcgagggtcgcgtagcgggaaaggggagtcgcgggtgtcgttttgtttgtcgtagggacgtcgaggtcgtcggtttgggagttttcgagttgcgtttcggaagggaagggcggttattggtttcgcggttcgcgcgattgttttatggtttgatttcgttttttttcgtttcggttcggt

SEQ ID NO: 3340 - DNA, 507 bp, Artificial Sequence
  chemically treated genomic DNA (Homo sapiens) CpG-island No: 3340
accgaaccgaaacgaaaaaaaacgaaatcaaaccataaaacaatcgcgcgaaccgcgaaaccaataaccgcccttcccttccgaaacgcaactcgaaaactcccaaaccgacgacctcgacgtccctacgacaaacaaaacgacacccgcgactcccctttcccgctacgcgaccctcgctaccgaaccgaacctacgcgcaaatacgaaactacgatccccgccccgaaacgaaaccaacccgacccccaacgacccaacccccgcgtctaatctaccgcaccaaccaaacgtctatccctacgtccgtatatccgtccgtcgatccgctcgcgccacgatcaaaacttccgaaaaccaacaaaaaaacgtcgataccccgccgcacaaaaacgacctctacctcgacataaaatcccgcaaaaacaaactacacatcccgacgctaaccctcgaataaatattaaacaaaacgaaaatatacgaaatacaaaaaaaacaaaataa

SEQ ID NO: 3341 - DNA, 638 bp, Artificial Sequence
  chemically treated genomic DNA (Homo sapiens) CpG-island No: 3341
tcgttttcgtcgttcgcggtcgtagtaacgttcggttttagtcgttcgcggttttagtaacgtttcgttttttcgttcgcggttatggtagcgtttcgtttattcgtcggtacgcgggttcgtcggtttcgttttcgcgtcgttcgtttcgtttttcgataggtttcgtttttaacggtttcgttttcgtattcgtttgggcggagttttagtcgcgttcgggggcgcgcgtttttttttcgtcgtttttttattttcgtagtttcgtgcgtttttttttttgttcggtttcgcggggtttttggggtcgattttatcgtcgaggttttttttttcggtttcgggcggttgcggcggtataaagggaagtagtatgttcgattttagttattggacggcggtggcggttttcggttatcggagtcgtttggtaaaaggcgcgttgttgtagcgttttaagaggtagggggtacggcgtcggcgaaggttcggcggttagtcgagtaaataggagttgttagaagtgtgttttggtcgcgtggcgcggattacggcgagcgtttgtttgtggtagtagtgggaaggggggaggacgtttgtggatcgaggtgttttttggggtttttggtatttttttt

SEQ ID NO: 3342 - DNA, 638 bp, Artificial Sequence
  chemically treated genomic DNA (Homo sapiens) CpG-island No: 3342
aaaaaaaataccaaaaaccccaaaaaacacctcgatccacaaacgtcctccccccttcccactactaccacaaacaaacgctcgccgtaatccgcgccacgcgaccaaaacacacttctaacaactcctatttactcgactaaccgccgaaccttcgccgacgccgtaccccctacctcttaaaacgctacaacaacgcgccttttaccaaacgactccgataaccgaaaaccgccaccgccgtccaataactaaaatcgaacatactacttccctttataccgccgcaaccgcccgaaaccgaaaaaaaaaacctcgacgataaaatcgaccccaaaaaccccgcgaaaccgaacaaaaaaaaaaacgcacgaaactacgaaaataaaaaaacgacgaaaaaaaaacgcgcgcccccgaacgcgactaaaactccgcccaaacgaatacgaaaacgaaaccgttaaaaacgaaacctatcgaaaaacgaaacgaacgacgcgaaaacgaaaccgacgaacccgcgtaccgacgaataaacgaaacgctaccataaccgcgaacgaaaaaacgaaacgttactaaaaccgcgaacgactaaaaccgaacgttactacgaccgcgaacgacgaaaacga

SEQ ID NO: 3343 - DNA, 638 bp, Artificial Sequence
  chemically treated genomic DNA (Homo sapiens) CpG-island No: 3343
aaggagggtgttagggattttaggggatatttcgatttataggcgtttttttttttttttattgttgttatagatagacgttcgtcgtggttcgcgttacgcggttaggatatatttttggtaatttttgtttgttcggttggtcgtcgagttttcgtcggcgtcgtgttttttattttttggagcgttgtagtagcgcgttttttgttaggcggtttcgatggtcgggagtcgttatcgtcgtttagtagttggggtcggatatgttgtttttttttgtgtcgtcgtagtcgttcgaggtcgggaagggaggtttcggcggtgggatcggttttaggagtttcgcggagtcggatagggaggggggcgtacggggttgcggggatgggggggcggcgagaaggaagcgcgcgttttcgagcgcgattggaatttcgtttaggcgagtgcgggggcggggtcgttgggggcggggtttgtcgggaggcggagcgagcgacgcggaagcgaggtcggcggattcgcgtgtcggcgagtgggcggggcgttgttatggtcgcgggcggagaggcggagcgttgttagggtcgcgggcggttgaggtcgggcgttgttacgatcgcgggcggcgggggcgg

SEQ ID NO: 3344 - DNA, 638 bp, Artificial Sequence
  chemically treated genomic DNA (Homo sapiens) CpG-island No: 3344
ccgcccccgccgcccgcgatcgtaacaacgcccgacctcaaccgcccgcgaccctaacaacgctccgcctctccgcccgcgaccataacaacgccccgcccactcgccgacacgcgaatccgccgacctcgcttccgcgtcgctcgctccgcctcccgacaaaccccgcccccaacgaccccgcccccgcactcgcctaaacgaaattccaatcgcgctcgaaaacgcgcgcttccttctcgccgcccccccatccccgcaaccccgtacgcccccctccctatccgactccgcgaaactcctaaaaccgatcccaccgccgaaacctcccttcccgacctcgaacgactacgacgacacaaaaaaaaacaacatatccgaccccaactactaaacgacgataacgactcccgaccatcgaaaccgcctaacaaaaaacgcgctactacaacgctccaaaaaataaaaaacacgacgccgacgaaaactcgacgaccaaccgaacaaacaaaaattaccaaaaatatatcctaaccgcgtaacgcgaaccacgacgaacgtctatctataacaacaataaaaaaaaaaaaaaacgcctataaatcgaaatatcccctaaaatccctaacaccctcctt

SEQ ID NO: 3345 - DNA, 532 bp, Artificial Sequence
  chemically treated genomic DNA (Homo sapiens) CpG-island No: 3345
ttttacggtaaatatcgtagttattcgaggtagtttaggtttaatgtttaggtattttgtaggcggcgcgcgtcgtcgtttttagttgtagtcgggattggcggagtgtttataattttcgacgtgtcgcgcgcgtagacgtttcgttgcggtcgtggtggaataggtggagtttgtttcgttgttttttgggaaacgaagtttcgttgaagagaggcggaattttgagtagtaggtggatttatagttaatgaagacgcgggtcgttttgagtgcggggtagagaagttaatggacgtgcggtattgagagggcgggtttttcggtagtgaaggtttggtgaacggttgcgcgatagaggatatttttttttgcgggtggcggcgaacgcggagagtacgttatgaaggtttcgggtacggtaaggcgggcgcggcgcggtagggggttaagggatggggtacgggttttattaggggtttgtataagtggcgtgggtcgggttggtgtcgcgcgtttttgtttgggtttt

SEQ ID NO: 3346 - DNA, 532 bp, Artificial Sequence
  chemically treated genomic DNA (Homo sapiens) CpG-island No: 3346
aaaacccaaacaaaaacgcgcgacaccaacccgacccacgccacttatacaaacccctaataaaacccgtaccccatcccttaaccccctaccgcgccgcgcccgccttaccgtacccgaaaccttcataacgtactctccgcgttcgccgccacccgcaaaaaaaaatatcctctatcgcgcaaccgttcaccaaaccttcactaccgaaaaacccgccctctcaataccgcacgtccattaacttctctaccccgcactcaaaacgacccgcgtcttcattaactataaatccacctactactcaaaattccgcctctcttcaacgaaacttcgtttcccaaaaaacaacgaaacaaactccacctattccaccacgaccgcaacgaaacgtctacgcgcgcgacacgtcgaaaattataaacactccgccaatcccgactacaactaaaaacgacgacgcgcgccgcctacaaaatacctaaacattaaacctaaactacctcgaataactacgatatttaccgtaaaa

SEQ ID NO: 3347 - DNA, 532 bp, Artificial Sequence
  chemically treated genomic DNA (Homo sapiens) CpG-island No: 3347
ggggtttaaatagaagcgcgcggtattaattcggtttacgttatttatgtaggtttttgatggggttcgtgttttattttttggttttttgtcgcgtcgcgttcgttttatcgtgttcgaggtttttatggcgtgtttttcgcgttcgtcgttattcgtaaaaggaagtgttttttgtcgcgtagtcgtttattaggtttttattatcggaagattcgtttttttaatgtcgtacgtttattggtttttttgtttcgtatttaaagcgattcgcgtttttattggttatggatttatttgttatttaaagtttcgtttttttttagcgagatttcgttttttagaaggtaacgaggtaagttttatttgttttattacgatcgtaacggagcgtttgcgcgcgcggtacgtcgggagttgtaggtatttcgttagtttcggttgtaattaggggcggcggcgcgcgtcgtttgtaggatgtttaagtattgaatttaagttatttcgggtggttgcggtgtttatcgtgaga

SEQ ID NO: 3348 - DNA, 532 bp, Artificial Sequence
  chemically treated genomic DNA (Homo sapiens) CpG-island No: 3348
tctcacgataaacaccgcaaccacccgaaataacttaaattcaatacttaaacatcctacaaacgacgcgcgccgccgcccctaattacaaccgaaactaacgaaatacctacaactcccgacgtaccgcgcgcgcaaacgctccgttacgatcgtaataaaacaaataaaacttacctcgttaccttctaaaaaacgaaatctcgctaaaaaaaaacgaaactttaaataacaaataaatccataaccaataaaaacgcgaatcgctttaaatacgaaacaaaaaaaccaataaacgtacgacattaaaaaaacgaatcttccgataataaaaacctaataaacgactacgcgacaaaaaacacttccttttacgaataacgacgaacgcgaaaaacacgccataaaaacctcgaacacgataaaacgaacgcgacgcgacaaaaaaccaaaaaataaaacacgaaccccatcaaaaacctacataaataacgtaaaccgaattaataccgcgcgcttctatttaaacccc

SEQ ID NO: 3349 - DNA, 501 bp, Artificial Sequence
  chemically treated genomic DNA (Homo sapiens) CpG-island No: 3349
attttgttagcggtttacgtttttttttttgaaagcggtttagatatagtatattgttttttttatattttcggtcgtatttcggtatcggtcgcggtttcgatatcggtcgtttttatggtcgtcgtcgaggacgtgtaggttgaggttaacgaatattttgtttttgagtttgagttttagttttagttcgtttaggatttttttgagttcgacgtcggtatcgatttcgttttaggtttcggtcgcggtttcggtttcggtttcggtttggaattcgggtttacggtttgttttttttttttttttcgttttcgtttttaatataagtttattttcgggcgcgggcgtgcgcgggcgcgtgcgttgtttatgtattggtattagatttagtcgttttcgtaatcgttaacgttatcgttatttttattttttgtttcggattttgattgagatcgtgatcgggagagggagagggagagggagagggagagggagagg

SEQ ID NO: 3350 - DNA, 501 bp, Artificial Sequence
  chemically treated genomic DNA (Homo sapiens) CpG-island No: 3350
cctctccctctccctctccctctccctctccctctcccgatcacgatctcaatcaaaatccgaaacaaaaaataaaaataacgataacgttaacgattacgaaaacgactaaatctaataccaatacataaacaacgcacgcgcccgcgcacgcccgcgcccgaaaataaacttatattaaaaacgaaaacgaaaaaaaaaaaaaaaacaaaccgtaaacccgaattccaaaccgaaaccgaaaccgaaaccgcgaccgaaacctaaaacgaaatcgataccgacgtcgaactcaaaaaaatcctaaacgaactaaaactaaaactcaaactcaaaaacaaaatattcgttaacctcaacctacacgtcctcgacgacgaccataaaaacgaccgatatcgaaaccgcgaccgataccgaaatacgaccgaaaatataaaaaaaacaatatactatatctaaaccgctttcaaaaaaaaaaacgtaaaccgctaacaaaat

SEQ ID NO: 3351 - DNA, 501 bp, Artificial Sequence
  chemically treated genomic DNA (Homo sapiens) CpG-island No: 3351
tttttttttttttttttttttttttttttttttttttcggttacggttttagttagagttcgaggtagagggtgagggtgacggtgacgttaacggttacgggggcggttgggtttaatgttagtgtatgggtagcgtacgcgttcgcgtacgttcgcgttcgggagtgagtttgtgttggagacggaggcggagagggggagggggataggtcgtggattcgaattttagatcgagatcgagatcgaaatcgcggtcggggtttgggacggggtcggtgtcggcgtcgggtttagggggattttgagcgagttggagttggagtttaagtttaagggtaaggtgttcgttaattttaatttgtacgttttcggcgacggttatggaaacggtcggtgtcggggtcgcgatcggtgtcggaatgcgatcggaaatgtgggagggatagtgtattgtgtttgggtcgtttttaaaaggaagggcgtgagtcgttggtagagt

SEQ ID NO: 3352 - DNA, 501 bp, Artificial Sequence
  chemically treated genomic DNA (Homo sapiens) CpG-island No: 3352
actctaccaacgactcacgcccttccttttaaaaacgacccaaacacaatacactatccctcccacatttccgatcgcattccgacaccgatcgcgaccccgacaccgaccgtttccataaccgtcgccgaaaacgtacaaattaaaattaacgaacaccttacccttaaacttaaactccaactccaactcgctcaaaatccccctaaacccgacgccgacaccgaccccgtcccaaaccccgaccgcgatttcgatctcgatctcgatctaaaattcgaatccacgacctatccccctccccctctccgcctccgtctccaacacaaactcactcccgaacgcgaacgtacgcgaacgcgtacgctacccatacactaacattaaacccaaccgcccccgtaaccgttaacgtcaccgtcaccctcaccctctacctcgaactctaactaaaaccgtaaccgaaaaaaaaaaaaaaaaaaaaaaaaaaaaaaaaaaaaa

SEQ ID NO: 3353 - DNA, 1117 bp, Artificial Sequence
  chemically treated genomic DNA (Homo sapiens) CpG-island No: 3353
tggggcgcggggaggtttcggttagagcgttcgttttttcgcgtttcgggcggggtttttatttgttttagcgggttattttttttcggtaatatcgtagcgttttttggttggttaggagcgagttttcggtttttaggagaggcggttttttcgggacgttgtatagcgggtgggcgaagagggtttgtaatttggagttcgattcgttgtggttgtcgttagtcggtttagttcggggttcggttcgggaaaagttgtgtacgatcgtgtcggggttcgaggtagttgcggtcgagtttcgcgttagggaggaggcgcggtcggtgtacgggtattttcgcgggcgttttcgaggtcgtagttggcgttgtatttggggttagaggtggaagtagaggtcggcggagagtagcgcgtttagtagtagtagagttagtaggcggtttcggcgtagtttcggtatggcgtgttggttaagggggacgtcgggggtaggtcggttgttttcggggtttcgggaggggtcgcggggtgcgggtagaagaggtgtttggagtttcgcgggtgggtcggggttagtgagatcggaatgtttttcgcgcgggttagttttttgtggaggggtgtcgttttttaatttggggattaggtgtacggagtatcggggttttcggagttagcgggcgtcgttttttcgcgtcgagtgagtcgagggaatggggttttcggggtgttcgttttttgcgttttttttttcgtgcgttcgttcgttcggacgttcgcggtaggtgaagggtttcggggcgtcggcgtcggttgttatcgcgggcggacgggcgacggggcggggggcgatcgcggagggcggacggaggtcgtcggttgtaaagttcggggcgttttttttgaggatgttgtcgttcggcggcggttgttagtgttttcgcgattttttttgcgggcggcggagacgttagttcggcggttggtacgggcggcgcgagtggggagttggcgaagtaggagcggtttcggggagtttgtttgtgcgtttggatttttagaggtagaggtagcgcggggttttttcgagtttggtttggcgtcggtattt

SEQ ID NO: 3354 - DNA, 1117 bp, Artificial Sequence
  chemically treated genomic DNA (Homo sapiens) CpG-island No: 3354
aaataccgacgccaaaccaaactcgaaaaaaccccgcgctacctctacctctaaaaatccaaacgcacaaacaaactccccgaaaccgctcctacttcgccaactccccactcgcgccgcccgtaccaaccgccgaactaacgtctccgccgcccgcaaaaaaaatcgcgaaaacactaacaaccgccgccgaacgacaacatcctcaaaaaaaacgccccgaactttacaaccgacgacctccgtccgccctccgcgatcgccccccgccccgtcgcccgtccgcccgcgataacaaccgacgccgacgccccgaaacccttcacctaccgcgaacgtccgaacgaacgaacgcacgaaaaaaaaaacgcaaaaaacgaacaccccgaaaaccccattccctcgactcactcgacgcgaaaaaacgacgcccgctaactccgaaaaccccgatactccgtacacctaatccccaaattaaaaaacgacacccctccacaaaaaactaacccgcgcgaaaaacattccgatctcactaaccccgacccacccgcgaaactccaaacacctcttctacccgcaccccgcgacccctcccgaaaccccgaaaacaaccgacctacccccgacgtcccccttaaccaacacgccataccgaaactacgccgaaaccgcctactaactctactactactaaacgcgctactctccgccgacctctacttccacctctaaccccaaatacaacgccaactacgacctcgaaaacgcccgcgaaaatacccgtacaccgaccgcgcctcctccctaacgcgaaactcgaccgcaactacctcgaaccccgacacgatcgtacacaacttttcccgaaccgaaccccgaactaaaccgactaacgacaaccacaacgaatcgaactccaaattacaaaccctcttcgcccacccgctatacaacgtcccgaaaaaaccgcctctcctaaaaaccgaaaactcgctcctaaccaaccaaaaaacgctacgatattaccgaaaaaaaataacccgctaaaacaaataaaaaccccgcccgaaacgcgaaaaaacgaacgctctaaccgaaacctccccgcgcccca

SEQ ID NO: 3355 - DNA, 1117 bp, Artificial Sequence
  chemically treated genomic DNA (Homo sapiens) CpG-island No: 3355
gggtgtcggcgttaggttaggttcggggaggtttcgcgttatttttgtttttaggagtttaggcgtatagataagtttttcggagtcgtttttgtttcgttaattttttattcgcgtcgttcgtgttagtcgtcggattggcgttttcgtcgttcgtaggaggagtcgcgggagtattagtagtcgtcgtcgagcgatagtatttttaggagagacgtttcgggttttgtagtcggcggttttcgttcgtttttcgcggtcgtttttcgtttcgtcgttcgttcgttcgcggtggtagtcggcgtcggcgtttcggggttttttatttgtcgcgagcgttcgggcgggcgggcgtacgggagaaaaggcgtaagaagcgggtatttcgggaattttattttttcggtttattcggcgcggagaagcgacgttcgttgatttcgagagtttcggtgtttcgtgtatttggtttttaagttgaggagcgatatttttttataggggattagttcgcgcggggagtatttcggttttattgatttcggtttattcgcgggattttaggtattttttttgttcgtatttcgcgatttttttcgggatttcggagatagtcggtttgttttcggcgttttttttggttagtacgttatgtcggggttgcgtcgggatcgtttattgattttgttattgttgggcgcgttgtttttcgtcgatttttatttttatttttggttttaagtatagcgttagttgcggtttcgggagcgttcgcgggggtgttcgtgtatcggtcgcgttttttttttggcgcgggattcggtcgtagttgtttcggatttcggtacgatcgtgtataatttttttcgaatcgagtttcggattgaatcggttggcggtagttatagcgggtcgagttttaagttgtaggtttttttcgtttattcgttgtataacgtttcggaggagtcgttttttttgggagtcgaggattcgtttttggttagttaggaggcgttgcggtattatcggaggaaggtggttcgttggaataggtgaggatttcgttcgggacgcgggagagcgggcgttttggtcggggttttttcgcgtttta

SEQ ID NO: 3356 - DNA, 1117 bp, Artificial Sequence
  chemically treated genomic DNA (Homo sapiens) CpG-island No: 3356
taaaacgcgaaaaaaccccgaccaaaacgcccgctctcccgcgtcccgaacgaaatcctcacctattccaacgaaccaccttcctccgataataccgcaacgcctcctaactaaccaaaaacgaatcctcgactcccaaaaaaaacgactcctccgaaacgttatacaacgaataaacgaaaaaaacctacaacttaaaactcgacccgctataactaccgccaaccgattcaatccgaaactcgattcgaaaaaaattatacacgatcgtaccgaaatccgaaacaactacgaccgaatcccgcgccaaaaaaaaaacgcgaccgatacacgaacacccccgcgaacgctcccgaaaccgcaactaacgctatacttaaaaccaaaaataaaaataaaaatcgacgaaaaacaacgcgcccaacaataacaaaatcaataaacgatcccgacgcaaccccgacataacgtactaaccaaaaaaaacgccgaaaacaaaccgactatctccgaaatcccgaaaaaaatcgcgaaatacgaacaaaaaaaatacctaaaatcccgcgaataaaccgaaatcaataaaaccgaaatactccccgcgcgaactaatcccctataaaaaaatatcgctcctcaacttaaaaaccaaatacacgaaacaccgaaactctcgaaatcaacgaacgtcgcttctccgcgccgaataaaccgaaaaaataaaattcccgaaatacccgcttcttacgccttttctcccgtacgcccgcccgcccgaacgctcgcgacaaataaaaaaccccgaaacgccgacgccgactaccaccgcgaacgaacgaacgacgaaacgaaaaacgaccgcgaaaaacgaacgaaaaccgccgactacaaaacccgaaacgtctctcctaaaaatactatcgctcgacgacgactactaatactcccgcgactcctcctacgaacgacgaaaacgccaatccgacgactaacacgaacgacgcgaataaaaaattaacgaaacaaaaacgactccgaaaaacttatctatacgcctaaactcctaaaaacaaaaataacgcgaaacctccccgaacctaacctaacgccgacaccc

SEQ ID NO: 3357 - DNA, 678 bp, Artificial Sequence
  chemically treated genomic DNA (Homo sapiens) CpG-island No: 3357
tgcgtttcgtcgatttcggatttttttatcgtttatatattttttcgcgcgtacgtgtattatatttggtgttatacggtttttgatatacgttattcgtggagcgtatattttgcgttttttgtgcgatttttttttcgtggcgagttttatcgcgttacgcggtttttttgcggtcgttttgtagattttttttacgtagggtttttttgtgcgttttattggtttcgcgcgttgtttttcgacgatgtttttttttttgcgtcgatatatcgcgatgttatattcgttatataatttttttcgatttttcgcgtttttaagcgtttttcgttttttcgcgatttttgtttttttatgaagtttttcgtaacgggttatatttggggaggtttttattttcggtaggcgttttttgggtgggtcgtcgtttttcggcgtaaataaaatgttgtttatcggcgttggtattacgtgtttatacgttgtaatttttatttttattggcgtgtgcgtttttacgtgtgcgcggtttattttcgttttaggttttttatttgcgtaaggttatttttttcgcgatattatagtttttttaagtagttttgtttttttatagattatttgttttacgagtttatatggattatggttatttcggatatcgggcgttttggg

SEQ ID NO: 3358 - DNA, 678 bp, Artificial Sequence
  chemically treated genomic DNA (Homo sapiens) CpG-island No: 3358
cccaaaacgcccgatatccgaaataaccataatccatataaactcgtaaaacaaataatctataaaaaaacaaaactacttaaaaaaactataatatcgcgaaaaaaataaccttacgcaaataaaaaacctaaaacgaaaataaaccgcgcacacgtaaaaacgcacacgccaataaaaataaaaattacaacgtataaacacgtaataccaacgccgataaacaacattttatttacgccgaaaaacgacgacccacccaaaaaacgcctaccgaaaataaaaacctccccaaatataacccgttacgaaaaacttcataaaaaaacaaaaatcgcgaaaaaacgaaaaacgcttaaaaacgcgaaaaatcgaaaaaaattatataacgaatataacatcgcgatatatcgacgcaaaaaaaaaaacatcgtcgaaaaacaacgcgcgaaaccaataaaacgcacaaaaaaaccctacgtaaaaaaaatctacaaaacgaccgcaaaaaaaccgcgtaacgcgataaaactcgccacgaaaaaaaaatcgcacaaaaaacgcaaaatatacgctccacgaataacgtatatcaaaaaccgtataacaccaaatataatacacgtacgcgcgaaaaaatatataaacgataaaaaaatccgaaatcgacgaaacgca

SEQ ID NO: 3359 - DNA, 678 bp, Artificial Sequence
  chemically treated genomic DNA (Homo sapiens) CpG-island No: 3359
tttagagcgttcggtgttcgagatagttatagtttatgtaaattcgtgggataagtgatttgtgaaagagtaagattgtttgagagggttgtgatgtcgcgagagaggtggttttgcgtaaatggggggtttggggcgagaatgggtcgcgtatacgtaaaagcgtatacgttagtaaagatgggggttataacgtgtgaatacgtggtgttagcgtcggtgaataatattttgtttgcgtcgagaaacgacggtttatttaagaagcgtttgtcggagatgagaatttttttaagtgtaattcgttgcgggaagttttatggaaaggtagaagtcgcgagagggcgggagacgtttgggggcgcgggaaatcggagagggttgtgtagcgagtgtggtatcgcggtgtgtcggcgtaaaaaagagagtatcgtcgaggagtagcgcgcgaaattagtggggcgtatagagagattttgcgtggggggggtttgtagaacggtcgtaaaaaaatcgcgtgacgcggtggagttcgttacggggggggggtcgtataagaggcgtagaatgtgcgttttacgggtggcgtatgttagagatcgtgtgatattaagtgtagtgtacgtgcgcgcgggagggtgtgtagacggtggaggagttcgagatcggcgagacgta

SEQ ID NO: 3360 - DNA, 678 bp, Artificial Sequence
  chemically treated genomic DNA (Homo sapiens) CpG-island No: 3360
tacgtctcgccgatctcgaactcctccaccgtctacacaccctcccgcgcgcacgtacactacacttaatatcacacgatctctaacatacgccacccgtaaaacgcacattctacgcctcttatacgaccccccccccgtaacgaactccaccgcgtcacgcgatttttttacgaccgttctacaaaccccccccacgcaaaatctctctatacgccccactaatttcgcgcgctactcctcgacgatactctcttttttacgccgacacaccgcgataccacactcgctacacaaccctctccgatttcccgcgcccccaaacgtctcccgccctctcgcgacttctacctttccataaaacttcccgcaacgaattacacttaaaaaaattctcatctccgacaaacgcttcttaaataaaccgtcgtttctcgacgcaaacaaaatattattcaccgacgctaacaccacgtattcacacgttataacccccatctttactaacgtatacgcttttacgtatacgcgacccattctcgccccaaaccccccatttacgcaaaaccacctctctcgcgacatcacaaccctctcaaacaatcttactctttcacaaatcacttatcccacgaatttacataaactataactatctcgaacaccgaacgctctaaa

SEQ ID NO: 3361 - DNA, 569 bp, Artificial Sequence
  chemically treated genomic DNA (Homo sapiens) CpG-island No: 3361
tttttttcggtttttttcgacgtttttattttatttttagtttagtcgttagggtgagcgcggggtttcgcgtagggaacgggattcgtagtcgttcgttttttttttttttttttttttttttttcgggtttagtcgtttcgtcgagtatcgtaggtttcgggtcgggagcgggcggaggaagggtcgggcgttcggcgtaagttcgcgtcgttttagtttcggtttcggttcggttcgtatacgtcgtttatttggaagtcggcgacgttgtcgtttatttttttgttgcgtgtcgtaaatcgaatagcgggcgttggtttttttgtcggatatttttttgttagcgtcgttttggtcgagtcgcgggggtcgaatgtgcgacggggtagagcggggggatggtttttttttgcggggggggggagaattcgtttgattgtttagggaggacgggttgttttcgggttggggcgggttagatgttgtatttttcgggggggaaaaggtatcgggaaatgaggttagttgttgtattaaggatagaggggggtagagatagtgggaga

SEQ ID NO: 3362 - DNA, 569 bp, Artificial Sequence
  chemically treated genomic DNA (Homo sapiens) CpG-island No: 3362
tctcccactatctctacccccctctatccttaatacaacaactaacctcatttcccgataccttttcccccccgaaaaatacaacatctaacccgccccaacccgaaaacaacccgtcctccctaaacaatcaaacgaattctccccccccccgcaaaaaaaaaccatccccccgctctaccccgtcgcacattcgacccccgcgactcgaccaaaacgacgctaacaaaaaaatatccgacaaaaaaaccaacgcccgctattcgatttacgacacgcaacaaaaaaataaacgacaacgtcgccgacttccaaataaacgacgtatacgaaccgaaccgaaaccgaaactaaaacgacgcgaacttacgccgaacgcccgacccttcctccgcccgctcccgacccgaaacctacgatactcgacgaaacgactaaacccgaaaaaaaaaaaaaaaaaaaaaaaaaaaacgaacgactacgaatcccgttccctacgcgaaaccccgcgctcaccctaacgactaaactaaaaataaaataaaaacgtcgaaaaaaaccgaaaaaaa

SEQ ID NO: 3363 - DNA, 569 bp, Artificial Sequence
  chemically treated genomic DNA (Homo sapiens) CpG-island No: 3363
ttttttattatttttgtttttttttatttttgatataatagttgattttatttttcgatattttttttttttcgaaaagtataatatttggttcgttttagttcgaagatagttcgttttttttggataattagacgaatttttttttttttcgtaaaaaaaagttattttttcgttttgtttcgtcgtatattcggttttcgcgattcggttagagcggcgttggtagaggagtgttcggtaggagggttaacgttcgttgttcggtttgcgatacgtagtagggaggtgggcggtagcgtcgtcggtttttaggtaagcggcgtgtgcgggtcgggtcggggtcggggttggggcggcgcgggtttgcgtcggacgttcggtttttttttcgttcgttttcggttcggggtttgcggtgttcggcggggcggttgagttcgggggggaggaggaggaggaggaggaggacggacggttgcgggtttcgttttttgcgcggagtttcgcgtttattttggcggttgagttgggggtggggtgggggcgtcgggaagggtcgagggagg

SEQ ID NO: 3364 - DNA, 569 bp, Artificial Sequence
  chemically treated genomic DNA (Homo sapiens) CpG-island No: 3364
cctccctcgacccttcccgacgcccccaccccacccccaactcaaccgccaaaataaacgcgaaactccgcgcaaaaaacgaaacccgcaaccgtccgtcctcctcctcctcctcctcctcccccccgaactcaaccgccccgccgaacaccgcaaaccccgaaccgaaaacgaacgaaaaaaaaaccgaacgtccgacgcaaacccgcgccgccccaaccccgaccccgacccgacccgcacacgccgcttacctaaaaaccgacgacgctaccgcccacctccctactacgtatcgcaaaccgaacaacgaacgttaaccctcctaccgaacactcctctaccaacgccgctctaaccgaatcgcgaaaaccgaatatacgacgaaacaaaacgaaaaaataacttttttttacgaaaaaaaaaaaaattcgtctaattatccaaaaaaaacgaactatcttcgaactaaaacgaaccaaatattatacttttcgaaaaaaaaaaaatatcgaaaaataaaatcaactattatatcaaaaataaaaaaaaacaaaaataataaaaaa

SEQ ID NO: 3365 - DNA, 1134 bp, Artificial Sequence
  chemically treated genomic DNA (Homo sapiens) CpG-island No: 3365
cgtgaaaggggggggtcgaagagagggcgagggggagagaggatagcgagaggcgggtaggcgtatagcgggagagaatagtacggagagaaatagaaagcgtgtaattaatttattttggttcggcgaaggcgagagggcgggcgtgagggggggagggagtcggaggttaggagttgggggggacgggagggagcgaagggaaggttgcgggagaaagagcgggggtcggggttagacgttaagaggggcgcggggagtatagagaagcggagggaagggcgttacgtcgaggggtcgggggaggcggtgattggggggcggagtggaggttgtattcggatcgcgggcgtttagttcggtttgggtcgacggagttttttgtcgtcgcgagttcgggtttcgggagggggataggcggtggcggtatcggggtcgtttcgggacgtagcgcggaaaggggagcggttcgaggttgcgcgtcggggggagggttggagggggagcgttttggggggttataacgtcggcggtttgcgagtcggattgtttgcggggggaatcgttttttcgggcgaagcggggatggggggagttgaggtagatgaagaggaggcggcggggaattcgtaggttcggcggagcgcgatttcgcggacggcgttcgggacgggagttagtagcgaggtagcgggcggcgtcgacgcggggtcgttttgttcgatggaggcgttggtgggtagagcgcgggtaggcgtgggttaggaggcgggggcggtcggaaggggggggtcggggtcggtcgggttttacgtagtttcgtcggagagtaggcgaattgcgggcgtttacgttcggtttttatagtcgcgttagttcgcggtttagggttcgcgcgggtttcgttggtttcgcgttcgcgttaatgggtgttcgcggattttcgtttcgttttcggttcgttttcgtaattcgagttaagagcggggcggggggtgcgggttgggggttttggggttcgggggggggggcggcggtcgtaggggttggggggtgcgcgggggcgaggttgggtggggggtagggagtcgtagagcgttaaggttatgttgaatgttcgttttagagaattta

SEQ ID NO: 3366 - DNA, 1134 bp, Artificial Sequence
  chemically treated genomic DNA (Homo sapiens) CpG-island No: 3366
taaattctctaaaacgaacattcaacataaccttaacgctctacgactccctaccccccacccaacctcgcccccgcgcaccccccaacccctacgaccgccgcccccccccccgaaccccaaaacccccaacccgcaccccccgccccgctcttaactcgaattacgaaaacgaaccgaaaacgaaacgaaaatccgcgaacacccattaacgcgaacgcgaaaccaacgaaacccgcgcgaaccctaaaccgcgaactaacgcgactataaaaaccgaacgtaaacgcccgcaattcgcctactctccgacgaaactacgtaaaacccgaccgaccccgaccccccccttccgaccgcccccgcctcctaacccacgcctacccgcgctctacccaccaacgcctccatcgaacaaaacgaccccgcgtcgacgccgcccgctacctcgctactaactcccgtcccgaacgccgtccgcgaaatcgcgctccgccgaacctacgaattccccgccgcctcctcttcatctacctcaactccccccatccccgcttcgcccgaaaaaacgattccccccgcaaacaatccgactcgcaaaccgccgacgttataaccccccaaaacgctccccctccaaccctccccccgacgcgcaacctcgaaccgctcccctttccgcgctacgtcccgaaacgaccccgataccgccaccgcctatccccctcccgaaacccgaactcgcgacgacaaaaaactccgtcgacccaaaccgaactaaacgcccgcgatccgaatacaacctccactccgccccccaatcaccgcctcccccgacccctcgacgtaacgcccttccctccgcttctctatactccccgcgcccctcttaacgtctaaccccgacccccgctctttctcccgcaaccttcccttcgctccctcccgtcccccccaactcctaacctccgactccctccccccctcacgcccgccctctcgccttcgccgaaccaaaataaattaattacacgctttctatttctctccgtactattctctcccgctatacgcctacccgcctctcgctatcctctctccccctcgccctctcttcgacccccccctttcacg

SEQ ID NO: 3367 - DNA, 1134 bp, Artificial Sequence
  chemically treated genomic DNA (Homo sapiens) CpG-island No: 3367
tgaattttttagaacgggtatttagtatggttttggcgttttgcggttttttgttttttatttagtttcgttttcgcgtattttttagtttttgcgatcgtcgttttttttttcgggttttagggtttttagttcgtatttttcgtttcgtttttggttcgggttgcgggggcgggtcgggggcggggcgagggttcgcgggtatttattggcgcgggcgcgaggttagcgaggttcgcgcgggttttgggtcgcgggttggcgcgattataagagtcgggcgtgggcgttcgtagttcgtttgtttttcggcggagttgcgtgaggttcggtcggtttcggtttttttttttcggtcgttttcgttttttggtttacgtttgttcgcgttttgtttattagcgtttttatcgggtaaggcggtttcgcgtcgacgtcgttcgttgtttcgttgttgattttcgtttcgggcgtcgttcgcggggtcgcgtttcgtcgggtttgcggatttttcgtcgttttttttttatttattttaattttttttattttcgtttcgttcgaggaggcggtttttttcgtaggtagttcggttcgtaggtcgtcggcgttgtaattttttaaagcgttttttttttagtttttttttcggcgcgtagtttcgggtcgttttttttttcgcgttgcgtttcggagcggtttcggtgtcgttatcgtttgtttttttttcgaggttcgggttcgcgacggtagagggtttcgtcggtttaaatcgagttgggcgttcgcggttcgggtgtagtttttatttcgttttttagttatcgtttttttcggtttttcgacgtggcgttttttttttcgtttttttgtgtttttcgcgttttttttggcgtttggtttcggttttcgttttttttttcgtaatttttttttcgttttttttcgttttttttagtttttagttttcgatttttttttttttttacgttcgttttttcgttttcgtcgaattaaagtggattaattatacgttttttgttttttttcgtgttgttttttttcgttgtgcgtttgttcgtttttcgttgttttttttttttttcgtttttttttcggttttttttttttacg

SEQ ID NO: 3368 - DNA, 1134 bp, Artificial Sequence
  chemically treated genomic DNA (Homo sapiens) CpG-island No: 3368
cgtaaaaaaaaaaaaccgaaaaaaaaacgaaaaaaaaaaaaaacaacgaaaaacgaacaaacgcacaacgaaaaaaaacaacacgaaaaaaaacaaaaaacgtataattaatccactttaattcgacgaaaacgaaaaaacgaacgtaaaaaaaaaaaaaaatcgaaaactaaaaactaaaaaaaacgaaaaaaaacgaaaaaaaaattacgaaaaaaaaaacgaaaaccgaaaccaaacgccaaaaaaaacgcgaaaaacacaaaaaaacgaaaaaaaaaacgccacgtcgaaaaaccgaaaaaaacgataactaaaaaacgaaataaaaactacacccgaaccgcgaacgcccaactcgatttaaaccgacgaaaccctctaccgtcgcgaacccgaacctcgaaaaaaaaacaaacgataacgacaccgaaaccgctccgaaacgcaacgcgaaaaaaaaaacgacccgaaactacgcgccgaaaaaaaaactaaaaaaaaaacgctttaaaaaattacaacgccgacgacctacgaaccgaactacctacgaaaaaaaccgcctcctcgaacgaaacgaaaataaaaaaaattaaaataaataaaaaaaaaacgacgaaaaatccgcaaacccgacgaaacgcgaccccgcgaacgacgcccgaaacgaaaatcaacaacgaaacaacgaacgacgtcgacgcgaaaccgccttacccgataaaaacgctaataaacaaaacgcgaacaaacgtaaaccaaaaaacgaaaacgaccgaaaaaaaaaaaccgaaaccgaccgaacctcacgcaactccgccgaaaaacaaacgaactacgaacgcccacgcccgactcttataatcgcgccaacccgcgacccaaaacccgcgcgaacctcgctaacctcgcgcccgcgccaataaatacccgcgaaccctcgccccgcccccgacccgcccccgcaacccgaaccaaaaacgaaacgaaaaatacgaactaaaaaccctaaaacccgaaaaaaaaaacgacgatcgcaaaaactaaaaaatacgcgaaaacgaaactaaataaaaaacaaaaaaccgcaaaacgccaaaaccatactaaatacccgttctaaaaaattca

SEQ ID NO: 3369 - DNA, 656 bp, Artificial Sequence
  chemically treated genomic DNA (Homo sapiens) CpG-island No: 3369
tttttcgtcgtttaagtttagttaaggggaaggggtcgtcggcggaatttcgcgtttttttggtttttttcgtttttttcgtttcgttattaattatttcgttcgcgtttcgcgcgcgtttttcggcggagttttaggttcgcgggttagaggtattttatcgttcggcgggagcgtttttttttcgcgtttttcgttttagttttttgttcgttttattttgggattttttagtcgttttttttacgaatgagatttttgtaatgagtaaacgaaagtggcgcggatttcggggcgtttagtaggagcgagcgtagtcgttagtcgtaagttcgtagtcgtgtttcgcgttttacgtcggttttttcggcggtagtcggagacgagcgttagtatcggcgggatagtagtagatgcgggtcgagagtcggttaggggcgtagaggcggaggggatcggcgcggcggggagtttatcgcgaagttggaggttgcgttcgcgggcgtattaggagtttaggtagcgagcgatcgaacgttttgtggtaggcggtggacgttgttgaaggtgagcgagatttcggggttagtttttagtgttcgggagtaacgtttagttcgttggaagattcggggataatgtttaaatttggggga

SEQ ID NO: 3370 - DNA, 656 bp, Artificial Sequence
  chemically treated genomic DNA (Homo sapiens) CpG-island No: 3370
tcccccaaatttaaacattatccccgaatcttccaacgaactaaacgttactcccgaacactaaaaactaaccccgaaatctcgctcaccttcaacaacgtccaccgcctaccacaaaacgttcgatcgctcgctacctaaactcctaatacgcccgcgaacgcaacctccaacttcgcgataaactccccgccgcgccgatcccctccgcctctacgcccctaaccgactctcgacccgcatctactactatcccgccgatactaacgctcgtctccgactaccgccgaaaaaaccgacgtaaaacgcgaaacacgactacgaacttacgactaacgactacgctcgctcctactaaacgccccgaaatccgcgccactttcgtttactcattacaaaaatctcattcgtaaaaaaaacgactaaaaaatcccaaaataaaacgaacaaaaaactaaaacgaaaaacgcgaaaaaaaaacgctcccgccgaacgataaaatacctctaacccgcgaacctaaaactccgccgaaaaacgcgcgcgaaacgcgaacgaaataattaataacgaaacgaaaaaaacgaaaaaaaccaaaaaaacgcgaaattccgccgacgaccccttccccttaactaaacttaaacgacgaaaaa

SEQ ID NO: 3371 - DNA, 656 bp, Artificial Sequence
  chemically treated genomic DNA (Homo sapiens) CpG-island No: 3371
ttttttaaatttgggtattgttttcgggttttttaacggattgggcgttgttttcggatattgaggattggtttcggggtttcgtttatttttagtagcgtttatcgtttgttatagagcgttcgatcgttcgttgtttgagtttttggtgcgttcgcggacgtagtttttagtttcgcggtgagtttttcgtcgcgtcgatttttttcgtttttgcgtttttgatcggttttcggttcgtatttgttgttgtttcgtcggtgttggcgttcgttttcggttgtcgtcggggaggtcggcgtggggcgcgggatacggttgcggatttgcggttggcggttgcgttcgtttttgttgggcgtttcgaaattcgcgttattttcgtttgtttattgtaaagattttattcgtggggaaagcggttggagggttttaaagtggggcgggtagggggttggggcgagggacgcggaggagaggcgttttcgtcgggcggtaaagtgtttttagttcgcgggtttaggatttcgtcgggaggcgcgcgcggagcgcgggcgaagtgattgatggcggagcgaggggggcgaggggggttaggggggcgcgagatttcgtcggcggttttttttttttggttaggtttaggcggcgggggg

SEQ ID NO: 3372 - DNA, 656 bp, Artificial Sequence
  chemically treated genomic DNA (Homo sapiens) CpG-island No: 3372
ccccccgccgcctaaacctaaccaaaaaaaaaaaaccgccgacgaaatctcgcgcccccctaacccccctcgcccccctcgctccgccatcaatcacttcgcccgcgctccgcgcgcgcctcccgacgaaatcctaaacccgcgaactaaaaacactttaccgcccgacgaaaacgcctctcctccgcgtccctcgccccaaccccctacccgccccactttaaaaccctccaaccgctttccccacgaataaaatctttacaataaacaaacgaaaataacgcgaatttcgaaacgcccaacaaaaacgaacgcaaccgccaaccgcaaatccgcaaccgtatcccgcgccccacgccgacctccccgacgacaaccgaaaacgaacgccaacaccgacgaaacaacaacaaatacgaaccgaaaaccgatcaaaaacgcaaaaacgaaaaaaatcgacgcgacgaaaaactcaccgcgaaactaaaaactacgtccgcgaacgcaccaaaaactcaaacaacgaacgatcgaacgctctataacaaacgataaacgctactaaaaataaacgaaaccccgaaaccaatcctcaatatccgaaaacaacgcccaatccgttaaaaaacccgaaaacaatacccaaatttaaaaaa

SEQ ID NO: 3373 - DNA, 721 bp, Artificial Sequence
  chemically treated genomic DNA (Homo sapiens) CpG-island No: 3373
acgtagtattttatagtagcgtatgttatttcgtacggcgggtgttttattatttttttttatcgttttatattttttatttattatatttcgtttttatattttaacgtattttttttttttattatttatttttatattatattaattttatttttcgtatacgtattatttttatttattttttaattttacggtattcgttattttatttttattattatatatcgcgttttttattttatcgtttcgttttaattttattatcgatattttttttaatttaatgttttttatttttatttttttattcgtataaattttttaatttttatttttatttttttacgtttatttttttattatgtatttcgtgtgtagtatattttttagtcgtattatttttttttttttatttattataaaaaattttttcgtattttttttaaaatatttttttcgcgtttttttttattataatttaattttttttataaatttttttaatttttaattaattaattaaatttagttttttttaattttttttttttaaattcgttttttttaaattttttatatttaatttaattttaaattaattaatttttaaatttttttttttataaaattttttaaacgttttaaattttttattttaattttttaaatttaattttaaaattttttaatttttaattaaatttaatcgttttttatt

SEQ ID NO: 3374 - DNA, 721 bp, Artificial Sequence
  chemically treated genomic DNA (Homo sapiens) CpG-island No: 3374
aataaaaaacgattaaatttaattaaaaattaaaaaattttaaaattaaatttaaaaaattaaaataaaaaatttaaaacgtttaaaaaattttataaaaaaaaaaatttaaaaattaattaatttaaaattaaattaaatataaaaaatttaaaaaaaacgaatttaaaaaaaaaaaattaaaaaaaactaaatttaattaattaattaaaaattaaaaaaatttataaaaaaaattaaattataataaaaaaaaacgcgaaaaaaatattttaaaaaaaatacgaaaaaattttttataataaataaaaaaaaaaaaataatacgactaaaaaatatactacacacgaaatacataataaaaaaataaacgtaaaaaaataaaaataaaaattaaaaaatttatacgaataaaaaaataaaaataaaaaacattaaattaaaaaaaatatcgataataaaattaaaacgaaacgataaaataaaaaacgcgatatataataataaaaataaaataacgaataccgtaaaattaaaaaataaataaaaataatacgtatacgaaaaataaaattaatataatataaaaataaataataaaaaaaaaaaatacgttaaaatataaaaacgaaatataataaataaaaaatataaaacgataaaaaaaaataataaaacacccgccgtacgaaataacatacgctactataaaatactacgt

SEQ ID NO: 3375 - DNA, 721 bp, Artificial Sequence
  chemically treated genomic DNA (Homo sapiens) CpG-island No: 3375
gatggggggcggttgggtttggttggggattggggagttttggggttgggtttggggggttagagtgggaggtttggggcgtttggggggttttgtggaggggggggtttgggggttggttggtttggggttgggttgggtatggggggtttggggagagcgggtttgggggggaaaggttggggggggttgggtttggttggttggttgagggttgggggggtttataggggaggttgggttgtggtggggaggagcgcggggagggtgttttgaggagggtgcgagggggttttttgtggtgggtgaggaagggggggtgatgcggttggagggtatgttgtatacggagtgtatggtggggaggtgggcgtgaggaggtggggatgagggttggggggtttgtgcgggtgggagggtgggggtgggaagtattaggttggggggagtgtcggtggtgggattggagcggagcggtggggtggagagcgcggtgtgtggtggtgggagtggggtggcgggtgtcgtgaggttggaggatgggtgaaggtggtgcgtatacgaggagtgaggttggtgtggtgtggaggtggatggtggggggaaggagtgcgttggggtgtggggacgaagtgtagtgggtgggaggtgtggagcggtgggagaaggtggtggagtattcgtcgtgcggagtgatatgcgttgttgtggggtgttgcgt

SEQ ID NO: 3376 - DNA, 721 bp, Artificial Sequence
  chemically treated genomic DNA (Homo sapiens) CpG-island No: 3376
acgcaacaccccacaacaacgcatatcactccgcacgacgaatactccaccaccttctcccaccgctccacacctcccacccactacacttcgtccccacaccccaacgcactccttccccccaccatccacctccacaccacaccaacctcactcctcgtatacgcaccaccttcacccatcctccaacctcacgacacccgccaccccactcccaccaccacacaccgcgctctccaccccaccgctccgctccaatcccaccaccgacactccccccaacctaatacttcccacccccaccctcccacccgcacaaaccccccaaccctcatccccacctcctcacgcccacctccccaccatacactccgtatacaacataccctccaaccgcatcacccccccttcctcacccaccacaaaaaaccccctcgcaccctcctcaaaacaccctccccgcgctcctccccaccacaacccaacctcccctataaacccccccaaccctcaaccaaccaaccaaacccaaccccccccaacctttcccccccaaacccgctctccccaaaccccccatacccaacccaaccccaaaccaaccaacccccaaacccccccctccacaaaaccccccaaacgccccaaacctcccactctaaccccccaaacccaaccccaaaactccccaatccccaaccaaacccaaccgccccccatc

SEQ ID NO: 3377 - DNA, 703 bp, Artificial Sequence
  chemically treated genomic DNA (Homo sapiens) CpG-island No: 3377
gggcgtcgtaggtagttttatttttcgttagggtaaatcgggaaggggtttcgcggtggggtcgcgattttcggttttcgttttaatcgtgggagttttgcgcgcgacgcgttttaggtggtttcgttattgttttattttgtagggtgtttatatttcgttgattggaaagaaaagaaatcggggaagaagggagttcggagtttcgtttttagttgtcggagcgcgttcgtagcgcgttcgtttagttaggggaggggtttcgggttcgattcggagtttagtcggcgcgggttcgttttttttttttcgtttttcgtttttcgttttacgttttttcgttttttttttcggggtttttttcgggcgtcgttcgcgttttcgtcgagtttgatttcgtttttggtttttttttttcgcgcgcgtcggatcgttttttagtttatttaggcgtacgttttaggggacgcgtcgtttttttttttttcgtaacggtattagtagtcgcgttgcggtttttttcgagttttcgtttttttagttttagttcggttcgtcgtattcggcgaggcgagcgcggggttagggcggcggtttcgaagagaggttcggtttcgttttcggtttcgtttttggagacgcgagtttcggtttcgggtttggcgggggtatgagggtggttcggggtatcggaggatttggg

SEQ ID NO: 3378 - DNA, 703 bp, Artificial Sequence
  chemically treated genomic DNA (Homo sapiens) CpG-island No: 3378
cccaaatcctccgataccccgaaccaccctcatacccccgccaaacccgaaaccgaaactcgcgtctccaaaaacgaaaccgaaaacgaaaccgaacctctcttcgaaaccgccgccctaaccccgcgctcgcctcgccgaatacgacgaaccgaactaaaactaaaaaaacgaaaactcgaaaaaaaccgcaacgcgactactaataccgttacgaaaaaaaaaaaaacgacgcgtcccctaaaacgtacgcctaaataaactaaaaaacgatccgacgcgcgcgaaaaaaaaaaaccaaaaacgaaatcaaactcgacgaaaacgcgaacgacgcccgaaaaaaaccccgaaaaaaaaaacgaaaaaacgtaaaacgaaaaacgaaaaacgaaaaaaaaaaaacgaacccgcgccgactaaactccgaatcgaacccgaaacccctcccctaactaaacgaacgcgctacgaacgcgctccgacaactaaaaacgaaactccgaactcccttcttccccgatttcttttctttccaatcaacgaaatataaacaccctacaaaataaaacaataacgaaaccacctaaaacgcgtcgcgcgcaaaactcccacgattaaaacgaaaaccgaaaatcgcgaccccaccgcgaaaccccttcccgatttaccctaacgaaaaataaaactacctacgacgccc

SEQ ID NO: 3379 - DNA, 703 bp, Artificial Sequence
  chemically treated genomic DNA (Homo sapiens) CpG-island No: 3379
tttaggtttttcggtgtttcgggttatttttatgttttcgttaggttcggggtcgggattcgcgtttttaggggcggggtcgggggcggggtcgggttttttttcgaggtcgtcgttttggtttcgcgttcgtttcgtcgagtgcggcgggtcgggttggagttggaggggcggggattcgggaggggtcgtagcgcggttgttggtgtcgttgcgggagaagaggaagcggcgcgttttttgaggcgtgcgtttggatggattgaaggacggttcgacgcgcgcggagggagagggttaggggcgaggttaggttcggcgggggcgcgggcggcgttcggagggggtttcggggagggaggcggggaggcgtggagcggggagcggggagcggggaggggggagcgggttcgcgtcggttgagtttcgggtcgggttcgagattttttttttggttgggcgggcgcgttgcgagcgcgtttcggtagttgaaagcggagtttcggatttttttttttttcggttttttttttttttaattagcgagatataaatattttgtaaggtaaaataatagcggggttatttgggacgcgtcgcgcgtagagtttttacggttggggcgggggtcgggagtcgcggttttatcgcggagttttttttcgatttgttttggcggagggtggggttatttgcggcgttt

SEQ ID NO: 3380 - DNA, 703 bp, Artificial Sequence
  chemically treated genomic DNA (Homo sapiens) CpG-island No: 3380
aaacgccgcaaataaccccaccctccgccaaaacaaatcgaaaaaaaactccgcgataaaaccgcgactcccgacccccgccccaaccgtaaaaactctacgcgcgacgcgtcccaaataaccccgctattattttaccttacaaaatatttatatctcgctaattaaaaaaaaaaaaaaccgaaaaaaaaaaaaatccgaaactccgctttcaactaccgaaacgcgctcgcaacgcgcccgcccaaccaaaaaaaaaatctcgaacccgacccgaaactcaaccgacgcgaacccgctcccccctccccgctccccgctccccgctccacgcctccccgcctccctccccgaaaccccctccgaacgccgcccgcgcccccgccgaacctaacctcgcccctaaccctctccctccgcgcgcgtcgaaccgtccttcaatccatccaaacgcacgcctcaaaaaacgcgccgcttcctcttctcccgcaacgacaccaacaaccgcgctacgacccctcccgaatccccgcccctccaactccaacccgacccgccgcactcgacgaaacgaacgcgaaaccaaaacgacgacctcgaaaaaaaacccgaccccgcccccgaccccgcccctaaaaacgcgaatcccgaccccgaacctaacgaaaacataaaaataacccgaaacaccgaaaaacctaaa

SEQ ID NO: 3381 - DNA, 638 bp, Artificial Sequence
  chemically treated genomic DNA (Homo sapiens) CpG-island No: 3381
ttattatttcgggtacgtagttttgcgaagtcgaattgattatttttagagattcggagagggttttgtttttcgtttttttttataaaaggagttcgggagttttagttcgggcgtaatcgcggggtttggtcgattttagcgttttttcgcgcggttattttcgatttcggtttcgttttttcgggtttttagttttcgtagtcgggaagggcgttgcgaggtttttaaaagatttttgtgtcgcgggcgtacgtcgtattttcggggaaaacgttttgcgtttcggtttcgcggtttttcgtcgtcgttcgtttcgcgcgttttagttttcgtttcggcgagggtttttcgtttcggaaggggcgcgacggggagttcggtttggttgttgcggtttcgcgtttcgtttagtcgcggtcgggaggatagggtagtagggtttcggcgtcgcgtttaggcgttttttttttagtttcgtttcggagacgtttcgtttttttcggttcggggaaatttgcggcgatcgggcgcgttcgcgtggttttcgttgggtaggggcgatttttagtgtttagggcgagtcgcgtcgagtaggatcgagttttttttcgtatattttggagtttgggtttggg

SEQ ID NO: 3382 - DNA, 638 bp, Artificial Sequence
  chemically treated genomic DNA (Homo sapiens) CpG-island No: 3382
cccaaacccaaactccaaaatatacgaaaaaaaactcgatcctactcgacgcgactcgccctaaacactaaaaatcgcccctacccaacgaaaaccacgcgaacgcgcccgatcgccgcaaatttccccgaaccgaaaaaaacgaaacgtctccgaaacgaaactaaaaaaaaaacgcctaaacgcgacgccgaaaccctactaccctatcctcccgaccgcgactaaacgaaacgcgaaaccgcaacaaccaaaccgaactccccgtcgcgccccttccgaaacgaaaaaccctcgccgaaacgaaaactaaaacgcgcgaaacgaacgacgacgaaaaaccgcgaaaccgaaacgcaaaacgttttccccgaaaatacgacgtacgcccgcgacacaaaaatcttttaaaaacctcgcaacgcccttcccgactacgaaaactaaaaacccgaaaaaacgaaaccgaaatcgaaaataaccgcgcgaaaaaacgctaaaatcgaccaaaccccgcgattacgcccgaactaaaactcccgaactccttttataaaaaaaaacgaaaaacaaaaccctctccgaatctctaaaaataatcaattcgacttcgcaaaactacgtacccgaaataataa

SEQ ID NO: 3383 - DNA, 638 bp, Artificial Sequence
  chemically treated genomic DNA (Homo sapiens) CpG-island No: 3383
tttaagtttaggttttagggtgtgcggggaaaggttcggttttgttcggcgcggttcgttttgggtattaggggtcgtttttgtttagcggaagttacgcgggcgcgttcggtcgtcgtaggttttttcggatcgggaaaagcgaggcgttttcggggcggggttggggagggggcgtttgggcgcggcgtcgggattttgttgttttgttttttcggtcgcggttggacggagcgcggggtcgtagtaattaggtcgggtttttcgtcgcgtttttttcggagcgggaggttttcgtcgaggcggaggttgggacgcgcggggcgggcggcggcggggagtcgcggggtcgaggcgtagggcgtttttttcggaggtgcggcgtgcgttcgcgatataaaggttttttaaagatttcgtagcgtttttttcggttgcggaggttggaggttcgggggggcgaggtcggggtcgggggtggtcgcgcgagggggcgttgggatcggttagatttcgcggttgcgttcgggttggggttttcgggttttttttgtggaaaagagcggaaagtagggtttttttcgggtttttgaaaatggttagttcggtttcgtagggttgcgtgttcggaataataa

SEQ ID NO: 3384 - DNA, 638 bp, Artificial Sequence
  chemically treated genomic DNA (Homo sapiens) CpG-island No: 3384
ttattattccgaacacgcaaccctacgaaaccgaactaaccattttcaaaaacccgaaaaaaaccctactttccgctcttttccacaaaaaaaacccgaaaaccccaacccgaacgcaaccgcgaaatctaaccgatcccaacgccccctcgcgcgaccacccccgaccccgacctcgcccccccgaacctccaacctccgcaaccgaaaaaaacgctacgaaatctttaaaaaacctttatatcgcgaacgcacgccgcacctccgaaaaaaacgccctacgcctcgaccccgcgactccccgccgccgcccgccccgcgcgtcccaacctccgcctcgacgaaaacctcccgctccgaaaaaaacgcgacgaaaaacccgacctaattactacgaccccgcgctccgtccaaccgcgaccgaaaaaacaaaacaacaaaatcccgacgccgcgcccaaacgccccctccccaaccccgccccgaaaacgcctcgcttttcccgatccgaaaaaacctacgacgaccgaacgcgcccgcgtaacttccgctaaacaaaaacgacccctaatacccaaaacgaaccgcgccgaacaaaaccgaacctttccccgcacaccctaaaacctaaacttaaa

SEQ ID NO: 3385 - DNA, 666 bp, Artificial Sequence
  chemically treated genomic DNA (Homo sapiens) CpG-island No: 3385
atcgttcgtttttaatttgcggtacgttttttttttcgttatcgtgtgtttttttttttatcgagtatttttttttttgttatcgtgtatttttttaagcggcgttattttttttgttatcgtgagttttttttttattgggcgtttttttttttatcgtcgtgcgttttttaatttgtggtatttttcgtttcgtcgtttttcgtttagttagataaatgttcggtttgcgtggtcgttgtttttggcgtcgtttgttagttcgtagttaaaataaatagtttaagagttattttttttttcgtggggggaatttttataacgacggttggttttagtcgcggtaggaagtggttttttgggttaacgatttaattttattgattaggtcgttgagggtagaattcgggaatgggattcggagcgcgggggcggaggtagagtttcgtcgtggttacgcgattatttgtgttttcgcggggattttatcgtcgatagcggttattattttataacgtaggtgcggaaggtttttgtcgagttatatttgtttattttttcgtgcgggggtgttgtgcgtttgtttttttttaaaattatggataggttaggattttacgtttggttgattgaggacgaattagtgagtgattgcgtgattttatt

SEQ ID NO: 3386 - DNA, 666 bp, Artificial Sequence
  chemically treated genomic DNA (Homo sapiens) CpG-island No: 3386
aataaaatcacgcaatcactcactaattcgtcctcaatcaaccaaacgtaaaatcctaacctatccataattttaaaaaaaaacaaacgcacaacacccccgcacgaaaaaataaacaaatataactcgacaaaaaccttccgcacctacgttataaaataataaccgctatcgacgataaaatccccgcgaaaacacaaataatcgcgtaaccacgacgaaactctacctccgcccccgcgctccgaatcccattcccgaattctaccctcaacgacctaatcaataaaattaaatcgttaacccaaaaaaccacttcctaccgcgactaaaaccaaccgtcgttataaaaattccccccacgaaaaaaaaaataactcttaaactatttattttaactacgaactaacaaacgacgccaaaaacaacgaccacgcaaaccgaacatttatctaactaaacgaaaaacgacgaaacgaaaaataccacaaattaaaaaacgcacgacgataaaaaaaaaaacgcccaataaaaaaaaaactcacgataacaaaaaaaataacgccgcttaaaaaaatacacgataacaaaaaaaaaaatactcgataaaaaaaaaaacacacgataacgaaaaaaaaaacgtaccgcaaattaaaaacgaacgat

SEQ ID NO: 3387 - DNA, 666 bp, Artificial Sequence
  chemically treated genomic DNA (Homo sapiens) CpG-island No: 3387
aataaagttacgtagttatttattggttcgtttttaattaattaggcgtggagttttaatttgtttatgattttaagaaagggtaggcgtataatattttcgtacggagaaatgaataggtgtggttcggtagaggtttttcgtatttgcgttatggagtggtggtcgttgtcggcgatggggttttcgcgagggtataagtgatcgcgtggttacggcgaggttttgttttcgttttcgcgtttcgggttttattttcgaattttgtttttagcggtttggttaatgaggttggatcgttggtttagaaagttattttttgtcgcgattggagttagtcgtcgttgtgaaaattttttttacggggaaggaagtggtttttgggttgtttattttggttgcgggttagtagacggcgttaggggtagcggttacgtagatcgggtatttgtttagttgggcgggaggcggcggagcgggaagtgttatagattgaggggcgtacggcggtggagggaggggcgtttagtggagagggggtttacggtgatagaggaagtggcgtcgtttgggggggtgtacgatggtagggggaggggtgttcggtggagggaggggtatacggtggcggggggaggggcgtgtcgtagattgagggcgaacggt

SEQ ID NO: 3388 - DNA, 666 bp, Artificial Sequence
  chemically treated genomic DNA (Homo sapiens) CpG-island No: 3388
accgttcgccctcaatctacgacacgcccctccccccgccaccgtatacccctccctccaccgaacacccctccccctaccatcgtacacccccccaaacgacgccacttcctctatcaccgtaaaccccctctccactaaacgcccctccctccaccgccgtacgcccctcaatctataacacttcccgctccgccgcctcccgcccaactaaacaaatacccgatctacgtaaccgctacccctaacgccgtctactaacccgcaaccaaaataaacaacccaaaaaccacttccttccccgtaaaaaaaattttcacaacgacgactaactccaatcgcgacaaaaaataactttctaaaccaacgatccaacctcattaaccaaaccgctaaaaacaaaattcgaaaataaaacccgaaacgcgaaaacgaaaacaaaacctcgccgtaaccacgcgatcacttataccctcgcgaaaaccccatcgccgacaacgaccaccactccataacgcaaatacgaaaaacctctaccgaaccacacctattcatttctccgtacgaaaatattatacgcctaccctttcttaaaatcataaacaaattaaaactccacgcctaattaattaaaaacgaaccaataaataactacgtaactttatt

SEQ ID NO: 3389 - DNA, 906 bp, Artificial Sequence
  chemically treated genomic DNA (Homo sapiens) CpG-island No: 3389
ggttcggcgcgtttttcgcgtttttttttcgcgtttatttggcgtaggtgttgtagtagcgttttcgttttttttcgtcggttttggcgtattattcgtagtagtttttggattatgtcgattcgtcggtggtaggggggtattttcgcgttcgcgcgtttcgttttgttttcggcgcgtagtagtagcgacgtttagaagttcggtcgttcgcgtcgggggttcggcgcggcgtcggggttggtttttttcgttaggttgtttttggtttgtcgggtgtttatgtcgtcgtcgttcgtcgggatttttcgttttgggtcgcgaggtcgcgttttcgttaatcgttcgtttttcggtcgttcgtgcgcgttcgtttttcgggttgtaattttgggggaattgttgcgcgcgggcgtcgcgggggcgggcgggcgggcggttgtcggcgtttttcgcgttttttttttttggttattcgggcgcgtttttcgggcgttcgtcgtcggttcgttcgtcggtttcgtttcggttcggttcggttcgtttcgtttttcgttttcgcgtcggagtttcgcggcgtcgcgcgttttttttttttcgggttttcgttttttttcgtttcgcggtttcgggttggggattattattaggcgttttttgtttgcgttttttcggtagtcgcgttttttgcgggcggtagtgttgcgtttttcggggtcgtggcgcgggggcgaggggaataggtaggttttatgggtcgtcgttttcggtttttatcgggtttttcgacgtttttattatcgcgcgttcggtgcgtcgggcgagatggggaaagtttggagtatgggggtgtgtgtgttggggggtttttttaggtttagagtcgggttttttaaggtgggtttt

SEQ ID NO: 3390 - DNA, 906 bp, Artificial Sequence
  chemically treated genomic DNA (Homo sapiens) CpG-island No: 3390
aaaacccaccttaaaaaacccgactctaaacctaaaaaaaccccccaacacacacacccccatactccaaactttccccatctcgcccgacgcaccgaacgcgcgataataaaaacgtcgaaaaacccgataaaaaccgaaaacgacgacccataaaacctacctattcccctcgcccccgcgccacgaccccgaaaaacgcaacactaccgcccgcaaaaaacgcgactaccgaaaaaacgcaaacaaaaaacgcctaataataatccccaacccgaaaccgcgaaacgaaaaaaaacgaaaacccgaaaaaaaaaaaacgcgcgacgccgcgaaactccgacgcgaaaacgaaaaacgaaacgaaccgaaccgaaccgaaacgaaaccgacgaacgaaccgacgacgaacgcccgaaaaacgcgcccgaataaccaaaaaaaaaaaacgcgaaaaacgccgacaaccgcccgcccgcccgcccccgcgacgcccgcgcgcaacaattcccccaaaattacaacccgaaaaacgaacgcgcacgaacgaccgaaaaacgaacgattaacgaaaacgcgacctcgcgacccaaaacgaaaaatcccgacgaacgacgacgacataaacacccgacaaaccaaaaacaacctaacgaaaaaaaccaaccccgacgccgcgccgaacccccgacgcgaacgaccgaacttctaaacgtcgctactactacgcgccgaaaacaaaacgaaacgcgcgaacgcgaaaatacccccctaccaccgacgaatcgacataatccaaaaactactacgaataatacgccaaaaccgacgaaaaaaaacgaaaacgctactacaacacctacgccaaataaacgcgaaaaaaaaacgcgaaaaacgcgccgaacc

SEQ ID NO: 3391 - DNA, 906 bp, Artificial Sequence
  chemically treated genomic DNA (Homo sapiens) CpG-island No: 3391
ggaatttattttgagaaattcgattttgggtttaagagagttttttaatatatatatttttatgttttaaattttttttatttcgttcgacgtatcgggcgcgcggtggtggaagcgtcggggagttcggtggggatcgagagcgacggtttatggggtttgtttgtttttttcgttttcgcgttacggtttcgggaagcgtagtattgtcgttcgtaggaggcgcgattgtcgagaggacgtaggtagggggcgtttggtggtggtttttagttcggagtcgcggggcgggaaggagcgggagttcgagaagagggaggcgcgcgacgtcgcggagtttcggcgcggaggcggggggcggggcgggtcgagtcgggtcggggcggggtcggcgggcgggtcggcggcgagcgttcggggagcgcgttcgggtagttaagagggaggagcgcggggagcgtcgatagtcgttcgttcgttcgttttcgcgacgttcgcgcgtaatagtttttttaaagttgtagttcgggaggcgagcgcgtacgggcggtcgaggggcgggcggttggcggggacgcggtttcgcggtttagagcggagagtttcggcgggcggcggcggtatgggtattcggtagattaagggtagtttggcggagagagttagtttcggcgtcgcgtcgggttttcgacgcgaacggtcggatttttgggcgtcgttgttgttgcgcgtcggggataaggcggggcgcgcgggcgcggggatgtttttttattatcggcgagtcggtatggtttaggagttgttgcggatggtgcgttagggtcggcgggaggaggcggggacgttgttgtagtatttgcgttaggtgagcgcggggagggggcgcggggggcgcgtcgggtt

SEQ ID NO: 3392 - DNA, 906 bp, Artificial Sequence
  chemically treated genomic DNA (Homo sapiens) CpG-island No: 3392
aacccgacgcgccccccgcgccccctccccgcgctcacctaacgcaaatactacaacaacgtccccgcctcctcccgccgaccctaacgcaccatccgcaacaactcctaaaccataccgactcgccgataataaaaaaacatccccgcgcccgcgcgccccgccttatccccgacgcgcaacaacaacgacgcccaaaaatccgaccgttcgcgtcgaaaacccgacgcgacgccgaaactaactctctccgccaaactacccttaatctaccgaatacccataccgccgccgcccgccgaaactctccgctctaaaccgcgaaaccgcgtccccgccaaccgcccgcccctcgaccgcccgtacgcgctcgcctcccgaactacaactttaaaaaaactattacgcgcgaacgtcgcgaaaacgaacgaacgaacgactatcgacgctccccgcgctcctccctcttaactacccgaacgcgctccccgaacgctcgccgccgacccgcccgccgaccccgccccgacccgactcgacccgccccgccccccgcctccgcgccgaaactccgcgacgtcgcgcgcctccctcttctcgaactcccgctccttcccgccccgcgactccgaactaaaaaccaccaccaaacgccccctacctacgtcctctcgacaatcgcgcctcctacgaacgacaatactacgcttcccgaaaccgtaacgcgaaaacgaaaaaaacaaacaaaccccataaaccgtcgctctcgatccccaccgaactccccgacgcttccaccaccgcgcgcccgatacgtcgaacgaaataaaaaaaatttaaaacataaaaatatatatattaaaaaactctcttaaacccaaaatcgaatttctcaaaataaattcc

SEQ ID NO: 3393 - DNA, 539 bp, Artificial Sequence
  chemically treated genomic DNA (Homo sapiens) CpG-island No: 3393
tcggggatcgtgcgacgcgtaacgttgggattgggtttatagtagtttttatttcgtttttgttttttcgtaagttacgagtacgggagttcgcgcgtggacgggttcgggttgttattgatcgcgcggatattcgcgcgttgcgttcggatattaatatttgtcgttgggattcggtcgacgggtagtcggagcggttttaaggttataggtaataatggcgacgttggtataggcgtttgcgtggcgggtttagtttcgagcggtagcggattttcgggtttcgttatttttttttttcgtaaagtatagagtgtttcggttaggagttgtacgttttagttcggttttgagaagttcggtttagaaatttcggcgtttttgtttagtcgcgatttcgtttcggcgttattgcgtatgtgcgttagaggaacgttgcgcgttcgtagagttaatcggagtttaagttgtcgtttttttttttcgcgtttttggttttggatttgtttttatggtaattttttttatttatcgttttg

SEQ ID NO: 3394 - DNA, 539 bp, Artificial Sequence
  chemically treated genomic DNA (Homo sapiens) CpG-island No: 3394
caaaacgataaataaaaaaaattaccataaaaacaaatccaaaaccaaaaacgcgaaaaaaaaaaacgacaacttaaactccgattaactctacgaacgcgcaacgttcctctaacgcacatacgcaataacgccgaaacgaaatcgcgactaaacaaaaacgccgaaatttctaaaccgaacttctcaaaaccgaactaaaacgtacaactcctaaccgaaacactctatactttacgaaaaaaaaaaataacgaaacccgaaaatccgctaccgctcgaaactaaacccgccacgcaaacgcctataccaacgtcgccattattacctataaccttaaaaccgctccgactacccgtcgaccgaatcccaacgacaaatattaatatccgaacgcaacgcgcgaatatccgcgcgatcaataacaacccgaacccgtccacgcgcgaactcccgtactcgtaacttacgaaaaaacaaaaacgaaataaaaactactataaacccaatcccaacgttacgcgtcgcacgatccccga

SEQ ID NO: 3395 - DNA, 539 bp, Artificial Sequence
  chemically treated genomic DNA (Homo sapiens) CpG-island No: 3395
tagagcgatgggtggaggaggttgttatggagataggtttagggttagaggcgcgggagggggaggcggtagtttgggtttcgattggttttgcgggcgcgtagcgtttttttggcgtatatgcgtagtgacgtcgaggcgaggtcgcggttaagtagaggcgtcggggtttttgggtcgggttttttaggatcgggttggaacgtgtagtttttggtcgggatattttgtgttttgcggggaagggaagtggcggagttcgaggattcgttgtcgttcgggattgagttcgttacgtaggcgtttgtgttagcgtcgttattgttgtttgtggttttagggtcgtttcggttgttcgtcggtcgggttttagcgataggtattgatgttcgggcgtagcgcgcgagtgttcgcgcgattagtgatagttcgagttcgtttacgcgcgggttttcgtgttcgtggtttgcgggagggtaaagacggggtggaggttgttgtgggtttagttttagcgttgcgcgtcgtacggttttcga

SEQ ID NO: 3396 - DNA, 539 bp, Artificial Sequence
  chemically treated genomic DNA (Homo sapiens) CpG-island No: 3396
tcgaaaaccgtacgacgcgcaacgctaaaactaaacccacaacaacctccaccccgtctttaccctcccgcaaaccacgaacacgaaaacccgcgcgtaaacgaactcgaactatcactaatcgcgcgaacactcgcgcgctacgcccgaacatcaatacctatcgctaaaacccgaccgacgaacaaccgaaacgaccctaaaaccacaaacaacaataacgacgctaacacaaacgcctacgtaacgaactcaatcccgaacgacaacgaatcctcgaactccgccacttcccttccccgcaaaacacaaaatatcccgaccaaaaactacacgttccaacccgatcctaaaaaacccgacccaaaaaccccgacgcctctacttaaccgcgacctcgcctcgacgtcactacgcatatacgccaaaaaaacgctacgcgcccgcaaaaccaatcgaaacccaaactaccgcctccccctcccgcgcctctaaccctaaacctatctccataacaacctcctccacccatcgctcta

SEQ ID NO: 3397 - DNA, 807 bp, Artificial Sequence
  chemically treated genomic DNA (Homo sapiens) CpG-island No: 3397
tgaggtataggcggtttattttgtatagttcgtttcgatttattagtagggttattagttagatgttcgcgtttagtacgtttacgttatgtattatttcgtttatcgttgtttttaaaaaatagtttgggaattttagttttttttttagtttttgggcgttggtttttagtaatagcgaaacggttcgtatgggtcgggcgttttgggatttcgcgtgtaggatttttcgggattcggaaaggttcgcggggcggcggcgcggcggtcgggtttatcgatttcgcgtttgtagaacgtttttcgttcgtttatgttcgttcggtaagcgtaagcgtagagttcggcgtcgggtttcgcgtttttgcgcggttgattgaggtcgaatttgaagttgaggcgcggcggcggcgcgggcggcgagtcgggggtcggtataacggcgcgcggtcggttggggtgggtagggtcggcggggttttcggcggcgcgcgcgcgcggtcgggcggcggggaagcgtagggttcgtgagcgcgcgcgtttcggggtttttttcgtcgcgggttcgcggcgcggcgacgcgcggttttcggtttgcgttaggcgcgggtttgtgggagcgtgtgcggttttacggaaggtggttcggttgtcggtcggcggttgaggtttgggcgttttttttttagattttcgtttcgtttttagggtttcgtattatatcgattttattttttttttttatcggagtttcgggggatgattcgacgattaaatagaggagttagaaagttttagttgttattt

SEQ ID NO: 3398 - DNA, 807 bp, Artificial Sequence
  chemically treated genomic DNA (Homo sapiens) CpG-island No: 3398
aaataacaactaaaactttctaactcctctatttaatcgtcgaatcatcccccgaaactccgataaaaaaaaaaaataaaatcgatataatacgaaaccctaaaaacgaaacgaaaatctaaaaaaaaaacgcccaaacctcaaccgccgaccgacaaccgaaccaccttccgtaaaaccgcacacgctcccacaaacccgcgcctaacgcaaaccgaaaaccgcgcgtcgccgcgccgcgaacccgcgacgaaaaaaaccccgaaacgcgcgcgctcacgaaccctacgcttccccgccgcccgaccgcgcgcgcgcgccgccgaaaaccccgccgaccctacccaccccaaccgaccgcgcgccgttataccgacccccgactcgccgcccgcgccgccgccgcgcctcaacttcaaattcgacctcaatcaaccgcgcaaaaacgcgaaacccgacgccgaactctacgcttacgcttaccgaacgaacataaacgaacgaaaaacgttctacaaacgcgaaatcgataaacccgaccgccgcgccgccgccccgcgaacctttccgaatcccgaaaaatcctacacgcgaaatcccaaaacgcccgacccatacgaaccgtttcgctattactaaaaaccaacgcccaaaaactaaaaaaaaaactaaaattcccaaactattttttaaaaacaacgataaacgaaataatacataacgtaaacgtactaaacgcgaacatctaactaataaccctactaataaatcgaaacgaactatacaaaataaaccgcctatacctca

SEQ ID NO: 3399 - DNA, 807 bp, Artificial Sequence
  chemically treated genomic DNA (Homo sapiens) CpG-island No: 3399
aaatgatagttagagttttttggtttttttgtttaatcgtcggattatttttcgaagtttcggtggagagaaaaagtaagatcggtgtagtgcggagttttgggagcggagcggggatttggggagggggcgtttaggttttagtcgtcggtcgataatcgggttatttttcgtgaggtcgtatacgtttttataggttcgcgtttggcgtaagtcgagaatcgcgcgtcgtcgcgtcgcgggttcgcgacggaggaagtttcgagacgcgcgcgtttacgggttttacgttttttcgtcgttcggtcgcgcgcgcgcgtcgtcgagggtttcgtcggttttgtttattttaatcggtcgcgcgtcgttgtgtcggttttcggttcgtcgttcgcgtcgtcgtcgcgttttagttttagattcggttttagttagtcgcgtagggacgcggagttcggcgtcgagttttgcgtttgcgtttgtcgggcgggtatggacgggcgagaggcgttttgtaagcgcgaaatcggtgagttcggtcgtcgcgtcgtcgtttcgcgagttttttcgagtttcggagaattttgtacgcgagattttagggcgttcgatttatgcgggtcgtttcgttgttgttaaaaattaacgtttagggattgggagaggaattggggtttttaaattgttttttggaagtagcgatgaacgggatagtgtatgacgtggacgtgttgggcgcgggtatttggttggtgattttgttggtggatcgggacgggttgtataagatgaatcgtttgtatttta

SEQ ID NO: 3400 - DNA, 807 bp, Artificial Sequence
  chemically treated genomic DNA (Homo sapiens) CpG-island No: 3400
taaaatacaaacgattcatcttatacaacccgtcccgatccaccaacaaaatcaccaaccaaatacccgcgcccaacacgtccacgtcatacactatcccgttcatcgctacttccaaaaaacaatttaaaaaccccaattcctctcccaatccctaaacgttaatttttaacaacaacgaaacgacccgcataaatcgaacgccctaaaatctcgcgtacaaaattctccgaaactcgaaaaaactcgcgaaacgacgacgcgacgaccgaactcaccgatttcgcgcttacaaaacgcctctcgcccgtccatacccgcccgacaaacgcaaacgcaaaactcgacgccgaactccgcgtccctacgcgactaactaaaaccgaatctaaaactaaaacgcgacgacgacgcgaacgacgaaccgaaaaccgacacaacgacgcgcgaccgattaaaataaacaaaaccgacgaaaccctcgacgacgcgcgcgcgcgaccgaacgacgaaaaaacgtaaaacccgtaaacgcgcgcgtctcgaaacttcctccgtcgcgaacccgcgacgcgacgacgcgcgattctcgacttacgccaaacgcgaacctataaaaacgtatacgacctcacgaaaaataacccgattatcgaccgacgactaaaacctaaacgccccctccccaaatccccgctccgctcccaaaactccgcactacaccgatcttactttttctctccaccgaaacttcgaaaaataatccgacgattaaacaaaaaaaccaaaaaactctaactatcattt

SEQ ID NO: 3401 - DNA, 1040 bp, Artificial Sequence
  chemically treated genomic DNA (Homo sapiens) CpG-island No: 3401
ttttcgtttcgcggcgtcggttcgttttgttttttaattggcgagtcgtatcgtcggttttagtacggagggtatgtgacggcgttagtgttttaggttagatttatttcggtcgtagcgagggttggtttttttttgtcgtagtgttgcgtgtcgtcgtcgtacgttcggggtagttggggtcgggcgtcgcggttttcgtagatggaggtataaaaatatcggttacggcgaggagttatgattgaggcggcggcggtcgcgttttttggcggttcgcgggggcggcgcggcgggcgttttttggcggcgcgtcggggtggagcggtttttcgtcgtcgtagtcgtagtcggcggaggcgttgttgtttttttttttcgtgttttcggcgttcgttcgtttgttcgttcgttttatttttttttcgttttagattaaagggggggagggaaaaggagttcggtcgttatttttttagtgtcgtcgttatcgtcgttatcgttcgtcgagtcggcgggagaatcgagtatcgtagcgaagtcgattcgtttcgtcgcggcggcgcggggggcggttgaagcgcgtttttcggttggaaagaggcggtcgggggtggcggtttgggtgcgggttcgggttgtagacggcggtgtttgtttgtgcggggcgggggggcggttttattttttgttttcgttcgttcgttttttcggtcgggttgcggtttttagtcgtgttcgggtttcgtcggtgcggagtaaggtcgggaaagggttcgaaagagaagaaaaagtagtcgtttttcgtcgtcgtttttttttttttttttgtttcgttttttcgttcggaaagttagggcggtttcgggcgtcggggggaggagagcggcgggttcgggtcggagtcgtcgtcgcgcgttttcgttcgtcgttggttttcggcgtttaggtcggggggttgtttgtaaattgcgtttattttgtggggttgaattcgttcgggttacgtttttttattacgtggtaggtgttgttgttgt

SEQ ID NO: 3402 - DNA, 1040 bp, Artificial Sequence
  chemically treated genomic DNA (Homo sapiens) CpG-island No: 3402
acaacaacaacacctaccacgtaataaaaaaacgtaacccgaacgaattcaaccccacaaaataaacgcaatttacaaacaaccccccgacctaaacgccgaaaaccaacgacgaacgaaaacgcgcgacgacgactccgacccgaacccgccgctctcctccccccgacgcccgaaaccgccctaactttccgaacgaaaaaacgaaacaaaaaaaaaaaaaaaaacgacgacgaaaaacgactactttttcttctctttcgaaccctttcccgaccttactccgcaccgacgaaacccgaacacgactaaaaaccgcaacccgaccgaaaaaacgaacgaacgaaaacaaaaaataaaaccgcccccccgccccgcacaaacaaacaccgccgtctacaacccgaacccgcacccaaaccgccacccccgaccgcctctttccaaccgaaaaacgcgcttcaaccgccccccgcgccgccgcgacgaaacgaatcgacttcgctacgatactcgattctcccgccgactcgacgaacgataacgacgataacgacgacactaaaaaaataacgaccgaactccttttccctccccccctttaatctaaaacgaaaaaaaaataaaacgaacgaacaaacgaacgaacgccgaaaacacgaaaaaaaaaaacaacaacgcctccgccgactacgactacgacgacgaaaaaccgctccaccccgacgcgccgccaaaaaacgcccgccgcgccgcccccgcgaaccgccaaaaaacgcgaccgccgccgcctcaatcataactcctcgccgtaaccgatatttttatacctccatctacgaaaaccgcgacgcccgaccccaactaccccgaacgtacgacgacgacacgcaacactacgacaaaaaaaaaccaaccctcgctacgaccgaaataaatctaacctaaaacactaacgccgtcacataccctccgtactaaaaccgacgatacgactcgccaattaaaaaacaaaacgaaccgacgccgcgaaacgaaaa

SEQ ID NO: 3403 - DNA, 1040 bp, Artificial Sequence
  chemically treated genomic DNA (Homo sapiens) CpG-island No: 3403
gtagtagtagtatttattacgtgatggaggagcgtagttcgggcggatttagttttataaaatgggcgtagtttgtaaatagtttttcggtttgggcgtcgagggttagcggcgggcgggggcgcgcgacggcggtttcggttcgggttcgtcgttttttttttttcgacgttcggagtcgttttgatttttcgggcgggggggcgaggtagagggggaggggaaggcggcggcggggagcggttgtttttttttttttttcgggttttttttcggttttgtttcgtatcgacggggttcgagtacggttggagatcgtagttcggtcgggagggcgggcgggcgggggtagagagtgaaatcgttttttcgtttcgtataaataagtatcgtcgtttgtagttcgaattcgtatttaggtcgttattttcggtcgtttttttttagtcggggagcgcgttttagtcgtttttcgcgtcgtcgcggcgagacgagtcggtttcgttacggtgttcggttttttcgtcggttcggcgagcggtggcggcggtggcggcggtattgggaaaatggcggtcgagttttttttttttttttttttttaatttgaagcggagggagaatggagcgagcgagtaagcgggcgagcgtcggggatacggggaggagggatagtagcgttttcgtcggttgcggttgcggcggcgaagggtcgttttatttcggcgcgtcgttagggggcgttcgtcgcgtcgttttcgcgggtcgttaggaggcgcggtcgtcgtcgttttagttatggtttttcgtcgtggtcgatgtttttgtatttttatttgcggaggtcgcggcgttcggttttagttgtttcggacgtgcggcgacggtacgtagtattgcggtagggggaagttagttttcgttgcggtcgaggtgagtttaatttgaggtattgacgtcgttatatgtttttcgtgttggggtcggcggtgcggttcgttagttgaggggtagggcgggtcggcgtcgcggagcgagag

SEQ ID NO: 3404 - DNA, 1040 bp, Artificial Sequence
  chemically treated genomic DNA (Homo sapiens) CpG-island No: 3404
ctctcgctccgcgacgccgacccgccctacccctcaactaacgaaccgcaccgccgaccccaacacgaaaaacatataacgacgtcaatacctcaaattaaactcacctcgaccgcaacgaaaactaacttccccctaccgcaatactacgtaccgtcgccgcacgtccgaaacaactaaaaccgaacgccgcgacctccgcaaataaaaatacaaaaacatcgaccacgacgaaaaaccataactaaaacgacgacgaccgcgcctcctaacgacccgcgaaaacgacgcgacgaacgccccctaacgacgcgccgaaataaaacgacccttcgccgccgcaaccgcaaccgacgaaaacgctactatccctcctccccgtatccccgacgctcgcccgcttactcgctcgctccattctccctccgcttcaaattaaaaaaaaaaaaaaaaaaaaaactcgaccgccattttcccaataccgccgccaccgccgccaccgctcgccgaaccgacgaaaaaaccgaacaccgtaacgaaaccgactcgtctcgccgcgacgacgcgaaaaacgactaaaacgcgctccccgactaaaaaaaaacgaccgaaaataacgacctaaatacgaattcgaactacaaacgacgatacttatttatacgaaacgaaaaaacgatttcactctctacccccgcccgcccgccctcccgaccgaactacgatctccaaccgtactcgaaccccgtcgatacgaaacaaaaccgaaaaaaaacccgaaaaaaaaaaaaaaacaaccgctccccgccgccgccttcccctccccctctacctcgcccccccgcccgaaaaatcaaaacgactccgaacgtcgaaaaaaaaaaaacgacgaacccgaaccgaaaccgccgtcgcgcgcccccgcccgccgctaaccctcgacgcccaaaccgaaaaactatttacaaactacgcccattttataaaactaaatccgcccgaactacgctcctccatcacgtaataaatactactactac

SEQ ID NO: 3405 - DNA, 508 bp, Artificial Sequence
  chemically treated genomic DNA (Homo sapiens) CpG-island No: 3405
tgcggcggcggtagcgaagttttgagtcgtggggaggtgggttttcgcgttcgggcgtcggggtagtttcgggttttttgcgaggtttgcggcgcggtttttagggaggaggtggcggttgtggcggtcggaatcgcgattttggtcggatttagtttcgcggtggacgtagggcggaggtcgagtttcgttaggagtttttgtcgagtcggagggaggcgtatttggcgtttcggtattagcggtagtcgggggttcggagcggttggaggagcgtagtgggaattgggaagagttagttcggttggagggcggatttttgcgttcgggagtcgggttttaggtatcgttgggggcgaagttacgcgttttttcgggtagttaattttatacgcgtttgtgtgcggtttcgggtattttagtaagttttagtattcgggcgcgggtaacgggaagcgtagaattaaatttttagcgtttaggttatttttttagatttagttttgta

SEQ ID NO: 3406 - DNA, 508 bp, Artificial Sequence
  chemically treated genomic DNA (Homo sapiens) CpG-island No: 3406
tacaaaactaaatctaaaaaaataacctaaacgctaaaaatttaattctacgcttcccgttacccgcgcccgaatactaaaacttactaaaatacccgaaaccgcacacaaacgcgtataaaattaactacccgaaaaaacgcgtaacttcgcccccaacgatacctaaaacccgactcccgaacgcaaaaatccgccctccaaccgaactaactcttcccaattcccactacgctcctccaaccgctccgaacccccgactaccgctaataccgaaacgccaaatacgcctccctccgactcgacaaaaactcctaacgaaactcgacctccgccctacgtccaccgcgaaactaaatccgaccaaaatcgcgattccgaccgccacaaccgccacctcctccctaaaaaccgcgccgcaaacctcgcaaaaaacccgaaactaccccgacgcccgaacgcgaaaacccacctccccacgactcaaaacttcgctaccgccgccgca

SEQ ID NO: 3407 - DNA, 508 bp, Artificial Sequence
  chemically treated genomic DNA (Homo sapiens) CpG-island No: 3407
tgtaaggttgggtttggggaggtgatttgggcgttggggatttggttttgcgtttttcgttattcgcgttcgggtgttagagtttattgggatgttcggaatcgtatataggcgcgtgtgaaattggttgttcgaaaagacgcgtggtttcgtttttagcggtgtttgagattcggttttcggacgtagaggttcgttttttagtcgggttagttttttttagtttttattgcgtttttttagtcgtttcggattttcggttgtcgttggtatcgaagcgttagatgcgttttttttcggttcggtaaagatttttggcggggttcggttttcgttttgcgtttatcgcggggttgggttcggttaaggtcgcggtttcggtcgttatagtcgttattttttttttaggagtcgcgtcgtaggtttcgtagagggttcggggttgtttcggcgttcgagcgcggggatttatttttttacggtttaaggtttcgttgtcgtcgtcgta

SEQ ID NO: 3408 - DNA, 508 bp, Artificial Sequence
  chemically treated genomic DNA (Homo sapiens) CpG-island No: 3408
tacgacgacgacaacgaaaccttaaaccgtaaaaaaataaatccccgcgctcgaacgccgaaacaaccccgaaccctctacgaaacctacgacgcgactcctaaaaaaaaaataacgactataacgaccgaaaccgcgaccttaaccgaacccaaccccgcgataaacgcaaaacgaaaaccgaaccccgccaaaaatctttaccgaaccgaaaaaaaacgcatctaacgcttcgataccaacgacaaccgaaaatccgaaacgactaaaaaaacgcaataaaaactaaaaaaaactaacccgactaaaaaacgaacctctacgtccgaaaaccgaatctcaaacaccgctaaaaacgaaaccacgcgtcttttcgaacaaccaatttcacacgcgcctatatacgattccgaacatcccaataaactctaacacccgaacgcgaataacgaaaaacgcaaaaccaaatccccaacgcccaaatcacctccccaaacccaaccttaca

SEQ ID NO: 3409 - DNA, 508 bp, Artificial Sequence
  chemically treated genomic DNA (Homo sapiens) CpG-island No: 3409
ttcgagtacggaagagtataattttcggagaagcgttaagaatttattcgttttaggttgaggggtttacgaaggggattaaagggttaagtgttagtcgtagtagtcggcgcggtttcgtttttttagtttgatttattgcggttaggcgatcgggttatttgatcgtagtcgcggcgtcggtcgttcggttcgttgggaaacgtagtttcgggtggtttggtacgcgtaagcgtttcgcggggagtttttatcgttaggacgtagagtcgacggagttttcgggttttggcgaaagggggttgggaagcggatttcggcgaagagtagttaggaacggttggacggggtcgagagacgacgtagcggagtttgagggggtcggggttatagggagaggtaaatgagggtagaagtattttttagacggagacggggttgacggttgagtaaaaaaggggcgtgaatttggagtattggtatgaaaaaaaggtgggggtttagatgg

SEQ ID NO: 3410 - DNA, 508 bp, Artificial Sequence
  chemically treated genomic DNA (Homo sapiens) CpG-island No: 3410
ccatctaaacccccacctttttttcataccaatactccaaattcacgccccttttttactcaaccgtcaaccccgtctccgtctaaaaaatacttctaccctcatttacctctccctataaccccgaccccctcaaactccgctacgtcgtctctcgaccccgtccaaccgttcctaactactcttcgccgaaatccgcttcccaaccccctttcgccaaaacccgaaaactccgtcgactctacgtcctaacgataaaaactccccgcgaaacgcttacgcgtaccaaaccacccgaaactacgtttcccaacgaaccgaacgaccgacgccgcgactacgatcaaataacccgatcgcctaaccgcaataaatcaaactaaaaaaacgaaaccgcgccgactactacgactaacacttaaccctttaatccccttcgtaaacccctcaacctaaaacgaataaattcttaacgcttctccgaaaattatactcttccgtactcgaa

SEQ ID NO: 3411 - DNA, 508 bp, Artificial Sequence
  chemically treated genomic DNA (Homo sapiens) CpG-island No: 3411
ttatttgggtttttattttttttttatgttaatattttaagtttacgttttttttttgtttagtcgttagtttcgttttcgtttgaagagtgtttttgtttttatttgtttttttttgtgatttcggtttttttagatttcgttgcgtcgtttttcggtttcgtttagtcgtttttgattgtttttcgtcggagttcgttttttaattttttttcgttagagttcgagagtttcgtcggttttgcgttttggcggtggggatttttcgcggagcgtttgcgcgtgttaggttattcgggattacgttttttagcgggtcgagcggtcggcgtcgcggttgcggttaggtgattcggtcgtttggtcgtagtgagttaggttgggagggcggggtcgcgtcggttgttgcggttggtatttggttttttaatttttttcgtgggttttttaatttggagcggataaatttttggcgttttttcgggggttgtgttttttcgtattcgga

SEQ ID NO: 3412 - DNA, 508 bp, Artificial Sequence
  chemically treated genomic DNA (Homo sapiens) CpG-island No: 3412
tccgaatacgaaaaaacacaacccccgaaaaaacgccaaaaatttatccgctccaaattaaaaaacccacgaaaaaaattaaaaaaccaaataccaaccgcaacaaccgacgcgaccccgccctcccaacctaactcactacgaccaaacgaccgaatcacctaaccgcaaccgcgacgccgaccgctcgacccgctaaaaaacgtaatcccgaataacctaacacgcgcaaacgctccgcgaaaaatccccaccgccaaaacgcaaaaccgacgaaactctcgaactctaacgaaaaaaaattaaaaaacgaactccgacgaaaaacaatcaaaaacgactaaacgaaaccgaaaaacgacgcaacgaaatctaaaaaaaccgaaatcacaaaaaaaaacaaataaaaacaaaaacactcttcaaacgaaaacgaaactaacgactaaacaaaaaaaaaacgtaaacttaaaatattaacataaaaaaaaaataaaaacccaaataa

SEQ ID NO: 3413 - DNA, 1393 bp, Artificial Sequence
  chemically treated genomic DNA (Homo sapiens) CpG-island No: 3413
ggaaaaagcgtttcgcgggttttttaattgttcgttaatttcgttttttttttttttagtcgtgatttcgcgttttttggttcgttcgtcgggttgtgcgtaggcgtttcgggtaggggcggggcgcgcggtagggtcgttacgaagcggggcgcggtgggttaattagaaggttttattttcgggtggcgcgggcgttattttgtgaggagcgatataaacgggcgtagaggtcggttgttcgtttagttgttatttaggtgcgttagtttgcggagttcgttcgtgttgttttgcggtaaggttttttttagtgtttttacgcggaaggtaattgtttgagaggcgcggcgtcgtatcgtttagagttgaggaagtcggcgttagttcgcggggtttcgggtcgttatttagagttatgagttacggtcgtttttttttcgatgtggagggtatgattttttttaaggtggataatttgatttatcgtatttcgttcgatacgttgaggcgcgttttcgagaagtacgggcgcgtcggcgacgtgtatatttcgcgggatcgttatattaaggagtttcgcggtttcgttttcgttcgtttttacgataagcgcgacgttgaggacgttatggatgttatggacggggtcgtgttggacggtcgcgagttgcgggtgtaaatggcgcgttacggtcgtttttcggatttatattatagtcgtcggggatcgttatttcgtaggtacgggggcggtggttacggacgtcggagtcgtaggtaaacggggttgaggggatcgcgggaggcggggcggggcgcgcgggaggttcgggcgattttataaaggttcgcggcgaagtacgtggtgcgggttcggacggggcgggggtgtacgtcgcgtttcgcgatttttcggttatttcgcgagttttcgtcgtttgcgattcgggagtggtcggggtgtgggcggcgcggggcggaggatttcgtttcgcgattggggaaatggcgtttggcggcgagataatggcggtttgggcgggagcgcgcgggcggggtcggtttcgttgtttggaattaatttcgttgtgtttgttcgtttcgttcgtagttttaggcggcgtcgtcgtagtcgatttcggagtcggagtcgttttaggtttcgtagtcgatttcgttatagtcgttcgaagtttcggtttcgtattcgttttcgatttcggtcgatttttaagtttagattcgtacgaaggtttaagtttaagttttcgtcggtttttagatttcgttcgcggtttaggtttcggtttcggtttaggagtttttttttagtgtttaagagggaatttaaatttaggtcgcgatcgaagagtttttttaagttttttga

SEQ ID NO: 3414 - DNA, 1393 bp, Artificial Sequence
  chemically treated genomic DNA (Homo sapiens) CpG-island No: 3414
tcaaaaaacttaaaaaaactcttcgatcgcgacctaaatttaaattccctcttaaacactaaaaaaaaactcctaaaccgaaaccgaaacctaaaccgcgaacgaaatctaaaaaccgacgaaaacttaaacttaaaccttcgtacgaatctaaacttaaaaatcgaccgaaatcgaaaacgaatacgaaaccgaaacttcgaacgactataacgaaatcgactacgaaacctaaaacgactccgactccgaaatcgactacgacgacgccgcctaaaactacgaacgaaacgaacaaacacaacgaaattaattccaaacaacgaaaccgaccccgcccgcgcgctcccgcccaaaccgccattatctcgccgccaaacgccatttccccaatcgcgaaacgaaatcctccgccccgcgccgcccacaccccgaccactcccgaatcgcaaacgacgaaaactcgcgaaataaccgaaaaatcgcgaaacgcgacgtacacccccgccccgtccgaacccgcaccacgtacttcgccgcgaacctttataaaatcgcccgaacctcccgcgcgccccgccccgcctcccgcgatcccctcaaccccgtttacctacgactccgacgtccgtaaccaccgcccccgtacctacgaaataacgatccccgacgactataatataaatccgaaaaacgaccgtaacgcgccatttacacccgcaactcgcgaccgtccaacacgaccccgtccataacatccataacgtcctcaacgtcgcgcttatcgtaaaaacgaacgaaaacgaaaccgcgaaactccttaatataacgatcccgcgaaatatacacgtcgccgacgcgcccgtacttctcgaaaacgcgcctcaacgtatcgaacgaaatacgataaatcaaattatccaccttaaaaaaaatcataccctccacatcgaaaaaaaaacgaccgtaactcataactctaaataacgacccgaaaccccgcgaactaacgccgacttcctcaactctaaacgatacgacgccgcgcctctcaaacaattaccttccgcgtaaaaacactaaaaaaaaccttaccgcaaaacaacacgaacgaactccgcaaactaacgcacctaaataacaactaaacgaacaaccgacctctacgcccgtttatatcgctcctcacaaaataacgcccgcgccacccgaaaataaaaccttctaattaacccaccgcgccccgcttcgtaacgaccctaccgcgcgccccgcccctacccgaaacgcctacgcacaacccgacgaacgaaccaaaaaacgcgaaatcacgactaaaaaaaaaaaaaacgaaattaacgaacaattaaaaaacccgcgaaacgctttttcc

SEQ ID NO: 3415 - DNA, 1393 bp, Artificial Sequence
  chemically treated genomic DNA (Homo sapiens) CpG-island No: 3415
ttaggagatttggggggatttttcgatcgcgatttggatttggatttttttttggatattgggggaggatttttggatcgagatcgggatttggatcgcgaacgagatttggagatcgacgaggatttggatttggattttcgtgcggatttggatttggaggtcgatcgagatcgagaacgagtgcgggatcgagatttcgagcggttgtagcgagatcggttgcgagatttggaacgatttcgatttcgggatcggttgcggcgacgtcgtttagggttgcgggcgggacgagtaagtatagcggggttaattttaggtagcggggtcggtttcgttcgcgcgttttcgtttaggtcgttattatttcgtcgttagacgttatttttttagtcgcgaggcggggtttttcgtttcgcgtcgtttatatttcggttattttcgggtcgtagacggcggaagttcgcggggtggtcggagggtcgcgagacgcggcgtgtattttcgtttcgttcgggttcgtattacgtgtttcgtcgcggatttttgtgaggtcgttcgggtttttcgcgcgtttcgtttcgtttttcgcggtttttttagtttcgtttatttgcggtttcggcgttcgtagttatcgttttcgtatttgcggggtggcggttttcggcggttgtggtgtgagttcggggggcggtcgtagcgcgttatttgtattcgtagttcgcggtcgtttagtacggtttcgtttatggtatttatagcgtttttagcgtcgcgtttgtcgtgaaagcgaacgaaggcgaagtcgcgggattttttggtgtagcggtttcgcgggatgtatacgtcgtcgacgcgttcgtatttttcgaagacgcgttttagcgtgtcgggcgaggtgcggtaggttaggttgtttattttgagggaggttatattttttatatcgggaggggggcggtcgtagtttatagttttgagtggcggttcggagtttcgcgaattggcgtcggtttttttagttttgggcggtgcgacgtcgcgttttttaggtagttgtttttcgcgtggggatattgggaaaggttttgtcgtagaatagtacggacgggtttcgtaggttagcgtatttgagtaataattgggcgggtagtcggtttttgcgttcgtttatatcgttttttataaaatggcgttcgcgttattcggaaatgaaattttttgattggtttatcgcgtttcgtttcgtaacgattttgtcgcgcgtttcgtttttattcgaagcgtttgcgtatagttcggcgggcgggttaaaaagcgcggagttacggttggagggagggggagcggaattagcgggtagttggaaagttcgcgaaacgtttttttt

SEQ ID NO: 3416 - DNA, 1393 bp, Artificial Sequence
  chemically treated genomic DNA (Homo sapiens) CpG-island No: 3416
aaaaaaaacgtttcgcgaactttccaactacccgctaattccgctccccctccctccaaccgtaactccgcgctttttaacccgcccgccgaactatacgcaaacgcttcgaataaaaacgaaacgcgcgacaaaatcgttacgaaacgaaacgcgataaaccaatcaaaaaatttcatttccgaataacgcgaacgccattttataaaaaacgatataaacgaacgcaaaaaccgactacccgcccaattattactcaaatacgctaacctacgaaacccgtccgtactattctacgacaaaacctttcccaatatccccacgcgaaaaacaactacctaaaaaacgcgacgtcgcaccgcccaaaactaaaaaaaccgacgccaattcgcgaaactccgaaccgccactcaaaactataaactacgaccgcccccctcccgatataaaaaatataacctccctcaaaataaacaacctaacctaccgcacctcgcccgacacgctaaaacgcgtcttcgaaaaatacgaacgcgtcgacgacgtatacatcccgcgaaaccgctacaccaaaaaatcccgcgacttcgccttcgttcgctttcacgacaaacgcgacgctaaaaacgctataaataccataaacgaaaccgtactaaacgaccgcgaactacgaatacaaataacgcgctacgaccgccccccgaactcacaccacaaccgccgaaaaccgccaccccgcaaatacgaaaacgataactacgaacgccgaaaccgcaaataaacgaaactaaaaaaaccgcgaaaaacgaaacgaaacgcgcgaaaaacccgaacgacctcacaaaaatccgcgacgaaacacgtaatacgaacccgaacgaaacgaaaatacacgccgcgtctcgcgaccctccgaccaccccgcgaacttccgccgtctacgacccgaaaataaccgaaatataaacgacgcgaaacgaaaaaccccgcctcgcgactaaaaaaataacgtctaacgacgaaataataacgacctaaacgaaaacgcgcgaacgaaaccgaccccgctacctaaaattaaccccgctatacttactcgtcccgcccgcaaccctaaacgacgtcgccgcaaccgatcccgaaatcgaaatcgttccaaatctcgcaaccgatctcgctacaaccgctcgaaatctcgatcccgcactcgttctcgatctcgatcgacctccaaatccaaatccgcacgaaaatccaaatccaaatcctcgtcgatctccaaatctcgttcgcgatccaaatcccgatctcgatccaaaaatcctcccccaatatccaaaaaaaaatccaaatccaaatcgcgatcgaaaaatccccccaaatctcctaa

SEQ ID NO: 3417 - DNA, 1236 bp, Artificial Sequence
  chemically treated genomic DNA (Homo sapiens) CpG-island No: 3417
agcgttcgtattttcggttttttaggaatttagttaagttagtcgatattcgtttttgattttaggcgttttttggcgggtgttgttgtacgtatttgcgggacgtggatttttaggatagtttcgtcggttttcggattcggttttttcgagaatcgaaagcgttgggttcggattttttgttttcggaaatcgtgttcgtttagtagggcgtcgttgggtttcgggcgggcgggggatcgcggaaggtttcgggttgttagattgcgcgagcgggaagtcgcgggttacgtggtcgtagtatttgacggtaagaaggggaaagtttagatttggtgataattttgtcgcgttgcgagcgaagaaagttcggagtaaggcgaaagagatttatacgcgtagaattggtaacgggcggttggcgcgatcggaagtgatgggtatagcggtagcgcgggaggggaggggcggggcggggcggggcggtgacgtagtcgacgtgatttttttaatatggcggaggttcgtcgtatgtgaaggagtattttaggggagttaaagttaatggaaaatcgcgagaggcgtcggggcggggaagacggcggtcgtttgtttaattcgaggttcgggaggtggttggggagtgaattttttggaaggcgattttaaaggcgtcgggattgagcgaagggcgtttgggtattgtcgtcgtcgtcgtttaggtcggggaggggtgcgttagtgttaggaagcgggttgcgtcgaggtcgtagcggaattagttggcgatttcgtagaatgaattataagagtaagaagcgtattcgcgaggttaagcggagtgcgcggtcggagtttaaggattcgttggattggattcggtataattattacgagagtttttcgttgagttcggcggtcgtggcggtgagcgggtcgggcgggggtggttaggtcgggtatcggtatttttagtcgttacgtatttttttttgggttcgaggttgttttcgtttcgagcgttcgggatttcgtagaggtttattcgtatttcgcggagtttggggttttcgaggcgcggatttcggggcgggtttgttttttttcgtgttgtggtcgttcgtttgttttggcggacgacgggagttttacgtttgtggcgtttttaattagaaggttcgtcgtttttgatttttttgggcggcgggttttttaggggatttggttgttaaggtt

SEQ ID NO: 3418 - DNA, 1236 bp, Artificial Sequence
  chemically treated genomic DNA (Homo sapiens) CpG-island No: 3418
aaccttaacaaccaaatcccctaaaaaacccgccgcccaaaaaaatcaaaaacgacgaaccttctaattaaaaacgccacaaacgtaaaactcccgtcgtccgccaaaacaaacgaacgaccacaacacgaaaaaaaacaaacccgccccgaaatccgcgcctcgaaaaccccaaactccgcgaaatacgaataaacctctacgaaatcccgaacgctcgaaacgaaaacaacctcgaacccaaaaaaaaatacgtaacgactaaaaataccgatacccgacctaaccacccccgcccgacccgctcaccgccacgaccgccgaactcaacgaaaaactctcgtaataattataccgaatccaatccaacgaatccttaaactccgaccgcgcactccgcttaacctcgcgaatacgcttcttactcttataattcattctacgaaatcgccaactaattccgctacgacctcgacgcaacccgcttcctaacactaacgcacccctccccgacctaaacgacgacgacgacaatacccaaacgcccttcgctcaatcccgacgcctttaaaatcgccttccaaaaaattcactccccaaccacctcccgaacctcgaattaaacaaacgaccgccgtcttccccgccccgacgcctctcgcgattttccattaactttaactcccctaaaatactccttcacatacgacgaacctccgccatattaaaaaaatcacgtcgactacgtcaccgccccgccccgccccgcccctcccctcccgcgctaccgctatacccatcacttccgatcgcgccaaccgcccgttaccaattctacgcgtataaatctctttcgccttactccgaactttcttcgctcgcaacgcgacaaaattatcaccaaatctaaactttccccttcttaccgtcaaatactacgaccacgtaacccgcgacttcccgctcgcgcaatctaacaacccgaaaccttccgcgatcccccgcccgcccgaaacccaacgacgccctactaaacgaacacgatttccgaaaacaaaaaatccgaacccaacgctttcgattctcgaaaaaaccgaatccgaaaaccgacgaaactatcctaaaaatccacgtcccgcaaatacgtacaacaacacccgccaaaaaacgcctaaaatcaaaaacgaatatcgactaacttaactaaattcctaaaaaaccgaaaatacgaacgct

SEQ ID NO: 3419 - DNA, 1236 bp, Artificial Sequence
  chemically treated genomic DNA (Homo sapiens) CpG-island No: 3419
agttttgatagttaggttttttaggggattcgtcgtttaaaggagttagggacgacgggttttttagttgagagcgttataggcgtgggattttcgtcgttcgttagagtagacgggcggttatagtacgggaggaagtagattcgtttcggaattcgcgtttcggggattttaaatttcgcggggtgcgggtgagtttttacgaggtttcgggcgttcggggcgagggtagtttcgggtttagagaaaggtgcgtagcggttggaggtgtcgatgttcggtttggttattttcgttcgattcgtttatcgttacggtcgtcgggtttagcgagaagttttcgtagtagttgtgtcgggtttaatttagcgagtttttgagtttcggtcgcgtatttcgtttggtttcgcggatgcgttttttgtttttgtggtttattttgcggggtcgttagttggtttcgttacgatttcggcgtagttcgttttttgatattaacgtattttttttcggtttgggcggcggcgacggtagtatttaaacgtttttcgtttagtttcggcgtttttaaagtcgttttttagaaaatttattttttagttatttttcgagtttcgggttgggtaagcggtcgtcgtttttttcgtttcgacgtttttcgcggttttttattggttttggtttttttggggtatttttttatatacggcgggttttcgttatgttgggaaggttacgtcggttgcgttatcgtttcgtttcgtttcgttttttttttttcgcgttgtcgttgtgtttattattttcggtcgcgttagtcgttcgttgttagttttgcgcgtgtgagtttttttcgttttgtttcgggtttttttcgttcgtagcgcggtagggttattattagatttgggtttttttttttttgtcgttaggtgttacggttacgtggttcgcggtttttcgttcgcgtagtttggtagttcggagtttttcgcggtttttcgttcgttcggggtttaacgacgttttattgggcgagtacgattttcgaggatagggggttcgggtttagcgttttcgattttcggaggagtcgggttcgggggtcgacggggttgttttggaggtttacgtttcgtaggtgcgtgtagtagtattcgttaggaggcgtttgaggttaggagcggatgtcggttgatttggttgggtttttgagggatcgggggtgcggacgtt

SEQ ID NO: 3420 - DNA, 1236 bp, Artificial Sequence
  chemically treated genomic DNA (Homo sapiens) CpG-island No: 3420
aacgtccgcacccccgatccctcaaaaacccaaccaaatcaaccgacatccgctcctaacctcaaacgcctcctaacgaatactactacacgcacctacgaaacgtaaacctccaaaacaaccccgtcgacccccgaacccgactcctccgaaaatcgaaaacgctaaacccgaaccccctatcctcgaaaatcgtactcgcccaataaaacgtcgttaaaccccgaacgaacgaaaaaccgcgaaaaactccgaactaccaaactacgcgaacgaaaaaccgcgaaccacgtaaccgtaacacctaacgacaaaaaaaaaaaaacccaaatctaataataaccctaccgcgctacgaacgaaaaaaacccgaaacaaaacgaaaaaaactcacacgcgcaaaactaacaacgaacgactaacgcgaccgaaaataataaacacaacgacaacgcgaaaaaaaaaaaacgaaacgaaacgaaacgataacgcaaccgacgtaaccttcccaacataacgaaaacccgccgtatataaaaaaataccccaaaaaaaccaaaaccaataaaaaaccgcgaaaaacgtcgaaacgaaaaaaacgacgaccgcttacccaacccgaaactcgaaaaataactaaaaaataaattttctaaaaaacgactttaaaaacgccgaaactaaacgaaaaacgtttaaatactaccgtcgccgccgcccaaaccgaaaaaaaatacgttaatatcaaaaaacgaactacgccgaaatcgtaacgaaaccaactaacgaccccgcaaaataaaccacaaaaacaaaaaacgcatccgcgaaaccaaacgaaatacgcgaccgaaactcaaaaactcgctaaattaaacccgacacaactactacgaaaacttctcgctaaacccgacgaccgtaacgataaacgaatcgaacgaaaataaccaaaccgaacatcgacacctccaaccgctacgcacctttctctaaacccgaaactaccctcgccccgaacgcccgaaacctcgtaaaaactcacccgcaccccgcgaaatttaaaatccccgaaacgcgaattccgaaacgaatctacttcctcccgtactataaccgcccgtctactctaacgaacgacgaaaatcccacgcctataacgctctcaactaaaaaacccgtcgtccctaactcctttaaacgacgaatcccctaaaaaacctaactatcaaaact

SEQ ID NO: 3421 - DNA, 722 bp, Artificial Sequence
  chemically treated genomic DNA (Homo sapiens) CpG-island No: 3421
ggcgatgggggtttcgtttcgaggcggggcgcggcgatcgggcgcggcgacggggcgcggcgggttttttcggggttttagttggttcgtattcggcggtcgcggcgcgatggaggcgtcggtcgagttattggtcgcgttgtttgcgttggttatcgcgttggtttttttgttcgtttggttattggtgcggcgtggggcggtcgcgagttcggagtttgttcgcgcgttttcggaattcgcgttttcggtcgaggttatcggggtttcggcgtcgtttcgtttttgcgttttcgagtcggcggtttcgttcgcggggtcggaggagtttggagagttcgcggggttgggggagttcggggagtttgcgggatcgggggagttcgaagggttaggggatttcgcggcggcgttagcggaggcggaggagtaggcggtggaggcgaggtaggtacgtatcggggttttcgcggttttttttttattttcggggtttcggttgtcgttgtcgtttttcgtcgagttagggagcggggtcgcggtttttagtttaggttgtttttaggaagcgtagaattcgcggttcgtaggaaatgtaggtttcgttatgttaagtcgtagtttcgtaaattcgtcgtttttttttagaaagtgtggcgaggggcgagttcgaaggagtttgtttggaggtgttttgttttttttttttttcggtttttttt

SEQ ID NO: 3422 - DNA, 722 bp, Artificial Sequence
  chemically treated genomic DNA (Homo sapiens) CpG-island No: 3422
aaaaaaaaccgaaaaaaaaaaaaaacaaaacacctccaaacaaactccttcgaactcgcccctcgccacactttctaaaaaaaaacgacgaatttacgaaactacgacttaacataacgaaacctacatttcctacgaaccgcgaattctacgcttcctaaaaacaacctaaactaaaaaccgcgaccccgctccctaactcgacgaaaaacgacaacgacaaccgaaaccccgaaaataaaaaaaaaaccgcgaaaaccccgatacgtacctacctcgcctccaccgcctactcctccgcctccgctaacgccgccgcgaaatcccctaacccttcgaactcccccgatcccgcaaactccccgaactcccccaaccccgcgaactctccaaactcctccgaccccgcgaacgaaaccgccgactcgaaaacgcaaaaacgaaacgacgccgaaaccccgataacctcgaccgaaaacgcgaattccgaaaacgcgcgaacaaactccgaactcgcgaccgccccacgccgcaccaataaccaaacgaacaaaaaaaccaacgcgataaccaacgcaaacaacgcgaccaataactcgaccgacgcctccatcgcgccgcgaccgccgaatacgaaccaactaaaaccccgaaaaaacccgccgcgccccgtcgccgcgcccgatcgccgcgccccgcctcgaaacgaaacccccatcgcc

SEQ ID NO: 3423 - DNA, 722 bp, Artificial Sequence
  chemically treated genomic DNA (Homo sapiens) CpG-island No: 3423
gggagaggtcgaggggaggggagagtaaaatatttttaaataaattttttcgggttcgtttttcgttatattttttgggggagggcggcgagtttgcggggttgcggtttagtatggcgggatttgtattttttgcgggtcgcgggttttgcgttttttgggggtagtttgggttggaggtcgcggtttcgttttttggttcggcggggaacggtagcggtagtcggagtttcgggggtggggagggggtcgcgagggtttcggtgcgtatttgtttcgtttttatcgtttgttttttcgttttcgttggcgtcgtcgcgggattttttggtttttcgggttttttcggtttcgtaggtttttcgagtttttttagtttcgcgggttttttaggttttttcggtttcgcgggcgaggtcgtcggttcgggggcgtaggggcgggacggcgtcggggtttcggtggtttcggtcgggggcgcgggtttcgggggcgcgcgggtaggtttcgggttcgcggtcgttttacgtcgtattagtagttaggcgagtagaagggttagcgcggtggttagcgtaggtagcgcggttagtagttcggtcggcgtttttatcgcgtcgcggtcgtcgagtgcgggttagttgggatttcgagggagttcgtcgcgtttcgtcgtcgcgttcggtcgtcgcgtttcgtttcggggcggagtttttatcgtt

SEQ ID NO: 3424 - DNA, 722 bp, Artificial Sequence
  chemically treated genomic DNA (Homo sapiens) CpG-island No: 3424
aacgataaaaactccgccccgaaacgaaacgcgacgaccgaacgcgacgacgaaacgcgacgaactccctcgaaatcccaactaacccgcactcgacgaccgcgacgcgataaaaacgccgaccgaactactaaccgcgctacctacgctaaccaccgcgctaacccttctactcgcctaactactaatacgacgtaaaacgaccgcgaacccgaaacctacccgcgcgcccccgaaacccgcgcccccgaccgaaaccaccgaaaccccgacgccgtcccgcccctacgcccccgaaccgacgacctcgcccgcgaaaccgaaaaaacctaaaaaacccgcgaaactaaaaaaactcgaaaaacctacgaaaccgaaaaaacccgaaaaaccaaaaaatcccgcgacgacgccaacgaaaacgaaaaaacaaacgataaaaacgaaacaaatacgcaccgaaaccctcgcgaccccctccccacccccgaaactccgactaccgctaccgttccccgccgaaccaaaaaacgaaaccgcgacctccaacccaaactacccccaaaaaacgcaaaacccgcgacccgcaaaaaatacaaatcccgccatactaaaccgcaaccccgcaaactcgccgccctcccccaaaaaatataacgaaaaacgaacccgaaaaaatttatttaaaaatattttactctcccctcccctcgacctctccc

SEQ ID NO: 3425 - DNA, 1096 bp, Artificial Sequence
  chemically treated genomic DNA (Homo sapiens) CpG-island No: 3425
cgtgcgtagttgaatttataggacgtttaggtggagaaggaattattttttgtttttggattcgtttcgatttttgtttggcgagggcgcgtttcggttgggcgtggatattgtttttcggtcgcgtcgggtcgggcgggtggggcgtttttgcgggttgggcggttgggtttttcggggtgtggttatttcgcgtttcgttttgcgtttttttttcgtcgtcggttttcgggtgtggtggtcgtattagttttttgtttttttagcgtagcgtcgtcgttcggtttttttagtttttcggtaaggcggtgggggcgtattttttggcgatttttttcgttttttttttcgtttgcgttgtcgtaggtgggttcggtttgtgggcgtttttcgatttttcgtaggtttcgcgcggcgtcggagcgggagatttttttgtagtttgcgtttcgcgggttttcgggtttcgtagagggacgtcggttttgcgcggggcggaagcggtcgggaagttacgtgttttcgcggtcgcgcgtggtgggggaggagggatcggcggcgtttacgtggttttcgcgggtttcgttagagtttgcgttcgggttttgatcgtatttttcgtttcgtaggattatggttaatttggagcgtatttttatcgttattaagtcggacggcgtgtagcgcggtttggtgggcgagattattaagcgtttcgagtagaagggatttcgtttcgtggttatgaagttttttcgggtaattcgttttcgttttttttttttcgttgtagtcggttcgcgggtgtttttttttttcggcggcggtttgttcgcgtttgtttttcgagtttatttcgttgtcgcgaaatttttttgttttttgttttcgtttacggcggtttgggttcgtcgattttttttcggggtggtggggatagacgtttttgggaaggtgaagcgttggtagcgtgattcgtttttcgggtttgggttttttttcgcgggtcgttatttgtttattcgtcgtaggggggtagtagggagcggaaaaatttcgggttttagattttttgcgtttgtttattcgggtttat

SEQ ID NO: 3426 - DNA, 1096 bp, Artificial Sequence
  chemically treated genomic DNA (Homo sapiens) CpG-island No: 3426
ataaacccgaataaacaaacgcaaaaaatctaaaacccgaaatttttccgctccctactacccccctacgacgaataaacaaataacgacccgcgaaaaaaaacccaaacccgaaaaacgaatcacgctaccaacgcttcaccttcccaaaaacgtctatccccaccaccccgaaaaaaaatcgacgaacccaaaccgccgtaaacgaaaacaaaaaacaaaaaaatttcgcgacaacgaaataaactcgaaaaacaaacgcgaacaaaccgccgccgaaaaaaaaaaacacccgcgaaccgactacaacgaaaaaaaaaaaacgaaaacgaattacccgaaaaaacttcataaccacgaaacgaaatcccttctactcgaaacgcttaataatctcgcccaccaaaccgcgctacacgccgtccgacttaataacgataaaaatacgctccaaattaaccataatcctacgaaacgaaaaatacgatcaaaacccgaacgcaaactctaacgaaacccgcgaaaaccacgtaaacgccgccgatccctcctcccccaccacgcgcgaccgcgaaaacacgtaacttcccgaccgcttccgccccgcgcaaaaccgacgtccctctacgaaacccgaaaacccgcgaaacgcaaactacaaaaaaatctcccgctccgacgccgcgcgaaacctacgaaaaatcgaaaaacgcccacaaaccgaacccacctacgacaacgcaaacgaaaaaaaaaacgaaaaaaatcgccaaaaaatacgcccccaccgccttaccgaaaaactaaaaaaaccgaacgacgacgctacgctaaaaaaacaaaaaactaatacgaccaccacacccgaaaaccgacgacgaaaaaaaaacgcaaaacgaaacgcgaaataaccacaccccgaaaaacccaaccgcccaacccgcaaaaacgccccacccgcccgacccgacgcgaccgaaaaacaatatccacgcccaaccgaaacgcgccctcgccaaacaaaaatcgaaacgaatccaaaaacaaaaaataattccttctccacctaaacgtcctataaattcaactacgcacg

SEQ ID NO: 3427 - DNA, 1096 bp, Artificial Sequence
  chemically treated genomic DNA (Homo sapiens) CpG-island No: 3427
gtggattcgagtgggtaggcgtagggggtttggggttcggggttttttcgttttttgttgtttttttgcggcgggtgggtaggtagcggttcgcgggaaggaatttaaattcggagggcgagttacgttattagcgttttatttttttaagggcgtttgtttttattatttcgggaaagggtcggcgggtttaagtcgtcgtgggcgggggtagagggtaaagggatttcgcggtagcgaaatgaattcggaaagtagacgcggataaatcgtcgtcgggagggaaaaatattcgcgagtcggttgtagcggggaaggggagacgggggcgagttattcggaggaattttatggttacgaggcggaattttttttgttcgaagcgtttgatgatttcgtttattaggtcgcgttgtacgtcgttcggtttgatggcgatgaaggtgcgttttaggttggttatggttttgcggggcgagaggtgcggttagggttcgggcgtaggttttggcggggttcgcggaggttacgtgggcgtcgtcggtttttttttttttattacgcgcggtcgcggggatacgtggtttttcggtcgttttcgtttcgcgtagggtcggcgtttttttgcggagttcgaaggttcgcggggcgtaagttgtaagggaatttttcgtttcgacgtcgcgcgggatttgcgggaaatcggggggcgtttatagatcgggtttatttgcggtagcgtaagcggaagagggaacgggaggagtcgttaggggatgcgtttttatcgttttatcgggaagttggaggggtcgggcggcggcgttgcgttgggagagtagagagttggtgcgattattatattcgggagtcggcggcggaggaggggcgtagggcggagcgcggggtggttatatttcggagggtttagtcgtttaattcgtaggaacgttttattcgttcggttcgacgcggtcggagaatagtgtttacgtttagtcggggcgcgttttcgttaggtagagatcgagacggatttagagataggaagtgattttttttttatttggacgttttatgagtttaattacgtacg

SEQ ID NO: 3428 - DNA, 1096 bp, Artificial Sequence
  chemically treated genomic DNA (Homo sapiens) CpG-island No: 3428
cgtacgtaattaaactcataaaacgtccaaataaaaaaaaaatcacttcctatctctaaatccgtctcgatctctacctaacgaaaacgcgccccgactaaacgtaaacactattctccgaccgcgtcgaaccgaacgaataaaacgttcctacgaattaaacgactaaaccctccgaaatataaccaccccgcgctccgccctacgcccctcctccgccgccgactcccgaatataataatcgcaccaactctctactctcccaacgcaacgccgccgcccgacccctccaacttcccgataaaacgataaaaacgcatcccctaacgactcctcccgttccctcttccgcttacgctaccgcaaataaacccgatctataaacgccccccgatttcccgcaaatcccgcgcgacgtcgaaacgaaaaattcccttacaacttacgccccgcgaaccttcgaactccgcaaaaaaacgccgaccctacgcgaaacgaaaacgaccgaaaaaccacgtatccccgcgaccgcgcgtaataaaaaaaaaaaaaccgacgacgcccacgtaacctccgcgaaccccgccaaaacctacgcccgaaccctaaccgcacctctcgccccgcaaaaccataaccaacctaaaacgcaccttcatcgccatcaaaccgaacgacgtacaacgcgacctaataaacgaaatcatcaaacgcttcgaacaaaaaaaattccgcctcgtaaccataaaattcctccgaataactcgcccccgtctccccttccccgctacaaccgactcgcgaatatttttccctcccgacgacgatttatccgcgtctactttccgaattcatttcgctaccgcgaaatccctttaccctctacccccgcccacgacgacttaaacccgccgaccctttcccgaaataataaaaacaaacgcccttaaaaaaataaaacgctaataacgtaactcgccctccgaatttaaattccttcccgcgaaccgctacctacccacccgccgcaaaaaaacaacaaaaaacgaaaaaaccccgaaccccaaaccccctacgcctacccactcgaatccac

SEQ ID NO: 3429 - DNA, 1118 bp, Artificial Sequence
  chemically treated genomic DNA (Homo sapiens) CpG-island No: 3429
gcgttcggttttttcggggtcgagggagggggcgtcgcgcggcgagtggggatttcgttgggtttcggcgtcggtaggggatttcgggagggcgtcggaattttgtcgcgtttgcgtcgtataaaggtcgaagggttaggaaagtattgtggggagtcgtttttcgttttggttcgtgttttatcgttcgggtgggcgagttttggtatcgttattaacgaggcggttcgcggttggtagtttcgttggggtcgcgaggtcgggggcggcgtggcgtgggaggttcggtttggtttcgggttgcggttcgggtgttcgcggcggtcgtttcgtttcgttttttttcgtcgtttcgcgcgcgtcggggtgggtattgtaatttcgattttttgttcgggttcgggcgttgtcggttggggagtttggggtttcggttcgcgtatttaggtcgtttttttgtcgagcgtatggtcggtttcggtgttttaaacgacgtagttcggttcgggacggcgatgttatcggttttcggcgggacggtcgcgaggttgtaaaggcggtcgtttcgattcgtgttcggtcgcgggtttcgggcgcggcggaagggcggttcgcggggtttcgggtttcgacgttttcgtaggtttcgtcgttttttatttttagtacgttttcgttttgtttggggttgatgtttattttttttatgggtagcggcgtcgattgcgtttcgttttcggtcgtttttattttttcggttgttattttcgcgcggcgcgtcgtttattcgggagttggtgtcggcgcgagcgtattttgggtcgcgggcgggggcgttatttgcggggcgtgcgggaggtcgggcgcggcggtattgattgcggatcgcgaggaggtttgagtatttttgtacgcggcgcgagagttggggtaggtgggttaggagcggttcggggagcgattggtttcgtttcgtcgcgagggaggggttgggaggagcgggagcgtagatagagggggcggggtgtagaattttttagagacggcgggattgagtcggttcgggtttagtgttgcgggcgtttcggaatttttttttttttttttttttttggttt

SEQ ID NO: 3430 - DNA, 1118 bp, Artificial Sequence
  chemically treated genomic DNA (Homo sapiens) CpG-island No: 3430
aaaccaaaaaaaaaaaaaaaaaaaaaaattccgaaacgcccgcaacactaaacccgaaccgactcaatcccgccgtctctaaaaaattctacaccccgccccctctatctacgctcccgctcctcccaacccctccctcgcgacgaaacgaaaccaatcgctccccgaaccgctcctaacccacctaccccaactctcgcgccgcgtacaaaaatactcaaacctcctcgcgatccgcaatcaataccgccgcgcccgacctcccgcacgccccgcaaataacgcccccgcccgcgacccaaaatacgctcgcgccgacaccaactcccgaataaacgacgcgccgcgcgaaaataacaaccgaaaaaataaaaacgaccgaaaacgaaacgcaatcgacgccgctacccataaaaaaaataaacatcaaccccaaacaaaacgaaaacgtactaaaaataaaaaacgacgaaacctacgaaaacgtcgaaacccgaaaccccgcgaaccgcccttccgccgcgcccgaaacccgcgaccgaacacgaatcgaaacgaccgcctttacaacctcgcgaccgtcccgccgaaaaccgataacatcgccgtcccgaaccgaactacgtcgtttaaaacaccgaaaccgaccatacgctcgacaaaaaaacgacctaaatacgcgaaccgaaaccccaaactccccaaccgacaacgcccgaacccgaacaaaaaatcgaaattacaatacccaccccgacgcgcgcgaaacgacgaaaaaaaacgaaacgaaacgaccgccgcgaacacccgaaccgcaacccgaaaccaaaccgaacctcccacgccacgccgcccccgacctcgcgaccccaacgaaactaccaaccgcgaaccgcctcgttaataacgataccaaaactcgcccacccgaacgataaaacacgaaccaaaacgaaaaacgactccccacaatactttcctaacccttcgacctttatacgacgcaaacgcgacaaaattccgacgccctcccgaaatcccctaccgacgccgaaacccaacgaaatccccactcgccgcgcgacgccccctccctcgaccccgaaaaaaccgaacgc

SEQ ID NO: 3431 - DNA, 1118 bp, Artificial Sequence
  chemically treated genomic DNA (Homo sapiens) CpG-island No: 3431
gaattaaaaaaaaaaaaagaaaaaaaaatttcgaagcgttcgtagtattgagttcgaatcggtttagtttcgtcgtttttagaaagttttgtatttcgttttttttgtttgcgttttcgttttttttagtttttttttcgcggcggggcgggattaatcgtttttcgagtcgtttttgatttatttattttagttttcgcgtcgcgtgtagaggtgtttaagttttttcgcggttcgtagttagtgtcgtcgcgttcggtttttcgtacgtttcgtaggtagcgttttcgttcgcggtttagagtgcgttcgcgtcggtattagttttcggataaacggcgcgtcgcgcggagatgatagtcgaggagatgaaggcgatcgagagcggggcgtagtcggcgtcgttgtttatggagggagtggatattagttttaaataggacgaaggcgtgttgaaggtgaggggcggcggggtttgcggaggcgtcggaattcggggtttcgcgggtcgttttttcgtcgcgttcggagttcgcggtcgggtacgggtcgaggcggtcgtttttgtagtttcgcggtcgtttcgtcgggggtcggtggtatcgtcgtttcggatcgggttgcgtcgtttaaggtatcgaggtcggttatgcgttcggtaggggggcggtttaggtgcgcgggtcgaggttttaggttttttagtcggtagcgttcgggttcgggtagggggtcgggattgtagtgtttatttcggcgcgcgcggggcggcggagaggggcggggcgaggcgatcgtcgcgggtattcgagtcgtagttcggggttaggtcgggttttttacgttacgtcgttttcgatttcgcggttttagcggagttgttagtcgcgggtcgtttcgttggtggcggtgttagggttcgtttattcgggcggtggaatacgggttaggacggggagcgattttttatagtgtttttttggtttttcggtttttgtgcgacgtaggcgcgatagggtttcggcgttttttcggggttttttgtcgacgtcgggatttagcgaggtttttattcgtcgcgcggcgttttttttttcggtttcggggaggtcgggcgt

SEQ ID NO: 3432 - DNA, 1118 bp, Artificial Sequence
  chemically treated genomic DNA (Homo sapiens) CpG-island No: 3432
acgcccgacctccccgaaaccgaaaaaaaaaacgccgcgcgacgaataaaaacctcgctaaatcccgacgtcgacaaaaaaccccgaaaaaacgccgaaaccctatcgcgcctacgtcgcacaaaaaccgaaaaaccaaaaaaacactataaaaaatcgctccccgtcctaacccgtattccaccgcccgaataaacgaaccctaacaccgccaccaacgaaacgacccgcgactaacaactccgctaaaaccgcgaaatcgaaaacgacgtaacgtaaaaaacccgacctaaccccgaactacgactcgaatacccgcgacgatcgcctcgccccgcccctctccgccgccccgcgcgcgccgaaataaacactacaatcccgaccccctacccgaacccgaacgctaccgactaaaaaacctaaaacctcgacccgcgcacctaaaccgcccccctaccgaacgcataaccgacctcgataccttaaacgacgcaacccgatccgaaacgacgataccaccgacccccgacgaaacgaccgcgaaactacaaaaacgaccgcctcgacccgtacccgaccgcgaactccgaacgcgacgaaaaaacgacccgcgaaaccccgaattccgacgcctccgcaaaccccgccgcccctcaccttcaacacgccttcgtcctatttaaaactaatatccactccctccataaacaacgacgccgactacgccccgctctcgatcgccttcatctcctcgactatcatctccgcgcgacgcgccgtttatccgaaaactaataccgacgcgaacgcactctaaaccgcgaacgaaaacgctacctacgaaacgtacgaaaaaccgaacgcgacgacactaactacgaaccgcgaaaaaacttaaacacctctacacgcgacgcgaaaactaaaataaataaatcaaaaacgactcgaaaaacgattaatcccgccccgccgcgaaaaaaaaactaaaaaaaacgaaaacgcaaacaaaaaaaacgaaatacaaaactttctaaaaacgacgaaactaaaccgattcgaactcaatactacgaacgcttcgaaatttttttttctttttttttttttaattc

SEQ ID NO: 3433 - DNA, 738 bp, Artificial Sequence
  chemically treated genomic DNA (Homo sapiens) CpG-island No: 3433
gttcggaataggtacgattcgtttttggcgattagttttcgatataagtttagttttcgtagataggcgtttatgggcgtcgcgttttcgcggggtttcgcgtcgttttggttttcgtcgtcggggacgtcgacggtcgtttttatgttgttggttttgttgtaggttaggcgcgagggttagttttatatggttaggtcgtcggttgttcgacgtttcggtttggggtaggcggcggttcgggttggggttcgggtttcgcgagcggcggtaggcggtaggcggcggcggcggttcgaggtagcggttcgcgtttttcgggcgcgtaggggagttttgtttaatgtatggttgttcgtacgcggtcgttttttcggagcgaatacgcgtttacgataaacggggggagcgggattaaggaaaatttcgagagtgagtagttatttttcgacggtttcgttgttcgatttaggatttaggtcgggggtcgtcgtttttataagttttttcgtttgtatcggtgtgaagcgagaaaagtttcgttttaggcgcgtacgtcgggtcggtttaggtgaagcggggtttgcgtttttcgcgcgttttttacgtcgggagtcgaggaaattaaaaaagaaagacgcggtttttcgtttttttattacgttggagggcgtcggaggggcggggagcgggtgggggttttttttggatttttttttttttttttagttttgttaa

SEQ ID NO: 3434 - DNA, 738 bp, Artificial Sequence
  chemically treated genomic DNA (Homo sapiens) CpG-island No: 3434
ttaacaaaactaaaaaaaaaaaaaaaaatccaaaaaaaacccccacccgctccccgcccctccgacgccctccaacgtaataaaaaaacgaaaaaccgcgtctttcttttttaatttcctcgactcccgacgtaaaaaacgcgcgaaaaacgcaaaccccgcttcacctaaaccgacccgacgtacgcgcctaaaacgaaacttttctcgcttcacaccgatacaaacgaaaaaacttataaaaacgacgacccccgacctaaatcctaaatcgaacaacgaaaccgtcgaaaaataactactcactctcgaaattttccttaatcccgctccccccgtttatcgtaaacgcgtattcgctccgaaaaaacgaccgcgtacgaacaaccatacattaaacaaaactcccctacgcgcccgaaaaacgcgaaccgctacctcgaaccgccgccgccgcctaccgcctaccgccgctcgcgaaacccgaaccccaacccgaaccgccgcctaccccaaaccgaaacgtcgaacaaccgacgacctaaccatataaaactaaccctcgcgcctaacctacaacaaaaccaacaacataaaaacgaccgtcgacgtccccgacgacgaaaaccaaaacgacgcgaaaccccgcgaaaacgcgacgcccataaacgcctatctacgaaaactaaacttatatcgaaaactaatcgccaaaaacgaatcgtacctattccgaac

SEQ ID NO: 3435 - DNA, 738 bp, Artificial Sequence
  chemically treated genomic DNA (Homo sapiens) CpG-island No: 3435
ttagtaaggttaagaaaaaaagagaagatttagggggagtttttattcgtttttcgttttttcggcgttttttagcgtggtggggaaacgaaaggtcgcgttttttttttttggttttttcggttttcggcgtggggagcgcgcgggggacgtaggtttcgttttatttgagtcggttcggcgtgcgcgtttggggcggggtttttttcgttttatatcggtatagacgaggaaatttgtgggggcggcgattttcggtttgggttttgagtcgggtagcgaggtcgtcgggaagtgattatttattttcggggttttttttaatttcgtttttttcgtttgtcgtgggcgcgtgttcgtttcgaggaggcggtcgcgtacggatagttatgtattaggtagggtttttttacgcgttcggagagcgcggatcgttgtttcgggtcgtcgtcgtcgtttgtcgtttgtcgtcgttcgcggagttcgagttttagttcgagtcgtcgtttattttaggtcggggcgtcgagtagtcggcggtttggttatgtggggttagttttcgcgtttggtttgtagtaggattagtaatatggaggcggtcgtcggcgttttcgacggcgaggattagggcggcgcggggtttcgcgaggacgcgacgtttatggacgtttatttgcggaaattgggtttgtatcggaaattggtcgttaaggacgggtcgtgtttgtttcgggt

SEQ ID NO: 3436 - DNA, 738 bp, Artificial Sequence
  chemically treated genomic DNA (Homo sapiens) CpG-island No: 3436
acccgaaacaaacacgacccgtccttaacgaccaatttccgatacaaacccaatttccgcaaataaacgtccataaacgtcgcgtcctcgcgaaaccccgcgccgccctaatcctcgccgtcgaaaacgccgacgaccgcctccatattactaatcctactacaaaccaaacgcgaaaactaaccccacataaccaaaccgccgactactcgacgccccgacctaaaataaacgacgactcgaactaaaactcgaactccgcgaacgacgacaaacgacaaacgacgacgacgacccgaaacaacgatccgcgctctccgaacgcgtaaaaaaaccctacctaatacataactatccgtacgcgaccgcctcctcgaaacgaacacgcgcccacgacaaacgaaaaaaacgaaattaaaaaaaaccccgaaaataaataatcacttcccgacgacctcgctacccgactcaaaacccaaaccgaaaatcgccgcccccacaaatttcctcgtctataccgatataaaacgaaaaaaaccccgccccaaacgcgcacgccgaaccgactcaaataaaacgaaacctacgtcccccgcgcgctccccacgccgaaaaccgaaaaaaccaaaaaaaaaaaacgcgacctttcgtttccccaccacgctaaaaaacgccgaaaaaacgaaaaacgaataaaaactccccctaaatcttctctttttttcttaaccttactaa

SEQ ID NO: 3437 - DNA, 534 bp, Artificial Sequence
  chemically treated genomic DNA (Homo sapiens) CpG-island No: 3437
gtagggggcgttgcggtgtagaggcgacgttgtttttttttttttagggtcgagcggggggtttgtcgttcgtagggggcgttgcggtgtagaggcgacgttgttttttttttttcggggtcgagcggggggtttgtcgttcgtagggggcgttgcggtgtagaggcgacgttgttttttttttttcggggtcgagcggggggtttgtcgttcgtagggggcgttgcggtgtagaggcgacgttgttttttttttttcggggtcgagcggggggtttgtcgttcgtagggggcgttgcggtgtagaggcgacgttgttttttttttttcggggtcgagcggggggtttgtcgttcgtagggggcgttgcggtgtagaggcgacgttgttttttttttttcggggtcgagcggggggtttgtcgttcgtagggggcgttgcggtgtagaggcgacgttgtttttttttttttagggtcgagttaaattttagagaattatatatagtggggatttttgtttttttttttttattt

SEQ ID NO: 3438 - DNA, 534 bp, Artificial Sequence
  chemically treated genomic DNA (Homo sapiens) CpG-island No: 3438
aaataaaaaaaaaaaaacaaaaatccccactatatataattctctaaaatttaactcgaccctaaaaaaaaaaaaacaacgtcgcctctacaccgcaacgccccctacgaacgacaaaccccccgctcgaccccgaaaaaaaaaaaacaacgtcgcctctacaccgcaacgccccctacgaacgacaaaccccccgctcgaccccgaaaaaaaaaaaacaacgtcgcctctacaccgcaacgccccctacgaacgacaaaccccccgctcgaccccgaaaaaaaaaaaacaacgtcgcctctacaccgcaacgccccctacgaacgacaaaccccccgctcgaccccgaaaaaaaaaaaacaacgtcgcctctacaccgcaacgccccctacgaacgacaaaccccccgctcgaccccgaaaaaaaaaaaacaacgtcgcctctacaccgcaacgccccctacgaacgacaaaccccccgctcgaccctaaaaaaaaaaaaacaacgtcgcctctacaccgcaacgccccctac

SEQ ID NO: 3439 - DNA, 534 bp, Artificial Sequence
  chemically treated genomic DNA (Homo sapiens) CpG-island No: 3439
ggatggaagagagaaaataaaaatttttattgtatgtggttttttggaatttaattcggttttggagaggaaagagtagcgtcgtttttgtatcgtagcgttttttgcgggcggtaaatttttcgttcggtttcggagaggaaagggtaacgtcgtttttgtatcgtagcgttttttgcgggcggtaagtttttcgttcggtttcggagaggaaagggtaacgtcgtttttgtatcgtagcgttttttgcgggcggtaaatttttcgttcggtttcggagaggaaagggtaacgtcgtttttgtatcgtagcgttttttgcgggcggtaaatttttcgttcggtttcggagaggaaagggtaacgtcgtttttgtatcgtagcgttttttgcgggcggtaaatttttcgttcggtttcggagaggaaagggtaacgtcgtttttgtatcgtagcgttttttgcgggcggtaaatttttcgttcggttttggagaggaaagggtagcgtcgtttttgtatcgtagcgttttttgt

SEQ ID NO: 3440 - DNA, 534 bp, Artificial Sequence
  chemically treated genomic DNA (Homo sapiens) CpG-island No: 3440
acaaaaaacgctacgatacaaaaacgacgctaccctttcctctccaaaaccgaacgaaaaatttaccgcccgcaaaaaacgctacgatacaaaaacgacgttaccctttcctctccgaaaccgaacgaaaaatttaccgcccgcaaaaaacgctacgatacaaaaacgacgttaccctttcctctccgaaaccgaacgaaaaatttaccgcccgcaaaaaacgctacgatacaaaaacgacgttaccctttcctctccgaaaccgaacgaaaaatttaccgcccgcaaaaaacgctacgatacaaaaacgacgttaccctttcctctccgaaaccgaacgaaaaacttaccgcccgcaaaaaacgctacgatacaaaaacgacgttaccctttcctctccgaaaccgaacgaaaaatttaccgcccgcaaaaaacgctacgatacaaaaacgacgctactctttcctctccaaaaccgaattaaattccaaaaaaccacatacaataaaaatttttattttctctcttccatcc

SEQ ID NO: 3441 - DNA, 658 bp, Artificial Sequence
  chemically treated genomic DNA (Homo sapiens) CpG-island No: 3441
cggggcgggggcgggggcggggtcgggggcgggttaggtttcgcgagtaggagagtttagagttcggagttcggttcggggttggcgggggcgcgggcggaggtaggcgggcgggcgtcggggaagtttttttttgggtagcgagtgagggcgggcgcgtagggagggagggcggtagcgagtttgcgacgggagaggcgtggggaggagagttcggcgcggaatatacgcgcggaggaggagtcgggttcggttttcggagagatttgttgggcgttcgcgtagttcggagatttttcgcgttcggagtatgagttcgagtttcgtcggagagcggtcgggagagacggtttcggcgtagttttgagacgttgggtcgggacgcggggcgttttgggcgcggggttcggtcggggggcggcggttcggggggttggagttcgcgttggcggcggtcgtttcggcgtagcgttatggggagttttcgggtcgcgcggttttcgttgtttttgcgttcggtgaagttgttgcggaggcgttttcggttgttgttggcgttcgtcgtggtgtttgtggggttttggattttgtatttggaattggtggcgtcggtttaggtcggcgggaattttttgaatcggagtaagtagtatttagg

SEQ ID NO: 3442 - DNA, 658 bp, Artificial Sequence
  chemically treated genomic DNA (Homo sapiens) CpG-island No: 3442
cctaaatactacttactccgattcaaaaaattcccgccgacctaaaccgacgccaccaattccaaatacaaaatccaaaaccccacaaacaccacgacgaacgccaacaacaaccgaaaacgcctccgcaacaacttcaccgaacgcaaaaacaacgaaaaccgcgcgacccgaaaactccccataacgctacgccgaaacgaccgccgccaacgcgaactccaaccccccgaaccgccgccccccgaccgaaccccgcgcccaaaacgccccgcgtcccgacccaacgtctcaaaactacgccgaaaccgtctctcccgaccgctctccgacgaaactcgaactcatactccgaacgcgaaaaatctccgaactacgcgaacgcccaacaaatctctccgaaaaccgaacccgactcctcctccgcgcgtatattccgcgccgaactctcctccccacgcctctcccgtcgcaaactcgctaccgccctccctccctacgcgcccgccctcactcgctacccaaaaaaaaacttccccgacgcccgcccgcctacctccgcccgcgcccccgccaaccccgaaccgaactccgaactctaaactctcctactcgcgaaacctaacccgcccccgaccccgcccccgcccccgccccg

SEQ ID NO: 3443 - DNA, 658 bp, Artificial Sequence
  chemically treated genomic DNA (Homo sapiens) CpG-island No: 3443
tttgggtgttatttatttcggtttagggggttttcgtcgatttgggtcgacgttattagttttagatatagagtttagagttttatagatattacggcgagcgttagtagtagtcggaagcgttttcgtagtagttttatcgggcgtaggagtagcgggggtcgcgcggttcgggggttttttatggcgttgcgtcgaggcggtcgtcgttagcgcgggttttaatttttcgagtcgtcgtttttcggtcgggtttcgcgtttagggcgtttcgcgtttcggtttagcgttttagggttgcgtcgaggtcgtttttttcggtcgtttttcggcggggttcgggtttatgtttcgggcgcgaggggttttcgggttgcgcgggcgtttagtaggttttttcgggagtcgagttcggtttttttttcgcgcgtgtgtttcgcgtcgggtttttttttttacgtttttttcgtcgtaggttcgttgtcgttttttttttttgcgcgttcgtttttattcgttgtttagaaggaggttttttcggcgttcgttcgtttgttttcgttcgcgttttcgttagtttcggatcgggtttcgggttttgggtttttttgttcgcggaatttggttcgttttcggtttcgttttcgttttcgtttcg

SEQ ID NO: 3444 - DNA, 658 bp, Artificial Sequence
  chemically treated genomic DNA (Homo sapiens) CpG-island No: 3444
cgaaacgaaaacgaaaacgaaaccgaaaacgaaccaaattccgcgaacaaaaaaacccaaaacccgaaacccgatccgaaactaacgaaaacgcgaacgaaaacaaacgaacgaacgccgaaaaaacctccttctaaacaacgaataaaaacgaacgcgcaaaaaaaaaaaacgacaacgaacctacgacgaaaaaaacgtaaaaaaaaaaacccgacgcgaaacacacgcgcgaaaaaaaaaccgaactcgactcccgaaaaaacctactaaacgcccgcgcaacccgaaaacccctcgcgcccgaaacataaacccgaaccccgccgaaaaacgaccgaaaaaaacgacctcgacgcaaccctaaaacgctaaaccgaaacgcgaaacgccctaaacgcgaaacccgaccgaaaaacgacgactcgaaaaattaaaacccgcgctaacgacgaccgcctcgacgcaacgccataaaaaacccccgaaccgcgcgacccccgctactcctacgcccgataaaactactacgaaaacgcttccgactactactaacgctcgccgtaatatctataaaactctaaactctatatctaaaactaataacgtcgacccaaatcgacgaaaaccccctaaaccgaaataaataacacccaaa

SEQ ID NO: 3445 - DNA, 519 bp, Artificial Sequence
  chemically treated genomic DNA (Homo sapiens) CpG-island No: 3445
gaagggcgcgggggtgggcggcggcggcggtttttgcgttggggggattcgttttttattttatttttagattcgattttttatttattttttttttaggtgttcggcgtcgtttcgcgcgtattcggggagagttgcgggcgggggaagtcgcggggtcgagcgtagaattttcgagttcgggtttgttcgtcggttacgtgggttcggggtattttgggggtttttcgcgttttttttcggagagcgattcggagagaggtttttcgttcgtttcgtcgagacgttggcggagatcgggtttttttagtcgtttcgggtttgcggttttcggggaggaggttcgtggggtttacgcgcgagttagggattcgggtgcgggatgttttcggtcgtttatatttaggcgcgcgttttagttcgcgtagtttaaattttgtttatcgttttttgtttggtttatttcgtttttttttttgttgtattttttaggggggtttttttttattatatttcgga

SEQ ID NO: 3446 - DNA, 519 bp, Artificial Sequence
  chemically treated genomic DNA (Homo sapiens) CpG-island No: 3446
tccgaaatataataaaaaaaaacccccctaaaaaatacaacaaaaaaaaaaacgaaataaaccaaacaaaaaacgataaacaaaatttaaactacgcgaactaaaacgcgcgcctaaatataaacgaccgaaaacatcccgcacccgaatccctaactcgcgcgtaaaccccacgaacctcctccccgaaaaccgcaaacccgaaacgactaaaaaaacccgatctccgccaacgtctcgacgaaacgaacgaaaaacctctctccgaatcgctctccgaaaaaaaacgcgaaaaacccccaaaataccccgaacccacgtaaccgacgaacaaacccgaactcgaaaattctacgctcgaccccgcgacttcccccgcccgcaactctccccgaatacgcgcgaaacgacgccgaacacctaaaaaaaaaataaataaaaaatcgaatctaaaaataaaataaaaaacgaatccccccaacgcaaaaaccgccgccgccgcccacccccgcgcccttc

SEQ ID NO: 3447 - DNA, 519 bp, Artificial Sequence
  chemically treated genomic DNA (Homo sapiens) CpG-island No: 3447
ttcgaggtatggtaaaaaagaatttttttagaagatgtagtaggagaggaaacggagtgagttaaatagaaggcggtgggtaaagtttgggttgcgcggattggagcgcgcgtttgggtgtggacggtcgagggtatttcgtattcgaatttttagttcgcgcgtggattttacggatttttttttcgggaatcgtaagttcggagcggttggaggggttcggttttcgttagcgtttcggcgggacgggcggggagttttttttcgggtcgtttttcgaggggagacgcgaggagtttttagggtgtttcggatttacgtggtcggcgggtaggttcgggttcgggaattttgcgttcggtttcgcggtttttttcgttcgtagtttttttcgagtacgcgcggggcgacgtcgggtatttgagggagaaatgggtgggaaatcgggtttgaggatgggatgagaggcgggtttttttaacgtaggagtcgtcgtcgtcgtttattttcgcgtttttt

SEQ ID NO: 3448 - DNA, 519 bp, Artificial Sequence
  chemically treated genomic DNA (Homo sapiens) CpG-island No: 3448
aaaaaacgcgaaaataaacgacgacgacgactcctacgttaaaaaaacccgcctctcatcccatcctcaaacccgatttcccacccatttctccctcaaatacccgacgtcgccccgcgcgtactcgaaaaaaactacgaacgaaaaaaaccgcgaaaccgaacgcaaaattcccgaacccgaacctacccgccgaccacgtaaatccgaaacaccctaaaaactcctcgcgtctcccctcgaaaaacgacccgaaaaaaaactccccgcccgtcccgccgaaacgctaacgaaaaccgaacccctccaaccgctccgaacttacgattcccgaaaaaaaaatccgtaaaatccacgcgcgaactaaaaattcgaatacgaaataccctcgaccgtccacacccaaacgcgcgctccaatccgcgcaacccaaactttacccaccgccttctatttaactcactccgtttcctctcctactacatcttctaaaaaaattcttttttaccatacctcgaa

SEQ ID NO: 3449 - DNA, 654 bp, Artificial Sequence
  chemically treated genomic DNA (Homo sapiens) CpG-island No: 3449
ggaagttttgggtttttcgtttatagtcgtcggaagtggtttcgtggtttcgtttttaggtttcgggtttttttttaggcgtttgcgttaagtcgcgagttaggtttaatcgttgcgttatcgggattcgagttttcgcgatgttttgggggtcgtgtttattattaaatgttaataaagttcgcgtttgtgtcgtcgaggtttttttgtgcgtcgattggggtttcggtaggtcggggtagtgtttttacggatatttttaaaagaggtcgttgttttacgagggaaatttaggttttgtttgatatttagcgatagagacggaaggggtcgcggcggttcgcgggtttgggttgcgcggtttaggtttaagtttttagtacgcgtattgggatcgtagcgttgtcggtagttcgatttcgcgttttgtaaatcgtgtcgcggttttttagagagggttattcgtttttatttgggttagttttttttagtagttattgtgtggtcggttcggggttagcgtcgttcgggtatttcgcggggcgggagggagcggttgagttaggttggtagtagcgcggtcgttggaaattgaggttttatgcggggattcggatagagcgggggtttcgttttagaaagatttattggcgt

SEQ ID NO: 3450 - DNA, 654 bp, Artificial Sequence
  chemically treated genomic DNA (Homo sapiens) CpG-island No: 3450
acgccaataaatctttctaaaacgaaacccccgctctatccgaatccccgcataaaacctcaatttccaacgaccgcgctactaccaacctaactcaaccgctccctcccgccccgcgaaatacccgaacgacgctaaccccgaaccgaccacacaataactactaaaaaaaactaacccaaataaaaacgaataaccctctctaaaaaaccgcgacacgatttacaaaacgcgaaatcgaactaccgacaacgctacgatcccaatacgcgtactaaaaacttaaacctaaaccgcgcaacccaaacccgcgaaccgccgcgaccccttccgtctctatcgctaaatatcaaacaaaacctaaatttccctcgtaaaacaacgacctcttttaaaaatatccgtaaaaacactaccccgacctaccgaaaccccaatcgacgcacaaaaaaacctcgacgacacaaacgcgaactttattaacatttaataataaacacgacccccaaaacatcgcgaaaactcgaatcccgataacgcaacgattaaacctaactcgcgacttaacgcaaacgcctaaaaaaaaacccgaaacctaaaaacgaaaccacgaaaccacttccgacgactataaacgaaaaacccaaaacttcc

SEQ ID NO: 3451 - DNA, 654 bp, Artificial Sequence
  chemically treated genomic DNA (Homo sapiens) CpG-island No: 3451
gcgttaataaatttttttggaacggagttttcgttttgttcgggttttcgtatgaagttttagtttttagcgatcgcgttgttgttagtttggtttagtcgttttttttcgtttcgcgaggtattcgggcggcgttggtttcgggtcggttatatagtagttgttggaaagggttgatttaaataggagcgagtgattttttttggggggtcgcggtacggtttgtagagcgcgggatcgggttgtcggtagcgttgcggttttaatgcgcgtgttggggatttggatttgggtcgcgtagtttaggttcgcgagtcgtcgcgatttttttcgtttttgtcgttggatgttaggtagagtttaagtttttttcgtaagatagcggttttttttgaaagtattcgtgagagtattatttcggtttgtcggagttttagtcgacgtatagaaaagtttcggcggtatagacgcgggttttattaatatttggtagtgagtacggtttttagggtatcgcgggggttcgggtttcggtgacgtaacggttaaatttggttcgcgatttagcgtaggcgtttgggggaaagttcggagtttgagggcggggttacggagttattttcggcggttgtgggcggaaaatttaaaattttt

SEQ ID NO: 3452 - DNA, 654 bp, Artificial Sequence
  chemically treated genomic DNA (Homo sapiens) CpG-island No: 3452
aaaaattttaaattttccgcccacaaccgccgaaaataactccgtaaccccgccctcaaactccgaactttcccccaaacgcctacgctaaatcgcgaaccaaatttaaccgttacgtcaccgaaacccgaacccccgcgataccctaaaaaccgtactcactaccaaatattaataaaacccgcgtctataccgccgaaacttttctatacgtcgactaaaactccgacaaaccgaaataatactctcacgaatactttcaaaaaaaaccgctatcttacgaaaaaaacttaaactctacctaacatccaacgacaaaaacgaaaaaaatcgcgacgactcgcgaacctaaactacgcgacccaaatccaaatccccaacacgcgcattaaaaccgcaacgctaccgacaacccgatcccgcgctctacaaaccgtaccgcgaccccccaaaaaaaatcactcgctcctatttaaatcaaccctttccaacaactactatataaccgacccgaaaccaacgccgcccgaatacctcgcgaaacgaaaaaaaacgactaaaccaaactaacaacaacgcgatcgctaaaaactaaaacttcatacgaaaacccgaacaaaacgaaaactccgttccaaaaaaatttattaacgc

SEQ ID NO: 3453 - DNA, 1000 bp, Artificial Sequence
  chemically treated genomic DNA (Homo sapiens) CpG-island No: 3453
tcggggatttaagttttcggggcgtcgttagattgggatgagggtggcgttacgggtaggcgaggttggggtgggggtttttagcgtttggtcgagtttgattgaaagagtttcgggatttgggcggagtaggggttcgcgcgtttatttcgttttatttgatgaatttattttcgcgtcgtagggtttttattacggtgggcggttttaattgtagcgcgtggacgtcgggttgggcgttcgttatggttcggttaggggcgggtcggggatttacggagttttgacggggatcgacggcgtcgttgtttttatcgcgcggttcgtttcggtttcgcggcgttagtgttcgttcgttcgttattttgtttcggatcgattatattttttgcggggttcgggcggggcggggatcgggttttttttttttttttttcgcggttgttttttcgtttttttttttttttgttttttttttttttttcgtgttttttcgttttttttttttgtttcggtttcgcgggcgttttttgtttttcgttcgtggttgtttgtttttgttgtgagtggtggtttttcggtttttcggtttcggcgtgtggtgggttgtttttttgcgttgtttttttcgttcgggttgttttttttgtgttttttttttttttcggtgcggcgtcgggtcggtcgttgttgttttcgtttttgttttcggtgggttcgcgtgtgcggttattttgcgggtttttcggtttcggttcgtttgttttcgtcgtgtgcgtcgtttcgttgcgtgtgcgtttgtgtttcgtttggttcgtttttttcgttttttgtgtttttttcgcgtaatttgagtttcggttcgttttgttttttgtgttttcgtggatttttttcgtggtttcgattacgttatgcgtttttgtcggtttcgttttttttttgtttttcgttttttcggcgtttttcgtttattcgttgcggatttttattttagttt

SEQ ID NO: 3454 - DNA, 1000 bp, Artificial Sequence
  chemically treated genomic DNA (Homo sapiens) CpG-island No: 3454
aaactaaaataaaaatccgcaacgaataaacgaaaaacgccgaaaaaacgaaaaacaaaaaaaaaacgaaaccgacaaaaacgcataacgtaatcgaaaccacgaaaaaaatccacgaaaacacaaaaaacaaaacgaaccgaaactcaaattacgcgaaaaaaacacaaaaaacgaaaaaaacgaaccaaacgaaacacaaacgcacacgcaacgaaacgacgcacacgacgaaaacaaacgaaccgaaaccgaaaaacccgcaaaataaccgcacacgcgaacccaccgaaaacaaaaacgaaaacaacaacgaccgacccgacgccgcaccgaaaaaaaaaaaaaacacaaaaaaaacaacccgaacgaaaaaaacaacgcaaaaaaacaacccaccacacgccgaaaccgaaaaaccgaaaaaccaccactcacaacaaaaacaaacaaccacgaacgaaaaacaaaaaacgcccgcgaaaccgaaacaaaaaaaaaaaacgaaaaaacacgaaaaaaaaaaaaaaaacaaaaaaaaaaaaaaacgaaaaaacaaccgcgaaaaaaaaaaaaaaaaaacccgatccccgccccgcccgaaccccgcaaaaaatataatcgatccgaaacaaaataacgaacgaacgaacactaacgccgcgaaaccgaaacgaaccgcgcgataaaaacaacgacgccgtcgatccccgtcaaaactccgtaaatccccgacccgcccctaaccgaaccataacgaacgcccaacccgacgtccacgcgctacaattaaaaccgcccaccgtaataaaaaccctacgacgcgaaaataaattcatcaaataaaacgaaataaacgcgcgaacccctactccgcccaaatcccgaaactctttcaatcaaactcgaccaaacgctaaaaacccccaccccaacctcgcctacccgtaacgccaccctcatcccaatctaacgacgccccgaaaacttaaatccccga

SEQ ID NO: 3455 - DNA, 1000 bp, Artificial Sequence
  chemically treated genomic DNA (Homo sapiens) CpG-island No: 3455
agattgagatgaaaattcgtaacgagtgagcgaggaacgtcggggaagcgggagatagaaagggagcgggatcgataagggcgtatgacgtggtcggggttacggagaaaatttacgagggtatagagagtagggcggatcgaggtttaaattacgcgaaaggggtataggaggcgaggggagcggattaggcggggtataggcgtatacgtaacgaggcgacgtatacgacgagggtaagcggatcgggatcgggaagttcgtagagtaatcgtatacgcgagtttatcgggagtaggaacggagataataacgatcggttcggcgtcgtatcggaaaggaaaggaaatataaagagggtaattcgggcggaaagggtagcgtaagagggtagtttattatacgtcggaatcggaaggtcgagggattattatttataatagagatagatagttacggacggggagtagagggcgttcgcgggatcggaatagggagagagaacgggaagatacgggggggggggggaaagtaagaagagggggagacggggaagtaatcgcggggaagaaagaagagaagttcggttttcgtttcgttcgggtttcgtagaggatatggtcggttcgggatagaatggcgggcgggcgggtattgacgtcgcggggtcggagcgggtcgcgcggtgggagtagcggcgtcgtcggttttcgttagggtttcgtgggttttcgattcgtttttggtcgggttatggcgggcgtttagttcggcgtttacgcgttgtagttggagtcgtttatcgtggtggagattttgcggcgcgggagtaagtttattaaatgggacgaggtaagcgcgcgggtttttgtttcgtttaaatttcgggatttttttagttaagttcgattagacgttggggatttttattttagtttcgtttgttcgtggcgttatttttattttagtttggcggcgtttcggaaatttaagttttcga

SEQ ID NO: 3456 - DNA, 1000 bp, Artificial Sequence
  chemically treated genomic DNA (Homo sapiens) CpG-island No: 3456
tcgaaaacttaaatttccgaaacgccgccaaactaaaataaaaataacgccacgaacaaacgaaactaaaataaaaatccccaacgtctaatcgaacttaactaaaaaaatcccgaaatttaaacgaaacaaaaacccgcgcgcttacctcgtcccatttaataaacttactcccgcgccgcaaaatctccaccacgataaacgactccaactacaacgcgtaaacgccgaactaaacgcccgccataacccgaccaaaaacgaatcgaaaacccacgaaaccctaacgaaaaccgacgacgccgctactcccaccgcgcgacccgctccgaccccgcgacgtcaatacccgcccgcccgccattctatcccgaaccgaccatatcctctacgaaacccgaacgaaacgaaaaccgaacttctcttctttcttccccgcgattacttccccgtctccccctcttcttactttcccccccccccccgtatcttcccgttctctctccctattccgatcccgcgaacgccctctactccccgtccgtaactatctatctctattataaataataatccctcgaccttccgattccgacgtataataaactaccctcttacgctaccctttccgcccgaattaccctctttatatttcctttcctttccgatacgacgccgaaccgatcgttattatctccgttcctactcccgataaactcgcgtatacgattactctacgaacttcccgatcccgatccgcttaccctcgtcgtatacgtcgcctcgttacgtatacgcctataccccgcctaatccgctcccctcgcctcctatacccctttcgcgtaatttaaacctcgatccgccctactctctataccctcgtaaattttctccgtaaccccgaccacgtcatacgcccttatcgatcccgctccctttctatctcccgcttccccgacgttcctcgctcactcgttacgaattttcatctcaatct

SEQ ID NO: 3457 - DNA, 636 bp, Artificial Sequence
  chemically treated genomic DNA (Homo sapiens) CpG-island No: 3457
  misc_feature (556)..(556): n is either a, c, g or t
tatcgagcgggattttatagatggggggcgtcgcgaagtgattgtagaatataaagagatatggcgtacgttttaaaatcggttttttttagaggatagcggggggtgggttcgttcgtgcgtatgtaaagtagggggcggggttcggggtcgtatggtaattagattagcggggcgggcggcgtttgcgcgttcggacgagtcggggcggagtcggtagcgttagtgggcgggttttggtgtaggtttcgtttcgtagttcgtcgagttaatgcggcgaatatgcgtacgcggtttttgggaggggcgggatcggagatacggagggcggggataatagagtcgagagtaagtggggttagaagcgttttttcgtaacggaggaggcggggtttgttgcgcgcgagaggagtgggcgaggcggtgtaggttgtagtcgcggagttaagagattatttatagatgaaaacgtaagggcgggacgagcggagaggttggatttgttatttatgtttgaggggcggagtttagcgcgtcgtcgcgaggagggaggtgntgtttcgttttttttattttttttttttaaagcgatattaattgagtattcgaatcgtagatttagtagttttatagagt

SEQ ID NO: 3458 - DNA, 636 bp, Artificial Sequence
  chemically treated genomic DNA (Homo sapiens) CpG-island No: 3458
  misc_feature (81)..(81): n is either a, c, g or t
actctataaaactactaaatctacgattcgaatactcaattaatatcgctttaaaaaaaaaaaataaaaaaaacgaaacancacctccctcctcgcgacgacgcgctaaactccgcccctcaaacataaataacaaatccaacctctccgctcgtcccgcccttacgttttcatctataaataatctcttaactccgcgactacaacctacaccgcctcgcccactcctctcgcgcgcaacaaaccccgcctcctccgttacgaaaaaacgcttctaaccccacttactctcgactctattatccccgccctccgtatctccgatcccgcccctcccaaaaaccgcgtacgcatattcgccgcattaactcgacgaactacgaaacgaaacctacaccaaaacccgcccactaacgctaccgactccgccccgactcgtccgaacgcgcaaacgccgcccgccccgctaatctaattaccatacgaccccgaaccccgccccctactttacatacgcacgaacgaacccaccccccgctatcctctaaaaaaaaccgattttaaaacgtacgccatatctctttatattctacaatcacttcgcgacgccccccatctataaaatcccgctcgata

SEQ ID NO: 3459 - DNA, 636 bp, Artificial Sequence
  chemically treated genomic DNA (Homo sapiens) CpG-island No: 3459
  misc_feature (81)..(81): n is either a, c, g or t
gttttgtggggttattgggtttacggttcgagtgtttagttggtgtcgttttgggggaagggggtagggggaacggggtantattttttttttcgcgacggcgcgttaggtttcgttttttaagtataggtagtaggtttagttttttcgttcgtttcgtttttgcgtttttatttgtaagtggttttttggtttcgcgattgtagtttgtatcgtttcgtttatttttttcgcgcgtagtaagtttcgtttttttcgttacgaaagaacgtttttggttttatttgttttcggttttattgttttcgtttttcgtgttttcggtttcgttttttttaagggtcgcgtacgtatgttcgtcgtattggttcggcgggttgcggggcgggatttgtattaaagttcgtttattggcgttgtcggtttcgtttcgattcgttcgggcgcgtaggcgtcgttcgtttcgttggtttgattattatacgatttcgggtttcgttttttgttttgtatgcgtacggacgggtttatttttcgttgttttttggaggaaatcgattttgaagcgtgcgttatatttttttgtgttttataattatttcgcggcgttttttatttatgggatttcgttcggtg

SEQ ID NO: 3460 - DNA, 636 bp, Artificial Sequence
  chemically treated genomic DNA (Homo sapiens) CpG-island No: 3460
  misc_feature (556)..(556): n is either a, c, g or t
caccgaacgaaatcccataaataaaaaacgccgcgaaataattataaaacacaaaaaaatataacgcacgcttcaaaatcgatttcctccaaaaaacaacgaaaaataaacccgtccgtacgcatacaaaacaaaaaacgaaacccgaaatcgtataataatcaaaccaacgaaacgaacgacgcctacgcgcccgaacgaatcgaaacgaaaccgacaacgccaataaacgaactttaatacaaatcccgccccgcaacccgccgaaccaatacgacgaacatacgtacgcgacccttaaaaaaaacgaaaccgaaaacacgaaaaacgaaaacaataaaaccgaaaacaaataaaaccaaaaacgttctttcgtaacgaaaaaaacgaaacttactacgcgcgaaaaaaataaacgaaacgatacaaactacaatcgcgaaaccaaaaaaccacttacaaataaaaacgcaaaaacgaaacgaacgaaaaaactaaacctactacctatacttaaaaaacgaaacctaacgcgccgtcgcgaaaaaaaaaatantaccccgttccccctacccccttcccccaaaacgacaccaactaaacactcgaaccgtaaacccaataaccccacaaaac

SEQ ID NO: 3461 - DNA, 1081 bp, Artificial Sequence
  chemically treated genomic DNA (Homo sapiens) CpG-island No: 3461
ggttcggaggcgttcgaagggaaattcggaggagaggtcggatagcgtaaggcggggataggggaatggtgggtttttgttcgttcgttgcggttgtgatagtattttcgcggttttttcgttttttttcgtttcgttttgttttttggttggttttttagggtgttttcgcgtttcgtcgggttttcgaggaatttaggggcgggtttcggtcgtcgtatttaggcgaggaggggtgttggggacgtttagttttcggaaaaagcggggcgggggttcgtaaaggttatatcggggcggtagttttcgagatagttgttagttcgagatagcgggcggcggcgtttacgcgtatatacgtttcggtacgcgtcgttaagcgcgggtataaagattcgcgcgtttacgttttatttcgaggttgtagcgtcgcgtcgtttcgttgtacgtacgtattttatttgtatttttcgtagacgtttcggtattttcggtttttatgggcgtgtcggtcgcgttagggtatttagagtttacgtatacgtgtgtggatattagcgtgtatacgttagatagtagggttatcgcgtagcgttcgtagttcgtttttatcgtttttttcgcgttcgtatagcgacgtttcggagcgtggcgggcggcgggatcggcggttatattattttcggaggcgtttacgcgcgagaggtgggtatttcgttcggttagtcgtttttggggcgtttttgtttttgagttttgttcgcgtatcggagttcgtatcgtatttattgtcggtttcgttgcggttgcggttgaggttcgggttttagtacggtttcgtcggtgtcgattgggtcgcggaggcggtaggggcggaacgggcggtcgtcggggttgggatttttttttcgtcggtagaagttttttttttttcgcggttaattttttcggcgtcgcgttttttttcgtgtagcgttttcgtcgtcggcgtcgttttaagtcgtttatttgcggtcgtttggttttttatagtcggttagtttcgggaggtgggtggtagaggagtcggagaggggttgta

SEQ ID NO: 3462 - DNA, 1081 bp, Artificial Sequence
  chemically treated genomic DNA (Homo sapiens) CpG-island No: 3462
tacaacccctctccgactcctctaccacccacctcccgaaactaaccgactataaaaaaccaaacgaccgcaaataaacgacttaaaacgacgccgacgacgaaaacgctacacgaaaaaaaacgcgacgccgaaaaaattaaccgcgaaaaaaaaaaaacttctaccgacgaaaaaaaaatcccaaccccgacgaccgcccgttccgcccctaccgcctccgcgacccaatcgacaccgacgaaaccgtactaaaacccgaacctcaaccgcaaccgcaacgaaaccgacaataaatacgatacgaactccgatacgcgaacaaaactcaaaaacaaaaacgccccaaaaacgactaaccgaacgaaatacccacctctcgcgcgtaaacgcctccgaaaataatataaccgccgatcccgccgcccgccacgctccgaaacgtcgctatacgaacgcgaaaaaaacgataaaaacgaactacgaacgctacgcgataaccctactatctaacgtatacacgctaatatccacacacgtatacgtaaactctaaataccctaacgcgaccgacacgcccataaaaaccgaaaataccgaaacgtctacgaaaaatacaaataaaatacgtacgtacaacgaaacgacgcgacgctacaacctcgaaataaaacgtaaacgcgcgaatctttatacccgcgcttaacgacgcgtaccgaaacgtatatacgcgtaaacgccgccgcccgctatctcgaactaacaactatctcgaaaactaccgccccgatataacctttacgaacccccgccccgctttttccgaaaactaaacgtccccaacacccctcctcgcctaaatacgacgaccgaaacccgcccctaaattcctcgaaaacccgacgaaacgcgaaaacaccctaaaaaaccaaccaaaaaacaaaacgaaacgaaaaaaaacgaaaaaaccgcgaaaatactatcacaaccgcaacgaacgaacaaaaacccaccattcccctatccccgccttacgctatccgacctctcctccgaatttcccttcgaacgcctccgaacc

SEQ ID NO: 3463 - DNA, 1081 bp, Artificial Sequence
  chemically treated genomic DNA (Homo sapiens) CpG-island No: 3463
tgtaattttttttcggtttttttgttatttatttttcggggttggtcggttgtggggagttaggcggtcgtaggtaaacggtttggggcggcgtcggcggcgagggcgttgtacggagggaagcgcggcgtcggaggggttaatcgcgggaggaggggggtttttgtcggcgggaggggggttttagtttcggcggtcgttcgtttcgtttttgtcgttttcgcggtttagtcggtatcggcgaggtcgtgttggaattcgggttttagtcgtagtcgtagcggggtcgatagtaagtgcggtgcgggtttcggtgcgcgggtaggatttaggggtagggacgttttaggggcgattggtcgggcggggtgtttatttttcgcgcgtgggcgttttcgggagtggtgtggtcgtcggtttcgtcgttcgttacgtttcgaggcgtcgttgtgcggacgcgggggaggcggtgggagcgagttgcgggcgttgcgcggtggttttgttgtttggcgtgtgtacgttagtgtttatatacgtgtgcgtgggttttgggtgttttggcgcggtcggtacgtttatgggggtcggggatgtcggggcgtttgcggagagtgtaggtggggtgcgtgcgtgtagcggggcggcgcggcgttgtagtttcgggatggagcgtgggcgcgcgggtttttgtgttcgcgtttggcggcgcgtgtcggggcgtgtgtgcgcgtgggcgtcgtcgttcgttgtttcggattgatagttgtttcgggggttgtcgtttcggtgtggtttttgcggattttcgtttcgtttttttcgggaattgggcgtttttagtattttttttcgtttgggtgcggcggtcgggattcgtttttgggtttttcgaaagttcggcggggcgcgggggtattttggagggttagttaggaagtagggcgaggcgagaggggacggagaagtcgcggagatgttgttatagtcgtagcgggcgagtagggatttattatttttttgttttcgttttgcgttgttcggtttttttttcgggttttttttcggacgttttcgagtt

SEQ ID NO: 3464 - DNA, 1081 bp, Artificial Sequence
  chemically treated genomic DNA (Homo sapiens) CpG-island No: 3464
aactcgaaaacgtccgaaaaaaaacccgaaaaaaaaaccgaacaacgcaaaacgaaaacaaaaaaataataaatccctactcgcccgctacgactataacaacatctccgcgacttctccgtcccctctcgcctcgccctacttcctaactaaccctccaaaatacccccgcgccccgccgaactttcgaaaaacccaaaaacgaatcccgaccgccgcacccaaacgaaaaaaaatactaaaaacgcccaattcccgaaaaaaacgaaacgaaaatccgcaaaaaccacaccgaaacgacaacccccgaaacaactatcaatccgaaacaacgaacgacgacgcccacgcgcacacacgccccgacacgcgccgccaaacgcgaacacaaaaacccgcgcgcccacgctccatcccgaaactacaacgccgcgccgccccgctacacgcacgcaccccacctacactctccgcaaacgccccgacatccccgacccccataaacgtaccgaccgcgccaaaacacccaaaacccacgcacacgtatataaacactaacgtacacacgccaaacaacaaaaccaccgcgcaacgcccgcaactcgctcccaccgcctcccccgcgtccgcacaacgacgcctcgaaacgtaacgaacgacgaaaccgacgaccacaccactcccgaaaacgcccacgcgcgaaaaataaacaccccgcccgaccaatcgcccctaaaacgtccctacccctaaatcctacccgcgcaccgaaacccgcaccgcacttactatcgaccccgctacgactacgactaaaacccgaattccaacacgacctcgccgataccgactaaaccgcgaaaacgacaaaaacgaaacgaacgaccgccgaaactaaaacccccctcccgccgacaaaaacccccctcctcccgcgattaacccctccgacgccgcgcttccctccgtacaacgccctcgccgccgacgccgccccaaaccgtttacctacgaccgcctaactccccacaaccgaccaaccccgaaaaataaataacaaaaaaaccgaaaaaaaattaca

SEQ ID NO: 3465 - DNA, 589 bp, Artificial Sequence
  chemically treated genomic DNA (Homo sapiens) CpG-island No: 3465
cggttttcgttgtttcgttttttttttcgttcgcgtttgcgcgggcgtcgttcgttacgtaaattgcgtagcggttcggttggattcgtagtttagcgtcgtattcggcgtgaaatcgtacgagaattggcgcgagttgcgtcgttggcgggcgttcggggttacgggaggcggtaggcgggcggtcgagttgcgggggtcgtgtcgtatttagggggttttcgggtgggtcgtgtttcgtgtcgttcgtttttatttgtatgggggttcgttagtttttacgttcgttttttttatatttaaatcggggtcgtgtcgttcggtcgggggcggtaacggattttcgtttttcggtttttgaagaaaattttcgtttatagttaagatggttttcgggtttcgttttcgggtttgaattcgcggagtttcgaatttttcgcgcgggttcgtttttcgtttcggcgcgttcgcggttttgtttatttggtcggtcgtttgttaggcgtgaagtttttacgggttttacggtttttttttatcgggttttcggtttttttttcgcgttcgggtagttattttagttagggag

SEQ ID NO: 3466 - DNA, 589 bp, Artificial Sequence
  chemically treated genomic DNA (Homo sapiens) CpG-island No: 3466
ctccctaactaaaataactacccgaacgcgaaaaaaaaaccgaaaacccgataaaaaaaaaccgtaaaacccgtaaaaacttcacgcctaacaaacgaccgaccaaataaacaaaaccgcgaacgcgccgaaacgaaaaacgaacccgcgcgaaaaattcgaaactccgcgaattcaaacccgaaaacgaaacccgaaaaccatcttaactataaacgaaaattttcttcaaaaaccgaaaaacgaaaatccgttaccgcccccgaccgaacgacacgaccccgatttaaatataaaaaaaacgaacgtaaaaactaacgaacccccatacaaataaaaacgaacgacacgaaacacgacccacccgaaaaccccctaaatacgacacgacccccgcaactcgaccgcccgcctaccgcctcccgtaaccccgaacgcccgccaacgacgcaactcgcgccaattctcgtacgatttcacgccgaatacgacgctaaactacgaatccaaccgaaccgctacgcaatttacgtaacgaacgacgcccgcgcaaacgcgaacgaaaaaaaaaacgaaacaacgaaaaccg

SEQ ID NO: 3467 - DNA, 589 bp, Artificial Sequence
  chemically treated genomic DNA (Homo sapiens) CpG-island No: 3467
ttttttggttgggatggttgttcgggcgcgggaggagggtcggggattcggtgagggaggatcgtagggttcgtgggggttttacgtttggtaggcggtcggttaggtgagtagggtcgcgggcgcgtcggggcgaggggcgggttcgcgcgggggattcggggtttcgcgggtttaggttcgggggcggggttcgggggttattttggttatgggcggaagttttttttagagatcgagggacgggaattcgttgtcgttttcggtcgggcggtacgatttcgatttgggtataggagagacgagcgtgggaattggcggatttttatataagtaaaggcgggcggtacggggtacggtttattcggggattttttggatgcggtacggttttcgtaattcggtcgttcgtttgtcgtttttcgtaatttcgggcgttcgttagcggcgtagttcgcgttaattttcgtacggttttacgtcgggtgcggcgttggattgcggatttagtcgggtcgttgcgtaatttgcgtagcgaacggcgttcgcgtaggcgcggacggggaagggggcggagtagcgggagtcg

SEQ ID NO: 3468 - DNA, 589 bp, Artificial Sequence
  chemically treated genomic DNA (Homo sapiens) CpG-island No: 3468
cgactcccgctactccgcccccttccccgtccgcgcctacgcgaacgccgttcgctacgcaaattacgcaacgacccgactaaatccgcaatccaacgccgcacccgacgtaaaaccgtacgaaaattaacgcgaactacgccgctaacgaacgcccgaaattacgaaaaacgacaaacgaacgaccgaattacgaaaaccgtaccgcatccaaaaaatccccgaataaaccgtaccccgtaccgcccgcctttacttatataaaaatccgccaattcccacgctcgtctctcctatacccaaatcgaaatcgtaccgcccgaccgaaaacgacaacgaattcccgtccctcgatctctaaaaaaaacttccgcccataaccaaaataacccccgaaccccgcccccgaacctaaacccgcgaaaccccgaatcccccgcgcgaacccgcccctcgccccgacgcgcccgcgaccctactcacctaaccgaccgcctaccaaacgtaaaacccccacgaaccctacgatcctccctcaccgaatccccgaccctcctcccgcgcccgaacaaccatcccaaccaaaaaa

SEQ ID NO: 3469 - DNA, 940 bp, Artificial Sequence
  chemically treated genomic DNA (Homo sapiens) CpG-island No: 3469
ggcgtttttaagttcggttattacggagattattttcgcgaggacgttcggggttattattcgggttaggttttttatttggttttttggtatcgtttttcggaggacgcggtatcgttttcgggtttgtagtttcgttttcgatagaattagatttttttttcggagtcgtagttacgttatttatcggttgaagtttcgtttttagcgttttcgtttcgtttttttttgttttcgatttcgaggtttcgttttttattttttttagttttttttttaagagttaggtttcgtttttcgatttttttagtttcgtttttcgtcgtcgggtttcgttttttattggtattagttcggaggttttattcgtttcggttttacgtttcgtttcgagttttaggatttcgtttcgtgcggcgtgagaattttttttttgcggtattttcggatagtttcggtttttatttttaattttttcgttatttagttttcgttgatattcggagttcggttcgtttttgttcggtttgatttagtttgtttttttgtatttcggttttttttagttcgggttgtggttttcgtttattttttcgtcgcgttttcggagttaatttcggtggtgttgtcgtttttgcgtaggcgcgttttcgtcgttattaggtcgggttacgtcgtttttttttattggatcgtgcgaaattcgcggttatacgttcgttggtacgggtttttttcgagtttcgttttcgcgacgtcgttgttttgcgttattttcggcggagcggtagtttgtaaggttaggtgaaagtgattttcgaaaaggtcggagatattttcggtcgaggtgatagtaaggttaggcgggcgtgggttttcggagggggttttgaggcgttattttaagtcgtttttagttttttttatagtatttttgttt

SEQ ID NO: 3470 - DNA, 940 bp, Artificial Sequence
  chemically treated genomic DNA (Homo sapiens) CpG-island No: 3470
aaacaaaaatactataaaaaaaactaaaaacgacttaaaataacgcctcaaaaccccctccgaaaacccacgcccgcctaaccttactatcacctcgaccgaaaatatctccgaccttttcgaaaatcactttcacctaaccttacaaactaccgctccgccgaaaataacgcaaaacaacgacgtcgcgaaaacgaaactcgaaaaaaacccgtaccaacgaacgtataaccgcgaatttcgcacgatccaataaaaaaaaacgacgtaacccgacctaataacgacgaaaacgcgcctacgcaaaaacgacaacaccaccgaaattaactccgaaaacgcgacgaaaaaataaacgaaaaccacaacccgaactaaaaaaaaccgaaatacaaaaaaacaaactaaatcaaaccgaacaaaaacgaaccgaactccgaatatcaacgaaaactaaataacgaaaaaattaaaaataaaaaccgaaactatccgaaaataccgcaaaaaaaaaattctcacgccgcacgaaacgaaatcctaaaactcgaaacgaaacgtaaaaccgaaacgaataaaacctccgaactaataccaataaaaaacgaaacccgacgacgaaaaacgaaactaaaaaaatcgaaaaacgaaacctaactcttaaaaaaaaaactaaaaaaaataaaaaacgaaacctcgaaatcgaaaacaaaaaaaaacgaaacgaaaacgctaaaaacgaaacttcaaccgataaataacgtaactacgactccgaaaaaaaaatctaattctatcgaaaacgaaactacaaacccgaaaacgataccgcgtcctccgaaaaacgataccaaaaaaccaaataaaaaacctaacccgaataataaccccgaacgtcctcgcgaaaataatctccgtaataaccgaacttaaaaacgcc

SEQ ID NO: 3471 - DNA, 940 bp, Artificial Sequence
  chemically treated genomic DNA (Homo sapiens) CpG-island No: 3471
aaataggagtgttgtgggagaggttgggggcgatttgaaatggcgttttaagatttttttcgggaatttacgttcgtttgattttattattatttcggtcggaagtgttttcggttttttcggaagttatttttatttaattttatagattatcgtttcgtcggaagtgacgtagggtagcggcgtcgcgggggcggggttcgggaaagattcgtgttagcgggcgtgtggtcgcgggtttcgtacggtttaataagggagggcggcgtggttcggtttggtagcgacgaggacgcgtttgcgtagaggcggtagtattatcggggttgatttcgggggcgcggcgaggaggtgagcgggggttatagttcgggttggggggagtcggggtgtaagagggtaggttggattaggtcgggtagaagcggatcgggtttcgagtgttaacgagagttaggtgacgaggaaattgggggtgggggtcggagttgttcggagatgtcgtagggggagggtttttacgtcgtacggggcggagttttgggattcggggcgggacgtggaatcgggacgggtgggattttcgagttggtgttagtggaaggcggagttcggcggcggggggcggagttaggagggtcgggggacggagtttggtttttgaaggaggagttggaggaggtgaaaggcggagtttcggggtcggaagtagagggggacggagcggaggcgttgggggcggggttttagtcggtgagtggcgtggttacggtttcggaaaaggggtttagttttgtcgaaggcggggttgtaggttcgggggcggtatcgcgtttttcgaagggcggtgttaaggagttaagtgaggagtttggttcgagtaatggtttcgggcgttttcgcgggggtggttttcgtggtggtcgggtttggggacgtt

SEQ ID NO: 3472 - DNA, 940 bp, Artificial Sequence
  chemically treated genomic DNA (Homo sapiens) CpG-island No: 3472
aacgtccccaaacccgaccaccacgaaaaccacccccgcgaaaacgcccgaaaccattactcgaaccaaactcctcacttaactccttaacaccgcccttcgaaaaacgcgataccgcccccgaacctacaaccccgccttcgacaaaactaaaccccttttccgaaaccgtaaccacgccactcaccgactaaaaccccgcccccaacgcctccgctccgtccccctctacttccgaccccgaaactccgcctttcacctcctccaactcctccttcaaaaaccaaactccgtcccccgaccctcctaactccgccccccgccgccgaactccgccttccactaacaccaactcgaaaatcccacccgtcccgattccacgtcccgccccgaatcccaaaactccgccccgtacgacgtaaaaaccctccccctacgacatctccgaacaactccgacccccacccccaatttcctcgtcacctaactctcgttaacactcgaaacccgatccgcttctacccgacctaatccaacctaccctcttacaccccgactccccccaacccgaactataacccccgctcacctcctcgccgcgcccccgaaatcaaccccgataatactaccgcctctacgcaaacgcgtcctcgtcgctaccaaaccgaaccacgccgccctcccttattaaaccgtacgaaacccgcgaccacacgcccgctaacacgaatctttcccgaaccccgcccccgcgacgccgctaccctacgtcacttccgacgaaacgataatctataaaattaaataaaaataacttccgaaaaaaccgaaaacacttccgaccgaaataataataaaatcaaacgaacgtaaattcccgaaaaaaatcttaaaacgccatttcaaatcgcccccaacctctcccacaacactcctattt

SEQ ID NO: 3473 - DNA, 638 bp, Artificial Sequence
  chemically treated genomic DNA (Homo sapiens) CpG-island No: 3473
cgatttcgagtttagtattcggtttattgtatagggatttcgcgttttatagttgcgttttttttgattttcgtaattcggtgcgcggttcgcggaacgtttcgatttttaggggtacggaaggtcgaggcgtgtcgggggagttaggagtagttggttggcgggcgtcgcgggttttttcggttacgtgatatttcggataacgtgcgtcgttacgtgacggtagagtttgtgagcgttttttttacgtgacggaggcgtttgtacgtggattaatggggaggcgggggcggggtcggtaggggcggtgcgcgggaagggatttcggattcggaggtcgcggagagttgggtagtgttggtcgttggcggagcgttggggtagtatgaagtgtttggttacgggcggtaacgtgaagggtgagtgtaggtcggtttggtagcggcggtgtagtagtcgcggagtcgttagtttaattttttttcgttttttttttcgtagtgttcggtaaggtcgtttattttttgtttcgtatcggggacgagttttatttggaatttttggaggacggggtgaggggttacggtgtggggggcgggtgggattttattcgggatcgggttattcgggattagatt

SEQ ID NO: 3474 - DNA, 638 bp, Artificial Sequence
  chemically treated genomic DNA (Homo sapiens) CpG-island No: 3474
aatctaatcccgaataacccgatcccgaataaaatcccacccgccccccacaccgtaacccctcaccccgtcctccaaaaattccaaataaaactcgtccccgatacgaaacaaaaaataaacgaccttaccgaacactacgaaaaaaaaaacgaaaaaaaattaaactaacgactccgcgactactacaccgccgctaccaaaccgacctacactcacccttcacgttaccgcccgtaaccaaacacttcatactaccccaacgctccgccaacgaccaacactacccaactctccgcgacctccgaatccgaaatcccttcccgcgcaccgcccctaccgaccccgcccccgcctccccattaatccacgtacaaacgcctccgtcacgtaaaaaaaacgctcacaaactctaccgtcacgtaacgacgcacgttatccgaaatatcacgtaaccgaaaaaacccgcgacgcccgccaaccaactactcctaactcccccgacacgcctcgaccttccgtacccctaaaaatcgaaacgttccgcgaaccgcgcaccgaattacgaaaatcaaaaaaaacgcaactataaaacgcgaaatccctatacaataaaccgaatactaaactcgaaatcg

SEQ ID NO: 3475 - DNA, 638 bp, Artificial Sequence
  chemically treated genomic DNA (Homo sapiens) CpG-island No: 3475
agtttagtttcgggtgattcggtttcgggtggagttttattcgttttttatatcgtagttttttatttcgttttttaagggttttaggtagagttcgttttcgatgcgggatagggagtggacggttttgtcgagtattgcggggagaagagcggaagggggttaggttggcggtttcgcggttgttgtatcgtcgttgttaggtcgatttgtatttattttttacgttgtcgttcgtgattaggtattttatgttgttttagcgtttcgttagcggttaatattgtttagtttttcgcgattttcgggttcggggttttttttcgcgtatcgtttttgtcggtttcgttttcgtttttttattggtttacgtgtaggcgttttcgttacgtgagaaaaacgtttataggttttgtcgttacgtgacggcgtacgttgttcggggtgttacgtgatcggggaggttcgcggcgttcgttagttagttgtttttggttttttcggtacgtttcggtttttcgtgtttttggagatcggggcgtttcgcgggtcgcgtatcggattgcgaaggttagagaggacgtagttgtggggcgcgaggtttttgtgtagtggatcgagtgttggattcggagtcg

SEQ ID NO: 3476 - DNA, 638 bp, Artificial Sequence
  chemically treated genomic DNA (Homo sapiens) CpG-island No: 3476
cgactccgaatccaacactcgatccactacacaaaaacctcgcgccccacaactacgtcctctctaaccttcgcaatccgatacgcgacccgcgaaacgccccgatctccaaaaacacgaaaaaccgaaacgtaccgaaaaaaccaaaaacaactaactaacgaacgccgcgaacctccccgatcacgtaacaccccgaacaacgtacgccgtcacgtaacgacaaaacctataaacgtttttctcacgtaacgaaaacgcctacacgtaaaccaataaaaaaacgaaaacgaaaccgacaaaaacgatacgcgaaaaaaaaccccgaacccgaaaatcgcgaaaaactaaacaatattaaccgctaacgaaacgctaaaacaacataaaatacctaatcacgaacgacaacgtaaaaaataaatacaaatcgacctaacaacgacgatacaacaaccgcgaaaccgccaacctaacccccttccgctcttctccccgcaatactcgacaaaaccgtccactccctatcccgcatcgaaaacgaactctacctaaaacccttaaaaaacgaaataaaaaactacgatataaaaaacgaataaaactccacccgaaaccgaatcacccgaaactaaact

SEQ ID NO: 3477 - DNA, 500 bp, Artificial Sequence
  chemically treated genomic DNA (Homo sapiens) CpG-island No: 3477
ggtagcgtagtcgggattgtttgttttcgttagttatttcgaatcgggtttgacgttcgaagtgtagcggtttaaagcgcgcgatttcgttggattcgggtttagggttttcgttttttagggatagttcgaaggtattattaatgttgaattggggtcgggcggcgtttatggtttcggttcgtttaggcgtcgtgcgtcgtcgttatttgcgtttatatatttagcgtcgtcgttgtttcgttttcgtatgtttcgttttttcgattttggtttcgttttacgcgtcggtttcgttttcgttcgttttaagtaggttagagttgtcgagttttgagcgggttgatgggtgggagttttttttagacggagcgcgttcgtttcgtgacgttatttagtggtcgttatggtaagcgatagttcgtgtcgggttcggatatattttttaggcgtgtatgtgcgggggtttggaggggtttttacgttttaatttttaggtt

SEQ ID NO: 3478 - DNA, 500 bp, Artificial Sequence
  chemically treated genomic DNA (Homo sapiens) CpG-island No: 3478
aacctaaaaattaaaacgtaaaaacccctccaaacccccgcacatacacgcctaaaaaatatatccgaacccgacacgaactatcgcttaccataacgaccactaaataacgtcacgaaacgaacgcgctccgtctaaaaaaaactcccacccatcaacccgctcaaaactcgacaactctaacctacttaaaacgaacgaaaacgaaaccgacgcgtaaaacgaaaccaaaatcgaaaaaacgaaacatacgaaaacgaaacaacgacgacgctaaatatataaacgcaaataacgacgacgcacgacgcctaaacgaaccgaaaccataaacgccgcccgaccccaattcaacattaataataccttcgaactatccctaaaaaacgaaaaccctaaacccgaatccaacgaaatcgcgcgctttaaaccgctacacttcgaacgtcaaacccgattcgaaataactaacgaaaacaaacaatcccgactacgctacc

SEQ ID NO: 3479 - DNA, 500 bp, Artificial Sequence
  chemically treated genomic DNA (Homo sapiens) CpG-island No: 3479
gatttggaggttggggcgtggaagtttttttaagttttcgtatatatacgtttgggggatgtgttcgagttcggtacgggttgtcgtttgttatggcggttattgagtggcgttacggggcgggcgcgtttcgtttggaagaggtttttatttattagttcgtttagggttcggtaattttggtttgtttagggcggacgggggcgggatcggcgcgtggggcggagttagggtcggaggggcggggtatgcgggggcggggtagcggcgacgttgggtgtgtgggcgtagatggcggcggcgtacggcgtttgagcgggtcggggttatgagcgtcgttcggttttagtttagtattgatgatgttttcgagttgtttttggaggacgggggttttgggttcgagtttagcggggtcgcgcgttttgggtcgttgtatttcgagcgttaggttcggttcgaggtggttgacgaagataagtagtttcggttgcgttatt

SEQ ID NO: 3480 - DNA, 500 bp, Artificial Sequence
  chemically treated genomic DNA (Homo sapiens) CpG-island No: 3480
aataacgcaaccgaaactacttatcttcgtcaaccacctcgaaccgaacctaacgctcgaaatacaacgacccaaaacgcgcgaccccgctaaactcgaacccaaaacccccgtcctccaaaaacaactcgaaaacatcatcaatactaaactaaaaccgaacgacgctcataaccccgacccgctcaaacgccgtacgccgccgccatctacgcccacacacccaacgtcgccgctaccccgcccccgcataccccgcccctccgaccctaactccgccccacgcgccgatcccgcccccgtccgccctaaacaaaccaaaattaccgaaccctaaacgaactaataaataaaaacctcttccaaacgaaacgcgcccgccccgtaacgccactcaataaccgccataacaaacgacaacccgtaccgaactcgaacacatcccccaaacgtatatatacgaaaacttaaaaaaacttccacgccccaacctccaaatc

SEQ ID NO: 3481 - DNA, 585 bp, Artificial Sequence
  chemically treated genomic DNA (Homo sapiens) CpG-island No: 3481
gttcggttcgcggatttcggttttttttttttgataggttggggtttagtttcgagatatttttaggtttcgttttcgagtagacgcgcgcgtttagttttagcgtagagaattaattattattcgtttttacgtttagttttttttggtttttgtttttaattaaaatggcgttagttcggaagttgtcgaggtgttaggagttgtcgaagtaagttcggaagttatcgagcgagttcggaagttgtcgaaagggagtagcggggaaggaggatggcggatattatcgtaagatttcgggaggacgggatttaaaaacgtgtgatataggaaggtcgaggagagttttcggatttttaagatgggattaaggttcgtgtttattttatttttttttttttttgcggcgtggtgcgtatgcgaggcgggaggaggttttaggcgagaggttgcgtatgtttagagggtagcgtttattgtttttatcgtttatatgtagaattcgacgttgattgggttgaatttaagtagggggtgaattcgggtttgtttgtttcgttttttggttcggttttgtagtagtat

SEQ ID NO: 3482 - DNA, 585 bp, Artificial Sequence
  chemically treated genomic DNA (Homo sapiens) CpG-island No: 3482
atactactacaaaaccgaaccaaaaaacgaaacaaacaaacccgaattcaccccctacttaaattcaacccaatcaacgtcgaattctacatataaacgataaaaacaataaacgctaccctctaaacatacgcaacctctcgcctaaaacctcctcccgcctcgcatacgcaccacgccgcaaaaaaaaaaaaaaataaaataaacacgaaccttaatcccatcttaaaaatccgaaaactctcctcgaccttcctatatcacacgtttttaaatcccgtcctcccgaaatcttacgataatatccgccatcctccttccccgctactccctttcgacaacttccgaactcgctcgataacttccgaacttacttcgacaactcctaacacctcgacaacttccgaactaacgccattttaattaaaaacaaaaaccaaaaaaaactaaacgtaaaaacgaataataattaattctctacgctaaaactaaacgcgcgcgtctactcgaaaacgaaacctaaaaatatctcgaaactaaaccccaacctatcaaaaaaaaaaaaccgaaatccgcgaaccgaac

SEQ ID NO: 3483 - DNA, 585 bp, Artificial Sequence
  chemically treated genomic DNA (Homo sapiens) CpG-island No: 3483
atgttgttataaggtcgagttagggggcggggtagataggttcgaatttattttttatttaaatttagtttaattagcgtcgagttttgtatgtgagcggtaggggtagtggacgttgttttttgggtatgcgtaatttttcgtttaaggttttttttcgtttcgtatgcgtattacgtcgtagagggggagaagggtagggtagatacgaattttggttttattttgaaagttcgggagtttttttcggtttttttgtattatacgtttttggatttcgttttttcggagttttgcgatgatattcgttatttttttttttcgttgttttttttcggtaattttcggattcgttcggtagttttcggatttgtttcggtaatttttagtatttcggtagttttcgagttagcgttattttggttgagggtagaagttaaaagggattgagcgtggaaacggatggtgattggttttttgcgttggggttgagcgcgcgcgtttgttcgggggcggagtttaggaatgtttcggggttggattttagtttgttaaggaggaagggtcggggttcgcgggtcgggt

SEQ ID NO: 3484 - DNA, 585 bp, Artificial Sequence
  chemically treated genomic DNA (Homo sapiens) CpG-island No: 3484
acccgacccgcgaaccccgacccttcctccttaacaaactaaaatccaaccccgaaacattcctaaactccgcccccgaacaaacgcgcgcgctcaaccccaacgcaaaaaaccaatcaccatccgtttccacgctcaatcccttttaacttctaccctcaaccaaaataacgctaactcgaaaactaccgaaatactaaaaattaccgaaacaaatccgaaaactaccgaacgaatccgaaaattaccgaaaaaaaacaacgaaaaaaaaaaataacgaatatcatcgcaaaactccgaaaaaacgaaatccaaaaacgtataatacaaaaaaaccgaaaaaaactcccgaactttcaaaataaaaccaaaattcgtatctaccctacccttctccccctctacgacgtaatacgcatacgaaacgaaaaaaaaccttaaacgaaaaattacgcatacccaaaaaacaacgtccactacccctaccgctcacatacaaaactcgacgctaattaaactaaatttaaataaaaaataaattcgaacctatctaccccgccccctaactcgaccttataacaacat

SEQ ID NO: 3485 - DNA, 656 bp, Artificial Sequence
  chemically treated genomic DNA (Homo sapiens) CpG-island No: 3485
gaggtggcgttggtttagtgcggtttgggcgaggaggcgtaggtggcggttgtgcggtagcgcgttaaggcggcggtcgaggtcgcgttggtcgtcgtgttggttttggaggtcggtttgagtgtcgagtagcgcggcgggcgtcgggcgtatacggattttttgggtgagtgagggcggtcggggtcggggtcgggagtcgagggttaggggttggagggcggtggttgtcgtagttgagttcgcgtttttcgttcggcgtaggcgtggatttcgcgttgatagcggtcggcggcgtgttgattttagtggttttggagttgaacggcggtttgtgtttggaggcgtgcggcgcgttggaggggttgtgggtcgcgtcgcggttggggtcggcggtcgacgaggcggtggcggcgtcgttggtggagattatgtttcggcggtcggcgcgttgttttatggagggaaaatagttgttggtggtcggcgttggcggcgttagtaagaagttcgtgtgggaggcggcgcgcgattacgggttttaggtgggcggggcgcggggcggggttgggttttaggttttggttcgagtggtggaggcgggatttcggggcggggtttggagtaaaggggcgtttttggggcgggattagtcg

SEQ ID NO: 3486 - DNA, 656 bp, Artificial Sequence
  chemically treated genomic DNA (Homo sapiens) CpG-island No: 3486
cgactaatcccgccccaaaaacgcccctttactccaaaccccgccccgaaatcccgcctccaccactcgaaccaaaacctaaaacccaaccccgccccgcgccccgcccacctaaaacccgtaatcgcgcgccgcctcccacacgaacttcttactaacgccgccaacgccgaccaccaacaactattttccctccataaaacaacgcgccgaccgccgaaacataatctccaccaacgacgccgccaccgcctcgtcgaccgccgaccccaaccgcgacgcgacccacaacccctccaacgcgccgcacgcctccaaacacaaaccgccgttcaactccaaaaccactaaaatcaacacgccgccgaccgctatcaacgcgaaatccacgcctacgccgaacgaaaaacgcgaactcaactacgacaaccaccgccctccaacccctaaccctcgactcccgaccccgaccccgaccgccctcactcacccaaaaaatccgtatacgcccgacgcccgccgcgctactcgacactcaaaccgacctccaaaaccaacacgacgaccaacgcgacctcgaccgccgccttaacgcgctaccgcacaaccgccacctacgcctcctcgcccaaaccgcactaaaccaacgccacctc

SEQ ID NO: 3487 - DNA, 656 bp, Artificial Sequence
  chemically treated genomic DNA (Homo sapiens) CpG-island No: 3487
cggttggtttcgttttaaggacgtttttttgttttaggtttcgtttcggggtttcgtttttattattcgggttaggatttggggtttagtttcgtttcgcgtttcgtttatttggagttcgtagtcgcgcgtcgttttttatacgaattttttgttgacgtcgttagcgtcgattattagtagttgttttttttttatgaggtagcgcgtcgatcgtcgaagtatggtttttattagcggcgtcgttatcgtttcgtcggtcgtcggttttagtcgcggcgcggtttatagtttttttagcgcgtcgtacgtttttagatataggtcgtcgtttagttttagggttattggggttagtacgtcgtcggtcgttgttagcgcgaaatttacgtttgcgtcgggcgggaggcgcgagtttagttacggtagttatcgttttttagtttttggttttcggttttcggtttcggtttcggtcgtttttatttatttaggaagttcgtgtgcgttcggcgttcgtcgcgttgttcggtatttaggtcggtttttagagttagtacggcggttagcgcggtttcggtcgtcgttttgacgcgttgtcgtatagtcgttatttgcgttttttcgtttaggtcgtattgggttagcgttatttt

SEQ ID NO: 3488 - DNA, 656 bp, Artificial Sequence
  chemically treated genomic DNA (Homo sapiens) CpG-island No: 3488
aaaataacgctaacccaatacgacctaaacgaaaaaacgcaaataacgactatacgacaacgcgtcaaaacgacgaccgaaaccgcgctaaccgccgtactaactctaaaaaccgacctaaataccgaacaacgcgacgaacgccgaacgcacacgaacttcctaaataaataaaaacgaccgaaaccgaaaccgaaaaccgaaaaccaaaaactaaaaaacgataactaccgtaactaaactcgcgcctcccgcccgacgcaaacgtaaatttcgcgctaacaacgaccgacgacgtactaaccccaataaccctaaaactaaacgacgacctatatctaaaaacgtacgacgcgctaaaaaaactataaaccgcgccgcgactaaaaccgacgaccgacgaaacgataacgacgccgctaataaaaaccatacttcgacgatcgacgcgctacctcataaaaaaaaaacaactactaataatcgacgctaacgacgtcaacaaaaaattcgtataaaaaacgacgcgcgactacgaactccaaataaacgaaacgcgaaacgaaactaaaccccaaatcctaacccgaataataaaaacgaaaccccgaaacgaaacctaaaacaaaaaaacgtccttaaaacgaaaccaaccg

SEQ ID NO: 3489 - DNA, 510 bp, Artificial Sequence
  chemically treated genomic DNA (Homo sapiens) CpG-island No: 3489
tgcggtatcggtttcgggcggtttcggatttcggtttttgggaagtaggaagtaggatttaggaagtgatagagggattcggagcgggggcggggtaggggttcgcgggggcggggtcgaggttacgcgcggaggggttgggcgggaggttgagcggcgtcggggggtcgggagcggggtcgtcggggacggggttagagagagttttttttttaggattcggtggagcgtttttatcgtagttttttcggaagaagggggcggggcggggtagggtcgacggcggtcgtcgtagaggcgtcgtaggtgcgggtgtagttttatagcggattcgaggttttttcgcgtttttgttttttataatggtattcgtaggagtttttaggattgggtgaggtttcgttttttcggttttcgacggaacgtatatttttaaggggttttattatcgtttttaataaataaatgtagaatttatacggatagtggatatgtttacgtgattttttt

SEQ ID NO: 3490 - DNA, 510 bp, Artificial Sequence
  chemically treated genomic DNA (Homo sapiens) CpG-island No: 3490
aaaaaaatcacgtaaacatatccactatccgtataaattctacatttatttattaaaaacgataataaaaccccttaaaaatatacgttccgtcgaaaaccgaaaaaacgaaacctcacccaatcctaaaaactcctacgaataccattataaaaaacaaaaacgcgaaaaaacctcgaatccgctataaaactacacccgcacctacgacgcctctacgacgaccgccgtcgaccctaccccgccccgcccccttcttccgaaaaaactacgataaaaacgctccaccgaatcctaaaaaaaaaactctctctaaccccgtccccgacgaccccgctcccgaccccccgacgccgctcaacctcccgcccaacccctccgcgcgtaacctcgaccccgcccccgcgaacccctaccccgcccccgctccgaatccctctatcacttcctaaatcctacttcctacttcccaaaaaccgaaatccgaaaccgcccgaaaccgataccgca

SEQ ID NO: 3491 - DNA, 510 bp, Artificial Sequence
  chemically treated genomic DNA (Homo sapiens) CpG-island No: 3491
aaaagagttacgtgaatatatttattgttcgtgtagattttatatttatttgttgggggcggtaatggggttttttggaggtgtgcgtttcgtcgggggtcgggaaggcggggttttatttaattttggagatttttgcggatgttattatgaggagtaagaacgcgaaggggtttcgggttcgttgtaaggttgtattcgtatttgcggcgtttttgcggcggtcgtcgtcggttttgtttcgtttcgtttttttttttcggaggagttgcggtgggggcgttttatcgggttttaggaaaggggttttttttggtttcgttttcggcggtttcgttttcggtttttcggcgtcgtttagtttttcgtttagttttttcgcgcgtgatttcggtttcgttttcgcgagtttttgtttcgttttcgtttcgggtttttttgttattttttgaattttgttttttgttttttagaggtcgggattcggagtcgttcgaagtcggtgtcgta

SEQ ID NO: 3492 - DNA, 510 bp, Artificial Sequence
  chemically treated genomic DNA (Homo sapiens) CpG-island No: 3492
tacgacaccgacttcgaacgactccgaatcccgacctctaaaaaacaaaaaacaaaattcaaaaaataacaaaaaaacccgaaacgaaaacgaaacaaaaactcgcgaaaacgaaaccgaaatcacgcgcgaaaaaactaaacgaaaaactaaacgacgccgaaaaaccgaaaacgaaaccgccgaaaacgaaaccaaaaaaaacccctttcctaaaacccgataaaacgcccccaccgcaactcctccgaaaaaaaaaaacgaaacgaaacaaaaccgacgacgaccgccgcaaaaacgccgcaaatacgaatacaaccttacaacgaacccgaaaccccttcgcgttcttactcctcataataacatccgcaaaaatctccaaaattaaataaaaccccgccttcccgacccccgacgaaacgcacacctccaaaaaaccccattaccgcccccaacaaataaatataaaatctacacgaacaataaatatattcacgtaactctttt

SEQ ID NO: 3493 - DNA, 1260 bp, Artificial Sequence
  chemically treated genomic DNA (Homo sapiens) CpG-island No: 3493
  misc_feature (481)..(481): n is either a, c, g or t
tttttcgaggggttcggtcgggaagttgtacggcggcggttgttagttggttttttttgttggcggtgatttttcgttttgggatttttttcggcgttgcgttttttttttgtgtggtttcggcgttttcggtttcgttttttttcgttttcgttcggtcgtttttttttcgcggcgggggcgggggcgggggcgggggcggggttcggggtatcgggtttcgggttttgttcggcgttgttttttttcgcgcgttaattttttttttgttcgggttgagcggttgttttcgtcgtttcgtggttagtgatagatttttttttgtcgggttcggttcggttgcgttagtttttcgttaaataataattatttttaggttacggtggttcgggggatttcgcggtcgtcgttcgtcgtttttatttgtcgtcggtttttcggtcgtgggtattatggagggtttcggtcgcgcggcgcgtanttaggaagtcgcgagtttcgcggcgcggttcggttcgttcggttcggtttagttaggttcggcgttgtttttcgttttttttttcgtcgttcgttttttttttcgttcgtttttttatttttttcggcgggtcggggagggagagcggcgcggttcgaggtgtcggttttttttcgtttttcgtcgttcggtttcgggttttttcggttttttttttttttttttttttagtttttttttttattcgtagtttcgtttttcgtttcggattttttggtttcgattggtgcgcggggttttggggttgcggtttttacggttcgtttcgttggggttttaggttgtcgtttttttaggtttgcgatcgttcgggtttttcgtcgttttcggttattttttggtttcgtcgtgcggattttaggaatgtcgcgttttcgttcggtttttttcgagggcgtttagtcgtgtttttttcggttcgagtttagttttttggttcggtttcggcgcggggttttcgggggttagggtaggacgggaatcggatttcgtggttgtttggcggggcgggggtcggggtttcggtcgtttggtttttatttgttcggaggtttatggggttggggtcgggtcggtcgggtgcggtttttttttcggaggttggcggagtgggagggcgagtcgcggtttcggcgaagttttaataattttattcgttaggtttattcgtaggtttttttcgttcggtttcggattttttttttttttcggtgtgggat

SEQ ID NO: 3494 - DNA, 1260 bp, Artificial Sequence
  chemically treated genomic DNA (Homo sapiens) CpG-island No: 3494
  misc_feature (780)..(780): n is either a, c, g or t
atcccacaccgaaaaaaaaaaaaaatccgaaaccgaacgaaaaaaacctacgaataaacctaacgaataaaattattaaaacttcgccgaaaccgcgactcgccctcccactccgccaacctccgaaaaaaaaaccgcacccgaccgacccgaccccaaccccataaacctccgaacaaataaaaaccaaacgaccgaaaccccgacccccgccccgccaaacaaccacgaaatccgattcccgtcctaccctaacccccgaaaaccccgcgccgaaaccgaaccaaaaaactaaactcgaaccgaaaaaaacacgactaaacgccctcgaaaaaaaccgaacgaaaacgcgacattcctaaaatccgcacgacgaaaccaaaaaataaccgaaaacgacgaaaaacccgaacgatcgcaaacctaaaaaaacgacaacctaaaaccccaacgaaacgaaccgtaaaaaccgcaaccccaaaaccccgcgcaccaatcgaaaccaaaaaatccgaaacgaaaaacgaaactacgaataaaaaaaaaaactaaaaaaaaaaaaaaaaaaaaaaccgaaaaaacccgaaaccgaacgacgaaaaacgaaaaaaaaccgacacctcgaaccgcgccgctctccctccccgacccgccgaaaaaaataaaaaaacgaacgaaaaaaaaaacgaacgacgaaaaaaaaaacgaaaaacaacgccgaacctaactaaaccgaaccgaacgaaccgaaccgcgccgcgaaactcgcgacttcctaantacgcgccgcgcgaccgaaaccctccataatacccacgaccgaaaaaccgacgacaaataaaaacgacgaacgacgaccgcgaaatcccccgaaccaccgtaacctaaaaataattattatttaacgaaaaactaacgcaaccgaaccgaacccgacaaaaaaaaatctatcactaaccacgaaacgacgaaaacaaccgctcaacccgaacaaaaaaaaaattaacgcgcgaaaaaaaacaacgccgaacaaaacccgaaacccgataccccgaaccccgcccccgcccccgcccccgcccccgccgcgaaaaaaaaacgaccgaacgaaaacgaaaaaaaacgaaaccgaaaacgccgaaaccacacaaaaaaaaaacgcaacgccgaaaaaaatcccaaaacgaaaaatcaccgccaacaaaaaaaaccaactaacaaccgccgccgtacaacttcccgaccgaacccctcgaaaaa

SEQ ID NO: 3495 - DNA, 1260 bp, Artificial Sequence
  chemically treated genomic DNA (Homo sapiens) CpG-island No: 3495
  misc_feature (780)..(780): n is either a, c, g or t
gttttatatcgaaaaaaaaaaaaaattcgaaatcgagcgaaaaaaatttgcgagtgggtttggcggatgggattattaaagtttcgtcggagtcgcggttcgtttttttatttcgttagttttcgggagaggagtcgtattcggtcggttcggttttagttttatggattttcgagtaggtaggagttaggcggtcgaggtttcgattttcgtttcgttaagtagttacgagattcggttttcgttttgttttgattttcgggagtttcgcgtcggggtcgggttagggagttgggttcgggtcgggggaggtacggttgggcgttttcgagaggggtcgggcggggacgcggtatttttggagttcgtacggcggggttaggaggtggtcgggagcggcggggagttcggacgatcgtagatttggggaggcggtaatttggagttttagcgaggcgggtcgtaggagtcgtagttttagagtttcgcgtattagtcggggttagagagttcgaggcggggagcgaggttgcgggtgggaggaggggttgggagaggaagagggagggaggtcgggggagttcgaggtcgggcggcgggaggcgaggggaggtcgatatttcgggtcgcgtcgtttttttttttcggttcgtcgggaggggtaggagggcgggcgggaggaagggcgggcggcggagaggagggcggagggtagcgtcgagtttggttgggtcgggtcggacgggtcgagtcgcgtcgcgggattcgcggttttttagntacgcgtcgcgcggtcggaattttttatggtgtttacggtcggggagtcggcggtaggtaggggcggcgggcggcggtcgcgagatttttcgggttatcgtggtttgggagtgattattgtttggcggggggttggcgtagtcgggtcggattcggtaggaaaaagtttgttattggttacggagcggcgggagtagtcgtttagttcgggtaggaggggagttgacgcgcgggaaagggtagcgtcgggtagagttcggagttcggtgtttcggatttcgttttcgttttcgttttcgttttcgtcgcggggaaggagcgatcgggcgggagcgggagggggcggggtcgggggcgtcgaggttatatagggggaaggcgtagcgtcgggaggggttttagagcgagaggttatcgttagtagggagggttagttggtaatcgtcgtcgtgtagtttttcggtcgagtttttcgaagga

SEQ ID NO: 3496 - DNA, 1260 bp, Artificial Sequence
  chemically treated genomic DNA (Homo sapiens) CpG-island No: 3496
  misc_feature (481)..(481): n is either a, c, g or t
tccttcgaaaaactcgaccgaaaaactacacgacgacgattaccaactaaccctccctactaacgataacctctcgctctaaaacccctcccgacgctacgccttccccctatataacctcgacgcccccgaccccgccccctcccgctcccgcccgatcgctccttccccgcgacgaaaacgaaaacgaaaacgaaaacgaaatccgaaacaccgaactccgaactctacccgacgctaccctttcccgcgcgtcaactcccctcctacccgaactaaacgactactcccgccgctccgtaaccaataacaaactttttcctaccgaatccgacccgactacgccaaccccccgccaaacaataatcactcccaaaccacgataacccgaaaaatctcgcgaccgccgcccgccgcccctacctaccgccgactccccgaccgtaaacaccataaaaaattccgaccgcgcgacgcgtanctaaaaaaccgcgaatcccgcgacgcgactcgacccgtccgacccgacccaaccaaactcgacgctaccctccgccctcctctccgccgcccgcccttcctcccgcccgccctcctacccctcccgacgaaccgaaaaaaaaaaacgacgcgacccgaaatatcgacctcccctcgcctcccgccgcccgacctcgaactcccccgacctccctccctcttcctctcccaacccctcctcccacccgcaacctcgctccccgcctcgaactctctaaccccgactaatacgcgaaactctaaaactacgactcctacgacccgcctcgctaaaactccaaattaccgcctccccaaatctacgatcgtccgaactccccgccgctcccgaccacctcctaaccccgccgtacgaactccaaaaataccgcgtccccgcccgacccctctcgaaaacgcccaaccgtacctcccccgacccgaacccaactccctaacccgaccccgacgcgaaactcccgaaaatcaaaacaaaacgaaaaccgaatctcgtaactacttaacgaaacgaaaatcgaaacctcgaccgcctaactcctacctactcgaaaatccataaaactaaaaccgaaccgaccgaatacgactcctctcccgaaaactaacgaaataaaaaaacgaaccgcgactccgacgaaactttaataatcccatccgccaaacccactcgcaaatttttttcgctcgatttcgaattttttttttttttcgatataaaac

SEQ ID NO: 3497 - DNA, 608 bp, Artificial Sequence
  chemically treated genomic DNA (Homo sapiens) CpG-island No: 3497
ttcgggtcgtagttatttgagttttcgtgaggttgaggttgtgtgttagttgttttttttcggcgtttattacgtagtgattttttttaaaggcgtgttttagttttagaagttgggacggggagaaggcggttcggattcgtttgggttttcgggttagcgcgttgtgtaaaaggaaattttcggggttagtgtcgttttttgcggggagtatagtagaaattttattagggggggttgttttgatcggagtcgcgtatttttttcgagtcgggttggttcggtatcgtgtttagggttttcgtatagtcgcgtcgttcgatttgcgggggtcggtggtttttttaagggtttacgaagggaacgtttgtttagttgttcggttcggaacgtcgggtttttatcggtgcggtatttaattagtcgttgtcgtagaggagttagtttttaggtttttgatttcggtcggtttcgtagtcgttttggcgtcgcgggtttcgttattttttcgtcgggcgttggaggtaggggagggagtcgtagagtttggttaggggattggcgtttataattcgaagaaattatttttttttttttttaatttttcg

SEQ ID NO: 3498 - DNA, 608 bp, Artificial Sequence
  chemically treated genomic DNA (Homo sapiens) CpG-island No: 3498
cgaaaaattaaaaaaaaaaaaaaataatttcttcgaattataaacgccaatcccctaaccaaactctacgactccctcccctacctccaacgcccgacgaaaaaataacgaaacccgcgacgccaaaacgactacgaaaccgaccgaaatcaaaaacctaaaaactaactcctctacgacaacgactaattaaataccgcaccgataaaaacccgacgttccgaaccgaacaactaaacaaacgttcccttcgtaaacccttaaaaaaaccaccgacccccgcaaatcgaacgacgcgactatacgaaaaccctaaacacgataccgaaccaacccgactcgaaaaaaatacgcgactccgatcaaaacaaccccccctaataaaatttctactatactccccgcaaaaaacgacactaaccccgaaaatttccttttacacaacgcgctaacccgaaaacccaaacgaatccgaaccgccttctccccgtcccaacttctaaaactaaaacacgcctttaaaaaaaatcactacgtaataaacgccgaaaaaaaacaactaacacacaacctcaacctcacgaaaactcaaataactacgacccgaa

SEQ ID NO: 3499 - DNA, 608 bp, Artificial Sequence
  chemically treated genomic DNA (Homo sapiens) CpG-island No: 3499
cgagaggttagaaagaagagaaagtagttttttcgggttgtgggcgttaattttttggttaggttttgcggtttttttttttgtttttagcgttcggcgaggaggtggcgaggttcgcggcgttagggcggttgcggagtcggtcgaggttaggagtttggggattggtttttttgcgatagcggttggttgggtgtcgtatcggtggagattcggcgtttcgggtcgggtagttgagtaggcgtttttttcgtgagtttttgggaggattatcggttttcgtaggtcgagcggcgcggttatgcgaaggttttgagtacggtgtcgggttagttcggttcgggagaagtgcgcggtttcggttagagtagttttttttaatgggatttttgttgtgtttttcgtagggaacgatattagtttcgagagtttttttttgtataacgcgttggttcgaaagtttaagcggattcgaatcgtttttttttcgttttagtttttaaggttggaatacgtttttgagaagaattattacgtggtgggcgtcgaaaggaagtagttggtatatagttttagttttacggaaatttaggtgattgcggttcggg

SEQ ID NO: 3500 - DNA, 608 bp, Artificial Sequence
  chemically treated genomic DNA (Homo sapiens) CpG-island No: 3500
cccgaaccgcaatcacctaaatttccgtaaaactaaaactatataccaactacttcctttcgacgcccaccacgtaataattcttctcaaaaacgtattccaaccttaaaaactaaaacgaaaaaaaaacgattcgaatccgcttaaactttcgaaccaacgcgttatacaaaaaaaaactctcgaaactaatatcgttccctacgaaaaacacaacaaaaatcccattaaaaaaaactactctaaccgaaaccgcgcacttctcccgaaccgaactaacccgacaccgtactcaaaaccttcgcataaccgcgccgctcgacctacgaaaaccgataatcctcccaaaaactcacgaaaaaaacgcctactcaactacccgacccgaaacgccgaatctccaccgatacgacacccaaccaaccgctatcgcaaaaaaaccaatccccaaactcctaacctcgaccgactccgcaaccgccctaacgccgcgaacctcgccacctcctcgccgaacgctaaaaacaaaaaaaaaaaccgcaaaacctaaccaaaaaattaacgcccacaacccgaaaaaactactttctcttctttctaacctctcg

SEQ ID NO: 3501 - DNA, 1227 bp, Artificial Sequence
  chemically treated genomic DNA (Homo sapiens) CpG-island No: 3501
agcgttaagttttggagtttttttttcgtacgggttttcgtttttttttaggttttcgaaaagtaggaaagaaaaaataaattttatatttttttttcggggcgcgaggattttttcgtttttagaagagggtggaagattaagaagtcgcgggtttggattgaaggggcgtaaagtgggtggtgaatagggtcgaacgtagtcgaaagtaagtttggcggtcgagttttgttcgcgtttttcggagttaggacggttgggggtattgtcgagggtattaggagtttggggatttcgcgggttttgggtttcgcggcgtcgggtacgtatagtttagtttgttttgattcgagcgtattgggggataattttttcgttcgtatttttttttaaagggttaagcggttcgtaggttattattttaaattagtcgtagtttcggagattggggatcgatattacgttcggtttcgcgtcgtttagttttttaatagggcgcgttggttcgcgagtcggaggaattttcgtttaggttttgttaagcgtttattcggagtaggtcgggggtagtgaaggatgcggcgggagcggcgcgttgtagtttcgcgacgtggtacgtattttggaagcgatgatttagatatcggtagcggtggatgagttaggggtagaaggtggacggatttcgttgttgcgaggcgaatagggggtgtggcgagtgcgaggagggtagggggtgggcggttagggcgtgcggcggcggtatcgggtgtattggtacggcggggttgggcgggtgcgagatcgtttcggcgaatattaagttcgggttggagtagacgtttttatcggcggcggcggcggcggtcgagtggaagtcgttgaggaacggatttatggggttggagttagcgtagttgagtgtcgcgggacggatggggttttcggagcgcgaggcgggtaggggattgtttttggttattagcgattcgatggtgaagtagcgtttgggcgtcggttggaatatgttgcgtcgaggagcgggcgttttgggtttttagtttttggcgatcgtcgtacgttgttttcgtcgttcgttgttcgcggcgaggacggacgagaattggggattcgtttgtttggggtgggggtgggggtggggggaaggaaaggaagaaagaaaggaaaggaaaggaaaaaggaaaggaggggggagggagagggaga

SEQ ID NO: 3502 - DNA, 1227 bp, Artificial Sequence
  chemically treated genomic DNA (Homo sapiens) CpG-island No: 3502
tctccctctccctcccccctcctttcctttttcctttcctttcctttctttcttcctttccttccccccacccccacccccaccccaaacaaacgaatccccaattctcgtccgtcctcgccgcgaacaacgaacgacgaaaacaacgtacgacgatcgccaaaaactaaaaacccaaaacgcccgctcctcgacgcaacatattccaaccgacgcccaaacgctacttcaccatcgaatcgctaataaccaaaaacaatcccctacccgcctcgcgctccgaaaaccccatccgtcccgcgacactcaactacgctaactccaaccccataaatccgttcctcaacgacttccactcgaccgccgccgccgccgccgataaaaacgtctactccaacccgaacttaatattcgccgaaacgatctcgcacccgcccaaccccgccgtaccaatacacccgataccgccgccgcacgccctaaccgcccaccccctaccctcctcgcactcgccacaccccctattcgcctcgcaacaacgaaatccgtccaccttctacccctaactcatccaccgctaccgatatctaaatcatcgcttccaaaatacgtaccacgtcgcgaaactacaacgcgccgctcccgccgcatccttcactacccccgacctactccgaataaacgcttaacaaaacctaaacgaaaattcctccgactcgcgaaccaacgcgccctattaaaaaactaaacgacgcgaaaccgaacgtaatatcgatccccaatctccgaaactacgactaatttaaaataataacctacgaaccgcttaaccctttaaaaaaaaatacgaacgaaaaaattatcccccaatacgctcgaatcaaaacaaactaaactatacgtacccgacgccgcgaaacccaaaacccgcgaaatccccaaactcctaataccctcgacaatacccccaaccgtcctaactccgaaaaacgcgaacaaaactcgaccgccaaacttactttcgactacgttcgaccctattcaccacccactttacgccccttcaatccaaacccgcgacttcttaatcttccaccctcttctaaaaacgaaaaaatcctcgcgccccgaaaaaaaaatataaaatttattttttctttcctacttttcgaaaacctaaaaaaaaacgaaaacccgtacgaaaaaaaaactccaaaacttaacgct

SEQ ID NO: 3503 - DNA, 1227 bp, Artificial Sequence
  chemically treated genomic DNA (Homo sapiens) CpG-island No: 3503
tttttttttttttttttttttttttttttttttttttttttttttttttttttttttttttttttttttatttttatttttattttaaataaacgagtttttaattttcgttcgttttcgtcgcgggtagcgggcggcggaggtagcgtgcggcggtcgttaggagttgggagtttagggcgttcgtttttcggcgtagtatgttttagtcggcgtttaagcgttgttttattatcgagtcgttggtggttaaggatagttttttgttcgtttcgcgtttcgaggattttattcgtttcgcggtatttagttacgttaattttagttttataaattcgttttttaacggtttttattcggtcgtcgtcgtcgtcgtcggtaggggcgtttattttaattcggatttggtgttcgtcgaggcggtttcgtattcgtttaatttcgtcgtgttagtgtattcggtgtcgtcgtcgtacgttttggtcgtttattttttatttttttcgtattcgttatattttttattcgtttcgtagtagcgggattcgtttattttttatttttggtttatttatcgttatcgatatttgggttatcgtttttaaggtacgtgttacgtcgcggaattgtagcgcgtcgttttcgtcgtattttttattgttttcggtttgtttcgggtgggcgtttggtaaggtttgggcggaggttttttcggttcgcgggttagcgcgttttgttgggaaattaggcggcgcggggtcgggcgtggtgtcgatttttagttttcgaagttacgattggtttggagtgatggtttgcgggtcgtttgattttttgggaaggggtgcgaacggagaagttgttttttagtgcgttcgaattagagtaggttgggttgtgcgtgttcggcgtcgcggagtttagagttcgcgggatttttaggtttttggtattttcggtaatgtttttaatcgttttggtttcgaggggcgcggataggattcggtcgttaggtttgttttcgattgcgttcgattttgtttattatttattttgcgtttttttagtttagattcgcggttttttagttttttatttttttttggaggcgagaggattttcgcgtttcgggagaaaagtatgggatttgtttttttttttttgtttttcggaggtttggggaggggcgggaattcgtgcgggaggaaagttttagggtttggcgtt

SEQ ID NO: 3504 - DNA, 1227 bp, Artificial Sequence
  chemically treated genomic DNA (Homo sapiens) CpG-island No: 3504
aacgccaaaccctaaaactttcctcccgcacgaattcccgcccctccccaaacctccgaaaaacaaaaaaaaaaaaacaaatcccatacttttctcccgaaacgcgaaaatcctctcgcctccaaaaaaaaataaaaaactaaaaaaccgcgaatctaaactaaaaaaacgcaaaataaataataaacaaaatcgaacgcaatcgaaaacaaacctaacgaccgaatcctatccgcgcccctcgaaaccaaaacgattaaaaacattaccgaaaataccaaaaacctaaaaatcccgcgaactctaaactccgcgacgccgaacacgcacaacccaacctactctaattcgaacgcactaaaaaacaacttctccgttcgcaccccttcccaaaaaatcaaacgacccgcaaaccatcactccaaaccaatcgtaacttcgaaaactaaaaatcgacaccacgcccgaccccgcgccgcctaatttcccaacaaaacgcgctaacccgcgaaccgaaaaaacctccgcccaaaccttaccaaacgcccacccgaaacaaaccgaaaacaataaaaaatacgacgaaaacgacgcgctacaattccgcgacgtaacacgtaccttaaaaacgataacccaaatatcgataacgataaataaaccaaaaataaaaaataaacgaatcccgctactacgaaacgaataaaaaatataacgaatacgaaaaaaataaaaaataaacgaccaaaacgtacgacgacgacaccgaatacactaacacgacgaaattaaacgaatacgaaaccgcctcgacgaacaccaaatccgaattaaaataaacgcccctaccgacgacgacgacgacgaccgaataaaaaccgttaaaaaacgaatttataaaactaaaattaacgtaactaaataccgcgaaacgaataaaatcctcgaaacgcgaaacgaacaaaaaactatccttaaccaccaacgactcgataataaaacaacgcttaaacgccgactaaaacatactacgccgaaaaacgaacgccctaaactcccaactcctaacgaccgccgcacgctacctccgccgcccgctacccgcgacgaaaacgaacgaaaattaaaaactcgtttatttaaaataaaaataaaaataaaaaaaaaaaaaaaaaaaaaaaaaaaaaaaaaaaaaaaaaaaaaaaaaaaaaaaaaaaaaaaaaaaaa

SEQ ID NO: 3505 - DNA, 582 bp, Artificial Sequence
  chemically treated genomic DNA (Homo sapiens) CpG-island No: 3505
tttttttttgttggcgttttttaattttagggttcggggggcgttcgtggcgtcgggttgtatttgtcggggtacgtcgggattgcgggtcggcgcgttcgttttgggttggggtgcggaagcgttcgagatttgggtatcgggcgagagtgtgagaggagcggacgtttaggagggagtcgaggacgcgcggcgggtagggggtaggggcgtaggaatcgggttttagttttagtcgggatatcggttttttttggtttggcggtttttggagggagacgagtttcggggagaaggagggcggcgattggggttagggattggcgatcggagtggggagggtcggcggttgagcgagttcgttggttgacgcgaggagggggaggttaatttttcgggagaaggggttttttcggcgttagggttggttagggagttgtcgtcgtcgttatcgagggttcggattttaggtagttgtaggtttcgttcgcgacgttcggaaagtatcgtttatttatttatttgtttgcgtttagcgtttcgggttgaatttaatagatatttttttggattttaggaatt

SEQ ID NO: 3506 - DNA, 582 bp, Artificial Sequence
  chemically treated genomic DNA (Homo sapiens) CpG-island No: 3506
aattcctaaaatccaaaaaaatatctattaaattcaacccgaaacgctaaacgcaaacaaataaataaataaacgatactttccgaacgtcgcgaacgaaacctacaactacctaaaatccgaaccctcgataacgacgacgacaactccctaaccaaccctaacgccgaaaaaaccccttctcccgaaaaattaacctccccctcctcgcgtcaaccaacgaactcgctcaaccgccgaccctccccactccgatcgccaatccctaaccccaatcgccgccctccttctccccgaaactcgtctccctccaaaaaccgccaaaccaaaaaaaaccgatatcccgactaaaactaaaacccgattcctacgcccctaccccctacccgccgcgcgtcctcgactccctcctaaacgtccgctcctctcacactctcgcccgatacccaaatctcgaacgcttccgcaccccaacccaaaacgaacgcgccgacccgcaatcccgacgtaccccgacaaatacaacccgacgccacgaacgccccccgaaccctaaaattaaaaaacgccaacaaaaaaaaa

SEQ ID NO: 3507 - DNA, 582 bp, Artificial Sequence
  chemically treated genomic DNA (Homo sapiens) CpG-island No: 3507
ggtttttaaagtttaagggggtgtttgttgggtttaattcgagacgttgaacgtaagtaaataaataaataaacggtatttttcgagcgtcgcgagcggagtttgtagttgtttggagttcgagttttcggtggcggcggcggtagttttttagttagttttggcgtcgaaagagttttttttttcgggaagttggttttttttttttcgcgttagttagcgagttcgtttagtcgtcggttttttttatttcgatcgttaatttttagttttagtcgtcgtttttttttttttcgggattcgtttttttttagaggtcgttaagttagggggaatcgatgtttcgattggggttgaaattcggtttttgcgtttttattttttattcgtcgcgcgttttcggtttttttttgggcgttcgttttttttatattttcgttcggtgtttaggtttcgggcgttttcgtattttagtttagggcgagcgcgtcggttcgtagtttcggcgtgtttcggtaggtgtagttcggcgttacgagcgtttttcgggttttaaagttgggagacgttagtaaaaagaaa

SEQ ID NO: 3508 - DNA, 582 bp, Artificial Sequence
  chemically treated genomic DNA (Homo sapiens) CpG-island No: 3508
tttctttttactaacgtctcccaactttaaaacccgaaaaacgctcgtaacgccgaactacacctaccgaaacacgccgaaactacgaaccgacgcgctcgccctaaactaaaatacgaaaacgcccgaaacctaaacaccgaacgaaaatataaaaaaaacgaacgcccaaaaaaaaaccgaaaacgcgcgacgaataaaaaataaaaacgcaaaaaccgaatttcaaccccaatcgaaacatcgattccccctaacttaacgacctctaaaaaaaaacgaatcccgaaaaaaaaaaaaacgacgactaaaactaaaaattaacgatcgaaataaaaaaaaccgacgactaaacgaactcgctaactaacgcgaaaaaaaaaaaaccaacttcccgaaaaaaaaaactctttcgacgccaaaactaactaaaaaactaccgccgccgccaccgaaaactcgaactccaaacaactacaaactccgctcgcgacgctcgaaaaataccgtttatttatttatttacttacgttcaacgtctcgaattaaacccaacaaacacccccttaaactttaaaaacc

SEQ ID NO: 3509 - DNA, 839 bp, Artificial Sequence
  chemically treated genomic DNA (Homo sapiens) CpG-island No: 3509
tcggcgtcggtttttcggatacgtcggcggcggagaggggtttacggcggcggttcggttagagattcggcgttcggagttagcgtttcgtattcgcgttttagcgggtagattttaatttagtatgagcgtcgttatttattcgtttatgatgtaggtggcgttcggtaacggtgatcgcgattttttgtttttcggatgggagattaagatcgattcgtagatcggttggttttttttcgtggattataatagtcgtattattacgtggaacgattcgcgcgtgttttttgagggttttaaggtgagtcgggttcgcggttcgttttggtcggtggcgttatttcgacggtaggcggcggggagtgggttgggtcggggggattcgatgcggcggggttcgggggtcggcgaaggtttttcgcgggcggatatcggtttcgcgtttcgttatatattttcgttgcgttcggacgagttttcgtttcggattcgtttttgataggcgtcggggcgaaaggaggtttcgggattcggtggttcgggaagcgatttcgtagtggtttcggtgcggtttacggttcgattttagggcggaaggtcgggtgtttagcgttggtttcgcgttttagggttgggagaggggcggtcggtttggttagtttcggaggtttcggtttatcgcggtttttgttgttcgttcggttttcgggttcgggattcgcggcgtattttgttgatcgcggattcgagggggatattcgtaagtttggatggtggttttggggggaattttatcgtttaagttttttaatttggttgaggggtattttggttat

SEQ ID NO: 3510 - DNA, 839 bp, Artificial Sequence
  chemically treated genomic DNA (Homo sapiens) CpG-island No: 3510
ataaccaaaatacccctcaaccaaattaaaaaacttaaacgataaaattccccccaaaaccaccatccaaacttacgaatatccccctcgaatccgcgatcaacaaaatacgccgcgaatcccgaacccgaaaaccgaacgaacaacaaaaaccgcgataaaccgaaacctccgaaactaaccaaaccgaccgcccctctcccaaccctaaaacgcgaaaccaacgctaaacacccgaccttccgccctaaaatcgaaccgtaaaccgcaccgaaaccactacgaaatcgcttcccgaaccaccgaatcccgaaacctcctttcgccccgacgcctatcaaaaacgaatccgaaacgaaaactcgtccgaacgcaacgaaaatatataacgaaacgcgaaaccgatatccgcccgcgaaaaaccttcgccgacccccgaaccccgccgcatcgaatccccccgacccaacccactccccgccgcctaccgtcgaaataacgccaccgaccaaaacgaaccgcgaacccgactcaccttaaaaccctcaaaaaacacgcgcgaatcgttccacgtaataatacgactattataatccacgaaaaaaaaccaaccgatctacgaatcgatcttaatctcccatccgaaaaacaaaaaatcgcgatcaccgttaccgaacgccacctacatcataaacgaataaataacgacgctcatactaaattaaaatctacccgctaaaacgcgaatacgaaacgctaactccgaacgccgaatctctaaccgaaccgccgccgtaaacccctctccgccgccgacgtatccgaaaaaccgacgccga

SEQ ID NO: 3511 - DNA, 839 bp, Artificial Sequence
  chemically treated genomic DNA (Homo sapiens) CpG-island No: 3511
gtagttaagatattttttaattaagttggagaatttgagcgataaaattttttttaaaattattatttaagtttgcgagtgtttttttcgagttcgcggttagtagggtgcgtcgcgggtttcgggttcggaggtcgagcgggtagtaggggtcgcggtgggtcggggttttcggagttgattaggtcggtcgttttttttttagttttagagcgcgaggttagcgttggatattcggtttttcgttttggagtcgagtcgtggatcgtatcggagttattgcggggtcgtttttcgggttatcgaatttcggggttttttttcgtttcgacgtttgttaagggcgggttcggagcggggattcgttcgggcgtagcgggagtgtgtggcggggcgcggagtcggtgttcgttcgcgaggggttttcgtcgattttcgggtttcgtcgtatcgagttttttcggtttagtttatttttcgtcgtttgtcgtcgaggtggcgttatcgattagggcgggtcgcgggttcggtttattttggggtttttagagggtacgcgcgggtcgttttacgtagtggtgcggttgttgtggtttacgaagaagggttagtcggtttgcgggtcgattttgattttttattcggggggtaaagggtcgcggttatcgttgtcggacgttatttgtattatgggcgagtgggtggcggcgtttatgttgggttggggtttgttcgttggggcgcgggtgcggggcgttggtttcgggcgtcgagtttttggtcgggtcgtcgtcgtgggttttttttcgtcgtcgacgtgttcgggaagtcggcgtcgg

SEQ ID NO: 3512 - DNA, 839 bp, Artificial Sequence
  chemically treated genomic DNA (Homo sapiens) CpG-island No: 3512
ccgacgccgacttcccgaacacgtcgacgacgaaaaaaaacccacgacgacgacccgaccaaaaactcgacgcccgaaaccaacgccccgcacccgcgccccaacgaacaaaccccaacccaacataaacgccgccacccactcgcccataatacaaataacgtccgacaacgataaccgcgaccctttaccccccgaataaaaaatcaaaatcgacccgcaaaccgactaacccttcttcgtaaaccacaacaaccgcaccactacgtaaaacgacccgcgcgtaccctctaaaaaccccaaaataaaccgaacccgcgacccgccctaatcgataacgccacctcgacgacaaacgacgaaaaataaactaaaccgaaaaaactcgatacgacgaaacccgaaaatcgacgaaaacccctcgcgaacgaacaccgactccgcgccccgccacacactcccgctacgcccgaacgaatccccgctccgaacccgcccttaacaaacgtcgaaacgaaaaaaaaccccgaaattcgataacccgaaaaacgaccccgcaataactccgatacgatccacgactcgactccaaaacgaaaaaccgaatatccaacgctaacctcgcgctctaaaactaaaaaaaaaacgaccgacctaatcaactccgaaaaccccgacccaccgcgacccctactacccgctcgacctccgaacccgaaacccgcgacgcaccctactaaccgcgaactcgaaaaaaacactcgcaaacttaaataataattttaaaaaaaattttatcgctcaaattctccaacttaattaaaaaatatcttaactac

SEQ ID NO: 3513 - DNA, 894 bp, Artificial Sequence
  chemically treated genomic DNA (Homo sapiens) CpG-island No: 3513
gcggtcgcggtcgaggcggggatagggaggcggtagttttttttgcgtagcgacggcgcgggcgggaggaggtcggggcgttttagtttttcgttttcgtttttttcggtcgtgacgttagagtcggacggggtaaattgagcggcggcggcggggcgttggggcggagattgcgattcggagtcgttcggattgacggagtttattgcggtgcgggcgttggcgcgggtacggaggattcgggtaggtatcgtaagcgatttcgaggtaatacggtttcggttttttgttcgtagggcgcggtgtcggaggggagcgggttcgggggaggtagggaggtagggaggtttttagagttacgcgggcggggttgcggggatttcggggtagtcggggcgtagggcgtagggcgtaaggtgtacggggtcgagcgtgtagtttgggaggtggtatagttgggggcggcggggattagggtagcgttttgggggttttaggttgggtttttagattgggttttcgacggcgttcgcgggcgttttttttagggagcgcgggttttcgtggggacgcgttcgaggtaggtgagtcgaggttggggcgttcgggggtgttttcggatgtcggtgcgcgcggttttttgattcgttttttcgcggtttgggggacgggagaatggggggttttcggtcgttttgggtttttatcgcgtatcgcgttcgtagcggagtttcggagttatggttttgagcgagttggcgttggttcgttggttgtaggagagtcgtcgttcgcggaagtttattttgtttatcgtgtttttggcgttgttgttggataatatgttgtttattgtcgtgggtacgtgcggatagggtatttttgtttcggtat

SEQ ID NO: 3514 - DNA, 894 bp, Artificial Sequence
  chemically treated genomic DNA (Homo sapiens) CpG-island No: 3514
ataccgaaacaaaaataccctatccgcacgtacccacgacaataaacaacatattatccaacaacaacgccaaaaacacgataaacaaaataaacttccgcgaacgacgactctcctacaaccaacgaaccaacgccaactcgctcaaaaccataactccgaaactccgctacgaacgcgatacgcgataaaaacccaaaacgaccgaaaaccccccattctcccgtcccccaaaccgcgaaaaaacgaatcaaaaaaccgcgcgcaccgacatccgaaaacacccccgaacgccccaacctcgactcacctacctcgaacgcgtccccacgaaaacccgcgctccctaaaaaaaacgcccgcgaacgccgtcgaaaacccaatctaaaaacccaacctaaaacccccaaaacgctaccctaatccccgccgcccccaactataccacctcccaaactacacgctcgaccccgtacaccttacgccctacgccctacgccccgactaccccgaaatccccgcaaccccgcccgcgtaactctaaaaacctccctacctccctacctcccccgaacccgctcccctccgacaccgcgccctacgaacaaaaaaccgaaaccgtattacctcgaaatcgcttacgatacctacccgaatcctccgtacccgcgccaacgcccgcaccgcaataaactccgtcaatccgaacgactccgaatcgcaatctccgccccaacgccccgccgccgccgctcaatttaccccgtccgactctaacgtcacgaccgaaaaaaacgaaaacgaaaaactaaaacgccccgacctcctcccgcccgcgccgtcgctacgcaaaaaaaactaccgcctccctatccccgcctcgaccgcgaccgc

SEQ ID NO: 3515 - DNA, 894 bp, Artificial Sequence
  chemically treated genomic DNA (Homo sapiens) CpG-island No: 3515
gtgtcggggtaggggtgttttgttcgtacgtatttacgatagtgagtagtatgttgtttagtagtagcgttaggaatacgatgaataggatgagttttcgcgagcggcggtttttttgtagttagcggattagcgttagttcgtttagggttatggtttcggggtttcgttgcgggcgcggtgcgcggtgaggatttaaggcggtcggggattttttattttttcgttttttaggtcgcggaagggcgggttagggagtcgcgcgtatcggtattcggggatattttcgggcgttttagtttcggtttatttgtttcgagcgcgtttttacgagagttcgcgttttttggaaagagcgttcgcgagcgtcgtcggggatttaatttggagatttaatttagaatttttaggacgttgttttgattttcgtcgtttttaattgtgttattttttaaattgtacgttcggtttcgtgtattttgcgttttgcgttttgcgtttcggttgtttcggggttttcgtagtttcgttcgcgtagttttgggggtttttttgtttttttgtttttttcgggttcgttttttttcggtatcgcgttttgcgagtagggaatcggggtcgtgttatttcggggtcgtttgcgatgtttgttcgggtttttcgtgttcgcgttaacgttcgtatcgtagtgggtttcgttagttcgggcggtttcgggtcgtagttttcgttttagcgtttcgtcgtcgtcgtttagtttatttcgttcggttttgacgttacggtcggagggagcgggggcggggggttggggcgtttcggttttttttcgttcgcgtcgtcgttgcgtaggaggggttgtcgtttttttgttttcgtttcggtcgcggtcgt

SEQ ID NO: 3516 - DNA, 894 bp, Artificial Sequence
  chemically treated genomic DNA (Homo sapiens) CpG-island No: 3516
acgaccgcgaccgaaacgaaaacaaaaaaacgacaacccctcctacgcaacgacgacgcgaacgaaaaaaaaccgaaacgccccaaccccccgcccccgctccctccgaccgtaacgtcaaaaccgaacgaaataaactaaacgacgacgacgaaacgctaaaacgaaaactacgacccgaaaccgcccgaactaacgaaacccactacgatacgaacgttaacgcgaacacgaaaaacccgaacaaacatcgcaaacgaccccgaaataacacgaccccgattccctactcgcaaaacgcgataccgaaaaaaaacgaacccgaaaaaaacaaaaaaacaaaaaaacccccaaaactacgcgaacgaaactacgaaaaccccgaaacaaccgaaacgcaaaacgcaaaacgcaaaatacacgaaaccgaacgtacaatttaaaaaataacacaattaaaaacgacgaaaatcaaaacaacgtcctaaaaattctaaattaaatctccaaattaaatccccgacgacgctcgcgaacgctctttccaaaaaacgcgaactctcgtaaaaacgcgctcgaaacaaataaaccgaaactaaaacgcccgaaaatatccccgaataccgatacgcgcgactccctaacccgcccttccgcgacctaaaaaacgaaaaaataaaaaatccccgaccgccttaaatcctcaccgcgcaccgcgcccgcaacgaaaccccgaaaccataaccctaaacgaactaacgctaatccgctaactacaaaaaaaccgccgctcgcgaaaactcatcctattcatcgtattcctaacgctactactaaacaacatactactcactatcgtaaatacgtacgaacaaaacacccctaccccgacac

SEQ ID NO: 3517 - DNA, 1182 bp, Artificial Sequence
  chemically treated genomic DNA (Homo sapiens) CpG-island No: 3517
tcgtgttcggagttcgcgtttcgcgtcgggttttatattttggatttcgaggcgaagtcggggcggtacggttcgtttaggttcgattcgttgttcgtcgtcgtttcgtcgttgtagtcggtttagggttttagtaggcgcgcgggcggcgtggttttaataatatcgtcgtcgtcgtcgttcgaggcggtttcgggcgatggcgggggttcgggtcgggttagatagttcgaggcgcgcggtcggttttcgtgggtcgcgtggcgtaggcgggtagttttgcgcgcgtagtagagtagtttttggaaggttttgcggaagtcgggggttgcggtagtagatgatggggttgaaggtcgagttggcgtagtttagttagttgaagaagacgaagaggcggtcgggtattagatcgcggtggaaggtttttattacgttggttaggaagaagggtcgttcgtagagcgtgaagacgtttatgatgatgtttagcgttttgagcgttttttgttcgtttagggttacgaggcgcgagggttcgtcgtttattcgtacgttcgttggttagcggggcggtggcggcggcggcggcggggcgcgggggttcgggcggcggcgcgggcgcggggacgggcgagggcgagggcgaggtcggtcgcgttggttcgtcgaggaaacggcgttcgtagttgtcgattttttttatttgtttttgggtttcgcggaatattcgtaggtatacgaaggttatgatgtataggggtacgtagaaggagattacggacgaggcgatggcgtaggttcggttggtgacgaagtcgtagtatttggggtcgttgtagtagcggcgcgtttcgtcgtttttcgttcgttattagtgtatgaggatgggtaggaaggatattagggtcgagatggtttatacggtgtatacgaggtttcgcgttcgcgcgcgcgttagtaggttttggtagcggaagggcgaggtgatggcgaggtagcggtttagggtaatgatatatagggtttcgatgttggtcgttacgtatagtacgtttattgaggtttatagttcgtagaagaaggagtcgtatttttagcggttttatattacgatggtggtttcgaacggtattattagtagttttatgattaggtcggcgttggttagggatatgatga

SEQ ID NO: 3518 - DNA, 1182 bp, Artificial Sequence
  chemically treated genomic DNA (Homo sapiens) CpG-island No: 3518
tcatcatatccctaaccaacgccgacctaatcataaaactactaataataccgttcgaaaccaccatcgtaatataaaaccgctaaaaatacgactccttcttctacgaactataaacctcaataaacgtactatacgtaacgaccaacatcgaaaccctatatatcattaccctaaaccgctacctcgccatcacctcgcccttccgctaccaaaacctactaacgcgcgcgcgaacgcgaaacctcgtatacaccgtataaaccatctcgaccctaatatccttcctacccatcctcatacactaataacgaacgaaaaacgacgaaacgcgccgctactacaacgaccccaaatactacgacttcgtcaccaaccgaacctacgccatcgcctcgtccgtaatctccttctacgtacccctatacatcataaccttcgtatacctacgaatattccgcgaaacccaaaaacaaataaaaaaaatcgacaactacgaacgccgtttcctcgacgaaccaacgcgaccgacctcgccctcgccctcgcccgtccccgcgcccgcgccgccgcccgaacccccgcgccccgccgccgccgccgccaccgccccgctaaccaacgaacgtacgaataaacgacgaaccctcgcgcctcgtaaccctaaacgaacaaaaaacgctcaaaacgctaaacatcatcataaacgtcttcacgctctacgaacgacccttcttcctaaccaacgtaataaaaaccttccaccgcgatctaatacccgaccgcctcttcgtcttcttcaactaactaaactacgccaactcgaccttcaaccccatcatctactaccgcaacccccgacttccgcaaaaccttccaaaaactactctactacgcgcgcaaaactacccgcctacgccacgcgacccacgaaaaccgaccgcgcgcctcgaactatctaacccgacccgaacccccgccatcgcccgaaaccgcctcgaacgacgacgacgacgatattattaaaaccacgccgcccgcgcgcctactaaaaccctaaaccgactacaacgacgaaacgacgacgaacaacgaatcgaacctaaacgaaccgtaccgccccgacttcgcctcgaaatccaaaatataaaacccgacgcgaaacgcgaactccgaacacga

SEQ ID NO: 3519 - DNA, 1182 bp, Artificial Sequence
  chemically treated genomic DNA (Homo sapiens) CpG-island No: 3519
ttattatgtttttggttagcgtcgatttggttatggggttgttggtggtgtcgttcggggttattatcgtggtgtggggtcgttgggagtacggtttttttttttgcgagttgtggattttagtggacgtgttgtgcgtgacggttagtatcgagattttgtgtgttattgttttggatcgttatttcgttattatttcgttttttcgttattagagtttgttgacgcgcgcgcgggcgcggggtttcgtgtgtatcgtgtgggttatttcggttttggtgttttttttgtttatttttatgtattggtggcgggcggagagcgacgaggcgcgtcgttgttataacgattttaagtgttgcgatttcgttattaatcgggtttacgttatcgtttcgttcgtagtttttttttacgtgtttttgtgtattatggttttcgtgtatttgcgggtgtttcgcgaggtttaaaagtaggtgaagaagatcgatagttgcgagcgtcgttttttcggcgggttagcgcggtcgatttcgttttcgttttcgttcgttttcgcgttcgcgtcgtcgttcggattttcgcgtttcgtcgtcgtcgtcgttatcgtttcgttggttaacgggcgtgcgggtaagcggcgggttttcgcgtttcgtggttttgagcgagtagaaggcgtttaggacgttgggtattattatgggcgtttttacgttttgcgggcggtttttttttttgattaacgtggtgaaggttttttatcgcgatttggtgttcgatcgttttttcgttttttttaattggttgggttacgttaattcggtttttaattttattatttattgtcgtagttttcgattttcgtaaggttttttagggattgttttgttgcgcgcgtagggttgttcgtttgcgttacgcgatttacggagatcggtcgcgcgtttcgggttgtttggttcggttcggattttcgttatcgttcggggtcgtttcggacgacgacgacgacgatgttgttggggttacgtcgttcgcgcgtttgttggagttttgggtcggttgtaacggcggggcggcggcggatagcgaatcgagtttggacgagtcgtgtcgtttcggtttcgtttcggaatttaaggtgtagggttcggcgcggggcgcggatttcgggtacgg

SEQ ID NO: 3520 - DNA, 1182 bp, Artificial Sequence
  chemically treated genomic DNA (Homo sapiens) CpG-island No: 3520
ccgtacccgaaatccgcgccccgcgccgaaccctacaccttaaattccgaaacgaaaccgaaacgacacgactcgtccaaactcgattcgctatccgccgccgccccgccgttacaaccgacccaaaactccaacaaacgcgcgaacgacgtaaccccaacaacatcgtcgtcgtcgtcgtccgaaacgaccccgaacgataacgaaaatccgaaccgaaccaaacaacccgaaacgcgcgaccgatctccgtaaatcgcgtaacgcaaacgaacaaccctacgcgcgcaacaaaacaatccctaaaaaaccttacgaaaatcgaaaactacgacaataaataataaaattaaaaaccgaattaacgtaacccaaccaattaaaaaaaacgaaaaaacgatcgaacaccaaatcgcgataaaaaaccttcaccacgttaatcaaaaaaaaaaaccgcccgcaaaacgtaaaaacgcccataataatacccaacgtcctaaacgccttctactcgctcaaaaccacgaaacgcgaaaacccgccgcttacccgcacgcccgttaaccaacgaaacgataacgacgacgacgacgaaacgcgaaaatccgaacgacgacgcgaacgcgaaaacgaacgaaaacgaaaacgaaatcgaccgcgctaacccgccgaaaaaacgacgctcgcaactatcgatcttcttcacctacttttaaacctcgcgaaacacccgcaaatacacgaaaaccataatacacaaaaacacgtaaaaaaaaactacgaacgaaacgataacgtaaacccgattaataacgaaatcgcaacacttaaaatcgttataacaacgacgcgcctcgtcgctctccgcccgccaccaatacataaaaataaacaaaaaaaacaccaaaaccgaaataacccacacgatacacacgaaaccccgcgcccgcgcgcgcgtcaacaaactctaataacgaaaaaacgaaataataacgaaataacgatccaaaacaataacacacaaaatctcgatactaaccgtcacgcacaacacgtccactaaaatccacaactcgcaaaaaaaaaaaccgtactcccaacgaccccacaccacgataataaccccgaacgacaccaccaacaaccccataaccaaatcgacgctaaccaaaaacataataa

SEQ ID NO: 3521 - DNA, 677 bp, Artificial Sequence
  chemically treated genomic DNA (Homo sapiens) CpG-island No: 3521
gtagtcgcggcgttttggcgatggttacgattattagtatattgttcgttacgatgagtagtacgatgagcgttattagtagatttatgttcgttgtttattgttgagatagcggttcggggttttcgttggcgggaggtagtaacgaggcgggcggcgacgcgggtattagtagtcgcgtcgcggtggtcgcgtcgtcggggagcggtgcggtcgacgataggttatcgggttcggaggcgtttaggacgagtattttcgcgtttatgtcgagttgcggaggtcgggggcggggggtgtggtagggttgggtcgtggttggggaatattttagaagttcgggcggcgtggtgcgtagagggaggtcgcggtcgggttagggtagtcgcggcgcggggtcggaggtatgggcgtcgggcgtttttttcgtaggagtcgagcgttgtcgttgtcgttgtcgtcgtcgtcgtcgtcgtcgttgttgttggagtcgttgtcgttgttggaagattcgtcgggattttagtatgtttttgagcgcgtcgggttcgtagtttcggtatttagtatttattttatttcgtttttattttttaagttaattttcggggtttcgcgttaggtttttgtagttaattcgggtaaaggtacgttttcgtttggtttgtatttttatt

SEQ ID NO: 3522 - DNA, 677 bp, Artificial Sequence
  chemically treated genomic DNA (Homo sapiens) CpG-island No: 3522
aataaaaatacaaaccaaacgaaaacgtacctttacccgaattaactacaaaaacctaacgcgaaaccccgaaaattaacttaaaaaataaaaacgaaataaaataaatactaaataccgaaactacgaacccgacgcgctcaaaaacatactaaaatcccgacgaatcttccaacaacgacaacgactccaacaacaacgacgacgacgacgacgacgacaacgacaacgacaacgctcgactcctacgaaaaaaacgcccgacgcccatacctccgaccccgcgccgcgactaccctaacccgaccgcgacctccctctacgcaccacgccgcccgaacttctaaaatattccccaaccacgacccaaccctaccacaccccccgcccccgacctccgcaactcgacataaacgcgaaaatactcgtcctaaacgcctccgaacccgataacctatcgtcgaccgcaccgctccccgacgacgcgaccaccgcgacgcgactactaatacccgcgtcgccgcccgcctcgttactacctcccgccaacgaaaaccccgaaccgctatctcaacaataaacaacgaacataaatctactaataacgctcatcgtactactcatcgtaacgaacaatatactaataatcgtaaccatcgccaaaacgccgcgactac

SEQ ID NO: 3523 - DNA, 677 bp, Artificial Sequence
  chemically treated genomic DNA (Homo sapiens) CpG-island No: 3523
ggtgggggtgtagattagacgggggcgtgtttttgttcggattggttgtaggagtttgacgcgaggtttcgggggttggtttggggagtgggagcggggtggggtgggtgttgggtgtcggagttgcgggttcggcgcgtttagaaatatgttgaagtttcggcggattttttagtagcggtagcggttttagtagtagcggcggcggcggcggcggcggtagcggtagcgatagcgttcggtttttgcgggaaaggcgttcggcgtttatgttttcggtttcgcgtcgcggttgttttgattcggtcgcgatttttttttgcgtattacgtcgttcgggtttttggggtgttttttaattacggtttagttttgttatatttttcgttttcggttttcgtagttcggtatgggcgcgggggtgttcgttttgggcgttttcgagttcggtaatttgtcgtcggtcgtatcgtttttcgacggcgcggttatcgcggcgcggttgttggtgttcgcgtcgtcgttcgtttcgttgttgtttttcgttagcgaaagtttcgagtcgttgttttagtagtggatagcgggtatgggtttgttgatggcgtttatcgtgttgtttatcgtggcgggtaatgtgttggtgatcgtggttatcgttaagacgtcgcggttgt

SEQ ID NO: 3524 - DNA, 677 bp, Artificial Sequence
  chemically treated genomic DNA (Homo sapiens) CpG-island No: 3524
acaaccgcgacgtcttaacgataaccacgatcaccaacacattacccgccacgataaacaacacgataaacgccatcaacaaacccatacccgctatccactactaaaacaacgactcgaaactttcgctaacgaaaaacaacaacgaaacgaacgacgacgcgaacaccaacaaccgcgccgcgataaccgcgccgtcgaaaaacgatacgaccgacgacaaattaccgaactcgaaaacgcccaaaacgaacacccccgcgcccataccgaactacgaaaaccgaaaacgaaaaatataacaaaactaaaccgtaattaaaaaacaccccaaaaacccgaacgacgtaatacgcaaaaaaaaatcgcgaccgaatcaaaacaaccgcgacgcgaaaccgaaaacataaacgccgaacgcctttcccgcaaaaaccgaacgctatcgctaccgctaccgccgccgccgccgccgccgctactactaaaaccgctaccgctactaaaaaatccgccgaaacttcaacatatttctaaacgcgccgaacccgcaactccgacacccaacacccaccccaccccgctcccactccccaaaccaacccccgaaacctcgcgtcaaactcctacaaccaatccgaacaaaaacacgcccccgtctaatctacacccccacc

SEQ ID NO: 3525 - DNA, 1732 bp, Artificial Sequence
  chemically treated genomic DNA (Homo sapiens) CpG-island No: 3525
cgtggcgcgttttttttttgcgttttttttttttagggtttatttttcgcggacgtagagcgtttgtcggggggacggtaggttcgcgatggttgtttttgaggtagtcggttttttttcgtcgtgggtttgggaagcgttcgaaaggttcgttcggatcgtttgcggtgttgttcgtagggaaagcgtcgttgttagtcgggttgttacgggtgcgagtggaagaagtatatcgtaggatgagcgacgtcgttgtagaggtaatcgcggggattgcggttagagacgggggatgggcgtagtcgaggataacgggatggtcggtattcggaacgcgttaggttcgtttcgtcggatcgttttattttttagttcgcgtttttagtcgtttttttagatttcgatcgtagttttagaagtgacggttacgtgggtggcggcgcgcgtcgcggggattggaatgttggcgtggggggacgaggttggaagggtcgtagagaagtaaaggaggattcgcgttcgcgtgttcgggcgtcgattgttgggcgacgtcgtcgggagcgagtacgtttttgacgttacgcgttgttcgtttaatgagtggaggtttgagggaggcgtcggtttcggtttcgttgtcgtcgtcgttatatcggtttttcgggagcgtttgaggaggcgcgggtcgttgcgggttcgggcgtcgtagcgcgtcggttcgagtttttggacgaggtttacggagtcgttcgtttcgatttagtcgttcgatgtttttaaaatggaggtagcgggggcggcggcgtgaagaaagcggcgttgtgggcgcgggagtaggggttcgggcggaggcggtggcgggatggggttgttgtttatgattttggcgtcggtcgtgttgggttttttttttacgtttttcgtttagttttttttgttgtatcgtagatagttcgagtcgtcggcggacgaggtcgttcgcgcgggcgagggttttcgttatattaagttagtgtcgggtttgtttttaagggagtatttttatggcggcggtcgggatgaggagtttttcggagcggtttttgagggcggcgcgatttttatcgcggttttcgagattttcgtttcgtcgacgcgggagatttgttatttttttaacgttattattttatttttgtttcgggagttgcgggatatcgcgttgattcgtcgttgggttattaagaagattaaggtggagttcgaggagttgttgtagattaagacggtcgggcgtttgttggaggggttgagtttgcgggacgtgtttttgggcgagacggtgttttttattaagattattcggttcgtgcggttagtcgtgttttcggttatcggggagttcgatggttttgaaggggaggcgttgttcgtcgtttgtttcgaggagttggttttcgaggcggaggtggagtataacgggggtttttatttggttatcgacgtggatttggttttcggtaagttcgtttatttgtttgttaagttgtttcgcgtggtgggaaggttgcgtttggtttttacgcgcgtgttttttatttattggtttttttttttcgtggaagattcgttgatcgatttcgaggtgcgtttttagtttgaagggcggtttatgttttagtttatttttattatcgttaattagtttaagaagattattaagcgtaagtatattttatcgaattataagatt

SEQ ID NO: 3526 - DNA, 1732 bp, Artificial Sequence
  chemically treated genomic DNA (Homo sapiens) CpG-island No: 3526
aatcttataattcgataaaatatacttacgcttaataatcttcttaaactaattaacgataataaaaataaactaaaacataaaccgcccttcaaactaaaaacgcacctcgaaatcgatcaacgaatcttccacgaaaaaaaaaaaccaataaataaaaaacacgcgcgtaaaaaccaaacgcaaccttcccaccacgcgaaacaacttaacaaacaaataaacgaacttaccgaaaaccaaatccacgtcgataaccaaataaaaacccccgttatactccacctccgcctcgaaaaccaactcctcgaaacaaacgacgaacaacgcctccccttcaaaaccatcgaactccccgataaccgaaaacacgactaaccgcacgaaccgaataatcttaataaaaaacaccgtctcgcccaaaaacacgtcccgcaaactcaacccctccaacaaacgcccgaccgtcttaatctacaacaactcctcgaactccaccttaatcttcttaataacccaacgacgaatcaacgcgatatcccgcaactcccgaaacaaaaataaaataataacgttaaaaaaataacaaatctcccgcgtcgacgaaacgaaaatctcgaaaaccgcgataaaaatcgcgccgccctcaaaaaccgctccgaaaaactcctcatcccgaccgccgccataaaaatactcccttaaaaacaaacccgacactaacttaatataacgaaaaccctcgcccgcgcgaacgacctcgtccgccgacgactcgaactatctacgatacaacaaaaaaaactaaacgaaaaacgtaaaaaaaaaacccaacacgaccgacgccaaaatcataaacaacaaccccatcccgccaccgcctccgcccgaacccctactcccgcgcccacaacgccgctttcttcacgccgccgcccccgctacctccattttaaaaacatcgaacgactaaatcgaaacgaacgactccgtaaacctcgtccaaaaactcgaaccgacgcgctacgacgcccgaacccgcaacgacccgcgcctcctcaaacgctcccgaaaaaccgatataacgacgacgacaacgaaaccgaaaccgacgcctccctcaaacctccactcattaaacgaacaacgcgtaacgtcaaaaacgtactcgctcccgacgacgtcgcccaacaatcgacgcccgaacacgcgaacgcgaatcctcctttacttctctacgacccttccaacctcgtccccccacgccaacattccaatccccgcgacgcgcgccgccacccacgtaaccgtcacttctaaaactacgatcgaaatctaaaaaaacgactaaaaacgcgaactaaaaaataaaacgatccgacgaaacgaacctaacgcgttccgaataccgaccatcccgttatcctcgactacgcccatcccccgtctctaaccgcaatccccgcgattacctctacaacgacgtcgctcatcctacgatatacttcttccactcgcacccgtaacaacccgactaacaacgacgctttccctacgaacaacaccgcaaacgatccgaacgaacctttcgaacgcttcccaaacccacgacgaaaaaaaaccgactacctcaaaaacaaccatcgcgaacctaccgtccccccgacaaacgctctacgtccgcgaaaaataaaccctaaaaaaaaaaaacgcaaaaaaaaaacgcgccacg

SEQ ID NO: 3527 - DNA, 1732 bp, Artificial Sequence
  chemically treated genomic DNA (Homo sapiens) CpG-island No: 3527
gattttgtaattcggtagggtgtgtttgcgtttgatgatttttttgagttggttgacgatgatggaggtgagttggggtatgggtcgttttttaaattgggagcgtatttcgaagtcgattagcgggttttttacgaaggagaagaattagtgggtgaagggtacgcgcgtaaagattaagcgtagtttttttattacgcgggatagtttgataaataagtaggcggatttgtcgaagattaggtttacgtcgatggttaggtggaagttttcgttgtattttattttcgtttcgaaggttagtttttcggggtaggcggcgggtagcgttttttttttagggttatcgggtttttcggtggtcgagggtacgattggtcgtacgagtcggatggttttgatgaagggtatcgtttcgtttaggaatacgtttcgtaggtttagtttttttagtaggcgttcggtcgttttggtttgtagtagtttttcgaattttattttgatttttttggtgatttagcggcgggttagcgcggtgtttcgtaattttcggaataggaataggatggtggcgttgaggaagtagtaagtttttcgcgtcggcggggcgggggtttcgggggtcgcggtgggggtcgcgtcgtttttaggggtcgtttcggagggttttttatttcggtcgtcgttataaaggtatttttttaggagtaggttcggtattggtttgatgtagcggaagttttcgttcgcgcgggcggtttcgttcgtcggcggttcgggttgtttgcggtatagtaggaagaattgggcgaggagcgtgaggaaggaatttagtacggtcgacgttaggattatgagtagtagttttatttcgttatcgttttcgttcgggtttttattttcgcgtttatagcgtcgttttttttacgtcgtcgttttcgttgtttttattttgaggatatcgggcggttgggtcggggcgagcggtttcgtgggtttcgtttaggggttcgggtcggcgcgttgcggcgttcgagttcgtagcggttcgcgtttttttagacgttttcgaagggtcggtgtggcggcggcggtagcggggtcgggatcggcgttttttttaggtttttatttattggacgagtagcgcgtgacgttagaggcgtgttcgttttcggcggcgtcgtttagtagtcggcgttcgggtacgcggacgcgggtttttttttatttttttgcggtttttttaatttcgtttttttacgttaatattttaattttcgcggcgcgcgtcgttatttacgtggtcgttatttttggagttgcggtcgggatttgggaggacggttggggacgcgggttggaggataaggcggttcggcggagcgggtttgacgcgtttcggatgtcggttatttcgttattttcggttgcgtttatttttcgtttttggtcgtagttttcgcggttatttttgtagcggcgtcgtttattttgcggtgtgttttttttattcgtattcgtgatagttcggttggtagcggcgttttttttgcgggtagtatcgtagacgattcgagcgggtttttcggacgttttttaagtttacggcgagaggggatcgattgttttagaggtagttatcgcggatttgtcgttttttcggtagacgttttgcgttcgcggagggtgggttttgggaaggagggacgtagggaaagggcgcgttacg

SEQ ID NO: 3528 - DNA, 1732 bp, Artificial Sequence
  chemically treated genomic DNA (Homo sapiens) CpG-island No: 3528
cgtaacgcgccctttccctacgtccctccttcccaaaacccaccctccgcgaacgcaaaacgtctaccgaaaaaacgacaaatccgcgataactacctctaaaacaatcgatcccctctcgccgtaaacttaaaaaacgtccgaaaaacccgctcgaatcgtctacgatactacccgcaaaaaaaacgccgctaccaaccgaactatcacgaatacgaataaaaaaaacacaccgcaaaataaacgacgccgctacaaaaataaccgcgaaaactacgaccaaaaacgaaaaataaacgcaaccgaaaataacgaaataaccgacatccgaaacgcgtcaaacccgctccgccgaaccgccttatcctccaacccgcgtccccaaccgtcctcccaaatcccgaccgcaactccaaaaataacgaccacgtaaataacgacgcgcgccgcgaaaattaaaatattaacgtaaaaaaacgaaattaaaaaaaccgcaaaaaaataaaaaaaaacccgcgtccgcgtacccgaacgccgactactaaacgacgccgccgaaaacgaacacgcctctaacgtcacgcgctactcgtccaataaataaaaacctaaaaaaaacgccgatcccgaccccgctaccgccgccgccacaccgacccttcgaaaacgtctaaaaaaacgcgaaccgctacgaactcgaacgccgcaacgcgccgacccgaacccctaaacgaaacccacgaaaccgctcgccccgacccaaccgcccgatatcctcaaaataaaaacaacgaaaacgacgacgtaaaaaaaacgacgctataaacgcgaaaataaaaacccgaacgaaaacgataacgaaataaaactactactcataatcctaacgtcgaccgtactaaattccttcctcacgctcctcgcccaattcttcctactataccgcaaacaacccgaaccgccgacgaacgaaaccgcccgcgcgaacgaaaacttccgctacatcaaaccaataccgaacctactcctaaaaaaatacctttataacgacgaccgaaataaaaaaccctccgaaacgacccctaaaaacgacgcgacccccaccgcgacccccgaaacccccgccccgccgacgcgaaaaacttactacttcctcaacgccaccatcctattcctattccgaaaattacgaaacaccgcgctaacccgccgctaaatcaccaaaaaaatcaaaataaaattcgaaaaactactacaaaccaaaacgaccgaacgcctactaaaaaaactaaacctacgaaacgtattcctaaacgaaacgatacccttcatcaaaaccatccgactcgtacgaccaatcgtaccctcgaccaccgaaaaacccgataaccctaaaaaaaaaacgctacccgccgcctaccccgaaaaactaaccttcgaaacgaaaataaaatacaacgaaaacttccacctaaccatcgacgtaaacctaatcttcgacaaatccgcctacttatttatcaaactatcccgcgtaataaaaaaactacgcttaatctttacgcgcgtacccttcacccactaattcttctccttcgtaaaaaacccgctaatcgacttcgaaatacgctcccaatttaaaaaacgacccataccccaactcacctccatcatcgtcaaccaactcaaaaaaatcatcaaacgcaaacacaccctaccgaattacaaaatc

SEQ ID NO: 3529 - DNA, 571 bp, Artificial Sequence
  chemically treated genomic DNA (Homo sapiens) CpG-island No: 3529
tttaggggtgcgcgagcggggtcggaattaagaagttttttttggggtgggcggggatcgatttagagtttttattgcggggtatcgtttttttttttcgtcggtcgttcgttaggaggcgttggggagtttgtagtttatttgcgaggcggtttcgttttttttattttttagttcgcgttcggcggagagattataattttcggagtgttttgggaacggagttacgggagttataggcggagggattcgagggcgggtttttcgggtgtgtgttttcggcgtcggcggtcgcggtcggggacggtgtgagagcggtaagatggcggcggcggcggtggtggagttttagagagtttagtttttatttagtatcgatcgggaggtttttatcgatattttttattttatcggtaaaggtcgtcgcgtcgttttttcggtttcgtcggtttagttcggtttatgtcggtcggcggtagcggagaggggttcggttagtcggttttgatgttgttgatttattgtgtgaggggggtcgggtcgggggcgtaggtcgttcggagttttttag

SEQ ID NO: 3530 - DNA, 571 bp, Artificial Sequence
  chemically treated genomic DNA (Homo sapiens) CpG-island No: 3530
ctaaaaaactccgaacgacctacgcccccgacccgacccccctcacacaataaatcaacaacatcaaaaccgactaaccgaacccctctccgctaccgccgaccgacataaaccgaactaaaccgacgaaaccgaaaaaacgacgcgacgacctttaccgataaaataaaaaatatcgataaaaacctcccgatcgatactaaataaaaactaaactctctaaaactccaccaccgccgccgccgccatcttaccgctctcacaccgtccccgaccgcgaccgccgacgccgaaaacacacacccgaaaaacccgccctcgaatccctccgcctataactcccgtaactccgttcccaaaacactccgaaaattataatctctccgccgaacgcgaactaaaaaataaaaaaaacgaaaccgcctcgcaaataaactacaaactccccaacgcctcctaacgaacgaccgacgaaaaaaaaaaacgataccccgcaataaaaactctaaatcgatccccgcccaccccaaaaaaaacttcttaattccgaccccgctcgcgcacccctaaa

SEQ ID NO: 3531 - DNA, 571 bp, Artificial Sequence
  chemically treated genomic DNA (Homo sapiens) CpG-island No: 3531
ttggggagtttcgagcggtttgcgttttcggttcggttttttttatatagtgagttagtagtattagagtcggttagtcgggttttttttcgttgtcgtcgatcgatataagtcgagttgggtcggcggggtcggggaggcggcgcggcgatttttatcgatggagtggaggatgtcgatggaggtttttcggtcggtgttgagtagagattgggttttttggaattttattatcgtcgtcgtcgttattttatcgtttttatatcgttttcggtcgcggtcgtcgacgtcggaaatatatattcggaaagttcgttttcgggttttttcgtttgtagttttcgtggtttcgtttttagagtatttcgggagttgtagttttttcgtcgggcgcgggttgaggggtggggagagcgggatcgtttcgtaggtgggttgtaagttttttagcgttttttagcgggcggtcggcgaggaaaagaggcggtgtttcgtagtgggagttttagatcggttttcgtttattttaaaagaggttttttgatttcggtttcgttcgcgtatttttgag

SEQ ID NO: 3532 - DNA, 571 bp, Artificial Sequence
  chemically treated genomic DNA (Homo sapiens) CpG-island No: 3532
ctcaaaaatacgcgaacgaaaccgaaatcaaaaaacctcttttaaaataaacgaaaaccgatctaaaactcccactacgaaacaccgcctcttttcctcgccgaccgcccgctaaaaaacgctaaaaaacttacaacccacctacgaaacgatcccgctctccccacccctcaacccgcgcccgacgaaaaaactacaactcccgaaatactctaaaaacgaaaccacgaaaactacaaacgaaaaaacccgaaaacgaactttccgaatatatatttccgacgtcgacgaccgcgaccgaaaacgatataaaaacgataaaataacgacgacgacgataataaaattccaaaaaacccaatctctactcaacaccgaccgaaaaacctccatcgacatcctccactccatcgataaaaatcgccgcgccgcctccccgaccccgccgacccaactcgacttatatcgatcgacgacaacgaaaaaaaacccgactaaccgactctaatactactaactcactatataaaaaaaaccgaaccgaaaacgcaaaccgctcgaaactccccaa

SEQ ID NO: 3533 - DNA, 744 bp, Artificial Sequence
  chemically treated genomic DNA (Homo sapiens) CpG-island No: 3533
cgttgttaattagtttgcgttcgttgtttttcggggaggggggttttagggtttttcggcgtcgcggtttttaagatttcgagttttacgcgagtcgtcggtttttttatcgcgcggtttagtgttttttttttggttttcgggtttcgcgagtcgggtaggggttgggagtttcgtatggtttagattagagaggcgggaagtaagggcgagtagttcggtttttagtcgaggttcgataattaggagggttcgtttggtttcgtcgtgttcgaagattaggacgttttacgatcgggtttggttattttttgtcggcgttcgtttttaggtagcggtttttacggattttcggtcgtagagtttcgttttttaagttttgtttttagttgtgcgcgttgtttatttgggagtttcggtttcgaggtcgtaggcgtatacgcgttttataggtttacgtttcgtttttttattatgtttattacgcggttttgtatttttaggttttgggtacggtttttttgtttattcgttttttttgtttcggtttagggggtcgcgggcgttggattcggtttggcgcgtttcgaagtcggtcgcggaggttaggggtgaggattgggaggaagttcggtggtcgggtgcggggcggcggcggtagggaagtgttgggtcggtttttgagtggagtcgagttcggttcgggttttgatagagtttaggtcgggttgtaaggtgttaggt

SEQ ID NO: 3534 - DNA, 744 bp, Artificial Sequence
  chemically treated genomic DNA (Homo sapiens) CpG-island No: 3534
acctaacaccttacaacccgacctaaactctatcaaaacccgaaccgaactcgactccactcaaaaaccgacccaacacttccctaccgccgccgccccgcacccgaccaccgaacttcctcccaatcctcacccctaacctccgcgaccgacttcgaaacgcgccaaaccgaatccaacgcccgcgaccccctaaaccgaaacaaaaaaaacgaataaacaaaaaaaccgtacccaaaacctaaaaatacaaaaccgcgtaataaacataataaaaaaacgaaacgtaaacctataaaacgcgtatacgcctacgacctcgaaaccgaaactcccaaataaacaacgcgcacaactaaaaacaaaacttaaaaaacgaaactctacgaccgaaaatccgtaaaaaccgctacctaaaaacgaacgccgacaaaaaataaccaaacccgatcgtaaaacgtcctaatcttcgaacacgacgaaaccaaacgaaccctcctaattatcgaacctcgactaaaaaccgaactactcgcccttacttcccgcctctctaatctaaaccatacgaaactcccaacccctacccgactcgcgaaacccgaaaaccaaaaaaaaaacactaaaccgcgcgataaaaaaaccgacgactcgcgtaaaactcgaaatcttaaaaaccgcgacgccgaaaaaccctaaaacccccctccccgaaaaacaacgaacgcaaactaattaacaacg

SEQ ID NO: 3535 - DNA, 744 bp, Artificial Sequence
  chemically treated genomic DNA (Homo sapiens) CpG-island No: 3535
gtttggtattttgtagttcggtttgggttttgttaaggttcgagtcggattcggttttatttagaggtcggtttagtatttttttgtcgtcgtcgtttcgtattcggttatcgggtttttttttagtttttatttttgattttcgcggtcgatttcgaggcgcgttaggtcgggtttagcgttcgcggttttttgggtcgggataaggagggcgggtgagtagaagggtcgtgtttagggtttggaagtgtaaggtcgcgtggtgggtatggtagggaagcggagcgtgggtttgtgaggcgcgtgtgcgtttgcgatttcgggatcggggtttttaaatgaatagcgcgtatagttgggagtagggtttggggagcggggttttgcggtcggggattcgtagaagtcgttgtttggaagcgggcgtcggtagggggtggttagattcggtcgtggagcgttttagttttcgggtacggcggggttaggcgagtttttttggttgtcgagtttcggttgagagtcgggttgttcgtttttgtttttcgtttttttaatttaaattatgcggggtttttagtttttattcggttcgcggggttcgagggttaagaggagggtattgggtcgcgcggtggaggagtcggcggttcgcgtggggttcgggattttggggatcgcgacgtcggggaattttggagttttttttttcgggggatagcgggcgtagattgattgatagcg

SEQ ID NO: 3536 - DNA, 744 bp, Artificial Sequence
  chemically treated genomic DNA (Homo sapiens) CpG-island No: 3536
cgctatcaatcaatctacgcccgctatcccccgaaaaaaaaaactccaaaattccccgacgtcgcgatccccaaaatcccgaaccccacgcgaaccgccgactcctccaccgcgcgacccaataccctcctcttaaccctcgaaccccgcgaaccgaataaaaactaaaaaccccgcataatttaaattaaaaaaacgaaaaacaaaaacgaacaacccgactctcaaccgaaactcgacaaccaaaaaaactcgcctaaccccgccgtacccgaaaactaaaacgctccacgaccgaatctaaccaccccctaccgacgcccgcttccaaacaacgacttctacgaatccccgaccgcaaaaccccgctccccaaaccctactcccaactatacgcgctattcatttaaaaaccccgatcccgaaatcgcaaacgcacacgcgcctcacaaacccacgctccgcttccctaccatacccaccacgcgaccttacacttccaaaccctaaacacgacccttctactcacccgccctccttatcccgacccaaaaaaccgcgaacgctaaacccgacctaacgcgcctcgaaatcgaccgcgaaaatcaaaaataaaaactaaaaaaaaacccgataaccgaatacgaaacgacgacgacaaaaaaatactaaaccgacctctaaataaaaccgaatccgactcgaaccttaacaaaacccaaaccgaactacaaaataccaaac

SEQ ID NO: 3537 - DNA, 786 bp, Artificial Sequence
  chemically treated genomic DNA (Homo sapiens) CpG-island No: 3537
ttttcgtttttttttatttttcgttcgatttttttttttttagttcgttgtcgtttagttcgcggtattttgagggttacgtcgtatagtttgttttgtcgtcggattttttttatgacgtcgtagtcgcgattaggtaatttagatacggagaagtgtattagattttttagttttttcgcgtcgttttttattatttttttcggtcgttgtaattgcgtaggtttcgtcggtcggttagatattaattagggcggggcgatagcgtacgtcgatagtcgttcggagcgcggagtagtaatcggacgggttttcgcggtcgtcgtagttgaattttttcggcgtcggaagtttcgttatttcgttttttggtttatgtgcggttttcgttttttcgttatttcgattttgatttcgtatgtgtattcgtcgaagtttttttagattaatcggttttatttttcgttttttcgattcggttatgattttattcgtattttcgacgtaggatttcggattttattttcgttatttcgatattttcggaattttcggaagcgattcgttgttatggcgattatgtatatagttaggtagtttcgcgtggggagtgtaggtggtttcggttgcggtagtcgcgtttcgggagcgtcgttgtttggtgaacggtgagtaggggttgttcgtcggtgggagtggggagacgggaaaagggtgtgcgttcggattgttgaaagtggttggggtttaaaaatcgttttatttgggggtttttagttgggtcgt

SEQ ID NO: 3538 - DNA, 786 bp, Artificial Sequence
  chemically treated genomic DNA (Homo sapiens) CpG-island No: 3538
acgacccaactaaaaacccccaaataaaacgatttttaaaccccaaccactttcaacaatccgaacgcacacccttttcccgtctccccactcccaccgacgaacaacccctactcaccgttcaccaaacaacgacgctcccgaaacgcgactaccgcaaccgaaaccacctacactccccacgcgaaactacctaactatatacataatcgccataacaacgaatcgcttccgaaaattccgaaaatatcgaaataacgaaaataaaatccgaaatcctacgtcgaaaatacgaataaaatcataaccgaatcgaaaaaacgaaaaataaaaccgattaatctaaaaaaacttcgacgaatacacatacgaaatcaaaatcgaaataacgaaaaaacgaaaaccgcacataaaccaaaaaacgaaataacgaaacttccgacgccgaaaaaattcaactacgacgaccgcgaaaacccgtccgattactactccgcgctccgaacgactatcgacgtacgctatcgccccgccctaattaatatctaaccgaccgacgaaacctacgcaattacaacgaccgaaaaaaataataaaaaacgacgcgaaaaaactaaaaaatctaatacacttctccgtatctaaattacctaatcgcgactacgacgtcataaaaaaaatccgacgacaaaacaaactatacgacgtaaccctcaaaataccgcgaactaaacgacaacgaactaaaaaaaaaaaaatcgaacgaaaaataaaaaaaaacgaaaa

SEQ ID NO: 3539 - DNA, 786 bp, Artificial Sequence
  chemically treated genomic DNA (Homo sapiens) CpG-island No: 3539
gcgatttagttgggaatttttagataaagcggtttttggattttagttatttttagtagttcgggcgtatatttttttttcgtttttttatttttatcggcgagtagtttttgtttatcgtttattaggtagcgacgttttcgggacgcgattgtcgtaatcgaaattatttgtattttttacgcggggttgtttggttgtgtatatagtcgttatggtaacgggtcgttttcggggatttcggaagtgtcggggtggcggaaatgaagttcgaggttttacgtcgaggatacgggtgaggttatggtcgaatcgggaagacgagagatggggtcgattgatttagaaagatttcggcggatgtatatgcgaagttaaggtcgagatagcgagggaacgaaggtcgtatatgaattaggaagcggagtggcggggttttcggcgtcgaggagatttaattacggcggtcgcggaggttcgttcgattgttgtttcgcgtttcgagcggttgtcggcgtgcgttatcgtttcgttttggttagtgtttagtcggtcggcgaggtttgcgtagttgtagcggtcggggaagatggtggaggacggcgcggaggagttggaggatttggtgtattttttcgtgtttgagttgtttagtcgcggttacggcgttatggaggagattcggcggtagggtaagttgtgcgacgtgatttttaaggtatcgcggattgggcggtagcgggttgagggaaaaggggtcgagcggggagtaaaaaggggcggggg

SEQ ID NO: 3540 - DNA, 786 bp, Artificial Sequence
  chemically treated genomic DNA (Homo sapiens) CpG-island No: 3540
cccccgcccctttttactccccgctcgaccccttttccctcaacccgctaccgcccaatccgcgataccttaaaaatcacgtcgcacaacttaccctaccgccgaatctcctccataacgccgtaaccgcgactaaacaactcaaacacgaaaaaatacaccaaatcctccaactcctccgcgccgtcctccaccatcttccccgaccgctacaactacgcaaacctcgccgaccgactaaacactaaccaaaacgaaacgataacgcacgccgacaaccgctcgaaacgcgaaacaacaatcgaacgaacctccgcgaccgccgtaattaaatctcctcgacgccgaaaaccccgccactccgcttcctaattcatatacgaccttcgttccctcgctatctcgaccttaacttcgcatatacatccgccgaaatctttctaaatcaatcgaccccatctctcgtcttcccgattcgaccataacctcacccgtatcctcgacgtaaaacctcgaacttcatttccgccaccccgacacttccgaaatccccgaaaacgacccgttaccataacgactatatacacaaccaaacaaccccgcgtaaaaaatacaaataatttcgattacgacaatcgcgtcccgaaaacgtcgctacctaataaacgataaacaaaaactactcgccgataaaaataaaaaaacgaaaaaaaaatatacgcccgaactactaaaaataactaaaatccaaaaaccgctttatctaaaaattcccaactaaatcgc

SEQ ID NO: 3541 - DNA, 578 bp, Artificial Sequence
  chemically treated genomic DNA (Homo sapiens) CpG-island No: 3541
ggttcgggatttgtatcgcggtaggaatgttcgcggtatgtataagcgatgatggttagtaatagacggtaagtgtatcgtagtttgcggtatgtaacggttttatagttgaaattagcggggcggattcgcgtttcgaattattgaacgcgacggtaaattaggattattagcgcgacggtaaaagttataaaatcgtgtaggattcgtttcgatttagttaggcgggattggcggtaatttatgatgtcgaattcggtagtaatttgacggtttttggcgaagtatgtcgattcgatatagttgacggtagtttatttaacgttttcgattttttagttacgttagaattattaatttggttaacgggcgaatgatcgtggtgcgtattaatgatcgcggtttttacggtaacgatcgcgttattttattttttcgcgcgggaagttgatcgttttaatacgttaaataatattaaagttcggaacgaaatcgaatattggtgttttagaagggttttttttttgggttcggtaatggtttggattataaggcgttaaaaaagaatttaagttttt

SEQ ID NO: 3542 - DNA, 578 bp, Artificial Sequence
  chemically treated genomic DNA (Homo sapiens) CpG-island No: 3542
aaaaacttaaattcttttttaacgccttataatccaaaccattaccgaacccaaaaaaaaaacccttctaaaacaccaatattcgatttcgttccgaactttaatattatttaacgtattaaaacgatcaacttcccgcgcgaaaaaataaaataacgcgatcgttaccgtaaaaaccgcgatcattaatacgcaccacgatcattcgcccgttaaccaaattaataattctaacgtaactaaaaaatcgaaaacgttaaataaactaccgtcaactatatcgaatcgacatacttcgccaaaaaccgtcaaattactaccgaattcgacatcataaattaccgccaatcccgcctaactaaatcgaaacgaatcctacacgattttataacttttaccgtcgcgctaataatcctaatttaccgtcgcgttcaataattcgaaacgcgaatccgccccgctaatttcaactataaaaccgttacataccgcaaactacgatacacttaccgtctattactaaccatcatcgcttatacataccgcgaacattcctaccgcgatacaaatcccgaacc

SEQ ID NO: 3543 - DNA, 578 bp, Artificial Sequence
  chemically treated genomic DNA (Homo sapiens) CpG-island No: 3543
aggagtttaagtttttttttggcgttttgtggtttaagttattgtcgggtttagaaaggggatttttttggggtattaatattcggtttcgtttcgaattttggtgttgtttgacgtgttaagacggttagtttttcgcgcgagaaagtgaaataacgcggtcgttgtcgtaagggtcgcgattattaatgcgtattacgattattcgttcgttagttaggttagtgattttggcgtagttgggggatcggaagcgttggatgggttgtcgttagttgtgtcggatcgatatgtttcgttagaggtcgttaggttattgtcgggttcggtattatagattgtcgttagtttcgtttggttaaatcgagacggattttgtacgattttgtagtttttatcgtcgcgttggtaattttgatttgtcgtcgcgtttagtggttcgaaacgcgggttcgtttcgttaattttaattatagggtcgttatatatcgtaggttgcggtatatttatcgtttgttgttgattattatcgtttgtatatgtcgcgagtatttttgtcgcgatgtagatttcgagtt

SEQ ID NO: 3544 - DNA, 578 bp, Artificial Sequence
  chemically treated genomic DNA (Homo sapiens) CpG-island No: 3544
aactcgaaatctacatcgcgacaaaaatactcgcgacatatacaaacgataataatcaacaacaaacgataaatataccgcaacctacgatatataacgaccctataattaaaattaacgaaacgaacccgcgtttcgaaccactaaacgcgacgacaaatcaaaattaccaacgcgacgataaaaactacaaaatcgtacaaaatccgtctcgatttaaccaaacgaaactaacgacaatctataataccgaacccgacaataacctaacgacctctaacgaaacatatcgatccgacacaactaacgacaacccatccaacgcttccgatcccccaactacgccaaaatcactaacctaactaacgaacgaataatcgtaatacgcattaataatcgcgacccttacgacaacgaccgcgttatttcactttctcgcgcgaaaaactaaccgtcttaacacgtcaaacaacaccaaaattcgaaacgaaaccgaatattaataccccaaaaaaatcccctttctaaacccgacaataacttaaaccacaaaacgccaaaaaaaaacttaaactcct

SEQ ID NO: 3545 - DNA, 789 bp, Artificial Sequence
  chemically treated genomic DNA (Homo sapiens) CpG-island No: 3545
gtcgtcggggtcgttcggcgttttttttatgttcgttcgtttgttcgttcgtcgcggtgttcggtgttcgtcgtcgtcgttcgcgtcgtcgttggttcgggatcgcgggtagtcggagtttatattcggggacggaggcgttcgttcgttcgttcgtttcgcgttcgtcgcgtcgcgtcgtacgtcggtttcgttttggcgacgttgcgcgttcgtcgtcgtttttcgtttttcgttcgtttcgagtcgtttacggttcgcgtcgcgtcgcgtttcggcgggtttgtagttcggcgcgcggttttgttcggtattatttgcgcgttcggggtggtcgtcgcgtgggattcggggtgtcgttattttagtttggttcggttgatttgcgggttttaaagggttaagcgcgttttagcggcgggttgttcggttaatttttttcgcgtcgtacggtgcgtttttttttcgggattcggaggaggtaggcggcgttagtgtttttcgcggcgttggggtgcggatgaatcgttttttttcgcgtatttttgggttgggggatagttcgggttttcgcgtcggtttcgatttcgcgtcggttttttttgcgtatatttggaggaggtttcgttttttgggagtttaggtgttagcgggcggtagttgttgcggttttcgagtttattttcgttaaggttcggtcgggttttttggttgtttcggagcggggtaggcgttttttgttttttttcggttttttttggaatcgggggggttggggtagttcgggtt

SEQ ID NO: 3546 - DNA, 789 bp, Artificial Sequence
  chemically treated genomic DNA (Homo sapiens) CpG-island No: 3546
aacccgaactaccccaacccccccgattccaaaaaaaaccgaaaaaaaacaaaaaacgcctaccccgctccgaaacaaccaaaaaacccgaccgaaccttaacgaaaataaactcgaaaaccgcaacaactaccgcccgctaacacctaaactcccaaaaaacgaaacctcctccaaatatacgcaaaaaaaaccgacgcgaaatcgaaaccgacgcgaaaacccgaactatcccccaacccaaaaatacgcgaaaaaaaacgattcatccgcaccccaacgccgcgaaaaacactaacgccgcctacctcctccgaatcccgaaaaaaaaacgcaccgtacgacgcgaaaaaaattaaccgaacaacccgccgctaaaacgcgcttaaccctttaaaacccgcaaatcaaccgaaccaaactaaaataacgacaccccgaatcccacgcgacgaccaccccgaacgcgcaaataataccgaacaaaaccgcgcgccgaactacaaacccgccgaaacgcgacgcgacgcgaaccgtaaacgactcgaaacgaacgaaaaacgaaaaacgacgacgaacgcgcaacgtcgccaaaacgaaaccgacgtacgacgcgacgcgacgaacgcgaaacgaacgaacgaacgaacgcctccgtccccgaatataaactccgactacccgcgatcccgaaccaacgacgacgcgaacgacgacgacgaacaccgaacaccgcgacgaacgaacaaacgaacgaacataaaaaaaacgccgaacgaccccgacgac

SEQ ID NO: 3547 - DNA, 789 bp, Artificial Sequence
  chemically treated genomic DNA (Homo sapiens) CpG-island No: 3547
gattcgggttattttaattttttcgattttagaaagggtcggagaaaagtagggggcgtttgtttcgtttcggagtagttagggagttcggtcgagttttgacgaggatgagttcggagatcgtagtagttatcgttcgttagtatttgagtttttagggggcggggttttttttaggtgtgcgtagaggaggtcggcgcggagtcggggtcggcgcgggagttcgagttgttttttagtttagaaatgcgcggggaggagcggtttattcgtattttagcgtcgcgggagatattggcgtcgtttgtttttttcgggtttcggggggagagcgtatcgtgcggcgcggagggggttaatcgggtagttcgtcgttggagcgcgtttaattttttggagttcgtaggttagtcgggttaggttggggtggcggtatttcgagttttacgcgacggttatttcgagcgcgtaagtggtgtcgggtagaatcgcgcgtcgggttgtagattcgtcggggcgcggcgcggcgcgggtcgtgggcggttcggggcgggcggagggcgggggacggcggcgggcgcgtagcgtcgttagggcgaagtcggcgtgcggcgcggcgcggcgggcgcggagcgagcgggcgggcgagcgttttcgttttcggatgtgagtttcggttgttcgcggtttcgagttagcggcggcgcgggcggcggcggcgggtatcgggtatcgcggcgggcgggtagacgggcgggtatggggggagcgtcgagcggtttcggcggt

SEQ ID NO: 3548 - DNA, 789 bp, Artificial Sequence
  chemically treated genomic DNA (Homo sapiens) CpG-island No: 3548
accgccgaaaccgctcgacgctccccccatacccgcccgtctacccgcccgccgcgatacccgatacccgccgccgccgcccgcgccgccgctaactcgaaaccgcgaacaaccgaaactcacatccgaaaacgaaaacgctcgcccgcccgctcgctccgcgcccgccgcgccgcgccgcacgccgacttcgccctaacgacgctacgcgcccgccgccgtcccccgccctccgcccgccccgaaccgcccacgacccgcgccgcgccgcgccccgacgaatctacaacccgacgcgcgattctacccgacaccacttacgcgctcgaaataaccgtcgcgtaaaactcgaaataccgccaccccaacctaacccgactaacctacgaactccaaaaaattaaacgcgctccaacgacgaactacccgattaaccccctccgcgccgcacgatacgctctccccccgaaacccgaaaaaaacaaacgacgccaatatctcccgcgacgctaaaatacgaataaaccgctcctccccgcgcatttctaaactaaaaaacaactcgaactcccgcgccgaccccgactccgcgccgacctcctctacgcacacctaaaaaaaaccccgccccctaaaaactcaaatactaacgaacgataactactacgatctccgaactcatcctcgtcaaaactcgaccgaactccctaactactccgaaacgaaacaaacgccccctacttttctccgaccctttctaaaatcgaaaaaattaaaataacccgaatc

SEQ ID NO: 3549 - DNA, 701 bp, Artificial Sequence
  chemically treated genomic DNA (Homo sapiens) CpG-island No: 3549
cgagacgatggcgatggttcgcgcggatttagagtttttcggatattcgaagataagttatatttggcgttggaattcgttgcggggtaggggtttttttttttttttaatgaagtttttattttcgcggaagcgttttatggtttcgttttttagttggtagaagcgtatttcgttcgcgaatacgtttagggagacgttgatcggttttcgtaggcggttttcggattggtagtagtagaggatatcgtcgaagttgggtcggttgcggtcgaagaagtattcgttttttagggggtcgaagtagcgtaggcgtttggcggggttttttaggagtgtgttggggaattgcgttagggtgtttagttgcgttttaaagcgtagttcggagatgttgatgtggacgcgttggtggtgtagggacgtcgtgtttagagtttggttttttatcgtgtttaggtcgggatcgtttttttttttttcgttttcgggaggcggtcgtcgaggtcgtggtagtttttttggtagcggaggtaagggtcgtattttcgggttcggtagcggaggtaagggtcgtattttcgagttcgcgtttttttgcgcgtcgcgtttttttggcgtcggttttttgggtttatcgttgagtttagtcgtcgggggatattggagttttttttttgtggtttggtcgtagtttgttt

SEQ ID NO: 3550 - DNA, 701 bp, Artificial Sequence
  chemically treated genomic DNA (Homo sapiens) CpG-island No: 3550
aaacaaactacgaccaaaccacaaaaaaaaaactccaatatcccccgacgactaaactcaacgataaacccaaaaaaccgacgccaaaaaaacgcgacgcgcaaaaaaacgcgaactcgaaaatacgacccttacctccgctaccgaacccgaaaatacgacccttacctccgctaccaaaaaaactaccacgacctcgacgaccgcctcccgaaaacgaaaaaaaaaaaaacgatcccgacctaaacacgataaaaaaccaaactctaaacacgacgtccctacaccaccaacgcgtccacatcaacatctccgaactacgctttaaaacgcaactaaacaccctaacgcaattccccaacacactcctaaaaaaccccgccaaacgcctacgctacttcgaccccctaaaaaacgaatacttcttcgaccgcaaccgacccaacttcgacgatatcctctactactaccaatccgaaaaccgcctacgaaaaccgatcaacgtctccctaaacgtattcgcgaacgaaatacgcttctaccaactaaaaaacgaaaccataaaacgcttccgcgaaaataaaaacttcattaaaaaaaaaaaaaaacccctaccccgcaacgaattccaacgccaaatataacttatcttcgaatatccgaaaaactctaaatccgcgcgaaccatcgccatcgtctcg

SEQ ID NO: 3551 - DNA, 701 bp, Artificial Sequence
  chemically treated genomic DNA (Homo sapiens) CpG-island No: 3551
gggtaggttgcggttaggttatagggggagagttttagtgtttttcgacggttgggtttagcgatgggtttaaggagtcggcgttaaaggggcgcggcgcgtagagagacgcggattcgggagtgcggtttttgttttcgttgtcggattcgggagtgcggtttttgttttcgttgttagaggagttgttacggtttcgacggtcgtttttcgaggacgaggaggaagaaggcgatttcggtttgggtacggtggaggattaggttttgggtacggcgtttttgtattattagcgcgtttatattaatattttcgggttgcgttttgagacgtagttgggtattttggcgtagttttttaatatatttttgggggatttcgttaagcgtttgcgttatttcgattttttgaggaacgagtattttttcgatcgtaatcggtttagtttcgacggtattttttattattattagttcgggggtcgtttgcggaggtcggttaacgtttttttggacgtgttcgcggacgagatacgtttttattagttgggggacgaggttatggagcgttttcgcgaggatgagggttttattaaagaagaggagaagtttttgtttcgtaacgagttttagcgttaggtgtggtttattttcgagtattcggagagttttgggttcgcgcgggttatcgttatcgtttcg

SEQ ID NO: 3552 - DNA, 701 bp, Artificial Sequence
  chemically treated genomic DNA (Homo sapiens) CpG-island No: 3552
cgaaacgataacgataacccgcgcgaacccaaaactctccgaatactcgaaaataaaccacacctaacgctaaaactcgttacgaaacaaaaacttctcctcttctttaataaaaccctcatcctcgcgaaaacgctccataacctcgtcccccaactaataaaaacgtatctcgtccgcgaacacgtccaaaaaaacgttaaccgacctccgcaaacgacccccgaactaataataataaaaaataccgtcgaaactaaaccgattacgatcgaaaaaatactcgttcctcaaaaaatcgaaataacgcaaacgcttaacgaaatcccccaaaaatatattaaaaaactacgccaaaatacccaactacgtctcaaaacgcaacccgaaaatattaatataaacgcgctaataatacaaaaacgccgtacccaaaacctaatcctccaccgtacccaaaccgaaatcgccttcttcctcctcgtcctcgaaaaacgaccgtcgaaaccgtaacaactcctctaacaacgaaaacaaaaaccgcactcccgaatccgacaacgaaaacaaaaaccgcactcccgaatccgcgtctctctacgcgccgcgcccctttaacgccgactccttaaacccatcgctaaacccaaccgtcgaaaaacactaaaactctccccctataacctaaccgcaacctaccc

SEQ ID NO: 3553 - DNA, 597 bp, Artificial Sequence
  chemically treated genomic DNA (Homo sapiens) CpG-island No: 3553
ttttcgatttttttttcgtttttttttattcgcgttgcgggttaagttcgagggaagtagtttcgaagttttcgcggcggcggcggcggcggtcgcggattttttttaggttgttcgtaaagttcggtcggtcggaggtagtcgttaattttttttaatttttgtcgattcgttgggcgaagtaatacgttttttgcgcgttttttttaggggttgagtcgggtgagtgggggcggggtaggaggttcgttggagtcggcggcggttgggcgtagatcgagggtttttagcgttttcgggttcgtttttttttttagttttcgagggtttcggtcgtttttattttttggcgttgtatataatttacgtggaggttaggttcgcgcggggggtttagagaaagtcggcgtcgggcgaggtttttgtaggtttttagattcggtgcgcgtgtttttatttagggcgaggttcgggcgagatcgggttatagttaattcgtattttttttatttcggtttattttagttttttcgtttttttgttagtttttggattttttttcggcgaattacgatttggggaacgaaggggtgggtg

SEQ ID NO: 3554 - DNA, 597 bp, Artificial Sequence
  chemically treated genomic DNA (Homo sapiens) CpG-island No: 3554
cacccaccccttcgttccccaaatcgtaattcgccgaaaaaaaatccaaaaactaacaaaaaaacgaaaaaactaaaataaaccgaaataaaaaaaatacgaattaactataacccgatctcgcccgaacctcgccctaaataaaaacacgcgcaccgaatctaaaaacctacaaaaacctcgcccgacgccgactttctctaaaccccccgcgcgaacctaacctccacgtaaattatatacaacgccaaaaaataaaaacgaccgaaaccctcgaaaactaaaaaaaaaaacgaacccgaaaacgctaaaaaccctcgatctacgcccaaccgccgccgactccaacgaacctcctaccccgcccccactcacccgactcaacccctaaaaaaaacgcgcaaaaaacgtattacttcgcccaacgaatcgacaaaaattaaaaaaaattaacgactacctccgaccgaccgaactttacgaacaacctaaaaaaaatccgcgaccgccgccgccgccgccgcgaaaacttcgaaactacttccctcgaacttaacccgcaacgcgaataaaaaaaaacgaaaaaaaaatcgaaaa

SEQ ID NO: 3555 - DNA, 597 bp, Artificial Sequence
  chemically treated genomic DNA (Homo sapiens) CpG-island No: 3555
tatttattttttcgttttttaaatcgtaattcgtcgaggaaggatttaggaattggtagaggagcgggagagttggggtgggtcggggtggggagggtgcgagttaattgtggttcggtttcgttcggatttcgttttaggtgggagtacgcgtatcgggtttgagaatttgtaagagtttcgttcggcgtcggttttttttgggtttttcgcgcgggtttggtttttacgtaagttgtgtgtagcgttagggagtggaggcggtcgagattttcggagattaggggagggggcgggttcgggggcgttgggggttttcggtttgcgtttagtcgtcgtcggttttagcgaattttttatttcgtttttatttattcggtttagtttttaggagagacgcgtaggaagcgtgttgtttcgtttagcggatcggtagaagttgagaggagttggcggttgttttcggtcggtcggattttgcgagtagtttggagaggattcgcgatcgtcgtcgtcgtcgtcgcggaggtttcggggttgtttttttcgagtttagttcgtagcgcgggtggagaggggcggggagggggtcggggg

SEQ ID NO: 3556 - DNA, 597 bp, Artificial Sequence
  chemically treated genomic DNA (Homo sapiens) CpG-island No: 3556
cccccgaccccctccccgcccctctccacccgcgctacgaactaaactcgaaaaaaacaaccccgaaacctccgcgacgacgacgacgacgatcgcgaatcctctccaaactactcgcaaaatccgaccgaccgaaaacaaccgccaactcctctcaacttctaccgatccgctaaacgaaacaacacgcttcctacgcgtctctcctaaaaactaaaccgaataaataaaaacgaaataaaaaattcgctaaaaccgacgacgactaaacgcaaaccgaaaacccccaacgcccccgaacccgccccctcccctaatctccgaaaatctcgaccgcctccactccctaacgctacacacaacttacgtaaaaaccaaacccgcgcgaaaaacccaaaaaaaaccgacgccgaacgaaactcttacaaattctcaaacccgatacgcgtactcccacctaaaacgaaatccgaacgaaaccgaaccacaattaactcgcaccctccccaccccgacccaccccaactctcccgctcctctaccaattcctaaatccttcctcgacgaattacgatttaaaaaacgaaaaaataaata

SEQ ID NO: 3557 - DNA, 679 bp, Artificial Sequence
  chemically treated genomic DNA (Homo sapiens) CpG-island No: 3557
aagtcgttgcgtcgcggtttattaagtttattttttttcgcgtttttcgtaggtttttcgtagatagtcgtatagtattttttattttatttaattcgtttcgcgtgttttgaattatagaaaggtaaatttgttaataaagaggcggttcgttcgcgtgcggggttttcgggcgcgtttcgttggttaggtgaggacggcgggtattgggtatcgtagcggggcgcggggcgggttggaggcgcgcggatattttttcggtcggtaaggaaggggcgggtcgaggcgcgggtcgtgtgtcgttgggtggttttgcgagtcgtcgtttttcgtttttttaggtttagtttttattatcgcgtggcggagttcgtgttcgggttaggtgagcgcgggcggttgcggcgggagaagcgcgttcgcgtggggtggggcgtcgggggcgggggagggaggttgggggtttcggtaaggcgtcgttattttcgtcgttcgtagtttttgatggatcgtggcggggtcggcgggtagggggacgttggttgcggataggggtggggtaggtatttcgggggagtcgcggcgcgtgggagtacgcgttggtgtgtgtaggggttcgtagtagggggtttttaattatacgtttgagttcgttttttgtatttgtgttttgggaaga

SEQ ID NO: 3558 - DNA, 679 bp, Artificial Sequence
  chemically treated genomic DNA (Homo sapiens) CpG-island No: 3558
tcttcccaaaacacaaatacaaaaaacgaactcaaacgtataattaaaaaccccctactacgaacccctacacacaccaacgcgtactcccacgcgccgcgactcccccgaaatacctaccccacccctatccgcaaccaacgtccccctacccgccgaccccgccacgatccatcaaaaactacgaacgacgaaaataacgacgccttaccgaaacccccaacctccctcccccgcccccgacgccccaccccacgcgaacgcgcttctcccgccgcaaccgcccgcgctcacctaacccgaacacgaactccgccacgcgataataaaaactaaacctaaaaaaacgaaaaacgacgactcgcaaaaccacccaacgacacacgacccgcgcctcgacccgccccttccttaccgaccgaaaaaatatccgcgcgcctccaacccgccccgcgccccgctacgatacccaatacccgccgtcctcacctaaccaacgaaacgcgcccgaaaaccccgcacgcgaacgaaccgcctctttattaacaaatttacctttctataattcaaaacacgcgaaacgaattaaataaaataaaaaatactatacgactatctacgaaaaacctacgaaaaacgcgaaaaaaaataaacttaataaaccgcgacgcaacgactt

SEQ ID NO: 3559 - DNA, 679 bp, Artificial Sequence
  chemically treated genomic DNA (Homo sapiens) CpG-island No: 3559
tttttttaaggtataagtgtagaaggcggatttaggcgtgtggttaaggattttttgttgcgggtttttgtatatattaacgcgtgtttttacgcgtcgcgattttttcgggatgtttgttttatttttattcgtagttagcgtttttttgttcgtcggtttcgttacggtttattagggattgcgggcggcggaggtggcggcgttttgtcgggatttttagtttttttttttcgttttcggcgttttattttacgcgggcgcgtttttttcgtcgtagtcgttcgcgtttatttggttcggatacgggtttcgttacgcggtgatggaagttgagtttagagaggcggagagcggcggttcgtagggttatttagcggtatacggttcgcgtttcggttcgttttttttttgtcggtcgggggagtgttcgcgcgtttttagttcgtttcgcgtttcgttgcggtgtttagtgttcgtcgtttttatttggttagcgggacgcgttcgggaatttcgtacgcgggcgggtcgtttttttgttagtaagtttgtttttttgtgatttagagtacgcggagcgaattaagtggagtgaggggtattgtgcgattgtttgcgggaaatttgcggggagcgcgggaagggatggatttgatgagtcgcggcgtagcggttt

SEQ ID NO: 3560 - DNA, 679 bp, Artificial Sequence
  chemically treated genomic DNA (Homo sapiens) CpG-island No: 3560
aaaccgctacgccgcgactcatcaaatccatcccttcccgcgctccccgcaaatttcccgcaaacaatcgcacaatacccctcactccacttaattcgctccgcgtactctaaatcacaaaaaaacaaacttactaacaaaaaaacgacccgcccgcgtacgaaattcccgaacgcgtcccgctaaccaaataaaaacgacgaacactaaacaccgcaacgaaacgcgaaacgaactaaaaacgcgcgaacactcccccgaccgacaaaaaaaaaacgaaccgaaacgcgaaccgtataccgctaaataaccctacgaaccgccgctctccgcctctctaaactcaacttccatcaccgcgtaacgaaacccgtatccgaaccaaataaacgcgaacgactacgacgaaaaaaacgcgcccgcgtaaaataaaacgccgaaaacgaaaaaaaaaaactaaaaatcccgacaaaacgccgccacctccgccgcccgcaatccctaataaaccgtaacgaaaccgacgaacaaaaaaacgctaactacgaataaaaataaaacaaacatcccgaaaaaatcgcgacgcgtaaaaacacgcgttaatatatacaaaaacccgcaacaaaaaatccttaaccacacgcctaaatccgccttctacacttataccttaaaaaaa

SEQ ID NO: 3561 - DNA, 776 bp, Artificial Sequence
  chemically treated genomic DNA (Homo sapiens) CpG-island No: 3561
acggtttttttcggagttattttttggaggattttatttcgttcggtgttcgggtttcgtatttattttttttttttcggttcgtttttcgtacggcgtttattttgtttttcgttttttcgttttatcgtcgttttgtttatattgtttttcgtgggcgttttcggtcgtttttttttttcgggtttcggtttgggggtgtttagttcgttcggcgtcggtttaaggtcgcgcgatttcgtacgtttttgagattcgtttcgtcgttcgtcgttcgggtcgtatttatcgcgttcgtaggatttgggggttttcgttttgttcgcgtttcggtatcgtcgtcgtcgtcgtcgttagcggaaatagggggcggggtttgttcgggaatggcgagtttgcggggcggggcggttcgggggcggagcggggaggggcggggcggagcggggaggggcggggcggagaaggatcgtagggttgagcggggcgttagcgttagtgttcggtattgtttcgggttgggttttttgcgttagaggaaggggagttcggggacggggtacggggttcgcgaggtacgggtgttttttcggggtttcggaagttttttttttcgtttcgtcgttcgtatgttcggatcggtcgttttttcgaggtgttatgatttcgttttttttttgcggcgaacgggttttttttcggggtaggggcggggaggttcgggtttggtagtgcgtttttttgggttttgcgtttatacggtatttaagggtttt

SEQ ID NO: 3562 - DNA, 776 bp, Artificial Sequence
  chemically treated genomic DNA (Homo sapiens) CpG-island No: 3562
aaaacccttaaataccgtataaacgcaaaacccaaaaaaacgcactaccaaacccgaacctccccgcccctaccccgaaaaaaaacccgttcgccgcaaaaaaaaaacgaaatcataacacctcgaaaaaacgaccgatccgaacatacgaacgacgaaacgaaaaaaaaaacttccgaaaccccgaaaaaacacccgtacctcgcgaaccccgtaccccgtccccgaactccccttcctctaacgcaaaaaacccaacccgaaacaataccgaacactaacgctaacgccccgctcaaccctacgatccttctccgccccgcccctccccgctccgccccgcccctccccgctccgcccccgaaccgccccgccccgcaaactcgccattcccgaacaaaccccgccccctatttccgctaacgacgacgacgacgacgataccgaaacgcgaacaaaacgaaaacccccaaatcctacgaacgcgataaatacgacccgaacgacgaacgacgaaacgaatctcaaaaacgtacgaaatcgcgcgaccttaaaccgacgccgaacgaactaaacacccccaaaccgaaacccgaaaaaaaaaaacgaccgaaaacgcccacgaaaaacaatataaacaaaacgacgataaaacgaaaaaacgaaaaacaaaataaacgccgtacgaaaaacgaaccgaaaaaaaaaaaataaatacgaaacccgaacaccgaacgaaataaaatcctccaaaaaataactccgaaaaaaaccgt

SEQ ID NO: 3563 - DNA, 776 bp, Artificial Sequence
  chemically treated genomic DNA (Homo sapiens) CpG-island No: 3563
aaggtttttgggtgtcgtgtgggcgtagagtttaggagagcgtattgttaggttcggattttttcgtttttatttcgggaagaggttcgttcgtcgtagggggaaggcgggattatagtatttcggaggagcggtcggttcgggtatgcgggcggcggggcggggagggaggttttcggaatttcgagagagtattcgtgtttcgcgggtttcgtgtttcgttttcgggtttttttttttttaacgtaggggatttagttcggggtagtgtcgggtattggcgttggcgtttcgtttagttttgcgattttttttcgtttcgttttttttcgtttcgtttcgttttttttcgtttcgttttcgggtcgtttcgtttcgtaggttcgttattttcgggtaggtttcgttttttgttttcgttggcggcggcggcggcggcggtgtcggagcgcgagtagagcggagatttttaggttttgcgggcgcggtgagtgcggttcgggcggcgggcggcgaggcgggttttaagagcgtgcggagtcgcgcggttttgagtcggcgtcgggcgggttgggtatttttaggtcgagattcgagaagggggagcggtcgggggcgtttacgggaggtagtgtgggtagggcggcggtgggacgagaggacgaggaatagagtaggcgtcgtgcgggaagcgggtcgggaaggggagggtgggtgcggggttcgggtatcgagcgaagtggggttttttaggggatggtttcgaggaagatcgt

SEQ ID NO: 3564 - DNA, 776 bp, Artificial Sequence
  chemically treated genomic DNA (Homo sapiens) CpG-island No: 3564
acgatcttcctcgaaaccatcccctaaaaaaccccacttcgctcgatacccgaaccccgcacccaccctccccttcccgacccgcttcccgcacgacgcctactctattcctcgtcctctcgtcccaccgccgccctacccacactacctcccgtaaacgcccccgaccgctcccccttctcgaatctcgacctaaaaatacccaacccgcccgacgccgactcaaaaccgcgcgactccgcacgctcttaaaacccgcctcgccgcccgccgcccgaaccgcactcaccgcgcccgcaaaacctaaaaatctccgctctactcgcgctccgacaccgccgccgccgccgccgccaacgaaaacaaaaaacgaaacctacccgaaaataacgaacctacgaaacgaaacgacccgaaaacgaaacgaaaaaaaacgaaacgaaacgaaaaaaaacgaaacgaaaaaaaatcgcaaaactaaacgaaacgccaacgccaatacccgacactaccccgaactaaatcccctacgttaaaaaaaaaaaaacccgaaaacgaaacacgaaacccgcgaaacacgaatactctctcgaaattccgaaaacctccctccccgccccgccgcccgcatacccgaaccgaccgctcctccgaaatactataatcccgccttccccctacgacgaacgaacctcttcccgaaataaaaacgaaaaaatccgaacctaacaatacgctctcctaaactctacgcccacacgacacccaaaaacctt

SEQ ID NO: 3565 - DNA, 1115 bp, Artificial Sequence
  chemically treated genomic DNA (Homo sapiens) CpG-island No: 3565
atttcgttttttttgtttgcgttttcgttttttttagtttttttttcgcggcggggcgggattaatcgtttttcgagtcgtttttgatttatttattttagttttcgcgtcgcgtgtagaggtgtttaagttttttcgcggttcgtagttagtgtcgtcgcgttcggtttttcgtacgtttcgtaggtagcgttttcgttcgcggtttagagtgcgttcgcgtcggtattagttttcggataaacggcgcgtcgcgcggagatgatagtcgaggagatgaaggcgatcgagagcggggcgtagtcggcgtcgttgtttatggagggagtggatattagttttaaataggacgaaggcgtgttgaaggtgaggggcggcggggtttgcggaggcgtcggaattcggggtttcgcgggtcgttttttcgtcgcgttcggagttcgcggtcgggtacgggtcgaggcggtcgtttttgtagtttcgcggtcgtttcgtcgggggtcggtggtatcgtcgtttcggatcgggttgcgtcgtttaaggtatcgaggtcggttatgcgttcggtaggggggcggtttaggtgcgcgggtcgaggttttaggttttttagtcggtagcgttcgggttcgggtagggggtcgggattgtagtgtttatttcggcgcgcgcggggcggcggagaggggcggggcgaggcgatcgtcgcgggtattcgagtcgtagttcggggttaggtcgggttttttacgttacgtcgttttcgatttcgcggttttagcggagttgttagtcgcgggtcgtttcgttggtggcggtgttagggttcgtttattcgggcggtggaatacgggttaggacggggagcgattttttatagtgtttttttggttttcggtttttgtgcgacgtaggcgcgatagggtttcggcgttttttcggggttttttgtcgacgtcgggatttagcgaggtttttattcgtcgcgcggcgttttttttttcggtttcggggaggtcgggcgcggggtatgtcgggagttgtagttttttttttttttcgtcgtttttcggagttagggttgcggggtgtggggcggggaggaggcgttttgt

SEQ ID NO: 3566 - DNA, 1115 bp, Artificial Sequence
  chemically treated genomic DNA (Homo sapiens) CpG-island No: 3566
acaaaacgcctcctccccgccccacaccccgcaaccctaactccgaaaaacgacgaaaaaaaaaaaaaactacaactcccgacataccccgcgcccgacctccccgaaaccgaaaaaaaaaacgccgcgcgacgaataaaaacctcgctaaatcccgacgtcgacaaaaaaccccgaaaaaacgccgaaaccctatcgcgcctacgtcgcacaaaaaccgaaaaccaaaaaaacactataaaaaatcgctccccgtcctaacccgtattccaccgcccgaataaacgaaccctaacaccgccaccaacgaaacgacccgcgactaacaactccgctaaaaccgcgaaatcgaaaacgacgtaacgtaaaaaacccgacctaaccccgaactacgactcgaatacccgcgacgatcgcctcgccccgcccctctccgccgccccgcgcgcgccgaaataaacactacaatcccgaccccctacccgaacccgaacgctaccgactaaaaaacctaaaacctcgacccgcgcacctaaaccgcccccctaccgaacgcataaccgacctcgataccttaaacgacgcaacccgatccgaaacgacgataccaccgacccccgacgaaacgaccgcgaaactacaaaaacgaccgcctcgacccgtacccgaccgcgaactccgaacgcgacgaaaaaacgacccgcgaaaccccgaattccgacgcctccgcaaaccccgccgcccctcaccttcaacacgccttcgtcctatttaaaactaatatccactccctccataaacaacgacgccgactacgccccgctctcgatcgccttcatctcctcgactatcatctccgcgcgacgcgccgtttatccgaaaactaataccgacgcgaacgcactctaaaccgcgaacgaaaacgctacctacgaaacgtacgaaaaaccgaacgcgacgacactaactacgaaccgcgaaaaaacttaaacacctctacacgcgacgcgaaaactaaaataaataaatcaaaaacgactcgaaaaacgattaatcccgccccgccgcgaaaaaaaaactaaaaaaaacgaaaacgcaaacaaaaaaaacgaaat

SEQ ID NO: 3567 - DNA, 1115 bp, Artificial Sequence
  chemically treated genomic DNA (Homo sapiens) CpG-island No: 3567
gtagagcgtttttttttcgttttatatttcgtagttttggtttcgggaggcggcggaggggggaggggattatagttttcggtatgtttcgcgttcggttttttcggggtcgagggagggggcgtcgcgcggcgagtggggatttcgttgggtttcggcgtcggtaggggatttcgggagggcgtcggaattttgtcgcgtttgcgtcgtataaaggtcgaaggttaggaaagtattgtggggagtcgtttttcgttttggttcgtgttttatcgttcgggtgggcgagttttggtatcgttattaacgaggcggttcgcggttggtagtttcgttggggtcgcggggtcgggggcggcgtggcgtgggaggttcggtttggtttcgggttgcggttcgggtgttcgcggcggtcgtttcgtttcgttttttttcgtcgtttcgcgcgcgtcggggtgggtattgtaatttcgattttttgttcgggttcgggcgttgtcggttggggagtttggggtttcggttcgcgtatttaggtcgtttttttgtcgagcgtatggtcggtttcggtgttttaaacgacgtagttcggttcgggacggcgatgttatcggttttcggcgggacggtcgcgaggttgtaaaggcggtcgtttcgattcgtgttcggtcgcgggtttcgggcgcggcggaagggcggttcgcggggtttcgggtttcgacgttttcgtaggtttcgtcgttttttatttttagtacgttttcgttttgtttggggttgatgtttattttttttatgggtagcggcgtcgattgcgtttcgttttcggtcgtttttattttttcggttgttattttcgcgcggcgcgtcgtttattcgggagttggtgtcggcgcgagcgtattttgggtcgcgggcgggggcgttatttgcggggcgtgcgggaggtcgggcgcggcggtattgattgcggatcgcgaggaggtttgagtatttttgtacgcggcgcgagagttggggtaggtgggttaggagcggttcggggagcgattggtttcgtttcgtcgcgagggaggggttgggaggagcgggagcgtagatagagggggcggggt

SEQ ID NO: 3568 - DNA, 1115 bp, Artificial Sequence
  chemically treated genomic DNA (Homo sapiens) CpG-island No: 3568
accccgccccctctatctacgctcccgctcctcccaacccctccctcgcgacgaaacgaaaccaatcgctccccgaaccgctcctaacccacctaccccaactctcgcgccgcgtacaaaaatactcaaacctcctcgcgatccgcaatcaataccgccgcgcccgacctcccgcacgccccgcaaataacgcccccgcccgcgacccaaaatacgctcgcgccgacaccaactcccgaataaacgacgcgccgcgcgaaaataacaaccgaaaaaataaaaacgaccgaaaacgaaacgcaatcgacgccgctacccataaaaaaaataaacatcaaccccaaacaaaacgaaaacgtactaaaaataaaaaacgacgaaacctacgaaaacgtcgaaacccgaaaccccgcgaaccgcccttccgccgcgcccgaaacccgcgaccgaacacgaatcgaaacgaccgcctttacaacctcgcgaccgtcccgccgaaaaccgataacatcgccgtcccgaaccgaactacgtcgtttaaaacaccgaaaccgaccatacgctcgacaaaaaaacgacctaaatacgcgaaccgaaaccccaaactccccaaccgacaacgcccgaacccgaacaaaaaatcgaaattacaatacccaccccgacgcgcgcgaaacgacgaaaaaaaacgaaacgaaacgaccgccgcgaacacccgaaccgcaacccgaaaccaaaccgaacctcccacgccacgccgcccccgaccccgcgaccccaacgaaactaccaaccgcgaaccgcctcgttaataacgataccaaaactcgcccacccgaacgataaaacacgaaccaaaacgaaaaacgactccccacaatactttcctaaccttcgacctttatacgacgcaaacgcgacaaaattccgacgccctcccgaaatcccctaccgacgccgaaacccaacgaaatccccactcgccgcgcgacgccccctccctcgaccccgaaaaaaccgaacgcgaaacataccgaaaactataatcccctcccccctccgccgcctcccgaaaccaaaactacgaaatataaaacgaaaaaaaaacgctctac

SEQ ID NO: 3569 - DNA, 965 bp, Artificial Sequence
  chemically treated genomic DNA (Homo sapiens) CpG-island No: 3569
gcgcggggcgcgtaacgagtagttaaatagtcggagcggagagatcgaagggttagtgggcgtgggggtcgtagtcgaggttcgggtggaggggttttcgtcgtttttcggttttttttttcgtcgttcgtttcggttcggttcggtttcgtttcgtttcggcggttcggtttttcgttcgttcgcgcgcggcgtagtttttttttcgaggtgtcggtggtttcgtcgttatttttttcggttttttttttttcgtcgcggcgcgtattttattttagtttttatttcgcgtattttagcgtttttttcgtatattcgaggttagggggcgggagggtcgtagtttcggcgtcgtcgcgtttcgttaggtgagaggcgttcgcgttcgtcgtattcgtcggcgtttttacgggtcgcgcgttttacgtcgtcgtagtcgatcgttcgcgtcgcgtgttcggttgttttttttttttcgtcgttcgcgttttcgttttggatttttgcgtttcgacgcgtttcgtttcgatttttggttttttttcgcgtttcggcgttgttcgttgtttttttttcgttttttttttgttcgtttcgcgttttttttttcgttttcggttgatttatttttttaggaatagggattttcgtgttttttcgttagttttattttgggaaaattttttttttcgcgcgtttcgtttcgtttcgttgggcgtatcggggtcggtcggcgcggggtgggtttggtttcgcggtttcgtttttattgcgtcgttcgtcggtttcggtcggagttcggttttgcgcgttgacgttttgtcgttttcgtagaacgatcgtcgcggtcggaagagttggcgttcggggcggattttttggaattggtttagcgtatttattttattttttcgtattttgggatcggtaaggttggggcgcggggatttggtaggattttgtcg

SEQ ID NO: 3570 - DNA, 965 bp, Artificial Sequence
  chemically treated genomic DNA (Homo sapiens) CpG-island No: 3570
cgacaaaatcctaccaaatccccgcgccccaaccttaccgatcccaaaatacgaaaaaataaaataaatacgctaaaccaattccaaaaaatccgccccgaacgccaactcttccgaccgcgacgatcgttctacgaaaacgacaaaacgtcaacgcgcaaaaccgaactccgaccgaaaccgacgaacgacgcaataaaaacgaaaccgcgaaaccaaacccaccccgcgccgaccgaccccgatacgcccaacgaaacgaaacgaaacgcgcgaaaaaaaaaattttcccaaaataaaactaacgaaaaaacacgaaaatccctattcctaaaaaaataaatcaaccgaaaacgaaaaaaaaaacgcgaaacgaacaaaaaaaaaacgaaaaaaaaacaacgaacaacgccgaaacgcgaaaaaaaaccaaaaatcgaaacgaaacgcgtcgaaacgcaaaaatccaaaacgaaaacgcgaacgacgaaaaaaaaaaaacaaccgaacacgcgacgcgaacgatcgactacgacgacgtaaaacgcgcgacccgtaaaaacgccgacgaatacgacgaacgcgaacgcctctcacctaacgaaacgcgacgacgccgaaactacgaccctcccgccccctaacctcgaatatacgaaaaaaacgctaaaatacgcgaaataaaaactaaaataaaatacgcgccgcgacgaaaaaaaaaaaaccgaaaaaaataacgacgaaaccaccgacacctcgaaaaaaaaactacgccgcgcgcgaacgaacgaaaaaccgaaccgccgaaacgaaacgaaaccgaaccgaaccgaaacgaacgacgaaaaaaaaaaccgaaaaacgacgaaaacccctccacccgaacctcgactacgacccccacgcccactaacccttcgatctctccgctccgactatttaactactcgttacgcgccccgcgc

SEQ ID NO: 3571 - DNA, 965 bp, Artificial Sequence
  chemically treated genomic DNA (Homo sapiens) CpG-island No: 3571
cggtaaagttttattaagttttcgcgttttagttttatcggttttagggtgcgggaaggtgggatgggtgcgttaagttagttttaaggagttcgtttcgagcgttaattttttcggtcgcggcgatcgttttgcggggacgatagggcgttagcgcgtagagtcgggtttcggtcggggtcgacgggcggcgtagtgaaggcggggtcgcggggttaagtttatttcgcgtcgatcggtttcggtgcgtttagcggagcggagcggagcgcgcggagggaggagtttttttagaatgggattgacgggaaaatacggggatttttatttttggaggagtgagttaatcgggagcgaggaggggagcgcggggcggataggagggaagcgggagaggggtagcgagtagcgtcggagcgcggagggaagttagaggtcgggacggagcgcgtcggagcgtagaggtttaaggcgggaacgcgggcggcggaaagaaaagagtagtcgagtacgcggcgcgagcggtcggttgcggcggcgtggggcgcgcggttcgtgagggcgtcggcgggtgcggcgggcgcgggcgttttttatttggcgggacgcggcggcgtcggagttgcggttttttcgttttttggtttcgagtgtgcgaggaggacgttggaatgcgcggaatgagggttggaatgagatgcgcgtcgcggcgggagggagggagtcggagggagtggcggcggggttatcggtatttcggggaggagattgcgtcgcgcgcgggcgggcgaggggtcgggtcgtcggggcggggcggggtcgggtcgggtcggggcgggcggcgggggagggggtcgagggacggcggggatttttttattcgggtttcggttgcggtttttacgtttattagtttttcgattttttcgtttcgattgtttggttgttcgttgcgcgtttcgcgt

SEQ ID NO: 3572 - DNA, 965 bp, Artificial Sequence
  chemically treated genomic DNA (Homo sapiens) CpG-island No: 3572
acgcgaaacgcgcaacgaacaaccaaacaatcgaaacgaaaaaatcgaaaaactaataaacgtaaaaaccgcaaccgaaacccgaataaaaaaatccccgccgtccctcgaccccctcccccgccgcccgccccgacccgacccgaccccgccccgccccgacgacccgacccctcgcccgcccgcgcgcgacgcaatctcctccccgaaataccgataaccccgccgccactccctccgactccctccctcccgccgcgacgcgcatctcattccaaccctcattccgcgcattccaacgtcctcctcgcacactcgaaaccaaaaaacgaaaaaaccgcaactccgacgccgccgcgtcccgccaaataaaaaacgcccgcgcccgccgcacccgccgacgccctcacgaaccgcgcgccccacgccgccgcaaccgaccgctcgcgccgcgtactcgactactcttttctttccgccgcccgcgttcccgccttaaacctctacgctccgacgcgctccgtcccgacctctaacttccctccgcgctccgacgctactcgctacccctctcccgcttccctcctatccgccccgcgctcccctcctcgctcccgattaactcactcctccaaaaataaaaatccccgtattttcccgtcaatcccattctaaaaaaactcctccctccgcgcgctccgctccgctccgctaaacgcaccgaaaccgatcgacgcgaaataaacttaaccccgcgaccccgccttcactacgccgcccgtcgaccccgaccgaaacccgactctacgcgctaacgccctatcgtccccgcaaaacgatcgccgcgaccgaaaaaattaacgctcgaaacgaactccttaaaactaacttaacgcacccatcccaccttcccgcaccctaaaaccgataaaactaaaacgcgaaaacttaataaaactttaccg

SEQ ID NO: 3573 - DNA, 760 bp, Artificial Sequence
  chemically treated genomic DNA (Homo sapiens) CpG-island No: 3573
gtgcgaggagtcgttgcgtgcgtggcggttggtgcggtataggagatttttttgatcggattcgtttgttggtcgcgcggcgggcgaggtttaggtaaaaataaagttttttcgtttagtatcggtttcgcgaggcgttttagaggattaagttttagttcgcgttattttattttcgcgtaggcgcgtttaattttcgttcgtttttcgttttttagtaattttttcgtatcgttgggtttcggtaatagttaatgagataggagttacgagaatacggattaatcggcggcggcgatagtgtggaacgcggttgttaggaggcgggacgcggcggcgtgttagtttagttattttagcgacggcggggaagagtgtgtacgtggtgggggttttttcggtggcgggtatggaggtttcgcgttgtcggtttagttttagcggcgataggttagatagggtcgtggtaggtttttttttgagcgaggcggaggggcgaagcgagaaggcggaggtttttttcgggagttttgcggggagagggcgggattcgggatttggcgatttagggagggattggtttcggcggcgggaggcgattttttcgttttattttcgtgtggggattttttttttaagtggagcggcggtattatatttcgcgtcgtgggtagagatttttggtttaggtttttgtttaggaatttttggagttttcgtgacgggttttttcggtttttttgggtttcgggtttttttt

SEQ ID NO: 3574 - DNA, 760 bp, Artificial Sequence
  chemically treated genomic DNA (Homo sapiens) CpG-island No: 3574
aaaaaaaacccgaaacccaaaaaaaccgaaaaaacccgtcacgaaaactccaaaaattcctaaacaaaaacctaaaccaaaaatctctacccacgacgcgaaatataataccgccgctccacttaaaaaaaaaatccccacacgaaaataaaacgaaaaaatcgcctcccgccgccgaaaccaatccctccctaaatcgccaaatcccgaatcccgccctctccccgcaaaactcccgaaaaaaacctccgccttctcgcttcgcccctccgcctcgctcaaaaaaaaacctaccacgaccctatctaacctatcgccgctaaaactaaaccgacaacgcgaaacctccatacccgccaccgaaaaaacccccaccacgtacacactcttccccgccgtcgctaaaataactaaactaacacgccgccgcgtcccgcctcctaacaaccgcgttccacactatcgccgccgccgattaatccgtattctcgtaactcctatctcattaactattaccgaaacccaacgatacgaaaaaattactaaaaaacgaaaaacgaacgaaaattaaacgcgcctacgcgaaaataaaataacgcgaactaaaacttaatcctctaaaacgcctcgcgaaaccgatactaaacgaaaaaactttatttttacctaaacctcgcccgccgcgcgaccaacaaacgaatccgatcaaaaaaatctcctataccgcaccaaccgccacgcacgcaacgactcctcgcac

SEQ ID NO: 3575 - DNA, 760 bp, Artificial Sequence
  chemically treated genomic DNA (Homo sapiens) CpG-island No: 3575
gagggaaattcgaggtttagaggggtcgagggagttcgttacgaaaattttagaagtttttaagtagggatttgaattaaaggtttttgtttacggcgcgggatgtagtgtcgtcgttttatttgagaaaggggtttttatacgggagtagggcgagggggtcgtttttcgtcgtcgaaattagtttttttttgagtcgttaagtttcgagtttcgtttttttttcgtagggttttcggagaggattttcgttttttcgtttcgttttttcgtttcgtttaggaggagatttgttacggttttgtttgatttgtcgtcgttgggattgagtcggtagcgcgaagtttttatgttcgttatcgaggaagtttttattacgtatatattttttttcgtcgtcgttagagtggttaggttggtacgtcgtcgcgtttcgttttttggtaatcgcgttttatattgtcgtcgtcgtcgattggttcgtgttttcgtggtttttgttttattggttattgtcggggtttaacgatgcgggagggttgttaaggggcgggaggcgagcgggagttaaacgcgtttgcgcgggggtggggtgacgcgagttaaggtttggttttttggagcgtttcgcggggtcggtattgagcgggaagattttgtttttgtttgggtttcgttcgtcgcgcggttagtaggcgagttcggttagaggagttttttatatcgtattaatcgttacgtacgtaacggtttttcgtat

SEQ ID NO: 3576 - DNA, 760 bp, Artificial Sequence
  chemically treated genomic DNA (Homo sapiens) CpG-island No: 3576
atacgaaaaaccgttacgtacgtaacgattaatacgatataaaaaactcctctaaccgaactcgcctactaaccgcgcgacgaacgaaacccaaacaaaaacaaaatcttcccgctcaataccgaccccgcgaaacgctccaaaaaaccaaaccttaactcgcgtcaccccacccccgcgcaaacgcgtttaactcccgctcgcctcccgccccttaacaaccctcccgcatcgttaaaccccgacaataaccaataaaacaaaaaccacgaaaacacgaaccaatcgacgacgacgacaatataaaacgcgattaccaaaaaacgaaacgcgacgacgtaccaacctaaccactctaacgacgacgaaaaaaaatatatacgtaataaaaacttcctcgataacgaacataaaaacttcgcgctaccgactcaatcccaacgacgacaaatcaaacaaaaccgtaacaaatctcctcctaaacgaaacgaaaaaacgaaacgaaaaaacgaaaatcctctccgaaaaccctacgaaaaaaaaacgaaactcgaaacttaacgactcaaaaaaaaactaatttcgacgacgaaaaacgaccccctcgccctactcccgtataaaaacccctttctcaaataaaacgacgacactacatcccgcgccgtaaacaaaaacctttaattcaaatccctacttaaaaacttctaaaattttcgtaacgaactccctcgacccctctaaacctcgaatttccctc

SEQ ID NO: 3577 - DNA, 627 bp, Artificial Sequence
  chemically treated genomic DNA (Homo sapiens) CpG-island No: 3577
gggcgtgtcgtttggcgtgattagcgcggtaggaaaagcgggtttagggattcgggtttgttacgtcgttttcgcgcgtttttaaattttttttcggttcgtttatttacgcggcggggattttttcggttttttttcggttttacggttatttttttttttataagtcggtttgcggttcgttttattagttcgggtcggacggggtcgtagtttttggtagatcgtatagttttcgagttcggaatgtcgagataaggtcggcgtcgattggcgacgtttcgttacgtgattttaacgtttcgtcggcgttaattttaaatagcggaataaattgaaagtttcggtgttagattttattttcggtttcggttcgggatttttttttttttcgggatttttcggggtttttatttcgttcgtatcgtcggggattcggtcggttcggcgcgagttttcgttcggggttttggttcggtttttaggttggaggagttcggagttcgttttcggagttacggtttaacggcggcggcgattgtagtttggaggtgagcgggatgtagtaatggagttttaggtttggtttgggtataggcggggagtaaggttttcgggcgcggaggt

SEQ ID NO: 3578 - DNA, 627 bp, Artificial Sequence
  chemically treated genomic DNA (Homo sapiens) CpG-island No: 3578
acctccgcgcccgaaaaccttactccccgcctatacccaaaccaaacctaaaactccattactacatcccgctcacctccaaactacaatcgccgccgccgttaaaccgtaactccgaaaacgaactccgaactcctccaacctaaaaaccgaaccaaaaccccgaacgaaaactcgcgccgaaccgaccgaatccccgacgatacgaacgaaataaaaaccccgaaaaatcccgaaaaaaaaaaaaatcccgaaccgaaaccgaaaataaaatctaacaccgaaactttcaatttattccgctatttaaaattaacgccgacgaaacgttaaaatcacgtaacgaaacgtcgccaatcgacgccgaccttatctcgacattccgaactcgaaaactatacgatctaccaaaaactacgaccccgtccgacccgaactaataaaacgaaccgcaaaccgacttataaaaaaaaaaataaccgtaaaaccgaaaaaaaaccgaaaaaatccccgccgcgtaaataaacgaaccgaaaaaaaatttaaaaacgcgcgaaaacgacgtaacaaacccgaatccctaaacccgcttttcctaccgcgctaatcacgccaaacgacacgccc

SEQ ID NO: 3579 - DNA, 627 bp, Artificial Sequence
  chemically treated genomic DNA (Homo sapiens) CpG-island No: 3579
attttcgcgttcggaggttttgtttttcgtttgtgtttaggttaggtttgggattttattgttgtatttcgtttatttttagattgtagtcgtcgtcgtcgttaggtcgtagtttcgaaggcgggtttcgggtttttttaatttgggggtcgagttagggtttcggacgggggttcgcgtcggatcggtcgggttttcggcggtgcgggcggggtgggaatttcgggggatttcgggaggggagggggtttcgggtcggggtcgggggtggggtttggtatcggagtttttagtttgtttcgttgtttgaaattggcgtcggcggagcgttaaggttacgtgacggaacgtcgttaatcggcgtcggttttgtttcggtatttcgggttcgaaggttgtgcggtttgttaggagttgcggtttcgttcggttcgggttggtaaggcggatcgtaggtcggtttgtgggggaagaagtggtcgtggggtcggggaggggtcggaggggttttcgtcgcgtgggtgggcgagtcgagggagagtttggggacgcgcggaagcggcgtgataggttcgggtttttgggttcgttttttttgtcgcgttggttacgttaggcgatacgttt

SEQ ID NO: 3580 - DNA, 627 bp, Artificial Sequence
  chemically treated genomic DNA (Homo sapiens) CpG-island No: 3580
aaacgtatcgcctaacgtaaccaacgcgacaaaaaaaacgaacccaaaaacccgaacctatcacgccgcttccgcgcgtccccaaactctccctcgactcgcccacccacgcgacgaaaacccctccgacccctccccgaccccacgaccacttcttcccccacaaaccgacctacgatccgccttaccaacccgaaccgaacgaaaccgcaactcctaacaaaccgcacaaccttcgaacccgaaataccgaaacaaaaccgacgccgattaacgacgttccgtcacgtaaccttaacgctccgccgacgccaatttcaaacaacgaaacaaactaaaaactccgataccaaaccccacccccgaccccgacccgaaaccccctcccctcccgaaatcccccgaaattcccaccccgcccgcaccgccgaaaacccgaccgatccgacgcgaacccccgtccgaaaccctaactcgacccccaaattaaaaaaacccgaaacccgccttcgaaactacgacctaacgacgacgacgactacaatctaaaaataaacgaaatacaacaataaaatcccaaacctaacctaaacacaaacgaaaaacaaaacctccgaacgcgaaaat

SEQ ID NO: 3581 - DNA, 683 bp, Artificial Sequence
  chemically treated genomic DNA (Homo sapiens) CpG-island No: 3581
tcgagagtgataatgtcgtttattcgcgatttatatattatttttttatttagtttatttattcgtcgcgaatcggttttttttttattttcgggtaataatacgttatatatgttacgattcggaatggtgtcgtcgttggtaatcgttaataattgagcgttaggtcgggcggttaatatttcggtttttttgttttagattagtttggggcgaaaagtagaaaaatcgttagagggatagcgttcggaaagtatatttagcgtggcgttaaaaatacgttttggtagatttttttacggtgcggtacggcgtacgcgggagtattattcgtttatttgaaatgtatttatcgtcgcggcggtaacggtttgttgcgtaaggacgtcgagaggattatgcggtggtgttaggttttttagtttgtttgcgaatatttattttataatgattgcggaatcgattaaaattacgtcgggtacgggggaaaaatagttttttagatatatcgttaatttgatgtttcggcgcgattaaaggcgttgtaatttatttgttaatagaaaagcggcggttgttatttgaattaatagatttatcgggtttatattaatttttagtttagaacggaaggttgcgattacgtagggatttattcgaatttagagttcggtggggatggg

SEQ ID NO: 3582 - DNA, 683 bp, Artificial Sequence
  chemically treated genomic DNA (Homo sapiens) CpG-island No: 3582
cccatccccaccgaactctaaattcgaataaatccctacgtaatcgcaaccttccgttctaaactaaaaattaatataaacccgataaatctattaattcaaataacaaccgccgcttttctattaacaaataaattacaacgcctttaatcgcgccgaaacatcaaattaacgatatatctaaaaaactatttttcccccgtacccgacgtaattttaatcgattccgcaatcattataaaataaatattcgcaaacaaactaaaaaacctaacaccaccgcataatcctctcgacgtccttacgcaacaaaccgttaccgccgcgacgataaatacatttcaaataaacgaataatactcccgcgtacgccgtaccgcaccgtaaaaaaatctaccaaaacgtatttttaacgccacgctaaatatactttccgaacgctatccctctaacgatttttctacttttcgccccaaactaatctaaaacaaaaaaaccgaaatattaaccgcccgacctaacgctcaattattaacgattaccaacgacgacaccattccgaatcgtaacatatataacgtattattacccgaaaataaaaaaaaaaccgattcgcgacgaataaataaactaaataaaaaaataatatataaatcgcgaataaacgacattatcactctcga

SEQ ID NO: 3583 - DNA, 683 bp, Artificial Sequence
  chemically treated genomic DNA (Homo sapiens) CpG-island No: 3583
tttatttttatcgggttttgaattcgggtaaatttttgcgtggtcgtaatttttcgttttgaattggggattaatatgggttcggtgaatttgttgatttaggtggtaatcgtcgtttttttgttgataggtgggttataacgtttttggtcgcgtcgggatattaggttggcggtgtatttaaagggttgtttttttttcgtattcggcgtgattttagtcgatttcgtagttattgtagagtgaatgttcgtaggtaggttggaaaatttgatattatcgtataattttttcgacgtttttgcgtagtaaatcgttgtcgtcgcgacgatggatgtattttaggtagacgaatggtattttcgcgtacgtcgtgtcgtatcgtggaaagatttgttaagacgtgtttttgacgttacgttggatatgtttttcgggcgttatttttttggcgatttttttgtttttcgttttaaattggtttggaatagggagatcgggatattgatcgttcgatttggcgtttaattgttggcggttattagcggcggtattatttcggatcgtggtatgtatagcgtgttattattcgaaggtgaagaaaaggtcggttcgcggcgggtgggtgaattggatgaggagatggtatatgagtcgcgggtgaacgatattattattttcgg

SEQ ID NO: 3584 - DNA, 683 bp, Artificial Sequence
  chemically treated genomic DNA (Homo sapiens) CpG-island No: 3584
ccgaaaataataatatcgttcacccgcgactcatataccatctcctcatccaattcacccacccgccgcgaaccgaccttttcttcaccttcgaataataacacgctatacataccacgatccgaaataataccgccgctaataaccgccaacaattaaacgccaaatcgaacgatcaatatcccgatctccctattccaaaccaatttaaaacgaaaaacaaaaaaatcgccaaaaaaataacgcccgaaaaacatatccaacgtaacgtcaaaaacacgtcttaacaaatctttccacgatacgacacgacgtacgcgaaaataccattcgtctacctaaaatacatccatcgtcgcgacgacaacgatttactacgcaaaaacgtcgaaaaaattatacgataatatcaaattttccaacctacctacgaacattcactctacaataactacgaaatcgactaaaatcacgccgaatacgaaaaaaaaacaaccctttaaatacaccgccaacctaatatcccgacgcgaccaaaaacgttataacccacctatcaacaaaaaaacgacgattaccacctaaatcaacaaattcaccgaacccatattaatccccaattcaaaacgaaaaattacgaccacgcaaaaatttacccgaattcaaaacccgataaaaataaa

SEQ ID NO: 3585 - DNA, 556 bp, Artificial Sequence
  chemically treated genomic DNA (Homo sapiens) CpG-island No: 3585
gtttcggcgcggttttggtttcgggagttcgcggtgtcgtagaaggcgtcggtcgtgaagtcgcggtcgaacgggcggtcggaggtggacggtttggtaaagttcgagtttttgttgtttaaagatggatttcgatggatcgaagaattttcgttattcgatttttttatgttcgcggcgttttcggggggtgcgaggagcggggggtatcgtttttagaatgggacggagggggcgtttaagtcgggcgcgggttgcgggggggtcggcggagttttgtacgttttttttttgtataggggtttattcgcggtcgaatttcgcgtttaggggttgttgtttgtcggacggcgtttcgtttttggtcggcggtttcgggagggttttgcggcgcggcgcggttttttgcgcgttcgcgaacgattttcgggaatcggttcgttcgcgtaatttagcgtttttggggaggttgtaatttgatttttttttttaggtcgttagttcgtttttggtcgtattggtcgttttatacgagggagaagggtatcgggattta

SEQ ID NO: 3586 - DNA, 556 bp, Artificial Sequence
  chemically treated genomic DNA (Homo sapiens) CpG-island No: 3586
taaatcccgatacccttctccctcgtataaaacgaccaatacgaccaaaaacgaactaacgacctaaaaaaaaaaatcaaattacaacctccccaaaaacgctaaattacgcgaacgaaccgattcccgaaaatcgttcgcgaacgcgcaaaaaaccgcgccgcgccgcaaaaccctcccgaaaccgccgaccaaaaacgaaacgccgtccgacaaacaacaacccctaaacgcgaaattcgaccgcgaataaacccctatacaaaaaaaaaacgtacaaaactccgccgacccccccgcaacccgcgcccgacttaaacgccccctccgtcccattctaaaaacgataccccccgctcctcgcaccccccgaaaacgccgcgaacataaaaaaatcgaataacgaaaattcttcgatccatcgaaatccatctttaaacaacaaaaactcgaactttaccaaaccgtccacctccgaccgcccgttcgaccgcgacttcacgaccgacgccttctacgacaccgcgaactcccgaaaccaaaaccgcgccgaaac

SEQ ID NO: 3587 - DNA, 556 bp, Artificial Sequence
  chemically treated genomic DNA (Homo sapiens) CpG-island No: 3587
tggatttcggtgtttttttttttcgtgtggagcggttagtgcggttagaggcgagttgacggtttggaaagagaaattaaattgtagtttttttaaagacgttgagttacgcgggcgagtcggttttcggggatcgttcgcgagcgcgtagagagtcgcgtcgcgtcgtagagttttttcggggtcgtcggttagaagcggggcgtcgttcgataggtagtagtttttgggcgcggggttcggtcgcgagtgagtttttgtgtagagagggggcgtgtaaggtttcgtcggttttttcgtagttcgcgttcgatttgggcgtttttttcgttttattttgggagcgatgtttttcgtttttcgtatttttcgggaacgtcgcgagtatggagaagtcgagtagcgaggatttttcgatttatcggagtttatttttggatagtaaggattcggattttgttaagtcgtttattttcggtcgttcgttcggtcgcggttttacggtcggcgttttttacggtatcgcgggttttcggggttagagtcgcgtcgaggt

SEQ ID NO: 3588 - DNA, 556 bp, Artificial Sequence
  chemically treated genomic DNA (Homo sapiens) CpG-island No: 3588
acctcgacgcgactctaaccccgaaaacccgcgataccgtaaaaaacgccgaccgtaaaaccgcgaccgaacgaacgaccgaaaataaacgacttaacaaaatccgaatccttactatccaaaaataaactccgataaatcgaaaaatcctcgctactcgacttctccatactcgcgacgttcccgaaaaatacgaaaaacgaaaaacatcgctcccaaaataaaacgaaaaaaacgcccaaatcgaacgcgaactacgaaaaaaccgacgaaaccttacacgccccctctctacacaaaaactcactcgcgaccgaaccccgcgcccaaaaactactacctatcgaacgacgccccgcttctaaccgacgaccccgaaaaaactctacgacgcgacgcgactctctacgcgctcgcgaacgatccccgaaaaccgactcgcccgcgtaactcaacgtctttaaaaaaactacaatttaatttctctttccaaaccgtcaactcgcctctaaccgcactaaccgctccacacgaaaaaaaaaaacaccgaaatcca

SEQ ID NO: 3589 - DNA, 637 bp, Artificial Sequence
  chemically treated genomic DNA (Homo sapiens) CpG-island No: 3589
cgggaaaatcgggcgtttggggaggcgcgcgggtagaggttattcgttttcgcggtttttagataggggcggagtttttattcggttttcgcgggtttcgttttcggacggcggaagtcgagttcgtttttttcgttcgggtttgggcgtgttttacgggcgtacggtatgttgggaaggcgttcgcgcggcggttattttgttttgtcggtttttgtgtgtaggagggatttcggtttgagagcgggtcgaggagattggcgacggtgtcgttcgtgttttcgttggcgggtgtttgggttggtgggaatagtcgttcgaaggaagtattatgatttcggtcgcgtagttgttggatgagttaatgggtcgggatcgaaatttagtttcggacgagaagcgtagtaacgtgcggtgggattacgagagcgtaagtttcgcgggttttggtttgagttcgggtttcgtgggggaggggagcgggcgcgggttgtggtttttttggtcgcggcgcgatgtggttagggtcgtattcggggtcgagcgtttgattcggtgtttatggagttaggagggaggatgttgttcggattcggggatgggggtgatttggttttgttgttttagtattaagggg

SEQ ID NO: 3590 - DNA, 637 bp, Artificial Sequence
  chemically treated genomic DNA (Homo sapiens) CpG-island No: 3590
ccccttaatactaaaacaacaaaaccaaatcacccccatccccgaatccgaacaacatcctccctcctaactccataaacaccgaatcaaacgctcgaccccgaatacgaccctaaccacatcgcgccgcgaccaaaaaaaccacaacccgcgcccgctcccctcccccacgaaacccgaactcaaaccaaaacccgcgaaacttacgctctcgtaatcccaccgcacgttactacgcttctcgtccgaaactaaatttcgatcccgacccattaactcatccaacaactacgcgaccgaaatcataatacttccttcgaacgactattcccaccaacccaaacacccgccaacgaaaacacgaacgacaccgtcgccaatctcctcgacccgctctcaaaccgaaatccctcctacacacaaaaaccgacaaaacaaaataaccgccgcgcgaacgccttcccaacataccgtacgcccgtaaaacacgcccaaacccgaacgaaaaaaacgaactcgacttccgccgtccgaaaacgaaacccgcgaaaaccgaataaaaactccgcccctatctaaaaaccgcgaaaacgaataacctctacccgcgcgcctccccaaacgcccgattttcccg

SEQ ID NO: 3591 - DNA, 637 bp, Artificial Sequence
  chemically treated genomic DNA (Homo sapiens) CpG-island No: 3591
ttttttgatattagaataataaaattaaattatttttattttcgggttcggatagtatttttttttttggttttatgggtatcgggttagacgttcgatttcgggtgcggttttggttatatcgcgtcgcggttaggagggttatagttcgcgttcgttttttttttttacggagttcgggtttaggttaaggttcgcgggatttacgttttcgtggttttatcgtacgttgttgcgtttttcgttcggggttaggtttcggtttcggtttattaatttatttaataattgcgcggtcgaaattatggtgtttttttcgggcggttgtttttattagtttaggtattcgttaacgaaaatacgggcgatatcgtcgttaattttttcggttcgtttttaggtcgaaattttttttatatataggagtcgataagataaaatggtcgtcgcgcggacgtttttttagtatgtcgtgcgttcgtgggatacgtttaggttcgggcggagagggcgagttcggttttcgtcgttcgggggcggggttcgcggaggtcgggtagggatttcgtttttgtttagaggtcgcggggacgggtagtttttgttcgcgcgtttttttaagcgttcggttttttcg

SEQ ID NO: 3592 - DNA, 637 bp, Artificial Sequence
  chemically treated genomic DNA (Homo sapiens) CpG-island No: 3592
cgaaaaaaccgaacgcttaaaaaaacgcgcgaacaaaaactacccgtccccgcgacctctaaacaaaaacgaaatccctacccgacctccgcgaaccccgcccccgaacgacgaaaaccgaactcgccctctccgcccgaacctaaacgtatcccacgaacgcacgacatactaaaaaaacgtccgcgcgacgaccattttatcttatcgactcctatatataaaaaaaatttcgacctaaaaacgaaccgaaaaaattaacgacgatatcgcccgtattttcgttaacgaatacctaaactaataaaaacaaccgcccgaaaaaaacaccataatttcgaccgcgcaattattaaataaattaataaaccgaaaccgaaacctaaccccgaacgaaaaacgcaacaacgtacgataaaaccacgaaaacgtaaatcccgcgaaccttaacctaaacccgaactccgtaaaaaaaaaaaacgaacgcgaactataaccctcctaaccgcgacgcgatataaccaaaaccgcacccgaaatcgaacgtctaacccgatacccataaaaccaaaaaaaaaaatactatccgaacccgaaaataaaaataatttaattttattattctaatatcaaaaaa

SEQ ID NO: 3593 - DNA, 560 bp, Artificial Sequence
  chemically treated genomic DNA (Homo sapiens) CpG-island No: 3593
gcgatcgaaagtggggagggcggatttaacgacggcgaattttcgcgttttgtttagtattaggagtaacgtttacgtttttaataaagatggcggtaatattttcggtttttagagttgttatgcgcgatgggttgtattatcgtgtttcgggcgtcggggtagaggtggagcgaattatcggggcggtcgggagttatgttggagcggcgggaggcggtagtagcgtcggggatgttgtggtgggggcggaaaaagttagggtcgtacgtcggaggggtttcggtcgcggagtagatggtgtttagagggcggcgggggtgcggagagataggcggaggggcgggggttcggggcggcggtaggggttcgggagggggttcgagcggcggggttagtttaaggttcggatcggggcggggggcggtggaggtcgtgtagggaggcgggagatgatggcgaggcggtcgtcgtggcggggtttcggggaacggtcgatttttatatttttgtttttttttttttttttgtttttttttagttaggaggagttggggggt

SEQ ID NO: 3594 - DNA, 560 bp, Artificial Sequence
  chemically treated genomic DNA (Homo sapiens) CpG-island No: 3594
accccccaactcctcctaactaaaaaaaaacaaaaaaaaaaaaaaaaacaaaaatataaaaatcgaccgttccccgaaaccccgccacgacgaccgcctcgccatcatctcccgcctccctacacgacctccaccgccccccgccccgatccgaaccttaaactaaccccgccgctcgaaccccctcccgaacccctaccgccgccccgaacccccgcccctccgcctatctctccgcacccccgccgccctctaaacaccatctactccgcgaccgaaacccctccgacgtacgaccctaactttttccgcccccaccacaacatccccgacgctactaccgcctcccgccgctccaacataactcccgaccgccccgataattcgctccacctctaccccgacgcccgaaacacgataatacaacccatcgcgcataacaactctaaaaaccgaaaatattaccgccatctttattaaaaacgtaaacgttactcctaatactaaacaaaacgcgaaaattcgccgtcgttaaatccgccctccccactttcgatcgc

SEQ ID NO: 3595 - DNA, 560 bp, Artificial Sequence
  chemically treated genomic DNA (Homo sapiens) CpG-island No: 3595
gttttttagttttttttggttgagggggaataaagagaggagaaggagtaggagtatgggggtcgatcgtttttcgaggtttcgttacggcggtcgtttcgttattatttttcgtttttttgtacggtttttatcgtttttcgtttcggttcgggttttgggttggtttcgtcgttcgggttttttttcgggtttttgtcgtcgtttcgggttttcgttttttcgtttgttttttcgtattttcgtcgttttttgggtattatttatttcgcggtcggagttttttcggcgtgcggttttggtttttttcgtttttattatagtattttcgacgttgttgtcgtttttcgtcgttttaatatggttttcggtcgtttcgatggttcgttttatttttgtttcggcgttcgaaatacggtggtataatttatcgcgtatggtagttttgaggatcgaagatgttgtcgttatttttattgaggacgtgagcgttgtttttggtgttgaatagagcgcgaaggttcgtcgtcgttgggttcgttttttttattttcggtcgt

SEQ ID NO: 3596 - DNA, 560 bp, Artificial Sequence
  chemically treated genomic DNA (Homo sapiens) CpG-island No: 3596
acgaccgaaaataaaaaaaacgaacccaacgacgacgaaccttcgcgctctattcaacaccaaaaacaacgctcacgtcctcaataaaaataacgacaacatcttcgatcctcaaaactaccatacgcgataaattataccaccgtatttcgaacgccgaaacaaaaataaaacgaaccatcgaaacgaccgaaaaccatattaaaacgacgaaaaacgacaacaacgtcgaaaatactataataaaaacgaaaaaaaccaaaaccgcacgccgaaaaaactccgaccgcgaaataaataatacccaaaaaacgacgaaaatacgaaaaaacaaacgaaaaaacgaaaacccgaaacgacgacaaaaacccgaaaaaaaacccgaacgacgaaaccaacccaaaacccgaaccgaaacgaaaaacgataaaaaccgtacaaaaaaacgaaaaataataacgaaacgaccgccgtaacgaaacctcgaaaaacgatcgacccccatactcctactccttctcctctctttattccccctcaaccaaaaaaaactaaaaaac

SEQ ID NO: 3597 - DNA, 1090 bp, Artificial Sequence
  chemically treated genomic DNA (Homo sapiens) CpG-island No: 3597
cgagttggatttagtattacgtacggcgaggatagtttttgtattaggtttagtatttcgcgagtttcggatagttttcgagtcggcgtttaagcgtatgcgttttcggggtttttttcgttgtcgttttttttcgtagcgtttcgggtcgcgtttttcgggattttcggttcgttttgaagttaggaaagtaatttcggcgaatcgggtacgttttcgtcgcgtcgtaaatcgttattcgtagttttcgtagtataattattagacgttggtgtcggagaatgaggtagtaggtatcgcggtgttacgcgtggttgtttaggattcggacgtcggcgaggtcgggcgtttagtttattcgttggcggtatttatgaatagtcgttcgttggagttgtttagtatcgattcgtagagcggttttattcgtacggcggtagttttggatcgcgagagtatggagcgttattatttgcgtgtgatcgcgtaggattacgggtcgtcgcgtttttcggttattacgatggtggtcgtgatagtagtcgatcgtaacgattattcgtcggtttttgagtaagcgtagtatcgggagatttttcgcgagaatgtggaggagggttattttattttgtagttgcgtgttattgacggcgacgcgttttttaacgttaatttgcgttatcgtttcgtggggtcgttagttgcgcgcgttgtagttgtcgtcgttttcgagattgatttacgtttcggttttattagtattagcggtcgagtggatcgcgagtatatggaaagttatgagttggtggtggaagttagcgattagggttaggaattcgggtcgcgttcggttattgtgcgcgtatatataattgtgttagacgagaacgataatgttttttagtttagcgagaagcgttacgtggcgtaggtgcgcgaggatgtgcgtttttatatagtcgtgttgcgcgttacggttattgatcgggataaggacgttaacggattggtgtattataatattattagtggtaatagtcgtggatattttgttatcgatagttttattggcgagatttaggtggtggta

SEQ ID NO: 3598 - DNA, 1090 bp, Artificial Sequence
  chemically treated genomic DNA (Homo sapiens) CpG-island No: 3598
taccaccacctaaatctcgccaataaaactatcgataacaaaatatccacgactattaccactaataatattataatacaccaatccgttaacgtccttatcccgatcaataaccgtaacgcgcaacacgactatataaaaacgcacatcctcgcgcacctacgccacgtaacgcttctcgctaaactaaaaaacattatcgttctcgtctaacacaattatatatacgcgcacaataaccgaacgcgacccgaattcctaaccctaatcgctaacttccaccaccaactcataactttccatatactcgcgatccactcgaccgctaatactaataaaaccgaaacgtaaatcaatctcgaaaacgacgacaactacaacgcgcgcaactaacgaccccacgaaacgataacgcaaattaacgttaaaaaacgcgtcgccgtcaataacacgcaactacaaaataaaataaccctcctccacattctcgcgaaaaatctcccgatactacgcttactcaaaaaccgacgaataatcgttacgatcgactactatcacgaccaccatcgtaataaccgaaaaacgcgacgacccgtaatcctacgcgatcacacgcaaataataacgctccatactctcgcgatccaaaactaccgccgtacgaataaaaccgctctacgaatcgatactaaacaactccaacgaacgactattcataaataccgccaacgaataaactaaacgcccgacctcgccgacgtccgaatcctaaacaaccacgcgtaacaccgcgatacctactacctcattctccgacaccaacgtctaataattatactacgaaaactacgaataacgatttacgacgcgacgaaaacgtacccgattcgccgaaattactttcctaacttcaaaacgaaccgaaaatcccgaaaaacgcgacccgaaacgctacgaaaaaaaacgacaacgaaaaaaaccccgaaaacgcatacgcttaaacgccgactcgaaaactatccgaaactcgcgaaatactaaacctaatacaaaaactatcctcgccgtacgtaatactaaatccaactcg

SEQ ID NO: 3599 - DNA, 1090 bp, Artificial Sequence
  chemically treated genomic DNA (Homo sapiens) CpG-island No: 3599
tgttattatttggatttcgttagtgaggttgtcgatggtaaagtgtttacggttattgttattgatgatgttgtagtgtattaattcgttggcgtttttgtttcggttagtggtcgtgacgcgtagtacgattgtgtgggggcgtatattttcgcgtatttgcgttacgtagcgtttttcgttgaattgaggagtattgtcgttttcgtttagtatagttatgtgtacgcgtatagtggtcgagcgcggttcgggtttttggttttggtcgttggtttttattattagtttatagttttttatgtgttcgcggtttattcggtcgttggtgttgatgaggtcggagcgtggattaatttcgaaggcggcggtagttgtagcgcgcgtagttggcggttttacgaagcggtagcgtaggttggcgttggggggcgcgtcgtcgttagtggtacgtagttgtaggatagggtagtttttttttatattttcgcgaagggtttttcggtattgcgtttgtttaaaaatcggcgagtggtcgttgcggtcggttattgttacggttattatcgtggtggtcgagaggcgcggcgattcgtggttttgcgcggttatacgtaggtagtgacgttttatgttttcgcggtttagagttgtcgtcgtacggataaggtcgttttgcgggtcgatgttgaatagttttagcgagcggttgtttatgagtgtcgttagcgagtagattaggcgttcggtttcgtcggcgttcgggttttgagtaattacgcgtagtatcgcggtgtttgttgttttatttttcggtattagcgtttggtagttgtattgcggaaattgcgggtggcggtttgcggcgcgacgaaagcgtgttcggttcgtcgaggttatttttttggttttaggacgggtcgggagtttcgggggacgcggttcggggcgttgcgggaggaagcggtagcggaagagatttcgggagcgtatgcgtttgggcgtcggttcgggagttgttcgagattcgcggggtgttgaatttgatgtaggagttgttttcgtcgtgcgtggtgttgaatttagttcg

SEQ ID NO: 3600 - DNA, 1090 bp, Artificial Sequence
  chemically treated genomic DNA (Homo sapiens) CpG-island No: 3600
cgaactaaattcaacaccacgcacgacgaaaacaactcctacatcaaattcaacaccccgcgaatctcgaacaactcccgaaccgacgcccaaacgcatacgctcccgaaatctcttccgctaccgcttcctcccgcaacgccccgaaccgcgtcccccgaaactcccgacccgtcctaaaaccaaaaaaataacctcgacgaaccgaacacgctttcgtcgcgccgcaaaccgccacccgcaatttccgcaatacaactaccaaacgctaataccgaaaaataaaacaacaaacaccgcgatactacgcgtaattactcaaaacccgaacgccgacgaaaccgaacgcctaatctactcgctaacgacactcataaacaaccgctcgctaaaactattcaacatcgacccgcaaaacgaccttatccgtacgacgacaactctaaaccgcgaaaacataaaacgtcactacctacgtataaccgcgcaaaaccacgaatcgccgcgcctctcgaccaccacgataataaccgtaacaataaccgaccgcaacgaccactcgccgatttttaaacaaacgcaataccgaaaaacccttcgcgaaaatataaaaaaaaactaccctatcctacaactacgtaccactaacgacgacgcgccccccaacgccaacctacgctaccgcttcgtaaaaccgccaactacgcgcgctacaactaccgccgccttcgaaattaatccacgctccgacctcatcaacaccaacgaccgaataaaccgcgaacacataaaaaactataaactaataataaaaaccaacgaccaaaaccaaaaacccgaaccgcgctcgaccactatacgcgtacacataactatactaaacgaaaacgacaatactcctcaattcaacgaaaaacgctacgtaacgcaaatacgcgaaaatatacgcccccacacaatcgtactacgcgtcacgaccactaaccgaaacaaaaacgccaacgaattaatacactacaacatcatcaataacaataaccgtaaacactttaccatcgacaacctcactaacgaaatccaaataataaca

SEQ ID NO: 3601 - DNA, 688 bp, Artificial Sequence
  chemically treated genomic DNA (Homo sapiens) CpG-island No: 3601
cggaggagttgttggttaatagtttgatcgtgcgttttgagaatatgtggtaggagcgttttttgttatcgttgttgggtcgttttttcgagggcgtggttgcggtgttcgttacgttcgttgaggacgtttttatttttaatatttagaacgatatagacgtagggggtatcgtgtttaatgtgagtttttcggcgttagttttacgtggggtcggggcgggcgttgtagggttttggtttagtttcgaggagttgtaggagtagttgtacgtgcgtcgggcggcgttggcggttcgttttttgttcgacgtattgtttttcgacgataacgtgtgtttgcgagagttttgtgagaattatatgaaatgcgtgttcgtgtttcgttttgattcgttcgcgttttttttggtttcggtttttacgttgtttcgatttatttagtttatcgttggtttgcgttgtcgttgttcgttcggatttacgggagatttttgcgagatcgagttcgatttttgttattttaatttatgtcgtaacggcggagtttgcgcgcggcgcgagggaggttatacgtgcgtttgtcgttcgcgttttatcggtgagtagggcgtcgggttagagttgggggaagtacgggttaaggttgggggcgggattataatgcgagtgagtattgggagttattt

SEQ ID NO: 3602 - DNA, 688 bp, Artificial Sequence
  chemically treated genomic DNA (Homo sapiens) CpG-island No: 3602
aaataactcccaatactcactcgcattataatcccgcccccaaccttaacccgtacttcccccaactctaacccgacgccctactcaccgataaaacgcgaacgacaaacgcacgtataacctccctcgcgccgcgcgcaaactccgccgttacgacataaattaaaataacaaaaatcgaactcgatctcgcaaaaatctcccgtaaatccgaacgaacaacgacaacgcaaaccaacgataaactaaataaatcgaaacaacgtaaaaaccgaaaccaaaaaaaacgcgaacgaatcaaaacgaaacacgaacacgcatttcatataattctcacaaaactctcgcaaacacacgttatcgtcgaaaaacaatacgtcgaacaaaaaacgaaccgccaacgccgcccgacgcacgtacaactactcctacaactcctcgaaactaaaccaaaaccctacaacgcccgccccgaccccacgtaaaactaacgccgaaaaactcacattaaacacgataccccctacgtctatatcgttctaaatattaaaaataaaaacgtcctcaacgaacgtaacgaacaccgcaaccacgccctcgaaaaaacgacccaacaacgataacaaaaaacgctcctaccacatattctcaaaacgcacgatcaaactattaaccaacaactcctccg

SEQ ID NO: 3603 - DNA, 688 bp, Artificial Sequence
  chemically treated genomic DNA (Homo sapiens) CpG-island No: 3603
aagtgatttttagtatttattcgtattgtggtttcgtttttagttttggttcgtgttttttttagttttggttcggcgttttgtttatcggtgaagcgcgggcggtagacgtacgtgtagtttttttcgcgtcgcgcgtaggtttcgtcgttgcgatatgggttggagtagtagaggtcgagttcggtttcgtaaaagtttttcgtgaattcgggcgggtagcggtagcgtaggttagcgatgggttggatgggtcggaatagcgtggaggtcgaggttaggaagggcgcggacgagttaaagcggagtacggatacgtattttatgtagtttttatagggttttcgtaggtatacgttgtcgtcgaagggtagtacgtcgagtagggagcgagtcgttagcgtcgttcggcgtacgtataattgtttttgtagtttttcggagttgaattagggttttgtagcgttcgtttcggttttacgtggagttagcgtcgagaaatttatattgagtacggtgttttttacgtttgtgtcgttttggatgttgaagatgaagacgtttttagcgggcgtagcgagtatcgtagttacgttttcgaggaagcggtttagtagcggtgataggaagcgtttttgttatatgtttttaaggcgtacggttaggttgttggttagtaattttttcg

SEQ ID NO: 3604 - DNA, 688 bp, Artificial Sequence
  chemically treated genomic DNA (Homo sapiens) CpG-island No: 3604
cgaaaaaattactaaccaacaacctaaccgtacgccttaaaaacatataacaaaaacgcttcctatcaccgctactaaaccgcttcctcgaaaacgtaactacgatactcgctacgcccgctaaaaacgtcttcatcttcaacatccaaaacgacacaaacgtaaaaaacaccgtactcaatataaatttctcgacgctaactccacgtaaaaccgaaacgaacgctacaaaaccctaattcaactccgaaaaactacaaaaacaattatacgtacgccgaacgacgctaacgactcgctccctactcgacgtactacccttcgacgacaacgtatacctacgaaaaccctataaaaactacataaaatacgtatccgtactccgctttaactcgtccgcgcccttcctaacctcgacctccacgctattccgacccatccaacccatcgctaacctacgctaccgctacccgcccgaattcacgaaaaacttttacgaaaccgaactcgacctctactactccaacccatatcgcaacgacgaaacctacgcgcgacgcgaaaaaaactacacgtacgtctaccgcccgcgcttcaccgataaacaaaacgccgaaccaaaactaaaaaaaacacgaaccaaaactaaaaacgaaaccacaatacgaataaatactaaaaatcactt

SEQ ID NO: 3605 - DNA, 713 bp, Artificial Sequence
  chemically treated genomic DNA (Homo sapiens) CpG-island No: 3605
tttaggttagaagtcgtagagcgtggtcggaaggggtcgtcgtcgaggtagcgatgagattggggagggggcggggttagacggaaggggcgtgtttatcgaagagggcgatttttcgggggttttggtattcggtttttgggcgcgcggtttttgaaggggtcggagtaggggcgggcgtgggcgtgatcgtttttgatcgcggtttggtttttaggagaggattgcgagttggatatcgaggtcggtcgttgcgtgtcgggcgtttgtcgtaacgggggtatttgtatcgacgcgtttaacggcggttttcgttgttagtgttcggtaggcggcgttttcgagggttcgcgttgcgaggtggttgcgcgttttttttcgtttagttcgttcgttatgtttcgcggtttgcggtagcgattttattttacgttgtttttttcgtaggtgttcgtttcgtgtttgagcgttttttcgtcgtttttatttattcgttttgatttagatttttgattgtttcgttttggtatttttatgagatatcgttttttttttgacgtttcgttcggggttttttgatttcgttgtattcgcgttttttcggtcggtttcgtcgtttttcgtcgttttttttttcgttttagtttttttttttcgtagggatggtgggtgtgaagtggtattttgtttttgacgtttttattttcgtaatt

SEQ ID NO: 3606 - DNA, 713 bp, Artificial Sequence
  chemically treated genomic DNA (Homo sapiens) CpG-island No: 3606
aattacgaaaataaaaacgtcaaaaacaaaataccacttcacacccaccatccctacgaaaaaaaaaaactaaaacgaaaaaaaaaacgacgaaaaacgacgaaaccgaccgaaaaaacgcgaatacaacgaaatcaaaaaaccccgaacgaaacgtcaaaaaaaaaacgatatctcataaaaataccaaaacgaaacaatcaaaaatctaaatcaaaacgaataaataaaaacgacgaaaaaacgctcaaacacgaaacgaacacctacgaaaaaaacaacgtaaaataaaatcgctaccgcaaaccgcgaaacataacgaacgaactaaacgaaaaaaaacgcgcaaccacctcgcaacgcgaaccctcgaaaacgccgcctaccgaacactaacaacgaaaaccgccgttaaacgcgtcgatacaaatacccccgttacgacaaacgcccgacacgcaacgaccgacctcgatatccaactcgcaatcctctcctaaaaaccaaaccgcgatcaaaaacgatcacgcccacgcccgcccctactccgaccccttcaaaaaccgcgcgcccaaaaaccgaataccaaaacccccgaaaaatcgccctcttcgataaacacgccccttccgtctaaccccgccccctccccaatctcatcgctacctcgacgacgaccccttccgaccacgctctacgacttctaacctaaa

SEQ ID NO: 3607 - DNA, 713 bp, Artificial Sequence
  chemically treated genomic DNA (Homo sapiens) CpG-island No: 3607
ggttgcgggggtgggagcgttaggagtagggtattattttatatttattatttttgcgaggagaaggggttggggcgagagaggaagcgacgagggacggcgggatcgatcggggggacgcgggtgtagcgaggttaggagatttcgggcggggcgttaggggaggggcggtgttttatggggatgttaggacggggtagttaggaatttgagttagggcgggtaggtgggggcggcggggaggcgtttagatacggggcgggtatttacgagagggatagcgtaaggtggaatcgttgtcgtaggtcgcgaaatatgacgaacgaattgggcgggaaggagcgcgtagttatttcgtagcgcgggttttcgaaggcgtcgtttgtcgggtattggtagcgaaagtcgtcgttgggcgcgtcggtgtaggtgttttcgttgcggtagacgttcggtacgtagcggtcggtttcggtgtttagttcgtagtttttttttgggggttaagtcgcggttagaggcggttacgtttacgttcgtttttgtttcggtttttttaaagatcgcgcgtttagaggtcgggtgttaagattttcgaaaggtcgtttttttcggtggatacgtttttttcgtttggtttcgttttttttttagttttatcgttgtttcggcggcggtttttttcggttacgttttacggtttttggtttaag

SEQ ID NO: 3608 - DNA, 713 bp, Artificial Sequence
  chemically treated genomic DNA (Homo sapiens) CpG-island No: 3608
cttaaaccaaaaaccgtaaaacgtaaccgaaaaaaaccgccgccgaaacaacgataaaactaaaaaaaaaacgaaaccaaacgaaaaaaacgtatccaccgaaaaaaacgacctttcgaaaatcttaacacccgacctctaaacgcgcgatctttaaaaaaaccgaaacaaaaacgaacgtaaacgtaaccgcctctaaccgcgacttaacccccaaaaaaaaactacgaactaaacaccgaaaccgaccgctacgtaccgaacgtctaccgcaacgaaaacacctacaccgacgcgcccaacgacgactttcgctaccaatacccgacaaacgacgccttcgaaaacccgcgctacgaaataactacgcgctccttcccgcccaattcgttcgtcatatttcgcgacctacgacaacgattccaccttacgctatccctctcgtaaatacccgccccgtatctaaacgcctccccgccgcccccacctacccgccctaactcaaattcctaactaccccgtcctaacatccccataaaacaccgcccctcccctaacgccccgcccgaaatctcctaacctcgctacacccgcgtccccccgatcgatcccgccgtccctcgtcgcttcctctctcgccccaaccccttctcctcgcaaaaataataaatataaaataataccctactcctaacgctcccacccccgcaacc

SEQ ID NO: 3609 - DNA, 949 bp, Artificial Sequence
  chemically treated genomic DNA (Homo sapiens) CpG-island No: 3609
ggcgacgttagggtagtcgtattgcggcgcgcgttttttattttttttagttttggtgtttggcggatgtcgggtttgtagggtcgcgtcgggttcgtttttatttatcgtgatttagtgttcgtgttcgcgttcgtgcgtcggcggttaaggtgtttggtcgggtttcgacgaggcgcgggagggtaggtttttttaggttttgacggatattcgggggttatagcgatcgatgtcggtattttaggtgtttgtggtattgtttgtaacgagaagtgatggggcgatgatagtcgcgagcgggtattagggggtaaggttgaggagcgttgagtcgttagatttagagagttatttatttggagggacgtgtcgttattcgcgtcgtcggagtttcggttttagttcggattttatttgttttggtttcgttcggggaagttgcgcggcgggcgggggcgatttgacgttatgaggggcgggtttcgggggcggggcgcgcgcgttttcggttcgagtcggaagtttcgattgcggcggtattcgggacggcgggcgggttggttattacgggataggaaggtgagattcgggattttagttttgtaagtaggtttcgtcggcgatcgttgacgggcgttgggttcgcggcgttgtaaggcggcgaggttcgggtttggcgtcgtttgcgtagttttggtcgcggcgtgtcggcgttgtagcgcggtagggggcggggtcggtcgttcggaggtttaagtggcggggacgtttttttgtcgggttaggtttttagagcgggttttcggcggcggcgacgggggtcgggtcgcgcgtgattcgtcgtagttacgtcgtttttaattattagtagttggtgttttaggttggcggcgtttattttttttttagtcgggtgatttaggggatttattttatgttggttttt

SEQ ID NO: 3610 - DNA, 949 bp, Artificial Sequence
  chemically treated genomic DNA (Homo sapiens) CpG-island No: 3610
aaaaaccaacataaaataaatcccctaaatcacccgactaaaaaaaaaataaacgccgccaacctaaaacaccaactactaataattaaaaacgacgtaactacgacgaatcacgcgcgacccgacccccgtcgccgccgccgaaaacccgctctaaaaacctaacccgacaaaaaaacgtccccgccacttaaacctccgaacgaccgaccccgccccctaccgcgctacaacgccgacacgccgcgaccaaaactacgcaaacgacgccaaacccgaacctcgccgccttacaacgccgcgaacccaacgcccgtcaacgatcgccgacgaaacctacttacaaaactaaaatcccgaatctcaccttcctatcccgtaataaccaacccgcccgccgtcccgaataccgccgcaatcgaaacttccgactcgaaccgaaaacgcgcgcgccccgcccccgaaacccgcccctcataacgtcaaatcgcccccgcccgccgcgcaacttccccgaacgaaaccaaaacaaataaaatccgaactaaaaccgaaactccgacgacgcgaataacgacacgtccctccaaataaataactctctaaatctaacgactcaacgctcctcaaccttaccccctaatacccgctcgcgactatcatcgccccatcacttctcgttacaaacaataccacaaacacctaaaataccgacatcgatcgctataacccccgaatatccgtcaaaacctaaaaaaacctaccctcccgcgcctcgtcgaaacccgaccaaacaccttaaccgccgacgcacgaacgcgaacacgaacactaaatcacgataaataaaaacgaacccgacgcgaccctacaaacccgacatccgccaaacaccaaaactaaaaaaaataaaaaacgcgcgccgcaatacgactaccctaacgtcgcc

SEQ ID NO: 3611 - DNA, 949 bp, Artificial Sequence
  chemically treated genomic DNA (Homo sapiens) CpG-island No: 3611
gaaagttaatataaaataaattttttgggttattcggttaggagaaaggtgagcgtcgttagtttggagtattagttattagtgattaagaacggcgtgattgcggcgggttacgcgcggttcggttttcgtcgtcgtcgtcggagattcgttttgagaatttgattcggtagggaggcgttttcgttatttgggttttcgggcggtcggtttcgttttttgtcgcgttgtagcgtcggtacgtcgcgattaaggttgcgtaggcggcgttaggttcgggtttcgtcgttttgtagcgtcgcgagtttagcgttcgttagcggtcgtcggcggagtttgtttgtaaagttgaggtttcggattttatttttttgtttcgtggtggttagttcgttcgtcgtttcggatgtcgtcgtagtcggagttttcggttcgggtcggaagcgcgcgcgtttcgttttcgaggttcgttttttatgacgttagatcgttttcgttcgtcgcgtagttttttcgagcgagattaaaataggtggaattcgggttggagtcggagtttcggcggcgcgggtggcggtacgtttttttaggtgggtggttttttgggtttggcgatttagcgttttttagttttgttttttggtgttcgttcgcgattgttatcgttttattatttttcgttgtagatagtattataggtatttggagtatcggtatcggtcgttgtggttttcgagtgttcgttagagtttaggggagtttgttttttcgcgtttcgtcggggttcggttaggtattttggtcgtcggcgtacggacgcgggtacgagtattagattacggtgagtggaagcgggttcgacgcggttttgtaggttcgatattcgttaggtattagggttgggaggggtgaggggcgcgcgtcgtagtgcggttgttttggcgtcgtt

SEQ ID NO: 3612 - DNA, 949 bp, Artificial Sequence
  chemically treated genomic DNA (Homo sapiens) CpG-island No: 3612
aacgacgccaaaacaaccgcactacgacgcgcgcccctcacccctcccaaccctaatacctaacgaatatcgaacctacaaaaccgcgtcgaacccgcttccactcaccgtaatctaatactcgtacccgcgtccgtacgccgacgaccaaaatacctaaccgaaccccgacgaaacgcgaaaaaacaaactcccctaaactctaacgaacactcgaaaaccacaacgaccgataccgatactccaaatacctataatactatctacaacgaaaaataataaaacgataacaatcgcgaacgaacaccaaaaaacaaaactaaaaaacgctaaatcgccaaacccaaaaaaccacccacctaaaaaaacgtaccgccacccgcgccgccgaaactccgactccaacccgaattccacctattttaatctcgctcgaaaaaactacgcgacgaacgaaaacgatctaacgtcataaaaaacgaacctcgaaaacgaaacgcgcgcgcttccgacccgaaccgaaaactccgactacgacgacatccgaaacgacgaacgaactaaccaccacgaaacaaaaaaataaaatccgaaacctcaactttacaaacaaactccgccgacgaccgctaacgaacgctaaactcgcgacgctacaaaacgacgaaacccgaacctaacgccgcctacgcaaccttaatcgcgacgtaccgacgctacaacgcgacaaaaaacgaaaccgaccgcccgaaaacccaaataacgaaaacgcctccctaccgaatcaaattctcaaaacgaatctccgacgacgacgacgaaaaccgaaccgcgcgtaacccgccgcaatcacgccgttcttaatcactaataactaatactccaaactaacgacgctcacctttctcctaaccgaataacccaaaaaatttattttatattaactttc

SEQ ID NO: 3613 - DNA, 836 bp, Artificial Sequence
  chemically treated genomic DNA (Homo sapiens) CpG-island No: 3613
gcgttcgtttcgtttttcggttattgtagtatcgttttagagtttatcgtttaagttttcgtttggagtcgtcgttattcggtgttgtatttttttttgtattagagggtcgaataatttcgttattatgttttttatttgggttacgttagataataggttttggaaagggtcgtcgttattcggcgttttataggatattcgtagtttttgcggtttttttttttgttcgacgtatttttttagtagttttatggtgatcgttaagtttttagaatacgatatcgggaagcgttattcggaggcggaaattagttcgcgttcggcgtaggcgggagaagggagaggagtgatattcgtttgtcggaagtcgttttttttttttttttcgttttttttttttgttattggtttttggtattcgggttttatttttttcggttacgtttttcgcggtcgtttttttcgttttcgtcggggtcgagtcgttgttcggttgatagttgaggatggtcggagtcgagggcgtcgttgggcggtagtcggagttggagttcgtggtatcgttggtcgacgtttttgaggaggacgaggagttggagaatgaggcgtgcgttgttttgggcggtagcgatttcgagaagtgtttttatttttaggtgggcgcgcggttcgggttttttttttttcggttttcgtcgaatttttttttttcggttcggttgtttttattttcgttttgtcgtagtcgtttttttagtggtggttcggggtcgtcgttagtttgtcgtttttttattttaagtttattttttttttttaattttaattttttg

SEQ ID NO: 3614 - DNA, 836 bp, Artificial Sequence
  chemically treated genomic DNA (Homo sapiens) CpG-island No: 3614
caaaaaattaaaattaaaaaaaaaaaataaacttaaaataaaaaaacgacaaactaacgacgaccccgaaccaccactaaaaaaacgactacgacaaaacgaaaataaaaacaaccgaaccgaaaaaaaaaaattcgacgaaaaccgaaaaaaaaaaaacccgaaccgcgcgcccacctaaaaataaaaacacttctcgaaatcgctaccgcccaaaacaacgcacgcctcattctccaactcctcgtcctcctcaaaaacgtcgaccaacgataccacgaactccaactccgactaccgcccaacgacgccctcgactccgaccatcctcaactatcaaccgaacaacgactcgaccccgacgaaaacgaaaaaaacgaccgcgaaaaacgtaaccgaaaaaaataaaacccgaataccaaaaaccaataacaaaaaaaaaaaacgaaaaaaaaaaaaaaaacgacttccgacaaacgaatatcactcctctcccttctcccgcctacgccgaacgcgaactaatttccgcctccgaataacgcttcccgatatcgtattctaaaaacttaacgatcaccataaaactactaaaaaaatacgtcgaacaaaaaaaaaaaccgcaaaaactacgaatatcctataaaacgccgaataacgacgaccctttccaaaacctattatctaacgtaacccaaataaaaaacataataacgaaattattcgaccctctaatacaaaaaaaaatacaacaccgaataacgacgactccaaacgaaaacttaaacgataaactctaaaacgatactacaataaccgaaaaacgaaacgaacgc

SEQ ID NO: 3615 - DNA, 836 bp, Artificial Sequence
  chemically treated genomic DNA (Homo sapiens) CpG-island No: 3615
taggaggttggggttaaaagggaagggtgggtttggggtgaggaagcggtagattaacggcggtttcggattattattggggagacgattgcggtaaggcgggaatagggatagtcgggtcgggaaggggaggttcggcgggagtcgggggagaggaggttcgggtcgcgcgtttatttgagagtaggagtatttttcggagtcgttgtcgtttaggatagcgtacgttttattttttagtttttcgttttttttaaggacgtcgattaacgatattacgggttttagtttcgattgtcgtttagcggcgttttcggtttcggttatttttaattgttagtcgaatagcggttcggtttcggcggaggcgggaaaagcggtcgcgaggggcgtagtcggaggaggtggggttcgagtgttaggaattaatgataaggaaaaaaagcgaaggaagggggaggagcgattttcgataaacggatgttattttttttttttttttcgtttgcgtcggacgcgggttgattttcgttttcgggtggcgtttttcggtgtcgtgttttggaagtttagcggttattatggagttgttgggagagtacgtcgggtaggaagggaagtcgtagaagttgcgggtgttttgtgaggcgtcgggtgacggcgattttttttagggtttgttgtttggcgtggtttagatgaaggatatggtaacggaattattcgattttttggtatagggggaagtgtagtatcgggtggcggcggttttagacgaggatttggacggtgagttttgagacggtgttgtagtgatcggaggacggggcgggcgt

SEQ ID NO: 3616 - DNA, 836 bp, Artificial Sequence
  chemically treated genomic DNA (Homo sapiens) CpG-island No: 3616
acgcccgccccgtcctccgatcactacaacaccgtctcaaaactcaccgtccaaatcctcgtctaaaaccgccgccacccgatactacacttccccctataccaaaaaatcgaataattccgttaccatatccttcatctaaaccacgccaaacaacaaaccctaaaaaaaatcgccgtcacccgacgcctcacaaaacacccgcaacttctacgacttcccttcctacccgacgtactctcccaacaactccataataaccgctaaacttccaaaacacgacaccgaaaaacgccacccgaaaacgaaaatcaacccgcgtccgacgcaaacgaaaaaaaaaaaaaaaataacatccgtttatcgaaaatcgctcctcccccttccttcgctttttttccttatcattaattcctaacactcgaaccccacctcctccgactacgcccctcgcgaccgcttttcccgcctccgccgaaaccgaaccgctattcgactaacaattaaaaataaccgaaaccgaaaacgccgctaaacgacaatcgaaactaaaacccgtaatatcgttaatcgacgtccttaaaaaaaacgaaaaactaaaaaataaaacgtacgctatcctaaacgacaacgactccgaaaaatactcctactctcaaataaacgcgcgacccgaacctcctctcccccgactcccgccgaacctccccttcccgacccgactatccctattcccgccttaccgcaatcgtctccccaataataatccgaaaccgccgttaatctaccgcttcctcaccccaaacccacccttcccttttaaccccaacctccta

SEQ ID NO: 3617 - DNA, 895 bp, Artificial Sequence
  chemically treated genomic DNA (Homo sapiens) CpG-island No: 3617
ttttcgttgacggcgttttattttgtttgtcgtttttcgttttaggtgaaggagtttaagcgttagtttattttcgacgtggtgaacgagggcggcgaggttgagaagatggagtttttcgtgagtttttgcgaggatattattttcgagatgtagatcgtcgcgtagatttcggagttcgagggcgagtcggagatcgacgaggacgagggcgcgggcgcggcggaggcgggcgcggaaggcgcggaggagggcgcggcggggttcgagggtacggcggttacggcggcggcgggggcgacggcgcgggttgtggcggtcgtaggtcgggttttgcgaggttttagttatcgtagtttgcggcggcgcgtgcggcggttgcggcggtttacggttcgcgaggcggttatcgtagtggcggcgttgttttgggtagtagtgacgcgcgttggggtcgttggcgcgggggcggcggcgggcgcgttgggtttgttttggggttcgttgttcggcggcggtttggtggagggcgttaagaaggtgacggtgatcgagtttttggtaggtatgttcgattttattagcgacgaggtgtacggcgagtagtcggtcgggtcgggcggagacgtagacggcgagggtgttagcgagggcgttggagacgtcgcggagggcgttggagacgaggaggaggcggtgtacgaggtcgggtcgggcggtgtcgacggggcggtggtcgtgatcgatgggggtttttttcggttcgaaggggttggcggtttcggggatatgggggatacgacgtttgcggaatcgtttatattcgagggtttttttatttttaagaggaaattgggggtgagagagtaggcggggttttggggttttggaaaga

SEQ ID NO: 3618 - DNA, 895 bp, Artificial Sequence
  chemically treated genomic DNA (Homo sapiens) CpG-island No: 3618
tctttccaaaaccccaaaaccccgcctactctctcacccccaatttcctcttaaaaataaaaaaaccctcgaatataaacgattccgcaaacgtcgtatcccccatatccccgaaaccgccaaccccttcgaaccgaaaaaaacccccatcgatcacgaccaccgccccgtcgacaccgcccgacccgacctcgtacaccgcctcctcctcgtctccaacgccctccgcgacgtctccaacgccctcgctaacaccctcgccgtctacgtctccgcccgacccgaccgactactcgccgtacacctcgtcgctaataaaatcgaacatacctaccaaaaactcgatcaccgtcaccttcttaacgccctccaccaaaccgccgccgaacaacgaaccccaaaacaaacccaacgcgcccgccgccgcccccgcgccaacgaccccaacgcgcgtcactactacccaaaacaacgccgccactacgataaccgcctcgcgaaccgtaaaccgccgcaaccgccgcacgcgccgccgcaaactacgataactaaaacctcgcaaaacccgacctacgaccgccacaacccgcgccgtcgcccccgccgccgccgtaaccgccgtaccctcgaaccccgccgcgccctcctccgcgccttccgcgcccgcctccgccgcgcccgcgccctcgtcctcgtcgatctccgactcgccctcgaactccgaaatctacgcgacgatctacatctcgaaaataatatcctcgcaaaaactcacgaaaaactccatcttctcaacctcgccgccctcgttcaccacgtcgaaaataaactaacgcttaaactccttcacctaaaacgaaaaacgacaaacaaaataaaacgccgtcaacgaaaa

SEQ ID NO: 3619 - DNA, 895 bp, Artificial Sequence
  chemically treated genomic DNA (Homo sapiens) CpG-island No: 3619
tttttttaaaattttaaaatttcgtttgtttttttatttttaatttttttttgaggatgggagagttttcgggtgtgggcggtttcgtaggcgtcgtgttttttatgttttcgagatcgttagttttttcgggtcggaaggggtttttatcggttacggttatcgtttcgtcggtatcgttcggttcggtttcgtgtatcgtttttttttcgtttttagcgtttttcgcggcgtttttagcgttttcgttggtattttcgtcgtttgcgttttcgttcggttcggtcggttgttcgtcgtgtatttcgtcgttggtggggtcgggtatgtttgttaggagttcggttatcgttatttttttggcgttttttattaggtcgtcgtcgaatagcgagttttagagtaggtttagcgcgttcgtcgtcgttttcgcgttagcggttttagcgcgcgttattgttgtttagagtagcgtcgttattgcggtggtcgtttcgcgggtcgtaagtcgtcgtagtcgtcgtacgcgtcgtcgtaggttgcggtagttgaggtttcgtagggttcggtttgcggtcgttataattcgcgtcgtcgttttcgtcgtcgtcgtggtcgtcgtgttttcgagtttcgtcgcgttttttttcgcgtttttcgcgttcgttttcgtcgcgttcgcgttttcgttttcgtcggttttcggttcgttttcgggtttcgagatttgcgcggcgatttgtatttcgaagatggtgttttcgtagaaatttacgaagagttttatttttttagtttcgtcgttttcgtttattacgtcgaagatgaattggcgtttggatttttttatttgaagcgaggggcggtagataggatagggcgtcgttagcggggg

SEQ ID NO: 3620 - DNA, 895 bp, Artificial Sequence
  chemically treated genomic DNA (Homo sapiens) CpG-island No: 3620
cccccgctaacgacgccctatcctatctaccgcccctcgcttcaaataaaaaaatccaaacgccaattcatcttcgacgtaataaacgaaaacgacgaaactaaaaaaataaaactcttcgtaaatttctacgaaaacaccatcttcgaaatacaaatcgccgcgcaaatctcgaaacccgaaaacgaaccgaaaaccgacgaaaacgaaaacgcgaacgcgacgaaaacgaacgcgaaaaacgcgaaaaaaaacgcgacgaaactcgaaaacacgacgaccacgacgacgacgaaaacgacgacgcgaattataacgaccgcaaaccgaaccctacgaaacctcaactaccgcaacctacgacgacgcgtacgacgactacgacgacttacgacccgcgaaacgaccaccgcaataacgacgctactctaaacaacaataacgcgcgctaaaaccgctaacgcgaaaacgacgacgaacgcgctaaacctactctaaaactcgctattcgacgacgacctaataaaaaacgccaaaaaaataacgataaccgaactcctaacaaacatacccgaccccaccaacgacgaaatacacgacgaacaaccgaccgaaccgaacgaaaacgcaaacgacgaaaataccaacgaaaacgctaaaaacgccgcgaaaaacgctaaaaacgaaaaaaaaacgatacacgaaaccgaaccgaacgataccgacgaaacgataaccgtaaccgataaaaaccccttccgacccgaaaaaactaacgatctcgaaaacataaaaaacacgacgcctacgaaaccgcccacacccgaaaactctcccatcctcaaaaaaaaattaaaaataaaaaaacaaacgaaattttaaaattttaaaaaaa

SEQ ID NO: 3621 - DNA, 757 bp, Artificial Sequence
  chemically treated genomic DNA (Homo sapiens) CpG-island No: 3621
gggaagtaggacgtttcgggtttaggagagtttagaggaggcgacgcgtagtttagagtcgggtgtttcgtagatcgttttagttttcggttagattttatttttagtagtttcgcggatcgggatcgaggattttcgggttacgcgttttcggttttcgataggtttagtacgcgtttcgcgggcggttttagttttttttttgtagaatgggcgggggatttaggcggtgcgtttcggggcgcggagggcggtcggaaggggtgtgatggggggcgggtttcgcgtcgtttcgtttcggggagggagtttcgggcgtagtattttggcgcgggtcggggtcgtcgtcgttattgtcgtcgggtaaggttttagtacggatatggtttcgcgcggcgttcgttcgggttcgagtttttcgcgtttcgttttgtagtttttcggcggagaggcggtttcgacggtgcggacggcgtagacggtcgggcgggcggtatggaggcggcgtatttgttttcggtcgtcgacgtgttgcgttatttttcggtgatagtcgagggcggtttgagttcggcgtaggtgatcggcgcgcgggagcgttacggttttaacggtgagcgcgcgggtcgggtcgggtcggggagcgggggtcgcgcgcgtcgtagttttagtttttttttttgtttttttattcggttttgggcgggtaggaagcgagggtttcggaaattttttcggatgtttttggggtattcgg

SEQ ID NO: 3622 - DNA, 757 bp, Artificial Sequence
  chemically treated genomic DNA (Homo sapiens) CpG-island No: 3622
ccgaataccccaaaaacatccgaaaaaatttccgaaaccctcgcttcctacccgcccaaaaccgaataaaaaaacaaaaaaaaaaactaaaactacgacgcgcgcgacccccgctccccgacccgacccgacccgcgcgctcaccgttaaaaccgtaacgctcccgcgcgccgatcacctacgccgaactcaaaccgccctcgactatcaccgaaaaataacgcaacacgtcgacgaccgaaaacaaatacgccgcctccataccgcccgcccgaccgtctacgccgtccgcaccgtcgaaaccgcctctccgccgaaaaactacaaaacgaaacgcgaaaaactcgaacccgaacgaacgccgcgcgaaaccatatccgtactaaaaccttacccgacgacaataacgacgacgaccccgacccgcgccaaaatactacgcccgaaactccctccccgaaacgaaacgacgcgaaacccgccccccatcacaccccttccgaccgccctccgcgccccgaaacgcaccgcctaaatcccccgcccattctacaaaaaaaaaactaaaaccgcccgcgaaacgcgtactaaacctatcgaaaaccgaaaacgcgtaacccgaaaatcctcgatcccgatccgcgaaactactaaaaataaaatctaaccgaaaactaaaacgatctacgaaacacccgactctaaactacgcgtcgcctcctctaaactctcctaaacccgaaacgtcctacttccc

SEQ ID NO: 3623 - DNA, 757 bp, Artificial Sequence
  chemically treated genomic DNA (Homo sapiens) CpG-island No: 3623
tcgggtgttttaggagtattcgaagaggttttcggagttttcgttttttgttcgtttagagtcgggtggggaggtaggaggggaaattgagattgcggcgcgcgcggttttcgtttttcggttcggttcggttcgcgcgtttatcgttggggtcgtagcgttttcgcgcgtcggttatttgcgtcgggtttaggtcgttttcggttgttatcgagaagtggcgtagtacgtcggcggtcgggagtagatgcgtcgtttttatgtcgttcgttcggtcgtttgcgtcgttcgtatcgtcgaggtcgttttttcgtcggggggttataaagcggggcgcgggggattcgggttcgggcgggcgtcgcgcgaggttatgttcgtgttgggattttattcgacggtagtggcggcggcggtttcggttcgcgttaggatgttgcgttcgggatttttttttcggggcggggcggcgcggggttcgttttttattatatttttttcggtcgtttttcgcgtttcggggcgtatcgtttgggtttttcgtttattttgtagaggggaaattgagatcgttcgcggggcgcgtgttgggtttgtcgggagtcgggggcgcgtggttcgggggttttcggtttcggttcgcggagttgttaggggtgggatttggtcgagagttggggcggtttgcggagtattcggttttgggttgcgcgtcgttttttttgggtttttttgggttcggggcgttttgtttttt

SEQ ID NO: 3624 - DNA, 757 bp, Artificial Sequence
  chemically treated genomic DNA (Homo sapiens) CpG-island No: 3624
aaaaaacaaaacgccccgaacccaaaaaaacccaaaaaaaacgacgcgcaacccaaaaccgaatactccgcaaaccgccccaactctcgaccaaatcccacccctaacaactccgcgaaccgaaaccgaaaacccccgaaccacgcgcccccgactcccgacaaacccaacacgcgccccgcgaacgatctcaatttcccctctacaaaataaacgaaaaacccaaacgatacgccccgaaacgcgaaaaacgaccgaaaaaaatataataaaaaacgaaccccgcgccgccccgccccgaaaaaaaaatcccgaacgcaacatcctaacgcgaaccgaaaccgccgccgccactaccgtcgaataaaatcccaacacgaacataacctcgcgcgacgcccgcccgaacccgaatcccccgcgccccgctttataaccccccgacgaaaaaacgacctcgacgatacgaacgacgcaaacgaccgaacgaacgacataaaaacgacgcatctactcccgaccgccgacgtactacgccacttctcgataacaaccgaaaacgacctaaacccgacgcaaataaccgacgcgcgaaaacgctacgaccccaacgataaacgcgcgaaccgaaccgaaccgaaaaacgaaaaccgcgcgcgccgcaatctcaatttcccctcctacctccccacccgactctaaacgaacaaaaaacgaaaactccgaaaacctcttcgaatactcctaaaacacccga

SEQ ID NO: 3625 - DNA, 502 bp, Artificial Sequence
  chemically treated genomic DNA (Homo sapiens) CpG-island No: 3625
gcggtcgggagggatttcggggattttaggacgtcgggggcgtggcgaggtcggtttcgtcgtaggggagggagggtttttatcgcgtcgtttatcgcggttttttagtttaggagggggcgggagtttcgggtttcgattgggcggcgttggcggggtcgttcgtttcgattaatgagcgtcggtcgggcgcggcggtgggcggggtagcgagcgttgttcggagtcgcggcgttcgcgggttgagttcggcgatttgggttttagcgaggcggtggggcggggcggggcggggcggggcgcgtagtaggagcgagtggggtcgttcgtcgggtcgcggatattgtcgttcggcgtttaggtagggatcggcggggcggggacgcgggcgaggagtaggaggacgaacgttttaatatttgtttcgagtttgtaagggagaggcggggggggtttgttaggtcgcgtttacgagggagttgggatttggttagggcgggga

SEQ ID NO: 3626 - DNA, 502 bp, Artificial Sequence
  chemically treated genomic DNA (Homo sapiens) CpG-island No: 3626
tccccgccctaaccaaatcccaactccctcgtaaacgcgacctaacaaaccccccccgcctctcccttacaaactcgaaacaaatattaaaacgttcgtcctcctactcctcgcccgcgtccccgccccgccgatccctacctaaacgccgaacgacaatatccgcgacccgacgaacgaccccactcgctcctactacgcgccccgccccgccccgccccgccccaccgcctcgctaaaacccaaatcgccgaactcaacccgcgaacgccgcgactccgaacaacgctcgctaccccgcccaccgccgcgcccgaccgacgctcattaatcgaaacgaacgaccccgccaacgccgcccaatcgaaacccgaaactcccgccccctcctaaactaaaaaaccgcgataaacgacgcgataaaaaccctccctcccctacgacgaaaccgacctcgccacgcccccgacgtcctaaaatccccgaaatccctcccgaccgc

SEQ ID NO: 3627 - DNA, 502 bp, Artificial Sequence
  chemically treated genomic DNA (Homo sapiens) CpG-island No: 3627
ttttcgttttgattagattttagttttttcgtagacgcggtttggtagatttttttcgttttttttttgtaggttcggggtaggtgttaaggcgttcgtttttttgtttttcgttcgcgttttcgtttcgtcgatttttatttgggcgtcgggcgatagtgttcgcggttcggcgggcggttttattcgtttttgttgcgcgtttcgtttcgtttcgtttcgttttatcgtttcgttggggtttagatcgtcgagtttagttcgcgggcgtcgcggtttcgggtagcgttcgttgtttcgtttatcgtcgcgttcggtcggcgtttattggtcggagcgaacggtttcgttagcgtcgtttaatcggagttcgggattttcgtttttttttggattaagggatcgcggtgggcggcgcggtaggggtttttttttttttgcggcggggtcgatttcgttacgttttcggcgttttggggttttcgaagtttttttcggtcgt

SEQ ID NO: 3628 - DNA, 502 bp, Artificial Sequence
  chemically treated genomic DNA (Homo sapiens) CpG-island No: 3628
acgaccgaaaaaaacttcgaaaaccccaaaacgccgaaaacgtaacgaaatcgaccccgccgcaaaaaaaaaaaaacccctaccgcgccgcccaccgcgatcccttaatccaaaaaaaaacgaaaatcccgaactccgattaaacgacgctaacgaaaccgttcgctccgaccaataaacgccgaccgaacgcgacgataaacgaaacaacgaacgctacccgaaaccgcgacgcccgcgaactaaactcgacgatctaaaccccaacgaaacgataaaacgaaacgaaacgaaacgaaacgcgcaacaaaaacgaataaaaccgcccgccgaaccgcgaacactatcgcccgacgcccaaataaaaatcgacgaaacgaaaacgcgaacgaaaaacaaaaaaacgaacgccttaacacctaccccgaacctacaaaaaaaaaacgaaaaaaatctaccaaaccgcgtctacgaaaaaactaaaatctaatcaaaacgaaaa

SEQ ID NO: 3629 - DNA, 619 bp, Artificial Sequence
  chemically treated genomic DNA (Homo sapiens) CpG-island No: 3629
gggtttgcggggtgtttcgcggagtttgttcgggtttgcgtcggtcgtcgggatcgtatcgtcgcgggtgtttcgtcgtttgcgttttttttcgtttttgtttgcggatcgtatttattttcggtgtattgtttttcgcgttcggtttttggtggaggttacgtttgtgcggagtgggttcggttcggggtatttacgtgcggtttttcgcggagcgttttttttacggttcgtcggagcgtttttttgtaggagtcgggggcggggtgggagatgaatggggcggcggcggcgcgcggtttaggttgcgtagggttttgttttggttggggcgagagggggcggtagaggcgggcgttgcggtttcggggttcgggaggcgtagggttggtggttgggggggtgtttacgtgcgtagggatttgcgtgtgttgtttggaggcgggtgtgcgtgtgttacgtggacgcgggagtgtgtttgtgtttgcgtggggggtgtaggataggatggagtggtgtgtgagggcgggttacgcggatacgggcgtgtgtttgttaggggagggggtgtgtttaagttttggcgttgtagggttgtgtagagaaggttgtgttatag

SEQ ID NO: 3630 - DNA, 619 bp, Artificial Sequence
  chemically treated genomic DNA (Homo sapiens) CpG-island No: 3630
ctataacacaaccttctctacacaaccctacaacgccaaaacttaaacacaccccctcccctaacaaacacacgcccgtatccgcgtaacccgccctcacacaccactccatcctatcctacaccccccacgcaaacacaaacacactcccgcgtccacgtaacacacgcacacccgcctccaaacaacacacgcaaatccctacgcacgtaaacacccccccaaccaccaaccctacgcctcccgaaccccgaaaccgcaacgcccgcctctaccgccccctctcgccccaaccaaaacaaaaccctacgcaacctaaaccgcgcgccgccgccgccccattcatctcccaccccgcccccgactcctacaaaaaaacgctccgacgaaccgtaaaaaaaacgctccgcgaaaaaccgcacgtaaataccccgaaccgaacccactccgcacaaacgtaacctccaccaaaaaccgaacgcgaaaaacaatacaccgaaaataaatacgatccgcaaacaaaaacgaaaaaaaacgcaaacgacgaaacacccgcgacgatacgatcccgacgaccgacgcaaacccgaacaaactccgcgaaacaccccgcaaaccc

SEQ ID NO: 3631 - DNA, 619 bp, Artificial Sequence
  chemically treated genomic DNA (Homo sapiens) CpG-island No: 3631
ttgtgatatagttttttttgtatagttttgtaacgttaagatttgagtatatttttttttttgataggtatacgttcgtgttcgcgtgattcgtttttatatattattttattttgttttgtattttttacgtagatataggtatattttcgcgtttacgtgatatacgtatattcgtttttaaatagtatacgtaggtttttgcgtacgtggatatttttttagttattagttttgcgtttttcgggtttcgaagtcgtagcgttcgtttttgtcgttttttttcgttttagttaaggtaggattttgcgtagtttgagtcgcgcgtcgtcgtcgttttatttattttttatttcgttttcggtttttgtaggaagacgtttcggcgggtcgtgggaggagcgtttcgcggagaatcgtacgtgggtgtttcgggtcgggtttatttcgtatagacgtggtttttattaggagtcgggcgcgggggatagtgtatcggggatggatgcggttcgtagatagaagcggggaagaacgtagacggcggggtattcgcggcgatgcggtttcggcggtcggcgtagattcgagtagatttcgcgaggtatttcgtagattt

SEQ ID NO: 3632 - DNA, 619 bp, Artificial Sequence
  chemically treated genomic DNA (Homo sapiens) CpG-island No: 3632
aaatctacgaaatacctcgcgaaatctactcgaatctacgccgaccgccgaaaccgcatcgccgcgaataccccgccgtctacgttcttccccgcttctatctacgaaccgcatccatccccgatacactatcccccgcgcccgactcctaataaaaaccacgtctatacgaaataaacccgacccgaaacacccacgtacgattctccgcgaaacgctcctcccacgacccgccgaaacgtcttcctacaaaaaccgaaaacgaaataaaaaataaataaaacgacgacgacgcgcgactcaaactacgcaaaatcctaccttaactaaaacgaaaaaaaacgacaaaaacgaacgctacgacttcgaaacccgaaaaacgcaaaactaataactaaaaaaatatccacgtacgcaaaaacctacgtatactatttaaaaacgaatatacgtatatcacgtaaacgcgaaaatatacctatatctacgtaaaaaatacaaaacaaaataaaataatatataaaaacgaatcacgcgaacacgaacgtatacctatcaaaaaaaaaaatatactcaaatcttaacgttacaaaactatacaaaaaaaactatatcacaa

SEQ ID NO: 3633 - DNA, 678 bp, Artificial Sequence
  chemically treated genomic DNA (Homo sapiens) CpG-island No: 3633
ttcgttttcgttttcgtttagtttcgtttttttttttttaggtttcgttcgcgtagtcggttcggttttttttcgttattagggggcggcggcgttaagggcggttttttgggtcgaagtcggcgacgttttaggtagttgcggcggtttttttgtggttagtggtagcggcgttttagtcggcggtcgtgaggggcgggtttttagtggtgcggtcggtaggtagcgatggcggtcgtacggggtttgcgggtgtcggtgaaggcggaggtttcggcggggtcggttttggggttttcgttttttgaggcggagttcggtgttgatcgtggcgagtcggagtttatggaggtggaggagggcgagttggaaatcgtgtttgtgcggcgttcgtttaaggaattgatttcggtacgggcgggggtcggggggtaaggaagaggtcgcggggttagtgtttagcgtcggagggggtcggaaggggcggtggtcggagttttagtcggggaagttaagggagcgggagaggagggagttagcgttttgggaacgggaacgtcgggttggaggagggacgcggagcgggagaaaggacgtcggggcgtcggaaatgggtgttgagggggttggggggtggtggcggagagttgggagggagttgaggattttttttcgttg

SEQ ID NO: 3634 - DNA, 678 bp, Artificial Sequence
  chemically treated genomic DNA (Homo sapiens) CpG-island No: 3634
caacgaaaaaaaatcctcaactccctcccaactctccgccaccaccccccaaccccctcaacacccatttccgacgccccgacgtcctttctcccgctccgcgtccctcctccaacccgacgttcccgttcccaaaacgctaactccctcctctcccgctcccttaacttccccgactaaaactccgaccaccgccccttccgaccccctccgacgctaaacactaaccccgcgacctcttccttaccccccgacccccgcccgtaccgaaatcaattccttaaacgaacgccgcacaaacacgatttccaactcgccctcctccacctccataaactccgactcgccacgatcaacaccgaactccgcctcaaaaaacgaaaaccccaaaaccgaccccgccgaaacctccgccttcaccgacacccgcaaaccccgtacgaccgccatcgctacctaccgaccgcaccactaaaaacccgcccctcacgaccgccgactaaaacgccgctaccactaaccacaaaaaaaccgccgcaactacctaaaacgtcgccgacttcgacccaaaaaaccgcccttaacgccgccgccccctaataacgaaaaaaaaccgaaccgactacgcgaacgaaacctaaaaaaaaaaaaacgaaactaaacgaaaacgaaaacgaa

SEQ ID NO: 3635 - DNA, 678 bp, Artificial Sequence
  chemically treated genomic DNA (Homo sapiens) CpG-island No: 3635
tagcggaggggggtttttaatttttttttagtttttcgttattattttttagtttttttaatatttattttcggcgtttcggcgttttttttttcgtttcgcgttttttttttagttcggcgttttcgtttttaggacgttggtttttttttttttcgtttttttgattttttcggttggggtttcggttatcgtttttttcggtttttttcggcgttagatattagtttcgcgattttttttttatttttcgattttcgttcgtatcgggattagttttttgagcgagcgtcgtataggtacgatttttagttcgtttttttttatttttatgggtttcggttcgttacggttaatatcggatttcgttttaggggacgggagttttagggtcggtttcgtcggggttttcgtttttatcgatattcgtaggtttcgtacggtcgttatcgttgtttgtcggtcgtattattgagagttcgttttttacggtcgtcggttagagcgtcgttgttattggttatagaggagtcgtcgtagttatttagagcgtcgtcggtttcggtttagaaggtcgtttttagcgtcgtcgttttttggtggcgggagaaaatcgggtcggttgcgcgggcgggatttggggaggagaaggcgggattgagcggggacgggggcggg

SEQ ID NO: 3636 - DNA, 678 bp, Artificial Sequence
  chemically treated genomic DNA (Homo sapiens) CpG-island No: 3636
cccgcccccgtccccgctcaatcccgccttctcctccccaaatcccgcccgcgcaaccgacccgattttctcccgccaccaaaaaacgacgacgctaaaaacgaccttctaaaccgaaaccgacgacgctctaaataactacgacgactcctctataaccaataacaacgacgctctaaccgacgaccgtaaaaaacgaactctcaataatacgaccgacaaacaacgataacgaccgtacgaaacctacgaatatcgataaaaacgaaaaccccgacgaaaccgaccctaaaactcccgtcccctaaaacgaaatccgatattaaccgtaacgaaccgaaacccataaaaataaaaaaaaacgaactaaaaatcgtacctatacgacgctcgctcaaaaaactaatcccgatacgaacgaaaatcgaaaaataaaaaaaaaatcgcgaaactaatatctaacgccgaaaaaaaccgaaaaaaacgataaccgaaaccccaaccgaaaaaatcaaaaaaacgaaaaaaaaaaaaaccaacgtcctaaaaacgaaaacgccgaactaaaaaaaaaacgcgaaacgaaaaaaaaaacgccgaaacgccgaaaataaatattaaaaaaactaaaaaataataacgaaaaactaaaaaaaaattaaaaacccccctccgcta

SEQ ID NO: 3637 - DNA, 1441 bp, Artificial Sequence
  chemically treated genomic DNA (Homo sapiens) CpG-island No: 3637
ttgcggcgcggtttttcggagttttttcgggttggaggcggtttagataaaggcggcggcggggtcggagcgcgtaggggaggagcgcgggttgcgtttaattttttttcgcggcggttgtaggataaaggcgtaaaggtagcggtcgaggtcggagtttacgcggggcgtgttcggtgcggggcgttcggcgcgggttgggttgggttcgggcgattttttttttcggggcggacggtgcggggatttttaggatagtaattttcgacgagggttatttattttggcgatttacgatttcggcgacgtgttcggagttgggtatcgggacgtattcggttatgttgacgttttttttgcggttgtcgattacgtttatttggtcggttagtagcgtcgggggttttagggtcgcggggtggggcgcgaagttcgcgaatacgtcggggggcgacggtcggggcggcggcggcggcgggggattcgcgttggggtttagtagcggtagcgattcgggggttacggcgggggttagggtcgggggcgcgtcggttttaggttcgtcggggggtataggtttcggagtcgtttcgtcgttcgcgtttttcgtcgtcgttgcgtcgttttcggtcgtttttttttcgttcgtgtcgttagcgttttttagttcgagcgtcgatagttggtttagcgttaggcggagcgcggcggtcgcgtcgtcgggttcgggcggcggtcggggcgcgggcgcggttttttgggcgttttcgggcgggggcgtaggttcgggttcggggttttttttcgtcgtttttacgtcgtcgtcgtcgtcgttttcgttttcgtcgtcgtcgggttggtcgagcgagttgggtatggcgggagttagcgttggggttcgcgtttttgtcgttcgcgtcgtcgtcgtcgttcgcgtcgtttttcgtttttgcgagttgggtcgtcggtcgtttgtatttagcggcgggggcgggtacggggggtcgggcgggcggggcggcggcggcgcggggttgttcggggtcgggtcgggtcgggtcgggcggcggtagcgattttggttgcggttcggcggcggcggcgacggcggcggcggtttttcggcggtcgaggcggcggcggcggcgcgggacgttttttttttttcgtcgtttttcgcggtttcgtttcggtttcgttttcgcgacgttacgtcgcggtttaataatgggcggtttttagggcgtaggcgcgcggggcggggtcggggcggggtcggcgtcgggtacgtggtttaggtttcgttttcgttcggcgttcgggcgggaattcgggcgtattcgtacgtgcgggcgttgttgtaggtgtgtgcggtttagtttttgtttggatagcgttttttttttaagtttgagagtttttgtttcgcgcgttttagggt

SEQ ID NO: 3638 - DNA, 1441 bp, Artificial Sequence
  chemically treated genomic DNA (Homo sapiens) CpG-island No: 3638
accctaaaacgcgcgaaacaaaaactctcaaacttaaaaaaaaaacgctatccaaacaaaaactaaaccgcacacacctacaacaacgcccgcacgtacgaatacgcccgaattcccgcccgaacgccgaacgaaaacgaaacctaaaccacgtacccgacgccgaccccgccccgaccccgccccgcgcgcctacgccctaaaaaccgcccattattaaaccgcgacgtaacgtcgcgaaaacgaaaccgaaacgaaaccgcgaaaaacgacgaaaaaaaaaaaacgtcccgcgccgccgccgccgcctcgaccgccgaaaaaccgccgccgccgtcgccgccgccgccgaaccgcaaccaaaatcgctaccgccgcccgacccgacccgacccgaccccgaacaaccccgcgccgccgccgccccgcccgcccgaccccccgtacccgcccccgccgctaaatacaaacgaccgacgacccaactcgcaaaaacgaaaaacgacgcgaacgacgacgacgacgcgaacgacaaaaacgcgaaccccaacgctaactcccgccatacccaactcgctcgaccaacccgacgacgacgaaaacgaaaacgacgacgacgacgacgtaaaaacgacgaaaaaaaaccccgaacccgaacctacgcccccgcccgaaaacgcccaaaaaaccgcgcccgcgccccgaccgccgcccgaacccgacgacgcgaccgccgcgctccgcctaacgctaaaccaactatcgacgctcgaactaaaaaacgctaacgacacgaacgaaaaaaaaacgaccgaaaacgacgcaacgacgacgaaaaacgcgaacgacgaaacgactccgaaacctataccccccgacgaacctaaaaccgacgcgcccccgaccctaacccccgccgtaacccccgaatcgctaccgctactaaaccccaacgcgaatcccccgccgccgccgccgccccgaccgtcgccccccgacgtattcgcgaacttcgcgccccaccccgcgaccctaaaacccccgacgctactaaccgaccaaataaacgtaatcgacaaccgcaaaaaaaacgtcaacataaccgaatacgtcccgatacccaactccgaacacgtcgccgaaatcgtaaatcgccaaaataaataaccctcgtcgaaaattactatcctaaaaatccccgcaccgtccgccccgaaaaaaaaaatcgcccgaacccaacccaacccgcgccgaacgccccgcaccgaacacgccccgcgtaaactccgacctcgaccgctacctttacgcctttatcctacaaccgccgcgaaaaaaaattaaacgcaacccgcgctcctcccctacgcgctccgaccccgccgccgcctttatctaaaccgcctccaacccgaaaaaactccgaaaaaccgcgccgcaa

SEQ ID NO: 3639 - DNA, 1441 bp, Artificial Sequence
  chemically treated genomic DNA (Homo sapiens) CpG-island No: 3639
gttttggggcgcgcgaggtagggatttttaggtttggggagggagcgttgtttaggtaggggttgagtcgtatatatttgtagtagcgttcgtacgtgcggatgcgttcgggttttcgttcgagcgtcgggcggaggcggggtttggattacgtgttcggcgtcggtttcgtttcggtttcgtttcgcgcgtttgcgttttgggggtcgtttattgttgggtcgcggcgtgacgtcgcgggggcggggtcggggcggggtcgcgggaggcggcgggagggaaggagcgtttcgcgtcgtcgtcgtcgtttcggtcgtcgaggagtcgtcgtcgtcgtcgtcgtcgtcgtcgagtcgtagttagagtcgttgtcgtcgttcggttcggttcggttcggtttcgagtagtttcgcgtcgtcgtcgtttcgttcgttcggtttttcgtgttcgttttcgtcgttggatgtaggcggtcggcggtttagttcgtagaggcggagggcggcgcgggcggcggcggcggcgcgggcggtaggagcgcgggttttagcgttagttttcgttatgtttagttcgttcggttagttcgacggcggcgggggcgggggcggcggcggcggcggcgtgggggcggcgggggaggatttcggattcggatttgcgttttcgttcgagggcgtttaggaggtcgcgttcgcgtttcggtcgtcgttcgaattcgacgacgcggtcgtcgcgtttcgtttggcgttggattagttgtcggcgttcgggttggggggcgttggcgatacggacgaggagggggcggtcggggacggcgtagcggcggcggggggcgcggacggcggggcggtttcggagtttgtgtttttcgacggatttgaggtcggcgcgttttcgattttggttttcgtcgtggttttcgggtcgttgtcgttgttggattttaacgcgagtttttcgtcgtcgtcgtcgtttcggtcgtcgtttttcgacgtgttcgcgggtttcgcgttttatttcgcggttttggggttttcgacgttgttggtcgattagatgagcgtgatcggtagtcgtaagaaaagcgttaatatgatcgagtgcgtttcggtgtttagtttcgagtacgtcgtcgagatcgtgggtcgttagggtgagtggttttcgtcgggggttgttgttttgggggttttcgtatcgttcgtttcggggaagggggtcgttcgagtttagtttagttcgcgtcggacgtttcgtatcggatacgtttcgcgtgggtttcggtttcggtcgttgtttttgcgtttttgttttgtagtcgtcgcgggagaaagttgggcgtagttcgcgttttttttttgcgcgtttcggtttcgtcgtcgtttttgtttgggtcgtttttagttcggaaaggtttcggggagtcgcgtcgtag

SEQ ID NO: 3640 - DNA, 1441 bp, Artificial Sequence
  chemically treated genomic DNA (Homo sapiens) CpG-island No: 3640
ctacgacgcgactccccgaaacctttccgaactaaaaacgacccaaacaaaaacgacgacgaaaccgaaacgcgcaaaaaaaaaacgcgaactacgcccaactttctcccgcgacgactacaaaacaaaaacgcaaaaacaacgaccgaaaccgaaacccacgcgaaacgtatccgatacgaaacgtccgacgcgaactaaactaaactcgaacgacccccttccccgaaacgaacgatacgaaaacccccaaaacaacaacccccgacgaaaaccactcaccctaacgacccacgatctcgacgacgtactcgaaactaaacaccgaaacgcactcgatcatattaacgcttttcttacgactaccgatcacgctcatctaatcgaccaacaacgtcgaaaaccccaaaaccgcgaaataaaacgcgaaacccgcgaacacgtcgaaaaacgacgaccgaaacgacgacgacgacgaaaaactcgcgttaaaatccaacaacgacaacgacccgaaaaccacgacgaaaaccaaaatcgaaaacgcgccgacctcaaatccgtcgaaaaacacaaactccgaaaccgccccgccgtccgcgccccccgccgccgctacgccgtccccgaccgccccctcctcgtccgtatcgccaacgccccccaacccgaacgccgacaactaatccaacgccaaacgaaacgcgacgaccgcgtcgtcgaattcgaacgacgaccgaaacgcgaacgcgacctcctaaacgccctcgaacgaaaacgcaaatccgaatccgaaatcctcccccgccgcccccacgccgccgccgccgccgcccccgcccccgccgccgtcgaactaaccgaacgaactaaacataacgaaaactaacgctaaaacccgcgctcctaccgcccgcgccgccgccgccgcccgcgccgccctccgcctctacgaactaaaccgccgaccgcctacatccaacgacgaaaacgaacacgaaaaaccgaacgaacgaaacgacgacgacgcgaaactactcgaaaccgaaccgaaccgaaccgaacgacgacaacgactctaactacgactcgacgacgacgacgacgacgacgacgactcctcgacgaccgaaacgacgacgacgacgcgaaacgctccttccctcccgccgcctcccgcgaccccgccccgaccccgcccccgcgacgtcacgccgcgacccaacaataaacgacccccaaaacgcaaacgcgcgaaacgaaaccgaaacgaaaccgacgccgaacacgtaatccaaaccccgcctccgcccgacgctcgaacgaaaacccgaacgcatccgcacgtacgaacgctactacaaatatatacgactcaacccctacctaaacaacgctccctccccaaacctaaaaatccctacctcgcgcgccccaaaac

SEQ ID NO: 3641 - DNA, 814 bp, Artificial Sequence
  chemically treated genomic DNA (Homo sapiens) CpG-island No: 3641
cgttgtgcgttgagtttatttggcgcggttggtttatcgttttttgcgggtcgtttttgattttgttgttggggtggttggtaattttggttatcggttgtttgaagatggacgtcgtttggcgtacgggtagcgtcgtgtttaggtcgggtttgttttgcgggaggaaggatatgtagttcggtttgggggcgtttcggcggcgcggagttttagggggtgcggggttcgggtgattttttgttttgtcggcgtttttcgtgtttttcgcgttcgttaggatttttacggttcggggaggtcgttttcgtagggtcggttcggtcggttttggaacgttcgtcgcgggtcgcgttttcgttatgcgttttgcgttttgtattttgtggtttgcgtttttcgttttgtgtttttcgttcgttgtgattttttgcgtttaggacgtcgggttgtgtcgtttgtagtttacgttatggtcgcgttttcgtttagaacgtttcgcgtcgacgttatttgcgtgacgttattatttattttgatttggttggaggagtcgtagcgtacgcgttggcggtttttgtttattttgtttattagtattttgttcgtgcggaagtcgaaggtgtttaggtttatggagtcgtttaggtagcgcgttagttgcggtttgttgcggaattttttttcgttcgggttgcggggaggcgggacggtcggcgtttcgggcggattttagattttaaatttaggtttcggtcgtagatttaaatttagttttagttttagttttaggtcgcgattttagttttagatt

SEQ ID NO: 3642 - DNA, 814 bp, Artificial Sequence
  chemically treated genomic DNA (Homo sapiens) CpG-island No: 3642
aatctaaaactaaaatcgcgacctaaaactaaaactaaaactaaatttaaatctacgaccgaaacctaaatttaaaatctaaaatccgcccgaaacgccgaccgtcccgcctccccgcaacccgaacgaaaaaaaattccgcaacaaaccgcaactaacgcgctacctaaacgactccataaacctaaacaccttcgacttccgcacgaacaaaatactaataaacaaaataaacaaaaaccgccaacgcgtacgctacgactcctccaaccaaatcaaaataaataataacgtcacgcaaataacgtcgacgcgaaacgttctaaacgaaaacgcgaccataacgtaaactacaaacgacacaacccgacgtcctaaacgcaaaaaatcacaacgaacgaaaaacacaaaacgaaaaacgcaaaccacaaaatacaaaacgcaaaacgcataacgaaaacgcgacccgcgacgaacgttccaaaaccgaccgaaccgaccctacgaaaacgacctccccgaaccgtaaaaatcctaacgaacgcgaaaaacacgaaaaacgccgacaaaacaaaaaatcacccgaaccccgcaccccctaaaactccgcgccgccgaaacgcccccaaaccgaactacatatccttcctcccgcaaaacaaacccgacctaaacacgacgctacccgtacgccaaacgacgtccatcttcaaacaaccgataaccaaaattaccaaccaccccaacaacaaaatcaaaaacgacccgcaaaaaacgataaaccaaccgcgccaaataaactcaacgcacaacg

SEQ ID NO: 3643 - DNA, 814 bp, Artificial Sequence
  chemically treated genomic DNA (Homo sapiens) CpG-island No: 3643
ggtttggggttggggtcgcgatttgaagttggggttgggattgggtttgggtttgcggtcgaggtttgggtttggggtttggggttcgttcggggcgtcgatcgtttcgttttttcgtagttcgagcgggaagaagtttcgtagtaagtcgtagttggcgcgttatttgggcggttttatggatttgagtattttcgattttcgtacgggtaagatgttgatgagtaagatgaataagagtcgttagcgcgtgcgttacgatttttttaattaggttaaggtgagtggtggcgttacgtaggtgacgtcggcgcggggcgttttaggcggggacgcggttatgacgtgagttgtaggcgatatagttcggcgttttgagcgtaggaggttatagcgggcggagggtatagagcggaaggcgtaggttatagggtgtagagcgtaaggcgtatggcgaggacgcggttcgcggcgggcgttttagagtcggtcggatcgattttgcgggagcggttttttcggatcgtgggggttttggcgggcgcgggggatacgaggggcgtcggtaaagtagggggttattcgggtttcgtattttttgaggtttcgcgtcgtcggggcgtttttaggtcggattgtatattttttttttcgtagggtaagttcgatttgaatacggcgttgttcgtgcgttagacggcgtttatttttaagtagtcggtgattaagattattaattattttagtaataaggttaagagcgattcgtagaaggcggtggattagtcgcgttaggtgagtttaacgtatagcg

SEQ ID NO: 3644 - DNA, 814 bp, Artificial Sequence
  chemically treated genomic DNA (Homo sapiens) CpG-island No: 3644
cgctatacgttaaactcacctaacgcgactaatccaccgccttctacgaatcgctcttaaccttattactaaaataattaataatcttaatcaccgactacttaaaaataaacgccgtctaacgcacgaacaacgccgtattcaaatcgaacttaccctacgaaaaaaaaaatatacaatccgacctaaaaacgccccgacgacgcgaaacctcaaaaaatacgaaacccgaataaccccctactttaccgacgcccctcgtatcccccgcgcccgccaaaacccccacgatccgaaaaaaccgctcccgcaaaatcgatccgaccgactctaaaacgcccgccgcgaaccgcgtcctcgccatacgccttacgctctacaccctataacctacgccttccgctctataccctccgcccgctataacctcctacgctcaaaacgccgaactatatcgcctacaactcacgtcataaccgcgtccccgcctaaaacgccccgcgccgacgtcacctacgtaacgccaccactcaccttaacctaattaaaaaaatcgtaacgcacgcgctaacgactcttattcatcttactcatcaacatcttacccgtacgaaaatcgaaaatactcaaatccataaaaccgcccaaataacgcgccaactacgacttactacgaaacttcttcccgctcgaactacgaaaaaacgaaacgatcgacgccccgaacgaaccccaaaccccaaacccaaacctcgaccgcaaacccaaacccaatcccaaccccaacttcaaatcgcgaccccaaccccaaacc

SEQ ID NO: 3645 - DNA, 907 bp, Artificial Sequence
  chemically treated genomic DNA (Homo sapiens) CpG-island No: 3645
gcgcgtacgaataaaggtcgtagtcgtcgttcggtagttagtttttgaacggtcggtcgaaagttatgcggtttaataagcggcgtacgcgtattgggttttcgcgcgtcgggcgtatacgtacgtaagacgtacgtacgtacgtacgacgtacgcgcggggtttaggtcgcggttcggggtaggggcgtcgaggtcgtcgtagaggtcgttgggaggagttcgttgaggttttgcgcggtcggcgcgtttatttatttatagtaaaagatatttttgtggtcggtcgatagtttcgattttttgggtatttttttttttttttagttttgcgggagcgtcgggtatttttatttttttcgttttattgcgttcggtttttcggttcgtcgtcgggttcgtcgtcgtcgttcggatttttattcgtcgtcgtcgttttagttgttttcgttgtcgttgtcgtcgtcgttatttgtcgcggttgtttcggttcgcgggttttcgtttttcgtttttagtcgggcgcgcgtcggttttgtcgttttttcggtttttttttcgcgttcgttagttttcgttcggggggttcgtttcgtttattcgttcgcgcggggtttcgcgttgcgtagtcgcggcgttatgttttcgtttttttacggtttcgttaattagcgcgttgggagggggcggggttttaagtggcgtgcgcgtttgcgcgttgtgttttgcgagttgttagtgtttagtagttgtgttcggagttcgcgcggttttttttattgtgttttgtttttgtcggtcgtttggtgcgcgtgcgcggggatatgttttcggattagtggggttttttttttcgatttttttttagtttaagttttggggattttggtttagtgattggatttcga

SEQ ID NO: 3646 - DNA, 907 bp, Artificial Sequence
  chemically treated genomic DNA (Homo sapiens) CpG-island No: 3646
tcgaaatccaatcactaaaccaaaatccccaaaacttaaactaaaaaaaaatcgaaaaaaaaaaccccactaatccgaaaacatatccccgcgcacgcgcaccaaacgaccgacaaaaacaaaacacaataaaaaaaaccgcgcgaactccgaacacaactactaaacactaacaactcgcaaaacacaacgcgcaaacgcgcacgccacttaaaaccccgccccctcccaacgcgctaattaacgaaaccgtaaaaaaacgaaaacataacgccgcgactacgcaacgcgaaaccccgcgcgaacgaataaacgaaacgaaccccccgaacgaaaactaacgaacgcgaaaaaaaaaccgaaaaaacgacaaaaccgacgcgcgcccgactaaaaacgaaaaacgaaaacccgcgaaccgaaacaaccgcgacaaataacgacgacgacaacgacaacgaaaacaactaaaacgacgacgacgaataaaaatccgaacgacgacgacgaacccgacgacgaaccgaaaaaccgaacgcaataaaacgaaaaaaataaaaatacccgacgctcccgcaaaactaaaaaaaaaaaaaaatacccaaaaaatcgaaactatcgaccgaccacaaaaatatcttttactataaataaataaacgcgccgaccgcgcaaaacctcaacgaactcctcccaacgacctctacgacgacctcgacgcccctaccccgaaccgcgacctaaaccccgcgcgtacgtcgtacgtacgtacgtacgtcttacgtacgtatacgcccgacgcgcgaaaacccaatacgcgtacgccgcttattaaaccgcataactttcgaccgaccgttcaaaaactaactaccgaacgacgactacgacctttattcgtacgcgc

SEQ ID NO: 3647 - DNA, 907 bp, Artificial Sequence
  chemically treated genomic DNA (Homo sapiens) CpG-island No: 3647
tcgaggtttagttattgggttagagtttttaagatttgggttggagaaaggtcggaggaaaggattttattagttcgaaagtatgttttcgcgtacgcgtattaggcggtcggtagagatagggtatagtaaaaggagtcgcgcggatttcgggtatagttgttgggtattggtagttcgtaaggtatagcgcgtaggcgcgtacgttatttaaggtttcgtttttttttagcgcgttgattggcggggtcgtagaggggcgggggtatggcgtcgcggttgcgtagcgcggggtttcgcgcgggcgggtgggcggagcgggtttttcgagcgggggttggcgagcgcggggagggggtcgaaagggcggtaaagtcggcgcgcgttcggttgggggcggagggcgggggttcgcgggtcggaatagtcgcggtaagtggcggcggcggtagcggtagcggaggtagttgaggcggcggcggcgagtgggggttcgggcggcggcggcgggttcggcggcgggtcgaggagtcgggcgtaatggagcggaagaggtgggagtgttcggcgttttcgtagggttgggagagggaagaagtgtttagaaggtcggggttgtcggtcggttatagggatgttttttattataggtgaatgagcgcgtcggtcgcgtagggttttaacgggttttttttagcggtttttgcggcggtttcggcgtttttgtttcgggtcgcggtttgggtttcgcgcgtgcgtcgtgcgtgcgtgcgtgcgttttgcgtgcgtgtgcgttcggcgcgcggaggtttagtgcgcgtgcgtcgtttgttgggtcgtatggttttcggtcggtcgtttagggattggttgtcggacggcgattgcggtttttgttcgtgcgcgt

SEQ ID NO: 3648 - DNA, 907 bp, Artificial Sequence
  chemically treated genomic DNA (Homo sapiens) CpG-island No: 3648
acgcgcacgaacaaaaaccgcaatcgccgtccgacaaccaatccctaaacgaccgaccgaaaaccatacgacccaacaaacgacgcacgcgcactaaacctccgcgcgccgaacgcacacgcacgcaaaacgcacgcacgcacgcacgacgcacgcgcgaaacccaaaccgcgacccgaaacaaaaacgccgaaaccgccgcaaaaaccgctaaaaaaaacccgttaaaaccctacgcgaccgacgcgctcattcacctataataaaaaacatccctataaccgaccgacaaccccgaccttctaaacacttcttccctctcccaaccctacgaaaacgccgaacactcccacctcttccgctccattacgcccgactcctcgacccgccgccgaacccgccgccgccgcccgaacccccactcgccgccgccgcctcaactacctccgctaccgctaccgccgccgccacttaccgcgactattccgacccgcgaacccccgccctccgcccccaaccgaacgcgcgccgactttaccgccctttcgaccccctccccgcgctcgccaacccccgctcgaaaaacccgctccgcccacccgcccgcgcgaaaccccgcgctacgcaaccgcgacgccatacccccgcccctctacgaccccgccaatcaacgcgctaaaaaaaaacgaaaccttaaataacgtacgcgcctacgcgctataccttacgaactaccaatacccaacaactatacccgaaatccgcgcgactccttttactataccctatctctaccgaccgcctaatacgcgtacgcgaaaacatactttcgaactaataaaatcctttcctccgacctttctccaacccaaatcttaaaaactctaacccaataactaaacctcga

SEQ ID NO: 3649 - DNA, 953 bp, Artificial Sequence
  chemically treated genomic DNA (Homo sapiens) CpG-island No: 3649
ttgtttcggcgggttggggggggggggcgttaagtcgggagttgcggcgggggggttcggggttcggaagttggggtggatcgggaattggagggggggtgttcgggggtcggcggtaggaggggaggggggtcgcgtcgggttgggagttggagagggaagatagggtcggggagttggggggggcgtcgggtcggaggtatcgggtttgggggttggggggcgcggggtcgggagtcgggggtcgggggcgtagggttcggattcggggtgggggcgtcggtcggacgggtttcgtttatcgaatgtttgttttgtggaaatattatgttaatcgcggcggggggcgcgggttgcgtttcggttgtgcgtttcggttcgggttgttgggggcgtcgggcggtcgcgtttttgtttcggcgtcgatcggtagttttcggggtcgtcgtcgtttttcgcgttcggtttcgttcgttttttgcgtttttttttcgcgcgttcggtttcggcgcgtttcgggtttcgttttttgcgcgttcggcgttttttttcgttttttttcgtcgttcgttttttcgtttttcggttttatcgttattgtttaatggcggcgacgtcggtagtggtcgcggttcggttgttgcggaggtttcggttttatttgtcgtcgttcgtgtttcgtgcgcgtcgtcgaggggggggacgcgcgcgttcggggaggtttgcggatttttacgtcggttcgttttttcgtggttcgttcgtcgcggtgattttgggttcggttcgttttcgtttcgggtagcggttttcgttatttttttttattcggtagtcggtcgggtttcggtttttttatttgttaaagaaaagggattcggttgttcgcgtcgaagtcgtcggttttgttgtggtacgatttggacgcgtgttacggacgtgttttgtgattt

SEQ ID NO: 3650 - DNA, 953 bp, Artificial Sequence
  chemically treated genomic DNA (Homo sapiens) CpG-island No: 3650
aaatcacaaaacacgtccgtaacacgcgtccaaatcgtaccacaacaaaaccgacgacttcgacgcgaacaaccgaatcccttttctttaacaaataaaaaaaccgaaacccgaccgactaccgaataaaaaaaaataacgaaaaccgctacccgaaacgaaaacgaaccgaacccaaaatcaccgcgacgaacgaaccacgaaaaaacgaaccgacgtaaaaatccgcaaacctccccgaacgcgcgcgtcccccccctcgacgacgcgcacgaaacacgaacgacgacaaataaaaccgaaacctccgcaacaaccgaaccgcgaccactaccgacgtcgccgccattaaacaataacgataaaaccgaaaaacgaaaaaacgaacgacgaaaaaaaacgaaaaaaaacgccgaacgcgcaaaaaacgaaacccgaaacgcgccgaaaccgaacgcgcgaaaaaaaaacgcaaaaaacgaacgaaaccgaacgcgaaaaacgacgacgaccccgaaaactaccgatcgacgccgaaacaaaaacgcgaccgcccgacgcccccaacaacccgaaccgaaacgcacaaccgaaacgcaacccgcgccccccgccgcgattaacataatatttccacaaaacaaacattcgataaacgaaacccgtccgaccgacgcccccaccccgaatccgaaccctacgcccccgacccccgactcccgaccccgcgccccccaacccccaaacccgatacctccgacccgacgccccccccaactccccgaccctatcttccctctccaactcccaacccgacgcgacccccctcccctcctaccgccgacccccgaacaccccccctccaattcccgatccaccccaacttccgaaccccgaacccccccgccgcaactcccgacttaacgccccccccccccaacccgccgaaacaa

SEQ ID NO: 3651 - DNA, 953 bp, Artificial Sequence
  chemically treated genomic DNA (Homo sapiens) CpG-island No: 3651
aggttatagagtacgttcgtggtacgcgtttaggtcgtgttatagtagggtcggcggtttcgacgcgggtagtcgggttttttttttttgatagatggggaaatcgaggttcggtcggttgtcgggtaggagagggtggcgggggtcgttgttcggggcgggggcgggtcgggtttaaggttatcgcggcgggcgggttacggggaggcgggtcggcgtggggattcgtaggttttttcgggcgcgcgcgttttttttttcggcggcgcgtacggggtacgggcggcggtaggtggagtcgaagttttcgtagtagtcgagtcgcggttattgtcggcgtcgtcgttattagataatagcggtggggtcggggagcggggaggcgggcggcggggaggggcggggaggggcgtcgggcgcgtaggaagcggggttcggggcgcgtcggggtcgggcgcgcggggagggggcgtaggaagcgggcgaggtcgggcgcgggaggcggcggcggtttcgggagttgtcgatcggcgtcgggataaaggcgcggtcgttcggcgtttttagtagttcgagtcggggcgtatagtcggggcgtagttcgcgtttttcgtcgcgattgatatgatgtttttataaagtaggtattcggtaagcggggttcgttcggtcggcgtttttatttcggattcgggttttacgttttcgattttcggttttcggtttcgcgttttttaatttttaggttcggtgttttcggttcggcgttttttttaatttttcggttttgttttttttttttagtttttagttcggcgcgatttttttttttttttgtcgtcggttttcggatattttttttttagttttcgatttattttagttttcgggtttcgagttttttcgtcgtagttttcggtttggcgttttttttttttaattcgtcgggatag

SEQ ID NO: 3652 - DNA, 953 bp, Artificial Sequence
  chemically treated genomic DNA (Homo sapiens) CpG-island No: 3652
ctatcccgacgaattaaaaaaaaaaaacgccaaaccgaaaactacgacgaaaaaactcgaaacccgaaaactaaaataaatcgaaaactaaaaaaaaaatatccgaaaaccgacgacaaaaaaaaaaaaaaatcgcgccgaactaaaaactaaaaaaaaaaaacaaaaccgaaaaattaaaaaaaacgccgaaccgaaaacaccgaacctaaaaattaaaaaacgcgaaaccgaaaaccgaaaatcgaaaacgtaaaacccgaatccgaaataaaaacgccgaccgaacgaaccccgcttaccgaatacctactttataaaaacatcatatcaatcgcgacgaaaaacgcgaactacgccccgactatacgccccgactcgaactactaaaaacgccgaacgaccgcgcctttatcccgacgccgatcgacaactcccgaaaccgccgccgcctcccgcgcccgacctcgcccgcttcctacgccccctccccgcgcgcccgaccccgacgcgccccgaaccccgcttcctacgcgcccgacgcccctccccgcccctccccgccgcccgcctccccgctccccgaccccaccgctattatctaataacgacgacgccgacaataaccgcgactcgactactacgaaaacttcgactccacctaccgccgcccgtaccccgtacgcgccgccgaaaaaaaaaacgcgcgcgcccgaaaaaacctacgaatccccacgccgacccgcctccccgtaacccgcccgccgcgataaccttaaacccgacccgcccccgccccgaacaacgacccccgccaccctctcctacccgacaaccgaccgaacctcgatttccccatctatcaaaaaaaaaaaacccgactacccgcgtcgaaaccgccgaccctactataacacgacctaaacgcgtaccacgaacgtactctataacct

SEQ ID NO: 3653 - DNA, 740 bp, Artificial Sequence
  chemically treated genomic DNA (Homo sapiens) CpG-island No: 3653
gggggttgttgtgtcgacgcggatttgttatatggttgcgcggagttaggaagaatgggtttttgtgtgtgcgatcgggacgtagcggcgcgggtcgtgttagtcgggcggagtcgggtgttcgacggcgtaggacgagcgggcgtaggacgagcgagcgtagcgggcgcgggcgtatcgtcggggcgcggggatttcgagggttagcggagtcgtgttgcgcgtagggatggacgttgggcgtttaaggttcgttttcgtggataggcgcgcggagggtagtaggatcgatgtatcgacggacgtatcgacggacgcgcggatagatgcgtcgatcgtaggttttttcgtcgtttcggggtcgtcgtgttcgtgtaggtcgcgagtagcggcggggtcggttttgcggttgtagtagttttattgtgaggtcggcgagataatgggcggttcgaggaggtatttgttcgtttgaaaggtttataaatcgtcgtcgcgtttagttgttttttcgttttttttcgcggattcgttagcgggaagcgcggtcgcggtcgggagggggaggttcggttcgatagtcgggtagggtcgtttgggttatcgtcgcgcgttttttttcgtttgggcgtagttgttcgtacgtttcgacgggagttgcgtttagttttttttttggagtcggcgttttaggttgttgttcggtcggtggttaaggttttagtattatcgtttttttt

SEQ ID NO: 3654 - DNA, 740 bp, Artificial Sequence
  chemically treated genomic DNA (Homo sapiens) CpG-island No: 3654
aaaaaaaacgataatactaaaaccttaaccaccgaccgaacaacaacctaaaacgccgactccaaaaaaaaaactaaacgcaactcccgtcgaaacgtacgaacaactacgcccaaacgaaaaaaaacgcgcgacgataacccaaacgaccctacccgactatcgaaccgaacctccccctcccgaccgcgaccgcgcttcccgctaacgaatccgcgaaaaaaaacgaaaaaacaactaaacgcgacgacgatttataaacctttcaaacgaacaaatacctcctcgaaccgcccattatctcgccgacctcacaataaaactactacaaccgcaaaaccgaccccgccgctactcgcgacctacacgaacacgacgaccccgaaacgacgaaaaaacctacgatcgacgcatctatccgcgcgtccgtcgatacgtccgtcgatacatcgatcctactaccctccgcgcgcctatccacgaaaacgaaccttaaacgcccaacgtccatccctacgcgcaacacgactccgctaaccctcgaaatccccgcgccccgacgatacgcccgcgcccgctacgctcgctcgtcctacgcccgctcgtcctacgccgtcgaacacccgactccgcccgactaacacgacccgcgccgctacgtcccgatcgcacacacaaaaacccattcttcctaactccgcgcaaccatataacaaatccgcgtcgacacaacaaccccc

SEQ ID NO: 3655 - DNA, 740 bp, Artificial Sequence
  chemically treated genomic DNA (Homo sapiens) CpG-island No: 3655
aggagggacggtggtgttggggttttggttatcggtcgggtagtagtttggagcgtcgattttagaggggaggttgggcgtagttttcgtcggggcgtgcgggtagttgcgtttaggcgggagggagcgcgcggcggtggtttaggcggttttgttcgattgtcggatcgagtttttttttttcggtcgcggtcgcgtttttcgttagcgggttcgcggggaggggcgggaaggtagttggacgcggcggcgatttatgggttttttaggcgagtaggtgttttttcgggtcgtttattgtttcgtcggttttataatggggttgttgtagtcgtagagtcggtttcgtcgttgttcgcggtttgtacgggtacgacggtttcgggacggcgggagagtttgcggtcggcgtatttgttcgcgcgttcgtcggtgcgttcgtcggtgtatcggttttgttgtttttcgcgcgtttgtttacgggaacgggttttgggcgtttagcgtttatttttgcgcgtagtacggtttcgttggttttcggggttttcgcgtttcgacggtgcgttcgcgttcgttgcgttcgttcgttttgcgttcgttcgttttgcgtcgtcgggtattcggtttcgttcggttggtacggttcgcgtcgttgcgtttcggtcgtatatataggggtttattttttttggtttcgcgtaattatatggtaaattcgcgtcgatatagtagttttt

SEQ ID NO: 3656 - DNA, 740 bp, Artificial Sequence
  chemically treated genomic DNA (Homo sapiens) CpG-island No: 3656
aaaaactactatatcgacgcgaatttaccatataattacgcgaaaccaaaaaaaataaacccctatatatacgaccgaaacgcaacgacgcgaaccgtaccaaccgaacgaaaccgaatacccgacgacgcaaaacgaacgaacgcaaaacgaacgaacgcaacgaacgcgaacgcaccgtcgaaacgcgaaaaccccgaaaaccaacgaaaccgtactacgcgcaaaaataaacgctaaacgcccaaaacccgttcccgtaaacaaacgcgcgaaaaacaacaaaaccgatacaccgacgaacgcaccgacgaacgcgcgaacaaatacgccgaccgcaaactctcccgccgtcccgaaaccgtcgtacccgtacaaaccgcgaacaacgacgaaaccgactctacgactacaacaaccccattataaaaccgacgaaacaataaacgacccgaaaaaacacctactcgcctaaaaaacccataaatcgccgccgcgtccaactaccttcccgcccctccccgcgaacccgctaacgaaaaacgcgaccgcgaccgaaaaaaaaaaactcgatccgacaatcgaacaaaaccgcctaaaccaccgccgcgcgctccctcccgcctaaacgcaactacccgcacgccccgacgaaaactacgcccaacctcccctctaaaatcgacgctccaaactactacccgaccgataaccaaaaccccaacaccaccgtccctcct

SEQ ID NO: 3657 - DNA, 2365 bp, Artificial Sequence
  chemically treated genomic DNA (Homo sapiens) CpG-island No: 3657
cgaggtttagcgtttttttaacgttcgttgtttcggtaggttttttcggggttttttgggttttaaattgcgaggagaggggcggttagtaaagtcggcggggattcggcgggtcggtttttcgcgtttttttaggtgcgttgtatttatttggtttatcgtagttttttgcgcggggtttgttttatcgagtttacgttaggggcggcgtttggagagggatacggcgcggggatatcgttcgacgattttttaggcgttgattttttgcgtttggcgaagaaatttgcgggcgatagcgcgcgcggtcggttagggcggggtcggttcggagattcgagagggggtcgggagagggcgcggggcgcgggtcggtcggggtgggggcgtcgttttcgttcgcgtcgaggttcgcggcgggttagttttgtttacgtcgtcgcgtaatgtgttgtgtaacgtatttttttttgtttcgcggttaagtttttcggggtcgtcgtcgcgtttaattttttttacgtcgtgtttacggcgttcggtcgcgttcggggaggggttttcgcggtcgggggcgaaaattgcgttttcggggggtcgcggtcgggatttagttttttatttcgttcgcgcgaagttgttggagggtataataacggggcggggaggggggtaagggcgtagtcgcgttttgagcgttgcgggttttttaatgttacgggaggaggcgggaatttagcgaggttttcgagggttggggggatcggtcggtcggataaagcggggtcgggtcgggtcggggcggggtcgtgcggggtttatcggagattagaggttcggatagttttttgatcgtcgcgtcgttggcgttggcggtcgcggtgtcggtcgcgggacgtttcgaaattttcgagtgtagttggttagcgagaggtttttggtcgcgttgtttttggttcgcgttttgttcggcgtttttttgaggcgtcgcgttcggggtcggggtcggggcgggggtcggggttcgggtcggggtcggggttggggtcggggtcgcgattggagtcggggtcggagtcggagtcggagtcggggtcggggtcggggttaggatcgcgatcgttatcggagtcgcgatcggagtcgcgatcggagtcggagtcggggtcggggttggagttaggatcgggattgggggcggggtggacgtcggggtcgggatcgggatattaggtagttgtttcggcgttttttcgaggtcgtcgagggatttagcggtcggttcgaggggcgggttgatagttatcgcgatcgcgacgggtcgcggcgttagtagtaggcggtagcgttttatttgtatcgtttcgcggtagaacgcgggtatcgagtcgttgtttatttcggtttattgtaggcgtttagggtttcgtagcggtatgttttgttggaagtcgtaattttagcggttttggttttcggcgtttagttcggttaggcgggtttgtagttcgcggtttagtttttcgtggtttatcggttcgaagaggttgcggtaggcgttggtgcgtattagtattgggaaggttttacgggcgataagacgttttatcgtggatgtgttgcggagggacgcgtcggatatggttcggggttgcgtaaacgcgggtagcgagagaggagaggatagcgagaagaaggggaaaggagaggaggagagggcggaggtcgggcgtaagggagatttcgcgtcgttcgattttgcgtgtgcgagggacgcggcggttatttggttgttcggtggtggatttttttgcgtcgggttcgtttgtttcgttcggacggtagtcgcgttttttcgatgtttgttggttagttcgttcgtttaggtttggtcggtatttttcgagtatagcgtatttggtttgtggaacgtttagttcgtttgcgttttttttatacgcgcgggttttattttcgtgcgcgcgggttcggtcgcgattagtataatgtagtatttttagttttaataatattacggcgattggcggtcgtttcgttgtttcgtttcgtcgcggttcggttttcgcgtatcgtttattggtcgcgcgtatatttatcgggggcggggcggggcgcgcggtcggggcgcgcggttgattggcggtcgcggggcgagcgcgttgtagtaggggaagggggcggtgagcggggcgggggcgggagttaaagggcgttgcgggcggtaacgtgatatcgcgacgtttcgttttttcgttttattttttttgtaatatttttttattttttcggttttcgtttttcgtcggtttttttgtttgtaggcgggggttttagtttagcgcgg

SEQ ID NO: 3658 - DNA, 2365 bp, Artificial Sequence
  chemically treated genomic DNA (Homo sapiens) CpG-island No: 3658
ccgcgctaaactaaaacccccgcctacaaacaaaaaaaccgacgaaaaacgaaaaccgaaaaaataaaaaaatattacaaaaaaaataaaacgaaaaaacgaaacgtcgcgatatcacgttaccgcccgcaacgccctttaactcccgcccccgccccgctcaccgcccccttcccctactacaacgcgctcgccccgcgaccgccaatcaaccgcgcgccccgaccgcgcgccccgccccgcccccgataaatatacgcgcgaccaataaacgatacgcgaaaaccgaaccgcgacgaaacgaaacaacgaaacgaccgccaatcgccgtaatattattaaaactaaaaatactacattatactaatcgcgaccgaacccgcgcgcacgaaaataaaacccgcgcgtataaaaaaaacgcaaacgaactaaacgttccacaaaccaaatacgctatactcgaaaaataccgaccaaacctaaacgaacgaactaaccaacaaacatcgaaaaaacgcgactaccgtccgaacgaaacaaacgaacccgacgcaaaaaaatccaccaccgaacaaccaaataaccgccgcgtccctcgcacacgcaaaatcgaacgacgcgaaatctcccttacgcccgacctccgccctctcctcctctcctttccccttcttctcgctatcctctcctctctcgctacccgcgtttacgcaaccccgaaccatatccgacgcgtccctccgcaacacatccacgataaaacgtcttatcgcccgtaaaaccttcccaatactaatacgcaccaacgcctaccgcaacctcttcgaaccgataaaccacgaaaaactaaaccgcgaactacaaacccgcctaaccgaactaaacgccgaaaaccaaaaccgctaaaattacgacttccaacaaaacataccgctacgaaaccctaaacgcctacaataaaccgaaataaacaacgactcgatacccgcgttctaccgcgaaacgatacaaataaaacgctaccgcctactactaacgccgcgacccgtcgcgatcgcgataactatcaacccgcccctcgaaccgaccgctaaatccctcgacgacctcgaaaaaacgccgaaacaactacctaatatcccgatcccgaccccgacgtccaccccgcccccaatcccgatcctaactccaaccccgaccccgactccgactccgatcgcgactccgatcgcgactccgataacgatcgcgatcctaaccccgaccccgaccccgactccgactccgactccgaccccgactccaatcgcgaccccgaccccaaccccgaccccgacccgaaccccgacccccgccccgaccccgaccccgaacgcgacgcctcaaaaaaacgccgaacaaaacgcgaaccaaaaacaacgcgaccaaaaacctctcgctaaccaactacactcgaaaatttcgaaacgtcccgcgaccgacaccgcgaccgccaacgccaacgacgcgacgatcaaaaaactatccgaacctctaatctccgataaaccccgcacgaccccgccccgacccgacccgaccccgctttatccgaccgaccgatccccccaaccctcgaaaacctcgctaaattcccgcctcctcccgtaacattaaaaaacccgcaacgctcaaaacgcgactacgcccttacccccctccccgccccgttattataccctccaacaacttcgcgcgaacgaaataaaaaactaaatcccgaccgcgaccccccgaaaacgcaattttcgcccccgaccgcgaaaacccctccccgaacgcgaccgaacgccgtaaacacgacgtaaaaaaaattaaacgcgacgacgaccccgaaaaacttaaccgcgaaacaaaaaaaaatacgttacacaacacattacgcgacgacgtaaacaaaactaacccgccgcgaacctcgacgcgaacgaaaacgacgcccccaccccgaccgacccgcgccccgcgccctctcccgaccccctctcgaatctccgaaccgaccccgccctaaccgaccgcgcgcgctatcgcccgcaaatttcttcgccaaacgcaaaaaatcaacgcctaaaaaatcgtcgaacgatatccccgcgccgtatccctctccaaacgccgcccctaacgtaaactcgataaaacaaaccccgcgcaaaaaactacgataaaccaaataaatacaacgcacctaaaaaaacgcgaaaaaccgacccgccgaatccccgccgactttactaaccgcccctctcctcgcaatttaaaacccaaaaaaccccgaaaaaacctaccgaaacaacgaacgttaaaaaaacgctaaacctcg

SEQ ID NO: 3659 - DNA, 2365 bp, Artificial Sequence
  chemically treated genomic DNA (Homo sapiens) CpG-island No: 3659
tcgcgttgggttgaggttttcgtttgtagataaaggagtcggcggggggcgggagtcgggggggtgggggagtgttgtaggggggatggggcgagggggcggggcgtcgcggtgttacgttatcgttcgtagcgttttttaattttcgttttcgtttcgtttatcgttttttttttttgttatagcgcgttcgtttcgcggtcgttaattagtcgcgcgtttcggtcgcgcgtttcgtttcgttttcggtgggtgtgcgcgcggttaatgggcggtgcgcgggggtcgggtcgcggcggggcggggtagcggggcggtcgttaatcgtcgtggtgttgttgaaattgaaaatattatattatgttaatcgcggtcgggttcgcgcgtacgggggtggggttcgcgcgtataaagggggcgtaggcgggttgggcgttttataggttaagtgcgttgtgttcgaggggtgtcggttaggtttgagcgagcgagttagttagtaggtatcgagggggcgcggttgtcgttcggacgagataggcgaattcgacgtagaagagtttattatcggatagttaggtagtcgtcgcgtttttcgtatacgtagagtcgggcggcgcggggttttttttgcgttcggttttcgttttttttttttttttttttttttttttttcgttgtttttttttttttcgttgttcgcgtttgcgtagtttcgggttatgttcgacgcgttttttcgtagtatatttacgatggagcgttttgtcgttcgtgggatttttttagtattagtgcgtattagcgtttgtcgtagttttttcgggtcggtggattacgaggagttgagtcgcgagttgtaggttcgtttggtcgagttgaacgtcgaggattagaatcgttgggattacgatttttagtaggatatgtcgttgcggggttttggacgtttgtagtggatcgaagtggatagcgattcggtgttcgcgttttatcgcgagacggtgtaggtggggcgttgtcgtttgttgttggcgtcgcggttcgtcgcggtcgcggtggttgttagttcgtttttcgagtcggtcgttgagtttttcgacggtttcgaggaggcgtcggagtagttgtttagtgtttcggtttcggtttcggcgtttatttcgtttttagtttcggttttggttttagtttcggtttcggtttcggtttcggtcgcggtttcggtcgcggtttcggtagcggtcgcggttttggtttcggtttcggtttcggtttcggtttcggtttcggtttcggttttagtcgcggtttcggttttagtttcggtttcggttcgggtttcggttttcgtttcggtttcggtttcggacgcggcgttttaagagagcgtcgagtagggcgcgaattaggggtagcgcggttaggagtttttcgttgattagttgtattcggggatttcgggacgtttcgcggtcggtatcgcggtcgttagcgttaacggcgcggcgattaagaagttgttcgggtttttgattttcggtgagtttcgtacggtttcgtttcggttcggttcggtttcgttttgttcggtcggtcggtttttttagttttcgggggtttcgttgggttttcgttttttttcgtggtattaaagggttcgtagcgtttagggcgcggttgcgtttttattttttttttcgtttcgttgttgtgttttttagtagtttcgcgcgggcggggtgggaggttgaatttcggtcgcgatttttcgggagcgtagttttcgttttcggtcgcgggagttttttttcgggcgcggtcgggcgtcgtgagtacggcgtggagggggttaagcgcggcggcggtttcggggggtttggtcgcgggataaggggaaatgcgttatatagtatattgcgcggcgacgtaaataaagttgattcgtcgcggatttcggcgcgggcggggacggcgtttttatttcggtcggttcgcgtttcgcgttttttttcggttttttttcgggttttcgggtcggtttcgttttgatcggtcgcgcgcgttgtcgttcgtagattttttcgttaagcgtaagagattagcgtttgagaagtcgtcgggcgatgttttcgcgtcgtgtttttttttaagcgtcgtttttggcgtgggttcggtggagtagatttcgcgtaagaggttgcggtgagttaagtgagtatagcgtatttgggggggcgcggagggtcgattcgtcgggttttcgtcggttttgttgatcgttttttttttcgtagtttagagtttaaagagtttcgagggaatttgtcggggtagcggacgttggaagggcgttgggtttcg

SEQ ID NO: 3660 - DNA, 2365 bp, Artificial Sequence
  chemically treated genomic DNA (Homo sapiens) CpG-island No: 3660
cgaaacccaacgcccttccaacgtccgctaccccgacaaattccctcgaaactctttaaactctaaactacgaaaaaaaaaacgatcaacaaaaccgacgaaaacccgacgaatcgaccctccgcgcccccccaaatacgctatactcacttaactcaccgcaacctcttacgcgaaatctactccaccgaacccacgccaaaaacgacgcttaaaaaaaaacacgacgcgaaaacatcgcccgacgacttctcaaacgctaatctcttacgcttaacgaaaaaatctacgaacgacaacgcgcgcgaccgatcaaaacgaaaccgacccgaaaacccgaaaaaaaaccgaaaaaaaacgcgaaacgcgaaccgaccgaaataaaaacgccgtccccgcccgcgccgaaatccgcgacgaatcaactttatttacgtcgccgcgcaatatactatataacgcatttccccttatcccgcgaccaaaccccccgaaaccgccgccgcgcttaaccccctccacgccgtactcacgacgcccgaccgcgcccgaaaaaaaactcccgcgaccgaaaacgaaaactacgctcccgaaaaatcgcgaccgaaattcaacctcccaccccgcccgcgcgaaactactaaaaaacacaacaacgaaacgaaaaaaaaaataaaaacgcaaccgcgccctaaacgctacgaaccctttaataccacgaaaaaaaacgaaaacccaacgaaacccccgaaaactaaaaaaaccgaccgaccgaacaaaacgaaaccgaaccgaaccgaaacgaaaccgtacgaaactcaccgaaaatcaaaaacccgaacaacttcttaatcgccgcgccgttaacgctaacgaccgcgataccgaccgcgaaacgtcccgaaatccccgaatacaactaatcaacgaaaaactcctaaccgcgctacccctaattcgcgccctactcgacgctctcttaaaacgccgcgtccgaaaccgaaaccgaaacgaaaaccgaaacccgaaccgaaaccgaaactaaaaccgaaaccgcgactaaaaccgaaaccgaaaccgaaaccgaaaccgaaaccgaaaccgaaaccaaaaccgcgaccgctaccgaaaccgcgaccgaaaccgcgaccgaaaccgaaaccgaaaccgaaactaaaaccaaaaccgaaactaaaaacgaaataaacgccgaaaccgaaaccgaaacactaaacaactactccgacgcctcctcgaaaccgtcgaaaaactcaacgaccgactcgaaaaacgaactaacaaccaccgcgaccgcgacgaaccgcgacgccaacaacaaacgacaacgccccacctacaccgtctcgcgataaaacgcgaacaccgaatcgctatccacttcgatccactacaaacgtccaaaaccccgcaacgacatatcctactaaaaatcgtaatcccaacgattctaatcctcgacgttcaactcgaccaaacgaacctacaactcgcgactcaactcctcgtaatccaccgacccgaaaaaactacgacaaacgctaatacgcactaatactaaaaaaatcccacgaacgacaaaacgctccatcgtaaatatactacgaaaaaacgcgtcgaacataacccgaaactacgcaaacgcgaacaacgaaaaaaaaaaaaacaacgaaaaaaaaaaaaaaaaaaaaaaaaaaaaaacgaaaaccgaacgcaaaaaaaaccccgcgccgcccgactctacgtatacgaaaaacgcgacgactacctaactatccgataataaactcttctacgtcgaattcgcctatctcgtccgaacgacaaccgcgccccctcgatacctactaactaactcgctcgctcaaacctaaccgacacccctcgaacacaacgcacttaacctataaaacgcccaacccgcctacgccccctttatacgcgcgaaccccacccccgtacgcgcgaacccgaccgcgattaacataatataatattttcaatttcaacaacaccacgacgattaacgaccgccccgctaccccgccccgccgcgacccgacccccgcgcaccgcccattaaccgcgcgcacacccaccgaaaacgaaacgaaacgcgcgaccgaaacgcgcgactaattaacgaccgcgaaacgaacgcgctataacaaaaaaaaaaaacgataaacgaaacgaaaacgaaaattaaaaaacgctacgaacgataacgtaacaccgcgacgccccgccccctcgccccatcccccctacaacactcccccacccccccgactcccgccccccgccgactcctttatctacaaacgaaaacctcaacccaacgcga

SEQ ID NO: 3661 - DNA, 565 bp, Artificial Sequence
  chemically treated genomic DNA (Homo sapiens) CpG-island No: 3661
gggcgcgtggggggtgagtaagttgaacggaggggagcgaggagcggtgggggagaaagggagtgaagtcgggtgggagaggttgtggattcgggaaggttcgagggattttcggagggaggcgaagtgtgaggttgaggaatgcgcgcgaggaggaggagtgggggtgtagaggggaggaggatgagcgcgggagagaaggcgcgatgagtgtagagacgcgaatcgcggcggtggacgagagcgtcgggaatggtatgtaggggcgagagtaggagcgcgggagagcgtatgaggtgtggtgatgtagagtcggggaatagtggtcgtaggggtatgcgtcgagatggacgtggtcgggtagaggcgagagaggagtgcgggagcgaagatgagggtaggagatatatggggaggaggagaggagatgagagtcgtcgagagcgcgatagggagacggaagaaaagtgaggagttgaggttagttggtagaggtgtgtgcggaagaggcgaagcgaggagtagggaagagaggagggggagagatgggtggataggggagtga

SEQ ID NO: 3662 - DNA, 565 bp, Artificial Sequence
  chemically treated genomic DNA (Homo sapiens) CpG-island No: 3662
tcactcccctatccacccatctctccccctcctctcttccctactcctcgcttcgcctcttccgcacacacctctaccaactaacctcaactcctcacttttcttccgtctccctatcgcgctctcgacgactctcatctcctctcctcctccccatatatctcctaccctcatcttcgctcccgcactcctctctcgcctctacccgaccacgtccatctcgacgcatacccctacgaccactattccccgactctacatcaccacacctcatacgctctcccgcgctcctactctcgcccctacataccattcccgacgctctcgtccaccgccgcgattcgcgtctctacactcatcgcgccttctctcccgcgctcatcctcctcccctctacacccccactcctcctcctcgcgcgcattcctcaacctcacacttcgcctccctccgaaaatccctcgaaccttcccgaatccacaacctctcccacccgacttcactccctttctcccccaccgctcctcgctcccctccgttcaacttactcaccccccacgcgccc

SEQ ID NO: 3663 - DNA, 565 bp, Artificial Sequence
  chemically treated genomic DNA (Homo sapiens) CpG-island No: 3663
ttatttttttgtttatttatttttttttttttttttttttttatttttcgtttcgtttttttcgtatatatttttattagttgattttagttttttatttttttttcgtttttttgtcgcgttttcggcggtttttattttttttttttttttttatgtgttttttgtttttattttcgttttcgtatttttttttcgtttttattcgattacgtttatttcggcgtatatttttgcggttattatttttcggttttgtattattatattttatacgttttttcgcgtttttattttcgtttttgtatattattttcgacgttttcgtttatcgtcgcggttcgcgtttttatatttatcgcgttttttttttcgcgtttattttttttttttttatatttttatttttttttttcgcgcgtattttttagttttatatttcgttttttttcgaaaatttttcgggttttttcgggtttatagttttttttattcggttttatttttttttttttttatcgtttttcgttttttttcgtttaatttgtttattttttacgcgttt

SEQ ID NO: 3664 - DNA, 565 bp, Artificial Sequence
  chemically treated genomic DNA (Homo sapiens) CpG-island No: 3664
aaacgcgtaaaaaataaacaaattaaacgaaaaaaaacgaaaaacgataaaaaaaaaaaaaaataaaaccgaataaaaaaaactataaacccgaaaaaacccgaaaaattttcgaaaaaaaacgaaatataaaactaaaaaatacgcgcgaaaaaaaaaaataaaaatataaaaaaaaaaaaaataaacgcgaaaaaaaaaacgcgataaatataaaaacgcgaaccgcgacgataaacgaaaacgtcgaaaataatatacaaaaacgaaaataaaaacgcgaaaaaacgtataaaatataataatacaaaaccgaaaaataataaccgcaaaaatatacgccgaaataaacgtaatcgaataaaaacgaaaaaaaaatacgaaaacgaaaataaaaacaaaaaacacataaaaaaaaaaaaaaaaaataaaaaccgccgaaaacgcgacaaaaaaacgaaaaaaaaataaaaaactaaaatcaactaataaaaatatatacgaaaaaaacgaaacgaaaaataaaaaaaaaaaaaaaaaaaaaaataaataaacaaaaaaataa

SEQ ID NO: 3665 - DNA, 851 bp, Artificial Sequence
  chemically treated genomic DNA (Homo sapiens) CpG-island No: 3665
cgtcgcggaggatacggcggggaagacgggggcgaggtcgaggacggggaggtcgagggagaggacgaaggagggggcggagggagagcgacggaagggggaggacgggggggggacggcgagggaggggcggagcgagggacggggggagagagggggggacggaggcgggggaataatagcgggcgtacgtaacggtaacgttaagggggggagaggggcggaggacgaattagcggacggagcgagagagagagggtagagaggaggaaagtagagacgggaaagcggagggagaggggattaggagtaggggtagcgagtggatcgtggaatgggatcgacgagttgcgatggagaggggaagagcggagcgtaggacggaggggggagagaaggagcgagacggtgaggggtgagcggaagaggaggggagaggagcggagaggacgaggggaggggagcgaggagcgagagcgcggacgagagggaggggcgaggagagggataggagaagcgggaagaggggcgagagcgggaggtagagggagggatagagaggcggagagcggagaggagagagagaggttgggcgagagtatagaggggagggaggtcggcgtggagagagaggagacgagaggtagaagaggagcgggaggtaggtgtagaaggaaggagagaggatgagtacgacgaaggagggagaagagagtgagaggagtagaggatagtggagaagcgaggcgcggagaggagagagggagagggagaagacgggagagagagaggtgcggagacggagcgagtaggagagggatgtagttatttaagtttattttgtttaaaat

SEQ ID NO: 3666 - DNA, 851 bp, Artificial Sequence
  chemically treated genomic DNA (Homo sapiens) CpG-island No: 3666
attttaaacaaaataaacttaaataactacatccctctcctactcgctccgtctccgcacctctctctctcccgtcttctccctctccctctctcctctccgcgcctcgcttctccactatcctctactcctctcactctcttctccctccttcgtcgtactcatcctctctccttccttctacacctacctcccgctcctcttctacctctcgtctcctctctctccacgccgacctccctcccctctatactctcgcccaacctctctctctcctctccgctctccgcctctctatccctccctctacctcccgctctcgcccctcttcccgcttctcctatccctctcctcgcccctccctctcgtccgcgctctcgctcctcgctcccctcccctcgtcctctccgctcctctcccctcctcttccgctcacccctcaccgtctcgctccttctctcccccctccgtcctacgctccgctcttcccctctccatcgcaactcgtcgatcccattccacgatccactcgctacccctactcctaatcccctctccctccgctttcccgtctctactttcctcctctctaccctctctctctcgctccgtccgctaattcgtcctccgcccctctcccccccttaacgttaccgttacgtacgcccgctattattcccccgcctccgtccccccctctctccccccgtccctcgctccgcccctccctcgccgtcccccccccgtcctcccccttccgtcgctctccctccgccccctccttcgtcctctccctcgacctccccgtcctcgacctcgcccccgtcttccccgccgtatcctccgcgacg

SEQ ID NO: 3667 - DNA, 851 bp, Artificial Sequence
  chemically treated genomic DNA (Homo sapiens) CpG-island No: 3667
gttttgaataaaataaatttgaatagttatattttttttttgttcgtttcgttttcgtatttttttttttttcgttttttttttttttttttttttttttcgcgtttcgtttttttattgttttttgttttttttatttttttttttttttttcgtcgtgtttattttttttttttttttttgtatttgtttttcgttttttttttgtttttcgttttttttttttttacgtcggttttttttttttttgtgttttcgtttagtttttttttttttttttcgtttttcgtttttttgtttttttttttatttttcgttttcgttttttttttcgttttttttgttttttttttcgtttttttttttcgttcgcgttttcgtttttcgttttttttttttcgtttttttcgtttttttttttttttttttcgtttattttttatcgtttcgttttttttttttttttttcgttttgcgtttcgttttttttttttttatcgtagttcgtcgattttattttacggtttattcgttgtttttgtttttggtttttttttttttcgttttttcgtttttgttttttttttttttattttttttttttcgtttcgttcgttggttcgtttttcgttttttttttttttttgacgttgtcgttgcgtacgttcgttgttgttttttcgttttcgttttttttttttttttttcgtttttcgtttcgtttttttttcgtcgtttttttttcgttttttttttttcgtcgtttttttttcgttttttttttcgttttttttttcggttttttcgttttcggtttcgttttcgtttttttcgtcgtgtttttcgcggcg

SEQ ID NO: 3668 - DNA, 851 bp, Artificial Sequence
  chemically treated genomic DNA (Homo sapiens) CpG-island No: 3668
cgccgcgaaaaacacgacgaaaaaaacgaaaacgaaaccgaaaacgaaaaaaccgaaaaaaaaaacgaaaaaaaaaacgaaaaaaaaacgacgaaaaaaaaaaaacgaaaaaaaaacgacgaaaaaaaaacgaaacgaaaaacgaaaaaaaaaaaaaaaaaacgaaaacgaaaaaacaacaacgaacgtacgcaacgacaacgtcaaaaaaaaaaaaaaaacgaaaaacgaaccaacgaacgaaacgaaaaaaaaaaaataaaaaaaaaaaaaacaaaaacgaaaaaacgaaaaaaaaaaaaaccaaaaacaaaaacaacgaataaaccgtaaaataaaatcgacgaactacgataaaaaaaaaaaaaacgaaacgcaaaacgaaaaaaaaaaaaaaaaaacgaaacgataaaaaataaacgaaaaaaaaaaaaaaaaaaacgaaaaaaacgaaaaaaaaaaaacgaaaaacgaaaacgcgaacgaaaaaaaaaaacgaaaaaaaaaacaaaaaaaacgaaaaaaaaaacgaaaacgaaaaataaaaaaaaaaacaaaaaaacgaaaaacgaaaaaaaaaaaaaaaaactaaacgaaaacacaaaaaaaaaaaaaaccgacgtaaaaaaaaaaaaaacgaaaaacaaaaaaaaaacgaaaaacaaatacaaaaaaaaaaaaaaaaaataaacacgacgaaaaaaaaaaaaaaaaataaaaaaaacaaaaaacaataaaaaaacgaaacgcgaaaaaaaaaaaaaaaaaaaaaaaaaacgaaaaaaaaaaaaatacgaaaacgaaacgaacaaaaaaaaaatataactattcaaatttattttattcaaaac

SEQ ID NO: 3669 - DNA, 561 bp, Artificial Sequence
  chemically treated genomic DNA (Homo sapiens) CpG-island No: 3669
gttgcgggttgttagcggagtcgcgcgtcgggagttacgtagggtagggaaggtatggtttttgttttcgtttaatgagaaggggttagcggtggcggtcgggttaggttcggggtttggggacgtcgaggcggtcgcggaggagcgtcgcgttaaggtttttagtttgttttatagtgtggatgcgttcgtgtcggataagaagtcgtttaaggaggtatttttagtgtcggttaaaagcgtttttttcggggttattttgcggttattgttgttgtcggggtacggcgttcgggaagcgtatagtttcgggtcgttgattaagtttttcgagatcgtttcggttaagtgggaaaattttttaagacggagcggcgtggatgtaggaattttgttgataattcgtcgtcgttaagatacgtgagttttattatttgtattttgagaaaatataagattaattcgaagtcgcgtatagtttttattacgttttagtttttcgttttggagggtaagttgttttagaaatagtatttttttattgtagagggtgcggatttt

SEQ ID NO: 3670 - DNA, 561 bp, Artificial Sequence
  chemically treated genomic DNA (Homo sapiens) CpG-island No: 3670
aaaatccgcaccctctacaataaaaaaatactatttctaaaacaacttaccctccaaaacgaaaaactaaaacgtaataaaaactatacgcgacttcgaattaatcttatattttctcaaaatacaaataataaaactcacgtatcttaacgacgacgaattatcaacaaaattcctacatccacgccgctccgtcttaaaaaattttcccacttaaccgaaacgatctcgaaaaacttaatcaacgacccgaaactatacgcttcccgaacgccgtaccccgacaacaacaataaccgcaaaataaccccgaaaaaaacgcttttaaccgacactaaaaatacctccttaaacgacttcttatccgacacgaacgcatccacactataaaacaaactaaaaaccttaacgcgacgctcctccgcgaccgcctcgacgtccccaaaccccgaacctaacccgaccgccaccgctaaccccttctcattaaacgaaaacaaaaaccataccttccctaccctacgtaactcccgacgcgcgactccgctaacaacccgcaac

SEQ ID NO: 3671 - DNA, 561 bp, Artificial Sequence
  chemically treated genomic DNA (Homo sapiens) CpG-island No: 3671
gaagttcgtattttttgtaatggagaggtattgtttttggagtaatttgttttttagagcgaggagttgggacgtggtaaaggttgtgcgcggtttcggattggttttgtgtttttttagggtgtaggtggtagggtttacgtgttttggcggcggcgaattattagtagggtttttgtatttacgtcgtttcgttttagggagtttttttatttgatcgaggcggtttcgaagggtttgattagcggttcggggttgtgcgtttttcgagcgtcgtgtttcggtagtagtagtagtcgtagggtggtttcggaagaggcgtttttggtcggtattggggatgtttttttgggcggttttttgttcgatacgagcgtatttatattgtagggtaggttggagattttgacgcggcgttttttcgcggtcgtttcggcgtttttaggtttcggatttggttcgatcgttatcgttggtttttttttattggacgaaaatagaagttatgttttttttgttttacgtagttttcgacgcgcgatttcgttagtaattcgtagt

SEQ ID NO: 3672 - DNA, 561 bp, Artificial Sequence
  chemically treated genomic DNA (Homo sapiens) CpG-island No: 3672
actacgaattactaacgaaatcgcgcgtcgaaaactacgtaaaacaaaaaaaacataacttctattttcgtccaataaaaaaaaaccaacgataacgatcgaaccaaatccgaaacctaaaaacgccgaaacgaccgcgaaaaaacgccgcgtcaaaatctccaacctaccctacaatataaatacgctcgtatcgaacaaaaaaccgcccaaaaaaacatccccaataccgaccaaaaacgcctcttccgaaaccaccctacgactactactactaccgaaacacgacgctcgaaaaacgcacaaccccgaaccgctaatcaaacccttcgaaaccgcctcgatcaaataaaaaaactccctaaaacgaaacgacgtaaatacaaaaaccctactaataattcgccgccgccaaaacacgtaaaccctaccacctacaccctaaaaaaacacaaaaccaatccgaaaccgcgcacaacctttaccacgtcccaactcctcgctctaaaaaacaaattactccaaaaacaatacctctccattacaaaaaatacgaacttc

SEQ ID NO: 3673 - DNA, 1060 bp, Artificial Sequence
  chemically treated genomic DNA (Homo sapiens) CpG-island No: 3673
gggtatcgcgagcgtaggtttaggcgtagtttttttgtttgcgggattgaataggtaggtgcgttttagcggtcgggcgggtcgggttttttttttgcgggtaggcgtcgcgttgcggggcgcggttggcggagcggggtagtcgggcgtagcgttttttgggtttgaagattggcgggcggcgggggcgcgcgtaggtcggcgggggcgcgtcgcgttgcgaggtttgcgcgttaggttgcgggagttatgcggcgatcgaggagttttgcggtcgttaagttgcgcgggtagaagcggttcggggttttcgcggttttcgcggttttcgcggtcgttgttttggtatttagcgttattcgtatacggcgtttcgttagttaggtcgggagtaagagttaggcggtggagaagtcgtcgtcggagaagtcgcggttgaggcgttcgtcgtcgcgggtttaggaggagggttcgggggagtcgtcgtcgtttgagttggcgttgttttcgttatcgtcgtcgtcgtcgtcgattttcgcgatttcgacgttttcggcgtttaatttggatttgggcgagtagcgggagcgttgggagacgttttagaagcggtagaagtttattttcgagggtgtcgttaagtttttgttagatattttgtgagtgcggcgggtcggggggcgcgggagtcgttgttacgcggattttttcggtaggagtcgggttcgtagttcgcgtgtaggttttgggcgttttttagttttgagttttttacgttacggagtcgacgcggttttttcgttagtattggggttattttttaattttaagggcggcggggcggggcggtgtttttagggttgtgtggtttgggaatggaaagggggtttcgttcggagtttgagggcgcgcgtagtcgttttgggatataaagagtttttttcggttataagtatcgtgttcggggacgttgttttttgttggcgcgtaaagggtgtgggggttttttttagtgaaaagaatataaattttacggtttttttttattcgaatttttttt

SEQ ID NO: 3674 - DNA, 1060 bp, Artificial Sequence
  chemically treated genomic DNA (Homo sapiens) CpG-island No: 3674
aaaaaaaattcgaataaaaaaaaaccgtaaaatttatattcttttcactaaaaaaaacccccacaccctttacgcgccaacaaaaaacaacgtccccgaacacgatacttataaccgaaaaaaactctttatatcccaaaacgactacgcgcgccctcaaactccgaacgaaaccccctttccattcccaaaccacacaaccctaaaaacaccgccccgccccgccgcccttaaaattaaaaaataaccccaatactaacgaaaaaaccgcgtcgactccgtaacgtaaaaaactcaaaactaaaaaacgcccaaaacctacacgcgaactacgaacccgactcctaccgaaaaaatccgcgtaacaacgactcccgcgccccccgacccgccgcactcacaaaatatctaacaaaaacttaacgacaccctcgaaaataaacttctaccgcttctaaaacgtctcccaacgctcccgctactcgcccaaatccaaattaaacgccgaaaacgtcgaaatcgcgaaaatcgacgacgacgacgacgataacgaaaacaacgccaactcaaacgacgacgactcccccgaaccctcctcctaaacccgcgacgacgaacgcctcaaccgcgacttctccgacgacgacttctccaccgcctaactcttactcccgacctaactaacgaaacgccgtatacgaataacgctaaataccaaaacaacgaccgcgaaaaccgcgaaaaccgcgaaaaccccgaaccgcttctacccgcgcaacttaacgaccgcaaaactcctcgatcgccgcataactcccgcaacctaacgcgcaaacctcgcaacgcgacgcgcccccgccgacctacgcgcgcccccgccgcccgccaatcttcaaacccaaaaaacgctacgcccgactaccccgctccgccaaccgcgccccgcaacgcgacgcctacccgcaaaaaaaaaacccgacccgcccgaccgctaaaacgcacctacctattcaatcccgcaaacaaaaaaactacgcctaaacctacgctcgcgataccc

SEQ ID NO: 3675 - DNA, 1060 bp, Artificial Sequence
  chemically treated genomic DNA (Homo sapiens) CpG-island No: 3675
aaaggggattcgggtaagagaaagtcgtgggatttatgttttttttattaagaaaggtttttatattttttgcgcgttagtaagagataacgttttcgagtacgatgtttatggtcgggaaagattttttgtgttttaagacggttgcgcgcgtttttaagtttcggacgaagttttttttttatttttaggttatatagttttagaagtatcgtttcgtttcgtcgtttttagaattaaggaataattttagtgttaacgggggagtcgcgtcggtttcgtaacgtggaaggtttagagttgaaaggcgtttaaggtttgtacgcgggttgcgagttcgatttttgtcgagggggttcgcgtggtaacggttttcgcgtttttcggttcgtcgtatttataaggtgtttagtaggagtttggcggtattttcggaggtaagtttttgtcgtttttggaacgttttttagcgttttcgttgttcgtttaggtttaggttggacgtcgaggacgtcggggtcgcgggagtcggcggcggcggcggcggtggcgggagtaacgttagtttaggcggcggcggttttttcgggttttttttttgggttcgcggcgacgagcgttttagtcgcggttttttcgacggcggtttttttatcgtttggtttttgttttcggtttggttagcggagcgtcgtgtgcgggtggcgttgggtgttaaggtagcggtcgcggaggtcgcgggggtcgcggaggtttcggatcgtttttgttcgcgtagtttggcggtcgtagagtttttcgatcgtcgtatggttttcgtagtttggcgcgtaggtttcgtagcgcggcgcgttttcgtcggtttgcgcgcgttttcgtcgttcgttagtttttaggtttagggggcgttgcgttcggttgtttcgtttcgttagtcgcgtttcgtagcgcggcgtttgttcgtaggagggagattcggttcgttcggtcgttgggacgtatttgtttgtttagtttcgtaggtagaggggttgcgtttgggtttacgttcgcgatattt

SEQ ID NO: 3676 - DNA, 1060 bp, Artificial Sequence
  chemically treated genomic DNA (Homo sapiens) CpG-island No: 3676
aaatatcgcgaacgtaaacccaaacgcaacccctctacctacgaaactaaacaaacaaatacgtcccaacgaccgaacgaaccgaatctccctcctacgaacaaacgccgcgctacgaaacgcgactaacgaaacgaaacaaccgaacgcaacgccccctaaacctaaaaactaacgaacgacgaaaacgcgcgcaaaccgacgaaaacgcgccgcgctacgaaacctacgcgccaaactacgaaaaccatacgacgatcgaaaaactctacgaccgccaaactacgcgaacaaaaacgatccgaaacctccgcgacccccgcgacctccgcgaccgctaccttaacacccaacgccacccgcacacgacgctccgctaaccaaaccgaaaacaaaaaccaaacgataaaaaaaccgccgtcgaaaaaaccgcgactaaaacgctcgtcgccgcgaacccaaaaaaaaaacccgaaaaaaccgccgccgcctaaactaacgttactcccgccaccgccgccgccgccgccgactcccgcgaccccgacgtcctcgacgtccaacctaaacctaaacgaacaacgaaaacgctaaaaaacgttccaaaaacgacaaaaacttacctccgaaaataccgccaaactcctactaaacaccttataaatacgacgaaccgaaaaacgcgaaaaccgttaccacgcgaaccccctcgacaaaaatcgaactcgcaacccgcgtacaaaccttaaacgcctttcaactctaaaccttccacgttacgaaaccgacgcgactcccccgttaacactaaaattattccttaattctaaaaacgacgaaacgaaacgatacttctaaaactatataacctaaaaataaaaaaaaaacttcgtccgaaacttaaaaacgcgcgcaaccgtcttaaaacacaaaaaatctttcccgaccataaacatcgtactcgaaaacgttatctcttactaacgcgcaaaaaatataaaaacctttcttaataaaaaaaacataaatcccacgactttctcttacccgaatccccttt

SEQ ID NO: 3677 - DNA, 632 bp, Artificial Sequence
  chemically treated genomic DNA (Homo sapiens) CpG-island No: 3677
tcgtcgtcgttttattacgtcgcggaggggtttgtagggttttttttacggtttggagttttttttttttttacgtttgaggaaggtttcgggcgcgcggaatagacgggtaggcggggggcgtataagtttagggtacgatggtagtagcgttggattcggttgggcgttgttcggtttcgtattcgttcgagaggatcgtcgttgttaggtttagaggagatatgaagagatcgggcgtagcgcgattcgggaagtttcgtcgaggtaggagaggcgttcggttagcggagggagttggttttttaatttttcggaaggaggaggagtcggcgttggagtcgttttagtcgcggtttcgcgggttggggggagggagaggggttgagttaagatggcggttaaggtggcgaagtagtagtcgcggcggcggcggcggttggagtgagcgttcgattcgtcgcgtcgaacgaggtttcggtgtagggtcgcgcgtcgtggtcgcgttttattttttaggtcggggcgtacgtcggtttttacgtttagttagttttcggtgagtaggttttggcgtttgtaatttcggttttcgggtttttgttagttcgggggttttcgagggttttcgg

SEQ ID NO: 3678 - DNA, 632 bp, Artificial Sequence
  chemically treated genomic DNA (Homo sapiens) CpG-island No: 3678
ccgaaaaccctcgaaaacccccgaactaacaaaaacccgaaaaccgaaattacaaacgccaaaacctactcaccgaaaactaactaaacgtaaaaaccgacgtacgccccgacctaaaaaataaaacgcgaccacgacgcgcgaccctacaccgaaacctcgttcgacgcgacgaatcgaacgctcactccaaccgccgccgccgccgcgactactacttcgccaccttaaccgccatcttaactcaacccctctccctccccccaacccgcgaaaccgcgactaaaacgactccaacgccgactcctcctccttccgaaaaattaaaaaaccaactccctccgctaaccgaacgcctctcctacctcgacgaaacttcccgaatcgcgctacgcccgatctcttcatatctcctctaaacctaacaacgacgatcctctcgaacgaatacgaaaccgaacaacgcccaaccgaatccaacgctactaccatcgtaccctaaacttatacgccccccgcctacccgtctattccgcgcgcccgaaaccttcctcaaacgtaaaaaaaaaaaaaactccaaaccgtaaaaaaaaccctacaaacccctccgcgacgtaataaaacgacgacga

SEQ ID NO: 3679 - DNA, 632 bp, Artificial Sequence
  chemically treated genomic DNA (Homo sapiens) CpG-island No: 3679
tcgggagttttcggaagttttcggattagtaggagttcggaggtcggggttgtaggcgttagggtttatttatcgggagttggttaagcgtgggagtcgacgtgcgtttcggtttgaggagtgggacgcggttacggcgcgcggttttatatcgggatttcgttcggcgcggcgagtcggacgtttattttagtcgtcgtcgtcgtcgcggttgttgtttcgttattttggtcgttattttgatttaatttttttttttttttttagttcgcggagtcgcggttaaggcggttttagcgtcggtttttttttttttcggagagttgggagattaatttttttcgttggtcgggcgttttttttatttcggcggagtttttcgggtcgcgttgcgttcggtttttttatgttttttttaggtttggtagcggcggttttttcggacggatacggggtcgagtagcgtttagtcggatttagcgttgttgttatcgtgttttgggtttgtgcgtttttcgtttgttcgtttgtttcgcgcgttcgaggttttttttaggcgtgggaaaaggaaaaattttaggtcgtggaagggattttgtaaattttttcgcggcgtggtggggcggcggcgg

SEQ ID NO: 3680 - DNA, 632 bp, Artificial Sequence
  chemically treated genomic DNA (Homo sapiens) CpG-island No: 3680
ccgccgccgccccaccacgccgcgaaaaaatttacaaaatcccttccacgacctaaaatttttccttttcccacgcctaaaaaaaacctcgaacgcgcgaaacaaacgaacaaacgaaaaacgcacaaacccaaaacacgataacaacaacgctaaatccgactaaacgctactcgaccccgtatccgtccgaaaaaaccgccgctaccaaacctaaaaaaaacataaaaaaaccgaacgcaacgcgacccgaaaaactccgccgaaataaaaaaaacgcccgaccaacgaaaaaaattaatctcccaactctccgaaaaaaaaaaaaaccgacgctaaaaccgccttaaccgcgactccgcgaactaaaaaaaaaaaaaaaaattaaatcaaaataacgaccaaaataacgaaacaacaaccgcgacgacgacgacgactaaaataaacgtccgactcgccgcgccgaacgaaatcccgatataaaaccgcgcgccgtaaccgcgtcccactcctcaaaccgaaacgcacgtcgactcccacgcttaaccaactcccgataaataaaccctaacgcctacaaccccgacctccgaactcctactaatccgaaaacttccgaaaactcccga

SEQ ID NO: 3681 - DNA, 739 bp, Artificial Sequence
  chemically treated genomic DNA (Homo sapiens) CpG-island No: 3681
ttcgcgcggaggagggttgcgtttttatttttttttttagtcgttttttatttttaaattgtggaaggggcgggggcgcgcgcgttttattacgtacgcgtttttacgtacgcgcgtttttttcgcgttcgcgtttttttttattttagttcggagggggcggggttgcgggcggttttagagggtgcgacgtttttagcgcggcggcggcgttagcgagcggtcggcggggcgcgggttgttgggcgcgttgtttcggcggggttcgttggtatagtcgtttcgcgcgagtcgttcgttcggcgggggaagttgcgagcgtttcgagcgttcggtttagggtcgttggcgttgttttttcgtcgttatcgtttttcgcgtttttttcgggcggtttcgtttttatttttatttttttcgcgtttatttttcggttgtgtcgcgcgttaggcggagcgaggcgttcgtcgtcgtcgagtcgagtcgaggggcgagagttggttttcgagtcgtcgttgataggagtatcgtcgcgggttgcgttcgtcggttgcgaggtttcgtcgcgtcgtttcggggtgtagattcgtcgcggggcgttggaggattgcgaggtgtttcgggaatcgcgggcggcgtcggcgggcggcgcggtttttataggagatttcggggattggggtttgattcggaggtgtagagagttttttagagcggtaggtaaggggttcggggagta

SEQ ID NO: 3682 - DNA, 739 bp, Artificial Sequence
  chemically treated genomic DNA (Homo sapiens) CpG-island No: 3682
tactccccgaaccccttacctaccgctctaaaaaactctctacacctccgaatcaaaccccaatccccgaaatctcctataaaaaccgcgccgcccgccgacgccgcccgcgattcccgaaacacctcgcaatcctccaacgccccgcgacgaatctacaccccgaaacgacgcgacgaaacctcgcaaccgacgaacgcaacccgcgacgatactcctatcaacgacgactcgaaaaccaactctcgcccctcgactcgactcgacgacgacgaacgcctcgctccgcctaacgcgcgacacaaccgaaaaataaacgcgaaaaaaataaaaataaaaacgaaaccgcccgaaaaaaacgcgaaaaacgataacgacgaaaaaacaacgccaacgaccctaaaccgaacgctcgaaacgctcgcaacttcccccgccgaacgaacgactcgcgcgaaacgactataccaacgaaccccgccgaaacaacgcgcccaacaacccgcgccccgccgaccgctcgctaacgccgccgccgcgctaaaaacgtcgcaccctctaaaaccgcccgcaaccccgccccctccgaactaaaataaaaaaaaacgcgaacgcgaaaaaaacgcgcgtacgtaaaaacgcgtacgtaataaaacgcgcgcgcccccgccccttccacaatttaaaaataaaaaacgactaaaaaaaaaaataaaaacgcaaccctcctccgcgcgaa

SEQ ID NO: 3683 - DNA, 739 bp, Artificial Sequence
  chemically treated genomic DNA (Homo sapiens) CpG-island No: 3683
tgtttttcgggttttttatttgtcgttttgaggggttttttgtattttcgggttaagttttagttttcggggttttttgtgaggatcgcgtcgttcgtcggcgtcgttcgcgattttcggagtatttcgtagttttttaacgtttcgcggcgagtttgtatttcggaacggcgcggcggggtttcgtagtcggcgagcgtagttcgcggcggtgtttttgttagcggcggttcgggggttagttttcgtttttcggttcggttcggcggcggcgggcgtttcgtttcgtttagcgcgcggtatagtcgggaggtgagcgcgagggggatgggaatgggggcggggtcgttcgaaggaggcgcggagggcggtggcggcgggagggtagcgttagcggttttaggtcgggcgttcggagcgttcgtagtttttttcgtcgggcgggcggttcgcgcgaggcggttgtgttagcgggtttcgtcggagtagcgcgtttagtaattcgcgtttcgtcggtcgttcgttagcgtcgtcgtcgcgttgggggcgtcgtattttttgaggtcgttcgtagtttcgtttttttcgggttggggtggggaggggcgcgagcgcggagggagcgcgcgtgcgtgggggcgcgtgcgtggtggagcgcgcgcgttttcgttttttttatagtttgggggtggggaacggttggaagagggagtggggacgtagttttttttcgcgcgga

SEQ ID NO: 3684 - DNA, 739 bp, Artificial Sequence
  chemically treated genomic DNA (Homo sapiens) CpG-island No: 3684
tccgcgcgaaaaaaaactacgtccccactccctcttccaaccgttccccacccccaaactataaaaaaaacgaaaacgcgcgcgctccaccacgcacgcgcccccacgcacgcgcgctccctccgcgctcgcgcccctccccaccccaacccgaaaaaaacgaaactacgaacgacctcaaaaaatacgacgcccccaacgcgacgacgacgctaacgaacgaccgacgaaacgcgaattactaaacgcgctactccgacgaaacccgctaacacaaccgcctcgcgcgaaccgcccgcccgacgaaaaaaactacgaacgctccgaacgcccgacctaaaaccgctaacgctaccctcccgccgccaccgccctccgcgcctccttcgaacgaccccgcccccattcccatccccctcgcgctcacctcccgactataccgcgcgctaaacgaaacgaaacgcccgccgccgccgaaccgaaccgaaaaacgaaaactaacccccgaaccgccgctaacaaaaacaccgccgcgaactacgctcgccgactacgaaaccccgccgcgccgttccgaaatacaaactcgccgcgaaacgttaaaaaactacgaaatactccgaaaatcgcgaacgacgccgacgaacgacgcgatcctcacaaaaaaccccgaaaactaaaacttaacccgaaaatacaaaaaacccctcaaaacgacaaataaaaaacccgaaaaaca

SEQ ID NO: 3685 - DNA, 585 bp, Artificial Sequence
  chemically treated genomic DNA (Homo sapiens) CpG-island No: 3685
gggacggcgcgtttattcgtagggcggataggtcgatgtcgtttaggttgcgggcgggggttgggtcgtttatggttttcgtggggaacggggtatcggggtcgtttacgtttcggttcggttattttattgtcgtcgtcgtcgttttttttttatcggagaatttcgggggcggattttatcgcgtttttttcggagatcggggagggggagggtcggcgcgaggatcgatttatcgattgataggcgttattttttcggagttagttattcgagtttattattttttttgcgtaggcgcggagcgatcgcgtattgggagggtggaagcgcgagcgtgacgcgagcgcgtcggggttttttttttttaggcgtcgatatttgcgcgtaggcgtaggcgagtaggcgaaaggcgcgcgcgaggacggagcgatcgcgcgagtttggcgtgaaagaagtgggcggcggtcgaggcggtcgcggagcgcgtttattagttggtgcgcgtgcgtatacgcgtttttttttttttttttattttttttgtttttttttttttttattttttttttagattttttttga

SEQ ID NO: 3686 - DNA, 585 bp, Artificial Sequence
  chemically treated genomic DNA (Homo sapiens) CpG-island No: 3686
tcaaaaaaaatctaaaaaaaaaataaaaaaaaaaaaaaacaaaaaaaataaaaaaaaaaaaaaaaacgcgtatacgcacgcgcaccaactaataaacgcgctccgcgaccgcctcgaccgccgcccacttctttcacgccaaactcgcgcgatcgctccgtcctcgcgcgcgcctttcgcctactcgcctacgcctacgcgcaaatatcgacgcctaaaaaaaaaaaaccccgacgcgctcgcgtcacgctcgcgcttccaccctcccaatacgcgatcgctccgcgcctacgcaaaaaaaataataaactcgaataactaactccgaaaaaataacgcctatcaatcgataaatcgatcctcgcgccgaccctccccctccccgatctccgaaaaaaacgcgataaaatccgcccccgaaattctccgataaaaaaaaaacgacgacgacgacaataaaataaccgaaccgaaacgtaaacgaccccgataccccgttccccacgaaaaccataaacgacccaacccccgcccgcaacctaaacgacatcgacctatccgccctacgaataaacgcgccgtccc

SEQ ID NO: 3687 - DNA, 585 bp, Artificial Sequence
  chemically treated genomic DNA (Homo sapiens) CpG-island No: 3687
ttaaaggagatttgagaaggaaataagggagagaaagggtaaaaaaaatagggaaagaaaaggaaacgcgtgtgcgtacgcgtattagttggtgggcgcgtttcgcggtcgtttcggtcgtcgtttattttttttacgttaggttcgcgcggtcgtttcgttttcgcgcgcgtttttcgtttgttcgtttgcgtttgcgcgtaggtgtcggcgtttagggggagggggtttcggcgcgttcgcgttacgttcgcgtttttatttttttagtgcgcggtcgtttcgcgtttgcgtaggagaggtggtaggttcgggtggttggtttcggggagatagcgtttgttagtcggtgggtcggttttcgcgtcggtttttttttttttcggttttcgggggaggcgcggtggagttcgttttcggggtttttcgatgggggagaagcggcgacggcggtagtggagtaatcgagtcggagcgtgagcggtttcggtgtttcgttttttacggaggttatgggcgatttagttttcgttcgtagtttggacgatatcgatttgttcgttttgcgggtgagcgcgtcgtttt

SEQ ID NO: 3688 - DNA, 585 bp, Artificial Sequence
  chemically treated genomic DNA (Homo sapiens) CpG-island No: 3688
aaaacgacgcgctcacccgcaaaacgaacaaatcgatatcgtccaaactacgaacgaaaactaaatcgcccataacctccgtaaaaaacgaaacaccgaaaccgctcacgctccgactcgattactccactaccgccgtcgccgcttctcccccatcgaaaaaccccgaaaacgaactccaccgcgcctcccccgaaaaccgaaaaaaaaaaaaaccgacgcgaaaaccgacccaccgactaacaaacgctatctccccgaaaccaaccacccgaacctaccacctctcctacgcaaacgcgaaacgaccgcgcactaaaaaaataaaaacgcgaacgtaacgcgaacgcgccgaaaccccctccccctaaacgccgacacctacgcgcaaacgcaaacgaacaaacgaaaaacgcgcgcgaaaacgaaacgaccgcgcgaacctaacgtaaaaaaaataaacgacgaccgaaacgaccgcgaaacgcgcccaccaactaatacgcgtacgcacacgcgtttccttttctttccctattttttttaccctttctctcccttatttccttctcaaatctcctttaa

SEQ ID NO: 3689 - DNA, 1014 bp, Artificial Sequence
  chemically treated genomic DNA (Homo sapiens) CpG-island No: 3689
tcgttcgcggatgacgtttgattagtttgtaacgttttatcgattttttcgagtttttattttttattttagttttttatttataattttagtttcgtttttcgtttttcgtttcgtttcgtaattagagtttcggggaatatttagttaggttcggaaggtttcgatttggggcggcgtagtagttgcgcggggaagcggttttgggtggttcggagagcgcgcggttacggggtttacgttaggttaggcgggtcgggggtaggggtttaggcgggaatgaggaagttacgcgattttagtcgggggtagaaatttcgaaatttgagcgtgcgattgagtttggaggtttcgtagttcgagttcgtttcgttttcgttcgattttcgagattcgggattttcgcgcgttttttttcggtttttttattttggtagacggagttagcgttcgcgggggtttcggagttaagagagtagatcggagttgtagtcggagtttacgtttcggtcgaggcggggtcggtcgaggcggggtcggggtttagggtttgttttcgggggcggggcggttttcggttttattttcgcgggattttcgtttgttttgtttcgttttcgttgttttcggttcgtttcgtcgtttagtgcgttatcgagagtttcgggtagggggtcgttttgtgttttgtagggtcgcggggtcgcgtagttttttcggtgcggcgggtaagtgttgttcggcgtcggggcgtttcgcgtcgtcggttttagcgtgttcggtcgttgtttttcggggtatttcgcgttgcgcgtatttttcgggttcggcgttcgtttcgggtttttttagtcgcgggcgttgtttcggcgttcgggggacgcgttttcgttgcgggagttgtcggtaggtgtttcgttttcggattcgttgcgagttatatttggtttagtttagatagcgtttgtatttggaaggaatgagggcgtaaaaggtttgaggggtggtggttat

SEQ ID NO: 3690 - DNA, 1014 bp, Artificial Sequence
  chemically treated genomic DNA (Homo sapiens) CpG-island No: 3690
ataaccaccacccctcaaaccttttacgccctcattccttccaaatacaaacgctatctaaactaaaccaaatataactcgcaacgaatccgaaaacgaaacacctaccgacaactcccgcaacgaaaacgcgtcccccgaacgccgaaacaacgcccgcgactaaaaaaacccgaaacgaacgccgaacccgaaaaatacgcgcaacgcgaaataccccgaaaaacaacgaccgaacacgctaaaaccgacgacgcgaaacgccccgacgccgaacaacacttacccgccgcaccgaaaaaactacgcgaccccgcgaccctacaaaacacaaaacgaccccctacccgaaactctcgataacgcactaaacgacgaaacgaaccgaaaacaacgaaaacgaaacaaaacaaacgaaaatcccgcgaaaataaaaccgaaaaccgccccgcccccgaaaacaaaccctaaaccccgaccccgcctcgaccgaccccgcctcgaccgaaacgtaaactccgactacaactccgatctactctcttaactccgaaacccccgcgaacgctaactccgtctaccaaaataaaaaaaccgaaaaaaaacgcgcgaaaatcccgaatctcgaaaatcgaacgaaaacgaaacgaactcgaactacgaaacctccaaactcaatcgcacgctcaaatttcgaaatttctacccccgactaaaatcgcgtaacttcctcattcccgcctaaacccctacccccgacccgcctaacctaacgtaaaccccgtaaccgcgcgctctccgaaccacccaaaaccgcttccccgcgcaactactacgccgccccaaatcgaaaccttccgaacctaactaaatattccccgaaactctaattacgaaacgaaacgaaaaacgaaaaacgaaactaaaattataaataaaaaactaaaataaaaaataaaaactcgaaaaaatcgataaaacgttacaaactaatcaaacgtcatccgcgaacga

SEQ ID NO: 3691 - DNA, 1014 bp, Artificial Sequence
  chemically treated genomic DNA (Homo sapiens) CpG-island No: 3691
gtagttattattttttaggttttttacgtttttattttttttaggtataaacgttatttgggttaggttaaatgtggttcgtagcgggttcgggagcggggtatttatcggtagttttcgtagcggaggcgcgtttttcgggcgtcgaggtagcgttcgcggttggaggggttcggggcgggcgtcgagttcgagggatgcgcgtagcgcggggtgtttcgggaggtagcggtcgggtacgttgggatcgacggcgcgggacgtttcgacgtcgggtagtatttattcgtcgtatcgagagagttacgcggtttcgcggttttgtagggtatagggcggttttttgttcggggttttcggtggcgtattgggcggcggggcgggtcgagggtagcgggggcgggataggatagacgagaatttcgcggaggtgaggtcgggggtcgtttcgttttcgagggtaggttttgagtttcggtttcgtttcggtcggtttcgtttcggtcggggcgtgggtttcggttgtagtttcggtttgtttttttggtttcggaattttcgcgggcgttggtttcgtttgttagggtgagggggtcgggaaggggcgcgcgggggtttcgggtttcggaaatcgggcggggacggaacgggttcgggttgcggggtttttagatttagtcgtacgtttagatttcgggatttttattttcggttgggatcgcgtaatttttttattttcgtttggatttttgttttcggttcgtttggtttggcgtgagtttcgtagtcgcgcgtttttcggattatttagggtcgttttttcgcgtagttgttgcgtcgttttaggtcggagtttttcgggtttggttgggtgtttttcggggttttggttacgggacggggcggggggcggggggcgggattgggattgtggatgaaggattaaggtaggggatgggggttcgaaggggtcggtggggcgttgtaaattggttaggcgttattcgcgggcgg

SEQ ID NO: 3692 - DNA, 1014 bp, Artificial Sequence
  chemically treated genomic DNA (Homo sapiens) CpG-island No: 3692
ccgcccgcgaataacgcctaaccaatttacaacgccccaccgaccccttcgaacccccatcccctaccttaatccttcatccacaatcccaatcccgccccccgccccccgccccgtcccgtaaccaaaaccccgaaaaacacccaaccaaacccgaaaaactccgacctaaaacgacgcaacaactacgcgaaaaaacgaccctaaataatccgaaaaacgcgcgactacgaaactcacgccaaaccaaacgaaccgaaaacaaaaatccaaacgaaaataaaaaaattacgcgatcccaaccgaaaataaaaatcccgaaatctaaacgtacgactaaatctaaaaaccccgcaacccgaacccgttccgtccccgcccgatttccgaaacccgaaacccccgcgcgccccttcccgaccccctcaccctaacaaacgaaaccaacgcccgcgaaaattccgaaaccaaaaaaacaaaccgaaactacaaccgaaacccacgccccgaccgaaacgaaaccgaccgaaacgaaaccgaaactcaaaacctaccctcgaaaacgaaacgacccccgacctcacctccgcgaaattctcgtctatcctatcccgcccccgctaccctcgacccgccccgccgcccaatacgccaccgaaaaccccgaacaaaaaaccgccctataccctacaaaaccgcgaaaccgcgtaactctctcgatacgacgaataaatactacccgacgtcgaaacgtcccgcgccgtcgatcccaacgtacccgaccgctacctcccgaaacaccccgcgctacgcgcatccctcgaactcgacgcccgccccgaacccctccaaccgcgaacgctacctcgacgcccgaaaaacgcgcctccgctacgaaaactaccgataaataccccgctcccgaacccgctacgaaccacatttaacctaacccaaataacgtttatacctaaaaaaaataaaaacgtaaaaaacctaaaaaataataactac

SEQ ID NO: 3693 - DNA, 967 bp, Artificial Sequence
  chemically treated genomic DNA (Homo sapiens) CpG-island No: 3693
agattgcggatagagggagtttaacgttattttttgtcgggggcggttttcgtcgcggcgacgttacggaagaggcgggatacggaggcggtcgcggcgcgggttgtaggattgatttcgggttgcgcggttttatttcgggcggttcgtttcgttttcgtcggttttcgtagtcgtcgttttaggttagttggagtaggtcgcgttcggttagtaggttttgggtgcggttgtagatattttttaaggtgtcggcggttcggattagcgcggttcgcgttttcgtttcggtggtttcgggatacgttagttttagtaggcggcggcgattcgggaaggcgaggaaggcgaggcgggcggtttgtcggattagttaggggtgatgcggatttagggtcgtacggtaggcgtcgttgtattgtacgttcgcgttcgggttttttagcgcgtcggtcgttattcggtggaggtagagttgggattagcgtagcgcgcggtgtagtaggagtagcgtgcgagagttcgagtttcgggtcgggtttcggggggtcgttttcggttgttttagtagtttcgtttttcgtttttacgtcgttatggttattagcgattagtagtgtttcgcgttcgggtcgtgtattcgagtttttaggtttgttattttggtgaaggtttttttagtggcgaaggcgaagacggagtcgaggggagttaggaatttgcgggcgagacgatttgagagaatggagatggagtcgttaaggaggcggggatcggttggggggcgggaggttatttattcgacgagtgttttttatttcgttaggtacggcgatagttttatatttttttcgggttttagattggcgtggaatcgttttattatgcggtttagtatttttcgagggtttagatacggaggttgtttttttttcggggtttttagggttttcgatttttgtcggat

SEQ ID NO: 3694 - DNA, 967 bp, Artificial Sequence
  chemically treated genomic DNA (Homo sapiens) CpG-island No: 3694
atccgacaaaaatcgaaaaccctaaaaaccccgaaaaaaaaacaacctccgtatctaaaccctcgaaaaatactaaaccgcataataaaacgattccacgccaatctaaaacccgaaaaaaatataaaactatcgccgtacctaacgaaataaaaaacactcgtcgaataaataacctcccgccccccaaccgatccccgcctccttaacgactccatctccattctctcaaatcgtctcgcccgcaaattcctaactcccctcgactccgtcttcgccttcgccactaaaaaaaccttcaccaaaataacaaacctaaaaactcgaatacacgacccgaacgcgaaacactactaatcgctaataaccataacgacgtaaaaacgaaaaacgaaactactaaaacaaccgaaaacgaccccccgaaacccgacccgaaactcgaactctcgcacgctactcctactacaccgcgcgctacgctaatcccaactctacctccaccgaataacgaccgacgcgctaaaaaacccgaacgcgaacgtacaatacaacgacgcctaccgtacgaccctaaatccgcatcacccctaactaatccgacaaaccgcccgcctcgccttcctcgccttcccgaatcgccgccgcctactaaaactaacgtatcccgaaaccaccgaaacgaaaacgcgaaccgcgctaatccgaaccgccgacaccttaaaaaatatctacaaccgcacccaaaacctactaaccgaacgcgacctactccaactaacctaaaacgacgactacgaaaaccgacgaaaacgaaacgaaccgcccgaaataaaaccgcgcaacccgaaatcaatcctacaacccgcgccgcgaccgcctccgtatcccgcctcttccgtaacgtcgccgcgacgaaaaccgcccccgacaaaaaataacgttaaactccctctatccgcaatct

SEQ ID NO: 3695 - DNA, 967 bp, Artificial Sequence
  chemically treated genomic DNA (Homo sapiens) CpG-island No: 3695
gttcggtaggagtcgggaattttggaggtttcggagaggaaatagttttcgtgtttgggttttcgggggatgttgggtcgtatgatgaggcggttttacgttagtttgaaattcgaaggggatgtggggttgtcgtcgtatttggcgggatggagggtattcgtcgagtgagtggtttttcgttttttagtcggttttcgtttttttggcggttttatttttatttttttaaatcgtttcgttcgtaggtttttgatttttttcggtttcgttttcgttttcgttattagggaggtttttattaaggtgatagatttggaggttcgggtgtacggttcggacgcggagtattattggtcgttggtggttatggcggcgtgggagcggagggcgggattgttggagtagtcgggggcggtttttcgggattcgattcggagttcgggttttcgtacgttgtttttgttgtatcgcgcgttgcgttggttttagttttgtttttatcgggtggcgatcggcgcgttgggaggttcggacgcgggcgtgtagtgtagcgacgtttatcgtgcggttttgggttcgtattatttttggttggttcgatagatcgttcgtttcgtttttttcgttttttcgggtcgtcgtcgtttgttggagttggcgtgtttcggagttatcgaggcggaggcgcgggtcgcgttggttcgggtcgtcggtattttggaggatgtttataatcgtatttagagtttgttggtcgagcgcggtttgttttagttggtttaagacggcggttgcggggatcggcgggaacggagcggatcgttcggggtggggtcgcgtagttcggggttagttttgtagttcgcgtcgcggtcgttttcgtatttcgtttttttcgtgacgtcgtcgcggcgagggtcgttttcggtagggaatggcgttgagttttttttgttcgtagttt

SEQ ID NO: 3696 - DNA, 967 bp, Artificial Sequence
  chemically treated genomic DNA (Homo sapiens) CpG-island No: 3696
aaactacgaacaaaaaaaactcaacgccattccctaccgaaaacgaccctcgccgcgacgacgtcacgaaaaaaacgaaatacgaaaacgaccgcgacgcgaactacaaaactaaccccgaactacgcgaccccaccccgaacgatccgctccgttcccgccgatccccgcaaccgccgtcttaaaccaactaaaacaaaccgcgctcgaccaacaaactctaaatacgattataaacatcctccaaaataccgacgacccgaaccaacgcgacccgcgcctccgcctcgataactccgaaacacgccaactccaacaaacgacgacgacccgaaaaaacgaaaaaaacgaaacgaacgatctatcgaaccaaccaaaaataatacgaacccaaaaccgcacgataaacgtcgctacactacacgcccgcgtccgaacctcccaacgcgccgatcgccacccgataaaaacaaaactaaaaccaacgcaacgcgcgatacaacaaaaacaacgtacgaaaacccgaactccgaatcgaatcccgaaaaaccgcccccgactactccaacaatcccgccctccgctcccacgccgccataaccaccaacgaccaataatactccgcgtccgaaccgtacacccgaacctccaaatctatcaccttaataaaaacctccctaataacgaaaacgaaaacgaaaccgaaaaaaatcaaaaacctacgaacgaaacgatttaaaaaaataaaaataaaaccgccaaaaaaacgaaaaccgactaaaaaacgaaaaaccactcactcgacgaataccctccatcccgccaaatacgacgacaaccccacatccccttcgaatttcaaactaacgtaaaaccgcctcatcatacgacccaacatcccccgaaaacccaaacacgaaaactatttcctctccgaaacctccaaaattcccgactcctaccgaac

SEQ ID NO: 3697 - DNA, 1093 bp, Artificial Sequence
  chemically treated genomic DNA (Homo sapiens) CpG-island No: 3697
cgggcgggggtcgaggttcgaggggcggcgtcgagagaaacggggcgcggattcggagcgcggcggcggcgggggaggcgcggagggcgtagggcggaggcgcgggtcgaggggggagggcgagcggagagggaggagttttcggtcgtcgtcgttagttcgttcggcggtcgcgtagttcgtattcgtcgtcgcgtttcggagtttgagttttagcgttgtcggagcgtaggtacgttcggggcgcggggtcggagcgcgtagcgcggcgtcgtttttcggttttcggttttttaatttcggcgttttcggagcggcgcgcggagggaggagggcgggcgggcgcggcgggtcgggtcggcgggcggcggattatgaggcgtttattatggtgcgatgcgatcgcgggttgtagatgttgttgattacggtcggagttttcgtcgttttttcgtttatggttatcgttatcggtatcgattattggttgtattttagcgcgtatatttgtaacggtattaatttgattatggacgacgggttttcgtttcgtcgcgttcgcggcgattttatttattttggtttgtggcgggtgtgttgtatcgaaggtacggttagtttcgatttttcgtcgttttatatatatatatatatatatatatatatatatacgcgcgcgcgcgcgcgcgtatatatatatacgcgtatatattgttcggcgcgcgggtcggggagagggtgggcgcggcgttggtttcgcgcgagatataaaggagtcggagttggcgggcgggttttttcgcggttagttgtatattagttttggtttttttcggttggggatttttttagtatatcgattttataaattttttacgcgtatattttttcgtttatagatataatgaaatatatcgaaatttaagtacgcgcgcgtagttcgggattcgagcgatttttaggggtcgcgtcggtattttcgggggaggtggaggttggcgagggggcgggaggaggttggggttggggggagcggacgggagggggggaggggttgtttggtaatcggtgtttgtgttattgttatgggaat

SEQ ID NO: 3698 - DNA, 1093 bp, Artificial Sequence
  chemically treated genomic DNA (Homo sapiens) CpG-island No: 3698
attcccataacaataacacaaacaccgattaccaaacaacccctccccccctcccgtccgctccccccaaccccaacctcctcccgccccctcgccaacctccacctcccccgaaaataccgacgcgacccctaaaaatcgctcgaatcccgaactacgcgcgcgtacttaaatttcgatatatttcattatatctataaacgaaaaaatatacgcgtaaaaaatttataaaatcgatatactaaaaaaatccccaaccgaaaaaaaccaaaactaatatacaactaaccgcgaaaaaacccgcccgccaactccgactcctttatatctcgcgcgaaaccaacgccgcgcccaccctctccccgacccgcgcgccgaacaatatatacgcgtatatatatatacgcgcgcgcgcgcgcgcgtatatatatatatatatatatatatatatatataaaacgacgaaaaatcgaaactaaccgtaccttcgatacaacacacccgccacaaaccaaaataaataaaatcgccgcgaacgcgacgaaacgaaaacccgtcgtccataatcaaattaataccgttacaaatatacgcgctaaaatacaaccaataatcgataccgataacgataaccataaacgaaaaaacgacgaaaactccgaccgtaatcaacaacatctacaacccgcgatcgcatcgcaccataataaacgcctcataatccgccgcccgccgacccgacccgccgcgcccgcccgccctcctccctccgcgcgccgctccgaaaacgccgaaattaaaaaaccgaaaaccgaaaaacgacgccgcgctacgcgctccgaccccgcgccccgaacgtacctacgctccgacaacgctaaaactcaaactccgaaacgcgacgacgaatacgaactacgcgaccgccgaacgaactaacgacgacgaccgaaaactcctccctctccgctcgccctcccccctcgacccgcgcctccgccctacgccctccgcgcctcccccgccgccgccgcgctccgaatccgcgccccgtttctctcgacgccgcccctcgaacctcgacccccgcccg

SEQ ID NO: 3699 - DNA, 1093 bp, Artificial Sequence
  chemically treated genomic DNA (Homo sapiens) CpG-island No: 3699
gtttttatagtaatagtatagatatcggttgttaagtaatttttttttttttttcgttcgttttttttaattttagttttttttcgttttttcgttagtttttatttttttcgggggtgtcggcgcggtttttggggatcgttcgggtttcgggttacgcgcgcgtgtttgagtttcggtgtgttttattgtgtttgtgggcgagggggtgtgcgcgtggagagtttgtgggatcggtgtgttggggaggtttttagtcgagagggattagagttgatgtatagttggtcgcgaagggattcgttcgttagtttcggtttttttgtgtttcgcgcggagttagcgtcgcgtttatttttttttcggttcgcgcgtcgggtagtgtgtgcgcgtgtgtgtgtgtgcgcgcgcgcgcgcgcgcgtgtgtatatgtgtgtgtgtgtgtgtgtgtgtgtggggcggcgaggggtcggggttggtcgtattttcgatgtagtatattcgttatagattagagtgggtgaggtcgtcgcgggcgcggcggggcgggggttcgtcgtttatggttaggttggtgtcgttgtagatgtgcgcgttggagtatagttagtagtcggtgtcgatggcgatggttatgagcgagaaggcggcgaaggtttcggtcgtggttagtagtatttgtagttcgcggtcgtatcgtattatggtgggcgttttatagttcgtcgttcgtcggttcggttcgtcgcgttcgttcgttttttttttttcgcgcgtcgtttcgggggcgtcggggttggggggtcgagggtcggggggcggcgtcgcgttgcgcgtttcgatttcgcgtttcgggcgtgtttgcgtttcggtagcgttggggtttaaatttcgaggcgcggcgacgagtgcgggttgcgcggtcgtcgggcgggttggcggcggcggtcgggggttttttttttttcgttcgtttttttttttcggttcgcgttttcgttttgcgtttttcgcgtttttttcgtcgtcgtcgcgtttcgggttcgcgtttcgtttttttcggcgtcgtttttcgagtttcggttttcgttcg

SEQ ID NO: 3700 - DNA, 1093 bp, Artificial Sequence
  chemically treated genomic DNA (Homo sapiens) CpG-island No: 3700
cgaacgaaaaccgaaactcgaaaaacgacgccgaaaaaaacgaaacgcgaacccgaaacgcgacgacgacgaaaaaaacgcgaaaaacgcaaaacgaaaacgcgaaccgaaaaaaaaaaacgaacgaaaaaaaaaaaacccccgaccgccgccgccaacccgcccgacgaccgcgcaacccgcactcgtcgccgcgcctcgaaatttaaaccccaacgctaccgaaacgcaaacacgcccgaaacgcgaaatcgaaacgcgcaacgcgacgccgccccccgaccctcgaccccccaaccccgacgcccccgaaacgacgcgcgaaaaaaaaaaaacgaacgaacgcgacgaaccgaaccgacgaacgacgaactataaaacgcccaccataatacgatacgaccgcgaactacaaatactactaaccacgaccgaaaccttcgccgccttctcgctcataaccatcgccatcgacaccgactactaactatactccaacgcgcacatctacaacgacaccaacctaaccataaacgacgaacccccgccccgccgcgcccgcgacgacctcacccactctaatctataacgaatatactacatcgaaaatacgaccaaccccgacccctcgccgccccacacacacacacacacacacacacatatacacacgcgcgcgcgcgcgcgcgcacacacacacacgcgcacacactacccgacgcgcgaaccgaaaaaaaaataaacgcgacgctaactccgcgcgaaacacaaaaaaaccgaaactaacgaacgaatcccttcgcgaccaactatacatcaactctaatccctctcgactaaaaacctccccaacacaccgatcccacaaactctccacgcgcacaccccctcgcccacaaacacaataaaacacaccgaaactcaaacacgcgcgcgtaacccgaaacccgaacgatccccaaaaaccgcgccgacacccccgaaaaaaataaaaactaacgaaaaaacgaaaaaaaactaaaattaaaaaaaacgaacgaaaaaaaaaaaaaaattacttaacaaccgatatctatactattactataaaaac

SEQ ID NO: 3701 - DNA, 870 bp, Artificial Sequence
  chemically treated genomic DNA (Homo sapiens) CpG-island No: 3701
ttttcgcgtcgttttttatagtttcgtttttttttttcgagttttcgtggtggcgagcgtaggggtttagcgagcgaagagcgaagtttcgggttcgcgaggacgcgcggcgggtcgtatggtgtcgggattcggggcgtatagggtgttttcggcgcgtttcgggttggtttggtttttcgcgtttttaggcgttcgtcgtttgttcgtttttgttcgtttcggtcggtaagggtgcgcggaggtttgttcgttttttcggcgtttggcggtttcggcggttgtaggaacgcggcgtttaggcggagttttcgtcgtcgagtagggtcgagcgcgaggagttgttttaattcgcgaagtcgtttagtttcgcggttcgcgagttgttgtagcggcgttcgttgtcggatgtcgagcggagttgtagtttcgtgtttcgcgtatttgggcgtcggtatttgggtttcggtatttgggttcggatcgcgtgttgtagggaggggtcggcgggcggggatcggtatttgagcgcgtttcgcgggcgtcgtcgtacggtttatttgtttttagagtcgcggaaggcgtagatcgtgatttgttcgaggaggagaaaatttagaaatgttttatttttaagaagtcgtcgagaaaatcgagagattggttcgatcgggcggaggttgttttcgttaattttaaattggttcggttcggaaattttagcggcgttaaggtttttttagggattttcggttcggggtgaggtgttcggcggtttttgaattttttttattgacgtgttgttggcgttttttaaattaaaacgggatatcgcgatcgttagcgatattgtttttaatttcgttattt

SEQ ID NO: 3702 - DNA, 870 bp, Artificial Sequence
  chemically treated genomic DNA (Homo sapiens) CpG-island No: 3702
aaataacgaaattaaaaacaatatcgctaacgatcgcgatatcccgttttaatttaaaaaacgccaacaacacgtcaataaaaaaaattcaaaaaccgccgaacacctcaccccgaaccgaaaatccctaaaaaaaccttaacgccgctaaaatttccgaaccgaaccaatttaaaattaacgaaaacaacctccgcccgatcgaaccaatctctcgattttctcgacgacttcttaaaaataaaacatttctaaattttctcctcctcgaacaaatcacgatctacgccttccgcgactctaaaaacaaataaaccgtacgacgacgcccgcgaaacgcgctcaaataccgatccccgcccgccgacccctccctacaacacgcgatccgaacccaaataccgaaacccaaataccgacgcccaaatacgcgaaacacgaaactacaactccgctcgacatccgacaacgaacgccgctacaacaactcgcgaaccgcgaaactaaacgacttcgcgaattaaaacaactcctcgcgctcgaccctactcgacgacgaaaactccgcctaaacgccgcgttcctacaaccgccgaaaccgccaaacgccgaaaaaacgaacaaacctccgcgcacccttaccgaccgaaacgaacaaaaacgaacaaacgacgaacgcctaaaaacgcgaaaaaccaaaccaacccgaaacgcgccgaaaacaccctatacgccccgaatcccgacaccatacgacccgccgcgcgtcctcgcgaacccgaaacttcgctcttcgctcgctaaacccctacgctcgccaccacgaaaactcgaaaaaaaaaaacgaaactataaaaaacgacgcgaaaa

SEQ ID NO: 3703 - DNA, 870 bp, Artificial Sequence
  chemically treated genomic DNA (Homo sapiens) CpG-island No: 3703
aaatgacgaggttaggaataatatcgttgacggtcgcggtgtttcgttttaatttagagggcgttagtaatacgttagtgagggagatttagaagtcgtcgggtattttatttcgggtcgggaatttttaagagaattttgacgtcgttgaagttttcggatcgggttagtttggaattgacgaaagtagttttcgttcggtcgagttagtttttcggttttttcggcggttttttgaggatgaggtatttttaggttttttttttttcgagtaaattacggtttgcgtttttcgcggttttgggaataggtgagtcgtgcggcggcgttcgcgggacgcgtttaggtgtcggttttcgttcgtcggtttttttttgtagtacgcggttcgggtttaggtgtcggggtttaggtgtcggcgtttaggtgcgcggggtacggggttgtagtttcgttcggtattcgatagcgggcgtcgttgtagtagttcgcgggtcgcggagttgaacggtttcgcgagttggggtagtttttcgcgttcggttttgttcggcggcgagagtttcgtttgggcgtcgcgtttttatagtcgtcggagtcgttaggcgtcgagggaacggatagattttcgcgtatttttgtcgatcggggcgggtagaggcgggtaagcggcgaacgtttgggagcgcggagagttaggttagttcggagcgcgtcggggatattttgtgcgtttcgagtttcggtattatgcgattcgtcgcgcgttttcgcgggttcggggtttcgtttttcgttcgttgagtttttgcgttcgttattacggaaattcggaaagaggaggcgaggttgtggggagcggcgcggaga

SEQ ID NO: 3704 - DNA, 870 bp, Artificial Sequence
  chemically treated genomic DNA (Homo sapiens) CpG-island No: 3704
tctccgcgccgctccccacaacctcgcctcctctttccgaatttccgtaataacgaacgcaaaaactcaacgaacgaaaaacgaaaccccgaacccgcgaaaacgcgcgacgaatcgcataataccgaaactcgaaacgcacaaaatatccccgacgcgctccgaactaacctaactctccgcgctcccaaacgttcgccgcttacccgcctctacccgccccgatcgacaaaaatacgcgaaaatctatccgttccctcgacgcctaacgactccgacgactataaaaacgcgacgcccaaacgaaactctcgccgccgaacaaaaccgaacgcgaaaaactaccccaactcgcgaaaccgttcaactccgcgacccgcgaactactacaacgacgcccgctatcgaataccgaacgaaactacaaccccgtaccccgcgcacctaaacgccgacacctaaaccccgacacctaaacccgaaccgcgtactacaaaaaaaaaccgacgaacgaaaaccgacacctaaacgcgtcccgcgaacgccgccgcacgactcacctattcccaaaaccgcgaaaaacgcaaaccgtaatttactcgaaaaaaaaaaaacctaaaaatacctcatcctcaaaaaaccgccgaaaaaaccgaaaaactaactcgaccgaacgaaaactactttcgtcaattccaaactaacccgatccgaaaacttcaacgacgtcaaaattctcttaaaaattcccgacccgaaataaaatacccgacgacttctaaatctccctcactaacgtattactaacgccctctaaattaaaacgaaacaccgcgaccgtcaacgatattattcctaacctcgtcattt

SEQ ID NO: 3705 - DNA, 643 bp, Artificial Sequence
  chemically treated genomic DNA (Homo sapiens) CpG-island No: 3705
attttcgttttaagatgagagaattttttgtcggtgttagcgtttagcggttaacggaggtgagttggatatacgttttttaatattttttttttggttcgcgatttagatttttatcggtttttattattatatcgggggtcgggttcgtcgcggggaggtagatggcgggcggcgtagttatagtttcggtttcgtcgttttttattttgcgttcgcgggttttagaattcgttcgtcggatagttaatcgcgtttcgttttttgtttatagttattgtcgtttatttcggaagtagtttttttttagacgtaagattcgttttatttacgcgcgcgtcgtagtttgggggcggagttcgtcgtagatttcgttttttttttttttcgattgggtaggcggggtaggaggggcggttattacgcgggagtatttatggcgtatgttttttggtgggttagttttcggacggcggttgcggaggtcgggtgagagggtgatcgcgttgttgaaagtcgattgcgtttacgtggattgcgggttcgtttcgggtcgtttttttttgttgtttacgaggaaatttaaagtttgtgttgatttatgaaatttgatttcgttttttttttttttttgagagtttat

SEQ ID NO: 3706 - DNA, 643 bp, Artificial Sequence
  chemically treated genomic DNA (Homo sapiens) CpG-island No: 3706
ataaactctcaaaaaaaaaaaaaaaacgaaatcaaatttcataaatcaacacaaactttaaatttcctcgtaaacaacaaaaaaaaacgacccgaaacgaacccgcaatccacgtaaacgcaatcgactttcaacaacgcgatcaccctctcacccgacctccgcaaccgccgtccgaaaactaacccaccaaaaaacatacgccataaatactcccgcgtaataaccgcccctcctaccccgcctacccaatcgaaaaaaaaaaaaaacgaaatctacgacgaactccgcccccaaactacgacgcgcgcgtaaataaaacgaatcttacgtctaaaaaaaaactacttccgaaataaacgacaataactataaacaaaaaacgaaacgcgattaactatccgacgaacgaattctaaaacccgcgaacgcaaaataaaaaacgacgaaaccgaaactataactacgccgcccgccatctacctccccgcgacgaacccgacccccgatataataataaaaaccgataaaaatctaaatcgcgaaccaaaaaaaaaatattaaaaaacgtatatccaactcacctccgttaaccgctaaacgctaacaccgacaaaaaattctctcatcttaaaacgaaaat

SEQ ID NO: 3707 - DNA, 643 bp, Artificial Sequence
  chemically treated genomic DNA (Homo sapiens) CpG-island No: 3707
gtaaatttttaggaggggagaaagaacgagattaggttttatgggttaatatagattttaggttttttcgtgaatagtagggaggagcggttcggagcgaattcgtagtttacgtaggcgtagtcggtttttagtagcgcgattatttttttattcgattttcgtagtcgtcgttcgaagattagtttattagagagtatgcgttatgggtgttttcgcgtggtagtcgttttttttgtttcgtttgtttagtcggaaaggagaaggggcggggtttgcggcgggtttcgtttttaaattgcggcgcgcgcgtgggtggggcgggttttacgtttggagaagggttattttcggggtggacggtaatggttgtgggtaaggagcgaggcgcgattggttgttcggcggacgagttttggggttcgcgagcgtaaagtggaaggcggcggggtcggggttgtggttgcgtcgttcgttatttattttttcgcggcgggttcggttttcggtatgatggtggggatcggtggggatttaggtcgcgggttaggaggagggtgttggggaacgtgtgtttagtttattttcgttagtcgttgaacgttagtatcgatagaagatttttttattttaaagcggaggt

SEQ ID NO: 3708 - DNA, 643 bp, Artificial Sequence
  chemically treated genomic DNA (Homo sapiens) CpG-island No: 3708
acctccgctttaaaataaaaaaatcttctatcgatactaacgttcaacgactaacgaaaataaactaaacacacgttccccaacaccctcctcctaacccgcgacctaaatccccaccgatccccaccatcataccgaaaaccgaacccgccgcgaaaaaataaataacgaacgacgcaaccacaaccccgaccccgccgccttccactttacgctcgcgaaccccaaaactcgtccgccgaacaaccaatcgcgcctcgctccttacccacaaccattaccgtccaccccgaaaataacccttctccaaacgtaaaacccgccccacccacgcgcgcgccgcaatttaaaaacgaaacccgccgcaaaccccgccccttctcctttccgactaaacaaacgaaacaaaaaaaacgactaccacgcgaaaacacccataacgcatactctctaataaactaatcttcgaacgacgactacgaaaatcgaataaaaaaataatcgcgctactaaaaaccgactacgcctacgtaaactacgaattcgctccgaaccgctcctccctactattcacgaaaaaacctaaaatctatattaacccataaaacctaatctcgttctttctcccctcctaaaaatttac

SEQ ID NO: 3709 - DNA, 727 bp, Artificial Sequence
  chemically treated genomic DNA (Homo sapiens) CpG-island No: 3709
gacgcgttcgtttcggtttggggggattcgggttagtagtcggtcgtcgcgcgtgcgtattgggcggggggtttcgcgtttttatttgtacgtggttagcgttcggcgttgggtcgtagtttttgtcgtgtacgttggggagtcggtatatgtaggtgggaagttttatacggagaggcgcgtcgttttcgtgatagggttttatttggtatatcggtatggtagaattaaagtaaaagggggtagcgcgtgttaaaggttaacgtttagaaatcgttagaggttacgacggagatcggttattttttttttgattttgttgcgggcgttcgggaaaacgtagttcggtgtgttttgattggtttaggttttttgacgttacgaagtcgatttttgatagagttaataggcgaaaaggagagacgggaagtatttttgtcgtttcgttcggaaagggtggagtataacgtcgaaagtagttaatgggagtttaggaggcggagcgtttgtgggagttttggagggaatttttttagttttcgaggcggatcgggtgttgtatttatggagcgagttgagagttcgaggtgagcggggttcgtagtttttcggtgttttttttcgcgcgttttttttgagatttacggtattttaatttttttggaaatggggggaatatggtcgaggcgcgtggcgaggtagttttttggaggtttcggagtggcga

SEQ ID NO: 3710 - DNA, 727 bp, Artificial Sequence
  chemically treated genomic DNA (Homo sapiens) CpG-island No: 3710
tcgccactccgaaacctccaaaaaactacctcgccacgcgcctcgaccatattccccccatttccaaaaaaattaaaataccgtaaatctcaaaaaaaacgcgcgaaaaaaaacaccgaaaaactacgaaccccgctcacctcgaactctcaactcgctccataaatacaacacccgatccgcctcgaaaactaaaaaaattccctccaaaactcccacaaacgctccgcctcctaaactcccattaactactttcgacgttatactccaccctttccgaacgaaacgacaaaaatacttcccgtctctccttttcgcctattaactctatcaaaaatcgacttcgtaacgtcaaaaaacctaaaccaatcaaaacacaccgaactacgttttcccgaacgcccgcaacaaaatcaaaaaaaaaataaccgatctccgtcgtaacctctaacgatttctaaacgttaacctttaacacgcgctacccccttttactttaattctaccataccgatataccaaataaaaccctatcacgaaaacgacgcgcctctccgtataaaacttcccacctacatataccgactccccaacgtacacgacaaaaactacgacccaacgccgaacgctaaccacgtacaaataaaaacgcgaaaccccccgcccaatacgcacgcgcgacgaccgactactaacccgaatccccccaaaccgaaacgaacgcgtc

SEQ ID NO: 3711 - DNA, 727 bp, Artificial Sequence
  chemically treated genomic DNA (Homo sapiens) CpG-island No: 3711
tcgttatttcggggtttttagggggttgtttcgttacgcgtttcggttatgttttttttatttttagggaggttggaatgtcgtgggttttaaagagggcgcgcgagaggggatatcggaagattgcgagtttcgtttatttcgagtttttagttcgttttatggatgtaatattcgattcgtttcggggattgggaaagttttttttagggtttttataggcgtttcgttttttgaatttttattggttgttttcgacgttgtgttttatttttttcgggcggggcggtaaaaatatttttcgtttttttttttcgtttattggttttgttaaaggtcgatttcgtgacgttaaagagtttgggttaattagagtatatcggattgcgttttttcgaacgttcgtagtagggttagaagggaggtggtcggttttcgtcgtgatttttgacggtttttgagcgttggtttttggtacgcgttatttttttttgttttggttttgttatgtcgatgtattaggtaaagttttattacgggggcggcgcgttttttcgtgtggagttttttatttgtatgtatcggttttttaacgtgtacggtaggagttacggtttagcgtcgggcgttggttacgtgtaggtaggagcgcggggtttttcgtttagtgcgtacgcgcggcgatcggttgttggttcgggtttttttaggtcggagcgagcgcgtt

SEQ ID NO: 3712 - DNA, 727 bp, Artificial Sequence
  chemically treated genomic DNA (Homo sapiens) CpG-island No: 3712
aacgcgctcgctccgacctaaaaaaacccgaaccaacaaccgatcgccgcgcgtacgcactaaacgaaaaaccccgcgctcctacctacacgtaaccaacgcccgacgctaaaccgtaactcctaccgtacacgttaaaaaaccgatacatacaaataaaaaactccacacgaaaaaacgcgccgcccccgtaataaaactttacctaatacatcgacataacaaaaccaaaacaaaaaaaaataacgcgtaccaaaaaccaacgctcaaaaaccgtcaaaaatcacgacgaaaaccgaccacctcccttctaaccctactacgaacgttcgaaaaaacgcaatccgatatactctaattaacccaaactctttaacgtcacgaaatcgacctttaacaaaaccaataaacgaaaaaaaaaaacgaaaaatatttttaccgccccgcccgaaaaaaataaaacacaacgtcgaaaacaaccaataaaaattcaaaaaacgaaacgcctataaaaaccctaaaaaaaactttcccaatccccgaaacgaatcgaatattacatccataaaacgaactaaaaactcgaaataaacgaaactcgcaatcttccgatatcccctctcgcgcgccctctttaaaacccacgacattccaacctccctaaaaataaaaaaaacataaccgaaacgcgtaacgaaacaaccccctaaaaaccccgaaataacga

SEQ ID NO: 3713 - DNA, 1406 bp, Artificial Sequence
  chemically treated genomic DNA (Homo sapiens) CpG-island No: 3713
tacgaacgttaacgtagtttaaggagaatttttaaaaaatttcgagggaggagttagtttattcgtttaggttacgcgtttcgcgttttttacgggtttagcgggcgcgaattcgttaatcgtttagcgtttcgttaattatcgtattttttatttattgtttcgttttgcgtttcgttttggttaattattagggagttatcgtttgttttttcgtttttttcgttcgtttttaatcggttggaagtttgaagtttttaaatttagtcggcgtttaatagcgcggtagtagcgaggtgtatttttagttttcgggcgggtagtttcgttttttttttttcgtttttttgttttttttaatgggagatggagttttcgatacgttatcgcgcggttgtgtaggagttgtttaatcggcgttcggggagaatggcgtaattaaaaagcggcggaagaaggtgggagggttatgacgtagcgagttttagtcgtgatttttttgggggtatcgcggcgttttttttttttgtttttaaagtaaaacgtcgtttcgacgtatttttcgcgtatttcggggggcggaggcggcgggttacggcgcgaagaggggcggtgttgacgtcggtcggttacgtgggcgtgttgtgggggggaggggcgtcgtcgcgcggtcggtttcgggcggttgggagcgcgcgagttagcgagcgagaggtagtcgcgttcgtcgtcgtttttgttttgtatgtcgttttttttcggcgcggtcgtcgtcgattatagtagtaggagttatcgtcgtcgcggttgatgtggttgggtcggggttgaggaggtcgttaagatgtcgtagtttaagtttcggaagatcgcgattttgggttatcggtttgtgggtgagtggtcggtggtcgcgcggttttttcgcgtcgtcggggtttcgtttgggagtcgggtcgcggtcgggtttgcgaagtttggagtcggcgcggttatgtggcggggcgggcgggggtcgcgcgtttcgtaattattattttgagcggaggtggtggcggtcggggcggcgttcgcgtcggtggaggagtcgcggtagttgggcgtttttcgcgggtcgggcgggtaggtggcggtcgggcggagggcgtgggaggcgcggggcgggggtcgtcggtcgtcgaggagttcgggtttcgtttggggaagtgaggcggcgtcggggagtcgcgttagaggttgtcgcgagggagttatatttgttttttcgttttcgtcgcgggcgcgcgtgatcggggttggcggttttttttatttcgttttcgatgtaaggaaaagaaagttcgtgggattttaataaaggaagtagcgtttcggttttattttatttgtggtgaagtttatttttg

SEQ ID NO: 3714 - DNA, 1406 bp, Artificial Sequence
  chemically treated genomic DNA (Homo sapiens) CpG-island No: 3714
caaaaataaacttcaccacaaataaaataaaaccgaaacgctacttcctttattaaaatcccacgaactttcttttccttacatcgaaaacgaaataaaaaaaaccgccaaccccgatcacgcgcgcccgcgacgaaaacgaaaaaacaaatataactccctcgcgacaacctctaacgcgactccccgacgccgcctcacttccccaaacgaaacccgaactcctcgacgaccgacgacccccgccccgcgcctcccacgccctccgcccgaccgccacctacccgcccgacccgcgaaaaacgcccaactaccgcgactcctccaccgacgcgaacgccgccccgaccgccaccacctccgctcaaaataataattacgaaacgcgcgacccccgcccgccccgccacataaccgcgccgactccaaacttcgcaaacccgaccgcgacccgactcccaaacgaaaccccgacgacgcgaaaaaaccgcgcgaccaccgaccactcacccacaaaccgataacccaaaatcgcgatcttccgaaacttaaactacgacatcttaacgacctcctcaaccccgacccaaccacatcaaccgcgacgacgataactcctactactataatcgacgacgaccgcgccgaaaaaaaacgacatacaaaacaaaaacgacgacgaacgcgactacctctcgctcgctaactcgcgcgctcccaaccgcccgaaaccgaccgcgcgacgacgcccctcccccccacaacacgcccacgtaaccgaccgacgtcaacaccgcccctcttcgcgccgtaacccgccgcctccgccccccgaaatacgcgaaaaatacgtcgaaacgacgttttactttaaaaacaaaaaaaaaaaacgccgcgatacccccaaaaaaatcacgactaaaactcgctacgtcataaccctcccaccttcttccgccgctttttaattacgccattctccccgaacgccgattaaacaactcctacacaaccgcgcgataacgtatcgaaaactccatctcccattaaaaaaaacaaaaaaacgaaaaaaaaaaaacgaaactacccgcccgaaaactaaaaatacacctcgctactaccgcgctattaaacgccgactaaatttaaaaacttcaaacttccaaccgattaaaaacgaacgaaaaaaacgaaaaaacaaacgataactccctaataattaaccaaaacgaaacgcaaaacgaaacaataaataaaaaatacgataattaacgaaacgctaaacgattaacgaattcgcgcccgctaaacccgtaaaaaacgcgaaacgcgtaacctaaacgaataaactaactcctccctcgaaattttttaaaaattctccttaaactacgttaacgttcgta

SEQ ID NO: 3715 - DNA, 1406 bp, Artificial Sequence
  chemically treated genomic DNA (Homo sapiens) CpG-island No: 3715
taagggtaaattttattatagatggaatgaagtcgaggcgttgttttttttgttaaaattttacggatttttttttttttatatcgggggcggggtgggggagatcgttagtttcggttacgcgcgttcgcggcgaaggcggggaggtaggtgtgattttttcgcggtagtttttagcgcggtttttcggcgtcgttttatttttttagacgagattcggatttttcggcggtcgacggttttcgtttcgcgttttttacgtttttcgttcggtcgttatttgttcgttcggttcgcggagggcgtttagttatcgcggtttttttatcggcgcggacgtcgtttcgatcgttattattttcgtttagaatggtggttacgaaacgcgcggttttcgttcgtttcgttatatggtcgcgtcggttttaaatttcgtaggttcggtcgcgattcggtttttaggcgaggtttcggcggcgcgaggaggtcgcgcggttatcggttatttatttatagatcggtagtttaggatcgcgatttttcgggatttggattgcggtattttggcggtttttttagtttcggtttaattatattaatcgcggcggcggtggtttttgttgttgtgatcggcggcggtcgcgtcgggagagagcggtatatagagtaggggcggcggcgggcgcggttgtttttcgttcgttagttcgcgcgtttttaatcgttcggaatcgatcgcgcggcggcgttttttttttttataatacgtttacgtgatcggtcggcgttagtatcgttttttttcgcgtcgtggttcgtcgttttcgtttttcgaaatacgcggggggtgcgtcggggcgacgttttattttaaaggtaaaaaaaggggacgtcgcgatgtttttagaaaagttacgattgaaattcgttgcgttatgatttttttattttttttcgtcgttttttaattacgttatttttttcgagcgtcgattggatagtttttgtatagtcgcgcgatgacgtgtcggaaattttattttttattgggggaaataaggaggcggggaggggggggcggggttgttcgttcgggagttaaaaatatatttcgttgttatcgcgttgttgggcgtcggttaggtttgaaggttttaaatttttaatcggttaggggcgggcgggagaggcggagagataaacggtggttttttggtgattggttagaacggagcgtagggcggggtaataggtgggaggtgcggtgattggcgaaacgttaagcggttggcgggttcgcgttcgttgagttcgtgaagggcgcgaggcgcgtggtttgggcgggtgggttggtttttttttcggggttttttgaaaattttttttgagttgcgttagcgttcgtg

SEQ ID NO: 3716 - DNA, 1406 bp, Artificial Sequence
  chemically treated genomic DNA (Homo sapiens) CpG-island No: 3716
cacgaacgctaacgcaactcaaaaaaaattttcaaaaaaccccgaaaaaaaaaccaacccacccgcccaaaccacgcgcctcgcgcccttcacgaactcaacgaacgcgaacccgccaaccgcttaacgtttcgccaatcaccgcacctcccacctattaccccgccctacgctccgttctaaccaatcaccaaaaaaccaccgtttatctctccgcctctcccgcccgcccctaaccgattaaaaatttaaaaccttcaaacctaaccgacgcccaacaacgcgataacaacgaaatatatttttaactcccgaacgaacaaccccgcccccccctccccgcctccttatttcccccaataaaaaataaaatttccgacacgtcatcgcgcgactatacaaaaactatccaatcgacgctcgaaaaaaataacgtaattaaaaaacgacgaaaaaaaataaaaaaatcataacgcaacgaatttcaatcgtaacttttctaaaaacatcgcgacgtcccctttttttacctttaaaataaaacgtcgccccgacgcaccccccgcgtatttcgaaaaacgaaaacgacgaaccacgacgcgaaaaaaaacgatactaacgccgaccgatcacgtaaacgtattataaaaaaaaaaaacgccgccgcgcgatcgattccgaacgattaaaaacgcgcgaactaacgaacgaaaaacaaccgcgcccgccgccgcccctactctatataccgctctctcccgacgcgaccgccgccgatcacaacaacaaaaaccaccgccgccgcgattaatataattaaaccgaaactaaaaaaaccgccaaaataccgcaatccaaatcccgaaaaatcgcgatcctaaactaccgatctataaataaataaccgataaccgcgcgacctcctcgcgccgccgaaacctcgcctaaaaaccgaatcgcgaccgaacctacgaaatttaaaaccgacgcgaccatataacgaaacgaacgaaaaccgcgcgtttcgtaaccaccattctaaacgaaaataataacgatcgaaacgacgtccgcgccgataaaaaaaccgcgataactaaacgccctccgcgaaccgaacgaacaaataacgaccgaacgaaaaacgtaaaaaacgcgaaacgaaaaccgtcgaccgccgaaaaatccgaatctcgtctaaaaaaataaaacgacgccgaaaaaccgcgctaaaaactaccgcgaaaaaatcacacctacctccccgccttcgccgcgaacgcgcgtaaccgaaactaacgatctcccccaccccgcccccgatataaaaaaaaaaaaatccgtaaaattttaacaaaaaaaacaacgcctcgacttcattccatctataataaaatttaccctta

SEQ ID NO: 3717 - DNA, 703 bp, Artificial Sequence
  chemically treated genomic DNA (Homo sapiens) CpG-island No: 3717
cggtgtcgggagcggggcgaggaggagggtgggtatgaggcggtagcggatcgcggagtcgagatttattcgaacgacgcgggcgagcggggttttggacgtcggtggagacgtaggcgaggtacggagcggaaggattagggttaagagtagcgcggtttttagtttcgggagcggggcggcgaggtgtttcgggtcggggttggggggagcggttggtttgtgtcgttcgcgcggcgggggcggttgcgcgtcggtgtttttcgttgtttttcgttttatattttagtttcgttagtttcgtttgtttcgttttaggtcgttttcggtttttttaatttttttagtgcgcggtttttttgttttaggcgttggttgtcggcgtttgtagcggtcggttaagtttcgaaggcgtgaggcggagtattttttggtcgtttttttttgcggcggtttttttcggttcggtttttattttttcgtttaggacgttggtttcgaagtaatatttgtggtcgggcggggttttttatagaatattttcggaacgtttcgggatgggattttcggatttaaattatagatttcggtcgcggtaggggcgtcgggatttgatttcgcgttgttttggggggatagaagcgtttcggagtggggaggggatttgaagtttgtggttttgatttttatttcgtggttgagg

SEQ ID NO: 3718 - DNA, 703 bp, Artificial Sequence
  chemically treated genomic DNA (Homo sapiens) CpG-island No: 3718
cctcaaccacgaaataaaaatcaaaaccacaaacttcaaatcccctccccactccgaaacgcttctatccccccaaaacaacgcgaaatcaaatcccgacgcccctaccgcgaccgaaatctataatttaaatccgaaaatcccatcccgaaacgttccgaaaatattctataaaaaaccccgcccgaccacaaatattacttcgaaaccaacgtcctaaacgaaaaaataaaaaccgaaccgaaaaaaaccgccgcaaaaaaaaacgaccaaaaaatactccgcctcacgccttcgaaacttaaccgaccgctacaaacgccgacaaccaacgcctaaaacaaaaaaaccgcgcactaaaaaaattaaaaaaaccgaaaacgacctaaaacgaaacaaacgaaactaacgaaactaaaatataaaacgaaaaacaacgaaaaacaccgacgcgcaaccgcccccgccgcgcgaacgacacaaaccaaccgctccccccaaccccgacccgaaacacctcgccgccccgctcccgaaactaaaaaccgcgctactcttaaccctaatccttccgctccgtacctcgcctacgtctccaccgacgtccaaaaccccgctcgcccgcgtcgttcgaataaatctcgactccgcgatccgctaccgcctcatacccaccctcctcctcgccccgctcccgacaccg

SEQ ID NO: 3719 - DNA, 703 bp, Artificial Sequence
  chemically treated genomic DNA (Homo sapiens) CpG-island No: 3719
ttttagttacggggtggaaattaggattataggttttaaattttttttttatttcgggacgtttttgtttttttagggtaacgcgggattaagtttcggcgtttttgtcgcggtcggggtttgtggtttgggttcgagagttttatttcggagcgtttcggggatgttttgtgagaggtttcgttcgattataaatgttgtttcggaattagcgttttggacggggaagtgggagtcgggtcgagggaagtcgtcgtagagggaggcggttaagaaatgtttcgttttacgttttcggggtttggtcggtcgttgtagacgtcggtaattagcgtttgagatagagaagtcgcgtattgggaggattaagggagtcgagggcggtttggaacggggtaggcggggttgacgaggttggaatgtgggacgaaggatagcgggaggtatcgacgcgtaatcgttttcgtcgcgcggacggtatagattaatcgttttttttaatttcggttcgagatatttcgtcgtttcgttttcggagttgagagtcgcgttgtttttggttttagttttttcgtttcgtatttcgtttgcgtttttatcggcgtttaaagtttcgttcgttcgcgtcgttcgggtaggtttcgatttcgcggttcgttatcgttttatatttattttttttttcgtttcgttttcggtatcg

SEQ ID NO: 3720 - DNA, 703 bp, Artificial Sequence
  chemically treated genomic DNA (Homo sapiens) CpG-island No: 3720
cgataccgaaaacgaaacgaaaaaaaaaataaatataaaacgataacgaaccgcgaaatcgaaacctacccgaacgacgcgaacgaacgaaactttaaacgccgataaaaacgcaaacgaaatacgaaacgaaaaaactaaaaccaaaaacaacgcgactctcaactccgaaaacgaaacgacgaaatatctcgaaccgaaattaaaaaaaacgattaatctataccgtccgcgcgacgaaaacgattacgcgtcgatacctcccgctatccttcgtcccacattccaacctcgtcaaccccgcctaccccgttccaaaccgccctcgactcccttaatcctcccaatacgcgacttctctatctcaaacgctaattaccgacgtctacaacgaccgaccaaaccccgaaaacgtaaaacgaaacatttcttaaccgcctccctctacgacgacttccctcgacccgactcccacttccccgtccaaaacgctaattccgaaacaacatttataatcgaacgaaacctctcacaaaacatccccgaaacgctccgaaataaaactctcgaacccaaaccacaaaccccgaccgcgacaaaaacgccgaaacttaatcccgcgttaccctaaaaaaacaaaaacgtcccgaaataaaaaaaaaatttaaaacctataatcctaatttccaccccgtaactaaaa

SEQ ID NO: 3721 - DNA, 768 bp, Artificial Sequence
  chemically treated genomic DNA (Homo sapiens) CpG-island No: 3721
cggcgtttttgtcgcggttaagagttgtggtttgggttcgagcgttttagttaggcgcgttttagagaggttatgggaggggtttcgcgcgattataaatgttgtttcggagttagcgttttggacggggaagtgagagtcgggacgaggggagtcgtcgaagagggaggcggtcgggaaatgtttcgcgttaggtttttaagggtttgttcgggcgttggagatgtcggtaacgagtacgttagacggagaagtcgcgtattgtgaggattaagggagtcgagggcggtttggaattgggaaggcggagttgacggggttggaatgtgggacgaaggatagcgggaggtatcgacgcgtaattgttttagtcgcgcggagggtacggatcgatcgtttcgtcgtttacggttcgagacgttcggtcgtttcgttttcgtagttgagagtcgcgacgtttttatattagttcgttcgtttcgtatttcgttcgcggtttcgtcgatatttatatagtcgttcgttcgcgtggttgtagtaggtttggttttcgttgttcgttttcgttttatatatatttttttgttagtttcgttttcggcgcggtttgcgtacgtacgatacgtaagtcgtgtaaacgttattttcggggtttttggttttttatcggaggaaatgtgagtcggatttaaagggtcgaggggattggggtgttttcgtgacgtttaagagtaaatagaagagggcggtttttaggttaaagttagg

SEQ ID NO: 3722 - DNA, 768 bp, Artificial Sequence
  chemically treated genomic DNA (Homo sapiens) CpG-island No: 3722
cctaactttaacctaaaaaccgccctcttctatttactcttaaacgtcacgaaaacaccccaatcccctcgaccctttaaatccgactcacatttcctccgataaaaaaccaaaaaccccgaaaataacgtttacacgacttacgtatcgtacgtacgcaaaccgcgccgaaaacgaaactaacaaaaaaatatatataaaacgaaaacgaacaacgaaaaccaaacctactacaaccacgcgaacgaacgactatataaatatcgacgaaaccgcgaacgaaatacgaaacgaacgaactaatataaaaacgtcgcgactctcaactacgaaaacgaaacgaccgaacgtctcgaaccgtaaacgacgaaacgatcgatccgtaccctccgcgcgactaaaacaattacgcgtcgatacctcccgctatccttcgtcccacattccaaccccgtcaactccgccttcccaattccaaaccgccctcgactcccttaatcctcacaatacgcgacttctccgtctaacgtactcgttaccgacatctccaacgcccgaacaaacccttaaaaacctaacgcgaaacatttcccgaccgcctccctcttcgacgactcccctcgtcccgactctcacttccccgtccaaaacgctaactccgaaacaacatttataatcgcgcgaaacccctcccataacctctctaaaacgcgcctaactaaaacgctcgaacccaaaccacaactcttaaccgcgacaaaaacgccg

SEQ ID NO: 3723 - DNA, 768 bp, Artificial Sequence
  chemically treated genomic DNA (Homo sapiens) CpG-island No: 3723
tttagttttagtttggaggtcgtttttttttatttgtttttagacgttacgggggtattttagttttttcgattttttggattcggtttatatttttttcggtgaagagttaaaggtttcggaagtgacgtttgtacggtttgcgtatcgtgcgtgcgtaggtcgcgtcgggggcggggttagtaggagggtgtgtgtggggcgggagcggataacggagattagatttattgtagttacgcgggcgagcggttgtgtggatgtcggcgaagtcgcgggcgaggtacggaacggacggattggtgtaagagcgtcgcggtttttagttacgggagcggggcggtcgggcgtttcgggtcgtgggcggcggggcggtcggttcgtgtttttcgcgcggttggggtagttgcgcgtcggtgtttttcgttgtttttcgttttatattttagtttcgttagtttcgtttttttagttttaggtcgttttcggtttttttaatttttatagtgcgcggttttttcgtttaacgtgttcgttgtcggtatttttagcgttcggataagtttttgaaggtttgacgcggagtatttttcggtcgttttttttttcggcggtttttttcgtttcggtttttattttttcgtttaggacgttggtttcgaagtaatatttgtggtcgcgcggggttttttttatgatttttttggaacgcgtttagttgggacgttcggatttagattatagtttttggtcgcgataggggcgtcg

SEQ ID NO: 3724 - DNA, 768 bp, Artificial Sequence
  chemically treated genomic DNA (Homo sapiens) CpG-island No: 3724
cgacgcccctatcgcgaccaaaaactataatctaaatccgaacgtcccaactaaacgcgttccaaaaaaatcataaaaaaaaccccgcgcgaccacaaatattacttcgaaaccaacgtcctaaacgaaaaaataaaaaccgaaacgaaaaaaaccgccgaaaaaaaaaacgaccgaaaaatactccgcgtcaaaccttcaaaaacttatccgaacgctaaaaataccgacaacgaacacgttaaacgaaaaaaccgcgcactataaaaattaaaaaaaccgaaaacgacctaaaactaaaaaaacgaaactaacgaaactaaaatataaaacgaaaaacaacgaaaaacaccgacgcgcaactaccccaaccgcgcgaaaaacacgaaccgaccgccccgccgcccacgacccgaaacgcccgaccgccccgctcccgtaactaaaaaccgcgacgctcttacaccaatccgtccgttccgtacctcgcccgcgacttcgccgacatccacacaaccgctcgcccgcgtaactacaataaatctaatctccgttatccgctcccgccccacacacaccctcctactaaccccgcccccgacgcgacctacgcacgcacgatacgcaaaccgtacaaacgtcacttccgaaacctttaactcttcaccgaaaaaaatataaaccgaatccaaaaaatcgaaaaaactaaaatacccccgtaacgtctaaaaacaaataaaaaaaaacgacctccaaactaaaactaaa

SEQ ID NO: 3725 - DNA, 592 bp, Artificial Sequence
  chemically treated genomic DNA (Homo sapiens) CpG-island No: 3725
agtcgcggtgtttcgttttaatttcggtttcgtttattcgtcgagggatcgttatgtttcgcgttcgtttttttttcgcgtttttttttacgtttcgcggttcgtcgttcgttcgggtattttttgtggtagtaggggtagcgcgtgtttcgtttgcgtggtcgtcggcgtggtcggttttagaaagtcgttttcggcgttagagttggatatggtatcgttttgacgacggttgtttggttttcgtttcgtgattattattatttttttggttttgggtagtgggcgcggtttcgggcgggcggaggcggcggtttcgggtattttttatcgtcgagtagcgtttggtatgacgcggtcggttgcgggttggtcggaggggggcgagaggtagtgcgtaggcgggagggcggtggtttttttaacgtcgattttcgtcgtcgttttgattggggttttgatttcgatacgttatttcgttgagttggtcgacgtcgcgttggtttcgttttgattggtaggaagttcgtttagtcgaagagtaggtagcgtagttcggcgtttgagtggtttttgggttgggggggggggg

SEQ ID NO: 3726 - DNA, 592 bp, Artificial Sequence
  chemically treated genomic DNA (Homo sapiens) CpG-island No: 3726
ccccccccccccaacccaaaaaccactcaaacgccgaactacgctacctactcttcgactaaacgaacttcctaccaatcaaaacgaaaccaacgcgacgtcgaccaactcaacgaaataacgtatcgaaatcaaaaccccaatcaaaacgacgacgaaaatcgacgttaaaaaaaccaccgccctcccgcctacgcactacctctcgcccccctccgaccaacccgcaaccgaccgcgtcataccaaacgctactcgacgataaaaaatacccgaaaccgccgcctccgcccgcccgaaaccgcgcccactacccaaaaccaaaaaaataataataatcacgaaacgaaaaccaaacaaccgtcgtcaaaacgataccatatccaactctaacgccgaaaacgactttctaaaaccgaccacgccgacgaccacgcaaacgaaacacgcgctacccctactaccacaaaaaatacccgaacgaacgacgaaccgcgaaacgtaaaaaaaaacgcgaaaaaaaaacgaacgcgaaacataacgatccctcgacgaataaacgaaaccgaaattaaaacgaaacaccgcgact

SEQ ID NO: 3727 - DNA, 592 bp, Artificial Sequence
  chemically treated genomic DNA (Homo sapiens) CpG-island No: 3727
ttttttttttttaatttagggattatttaggcgtcggattgcgttgtttgtttttcgattgggcgagttttttgttaattagggcggaattagcgcggcgtcggttagtttagcgggatggcgtgtcgggattagagttttagttagggcgacgacgagagtcggcgttgagggagttatcgttttttcgtttgcgtattgtttttcgttttttttcggttagttcgtagtcggtcgcgttatgttaggcgttgttcggcggtagggagtgttcggggtcgtcgttttcgttcgttcgaagtcgcgtttattgtttagagttagagggatggtggtagttacggggcgggagttagatagtcgtcgttaggacggtgttatgtttagttttgacgtcgaagacgattttttggagtcggttacgtcgacggttacgtaggcggggtacgcgttgtttttgttgttataggaggtattcgggcgggcggcgggtcgcggggcgtggggaggggcgcgggggagaagcgggcgcggggtatagcggtttttcggcgggtgggcggggtcggggttgaggcggggtatcgcgatt

SEQ ID NO: 3728 - DNA, 592 bp, Artificial Sequence
  chemically treated genomic DNA (Homo sapiens) CpG-island No: 3728
aatcgcgataccccgcctcaaccccgaccccgcccacccgccgaaaaaccgctataccccgcgcccgcttctcccccgcgcccctccccacgccccgcgacccgccgcccgcccgaatacctcctataacaacaaaaacaacgcgtaccccgcctacgtaaccgtcgacgtaaccgactccaaaaaatcgtcttcgacgtcaaaactaaacataacaccgtcctaacgacgactatctaactcccgccccgtaactaccaccatccctctaactctaaacaataaacgcgacttcgaacgaacgaaaacgacgaccccgaacactccctaccgccgaacaacgcctaacataacgcgaccgactacgaactaaccgaaaaaaaacgaaaaacaatacgcaaacgaaaaaacgataactccctcaacgccgactctcgtcgtcgccctaactaaaactctaatcccgacacgccatcccgctaaactaaccgacgccgcgctaattccgccctaattaacaaaaaactcgcccaatcgaaaaacaaacaacgcaatccgacgcctaaataatccctaaattaaaaaaaaaaaa

SEQ ID NO: 3729 - DNA, 805 bp, Artificial Sequence
  chemically treated genomic DNA (Homo sapiens) CpG-island No: 3729
  misc_feature (91)..(92): n is either a, c, g or t
  misc_feature (234)..(234): n is either a, c, g or t
  misc_feature (289)..(289): n is either a, c, g or t
  misc_feature (317)..(317): n is either a, c, g or t
  misc_feature (363)..(363): n is either a, c, g or t
  misc_feature (367)..(367): n is either a, c, g or t
  misc_feature (599)..(599): n is either a, c, g or t
  misc_feature (726)..(726): n is either a, c, g or t
  misc_feature (796)..(796): n is either a, c, g or t
ttacgcgtttagtatagttattttttttcgttttatgcgtttagtatagttattttttttcgttttatgcgtttagtatagttattttttnnttcgttttacgcgtttagtatagttattttttttcgttttacgcgtttagtatagttattttttttcgttttacgcgtttagtatagttattttttttcgttttacgcgtttagtatagttattttttttcgttttacgcgntttagtatagttattttttttcgttttatgcgtttagtatagttatttttttttnggttttatgcgtttagtatagttatttntttttcgttttatgcgtttagtatagttattttttttcgttttatngcgntttagtatagttattttttttcgttttacgcgtttagtatagttattttttttcgttttacgcgtttagtatagttattttttttcgttttatgcgtttagtatagttattttttttcgttttatgcgtttagtatagttattttttttcgttttatgcgtttagtatagttattttttttcgttttatgcgtttagtatagttattttttttcgttttatgcgtttagtantagttattttttttcgttttatgcgtttagtatagttattttttttcgttttatgcgtttagtatagttattttttttcgttttatgcgtttagtatagttattttttttcgttttaggcgtttagntatagttatttttttttattttatgtatttagtatagttattttttttcgttttatgcgtttagtatagnttatttttt

SEQ ID NO: 3730 - DNA, 805 bp, Artificial Sequence
  chemically treated genomic DNA (Homo sapiens) CpG-island No: 3730
  misc_feature (10)..(10): n is either a, c, g or t
  misc_feature (80)..(80): n is either a, c, g or t
  misc_feature (207)..(207): n is either a, c, g or t
  misc_feature (439)..(439): n is either a, c, g or t
  misc_feature (443)..(443): n is either a, c, g or t
  misc_feature (489)..(489): n is either a, c, g or t
  misc_feature (517)..(517): n is either a, c, g or t
  misc_feature (572)..(572): n is either a, c, g or t
  misc_feature (714)..(715): n is either a, c, g or t
aaaaaataanctatactaaacgcataaaacgaaaaaaaataactatactaaatacataaaataaaaaaaaataactatanctaaacgcctaaaacgaaaaaaaataactatactaaacgcataaaacgaaaaaaaataactatactaaacgcataaaacgaaaaaaaataactatactaaacgcataaaacgaaaaaaaataactantactaaacgcataaaacgaaaaaaaataactatactaaacgcataaaacgaaaaaaaataactatactaaacgcataaaacgaaaaaaaataactatactaaacgcataaaacgaaaaaaaataactatactaaacgcataaaacgaaaaaaaataactatactaaacgcgtaaaacgaaaaaaaataactatactaaacgcgtaaaacgaaaaaaaataactatactaaancgcnataaaacgaaaaaaaataactatactaaacgcataaaacgaaaaanaaataactatactaaacgcataaaaccnaaaaaaaaataactatactaaacgcataaaacgaaaaaaaataactatactaaancgcgtaaaacgaaaaaaaataactatactaaacgcgtaaaacgaaaaaaaataactatactaaacgcgtaaaacgaaaaaaaataactatactaaacgcgtaaaacgaaaaaaaataactatactaaacgcgtaaaacgaannaaaaaataactatactaaacgcataaaacgaaaaaaaataactatactaaacgcataaaacgaaaaaaaataactatactaaacgcgtaa

SEQ ID NO: 3731 - DNA, 805 bp, Artificial Sequence
  chemically treated genomic DNA (Homo sapiens) CpG-island No: 3731
  misc_feature (10)..(10): n is either a, c, g or t
  misc_feature (80)..(80): n is either a, c, g or t
  misc_feature (207)..(207): n is either a, c, g or t
  misc_feature (439)..(439): n is either a, c, g or t
  misc_feature (443)..(443): n is either a, c, g or t
  misc_feature (489)..(489): n is either a, c, g or t
  misc_feature (517)..(517): n is either a, c, g or t
  misc_feature (572)..(572): n is either a, c, g or t
  misc_feature (714)..(715): n is either a, c, g or t
gaagagtaanttgtgttgggcgtatgggacggaaaagagtaattgtgttgggtgtatggggtggaaaagagtaattgtgnttgggcgtttgggacgggaaagggtaattgtgttgggcgtatgggacgggaaagggtaattgtgttgggcgtatgggacggaaaagggtaattgtgttgggcgtatgggacgggaaagggtaattgntgttgggcgtatgggacgggaaagggtaattgtgttgggcgtatgggacgggaaagggtaattgtgttgggcgtatgggacgggaaagagtaattgtgttgggcgtatgggacgggaaagagtaattgtgttgggcgtatgggacggaaaagagtaattgtgttgggcgcgtgggacggaaaagggtaattgtgttgggcgcgtgggacgggaaagggtaattgtgttgggncgtnatgggacgggaaagggtaattgtgttgggcgtatgggacgggaaangggtaattgtgttgggcgtatgggattnggaaaagagtaattgtgttgggcgtatgggacgggaaagggtaattgtgttgggncgcgtgggacggaaaagagtaattgtgttgggcgcgtgggacgggaaagggtaattgtgttgggcgcgtgggacgggaaagggtaattgtgttgggcgcgtgggacgggaaagggtaattgtgttgggcgcgtgggacgggnnaaagggtaattgtgttgggcgtatgggacgggaaagggtaattgtgttgggcgtatggggcggaaaagagtaattgtgttgggcgcgtgg

SEQ ID NO: 3732 - DNA, 805 bp, Artificial Sequence
  chemically treated genomic DNA (Homo sapiens) CpG-island No: 3732
  misc_feature (91)..(92): n is either a, c, g or t
  misc_feature (234)..(234): n is either a, c, g or t
  misc_feature (289)..(289): n is either a, c, g or t
  misc_feature (317)..(317): n is either a, c, g or t
  misc_feature (363)..(363): n is either a, c, g or t
  misc_feature (367)..(367): n is either a, c, g or t
  misc_feature (599)..(599): n is either a, c, g or t
  misc_feature (726)..(726): n is either a, c, g or t
  misc_feature (796)..(796): n is either a, c, g or t
ccacgcgcccaacacaattactcttttccgccccatacgcccaacacaattaccctttcccgtcccatacgcccaacacaattaccctttnncccgtcccacgcgcccaacacaattaccctttcccgtcccacgcgcccaacacaattaccctttcccgtcccacgcgcccaacacaattaccctttcccgtcccacgcgcccaacacaattactcttttccgtcccacgcgncccaacacaattaccctttcccgtcccatacgcccaacacaattactcttttccnaatcccatacgcccaacacaattacccntttcccgtcccatacgcccaacacaattaccctttcccgtcccatnacgncccaacacaattaccctttcccgtcccacgcgcccaacacaattacccttttccgtcccacgcgcccaacacaattactcttttccgtcccatacgcccaacacaattactctttcccgtcccatacgcccaacacaattactctttcccgtcccatacgcccaacacaattaccctttcccgtcccatacgcccaacacaattaccctttcccgtcccatacgcccaacancaattaccctttcccgtcccatacgcccaacacaattacccttttccgtcccatacgcccaacacaattaccctttcccgtcccatacgcccaacacaattaccctttcccgtcccaaacgcccaancacaattactcttttccaccccatacacccaacacaattactcttttccgtcccatacgcccaacacaanttactcttc

SEQ ID NO: 3733 - DNA, 789 bp, Artificial Sequence
  chemically treated genomic DNA (Homo sapiens) CpG-island No: 3733
agttcgcggagttggttcgagaaggtggttgagggtattaagtttttatcgtcgtttttttttaaaataaatattagttagtcgtcgagttcggagtcgggagggcggtagggtggcgttagtatttatttttttcggaatggtagggttcgtagtcgaagaggtcgcggcgtcggcgtcggcgtcggtttcgggttttatgttttcgttgaatagagtttggttcggtttcgcgtcgttattatcgttatcgtttagcgtcgttattttataatcgagagtcggggttcgagcggtcgttgtcgggcggggagggggaagggaggcggagagttgggggaggcggaggcggaggcggaggcggaggagcggggggcgcggggggcgcggggaggagcggttcgggcggcgtcgcgggcggagggcgtttgggttattttaggtatcggttcgcggtttcgggcgtagtcgagtttgaggggattgggggaaggacgttaggcgggggtgcgggggggagcgggggaagggggcggagacgacgagaagtcgtcgcggtaacggcgttattcgcgtgttacggtcgtgacgttatttcggtgcgtgacgtaatttgaggcgcgttttcgcgtcgtcgttcggggagggtttttttttttttaattattcgcgtttttatattttgttttcgtttcgtcgtttttatggtttcggttttttattttttttttgtttttttcgtttttagtttgttttgtaatgtgggatttattagaagagtagggttgg

SEQ ID NO: 3734 - DNA, 789 bp, Artificial Sequence
  chemically treated genomic DNA (Homo sapiens) CpG-island No: 3734
ccaaccctactcttctaataaatcccacattacaaaacaaactaaaaacgaaaaaaacaaaaaaaaaataaaaaaccgaaaccataaaaacgacgaaacgaaaacaaaatataaaaacgcgaataattaaaaaaaaaaaaaccctccccgaacgacgacgcgaaaacgcgcctcaaattacgtcacgcaccgaaataacgtcacgaccgtaacacgcgaataacgccgttaccgcgacgacttctcgtcgtctccgcccccttcccccgctcccccccgcacccccgcctaacgtccttcccccaatcccctcaaactcgactacgcccgaaaccgcgaaccgatacctaaaataacccaaacgccctccgcccgcgacgccgcccgaaccgctcctccccgcgccccccgcgccccccgctcctccgcctccgcctccgcctccgcctcccccaactctccgcctcccttccccctccccgcccgacaacgaccgctcgaaccccgactctcgattataaaataacgacgctaaacgataacgataataacgacgcgaaaccgaaccaaactctattcaacgaaaacataaaacccgaaaccgacgccgacgccgacgccgcgacctcttcgactacgaaccctaccattccgaaaaaaataaatactaacgccaccctaccgccctcccgactccgaactcgacgactaactaatatttattttaaaaaaaaacgacgataaaaacttaataccctcaaccaccttctcgaaccaactccgcgaact

SEQ ID NO: 3735 - DNA, 789 bp, Artificial Sequence
  chemically treated genomic DNA (Homo sapiens) CpG-island No: 3735
ttagttttgtttttttagtaaattttatattatagaataggttgaggacggaggagataagaggaaagtaggaaatcggagttatggaaacggcggagcggaggtaaagtgtgagagcgcgggtggttagaagggaaaaaatttttttcggacgacggcgcgaaggcgcgttttagattacgttacgtatcggggtgacgttacgatcgtgatacgcgggtgacgtcgttgtcgcggcgatttttcgtcgttttcgtttttttttttcgttttttttcgtattttcgtttagcgttttttttttaatttttttaggttcggttgcgttcggggtcgcgggtcggtatttgaggtggtttaggcgtttttcgttcgcggcgtcgttcgggtcgttttttttcgcgtttttcgcgtttttcgttttttcgttttcgttttcgttttcgttttttttagtttttcgtttttttttttttttttcgttcgatagcggtcgttcgggtttcggttttcggttataagatggcggcgttgagcggtggcggtggtggcggcgcggagtcgggttaggttttgtttaacggggatatggagttcgaggtcggcgtcggcgtcggcgtcgcggttttttcggttgcggattttgttatttcggaggaggtgagtgttggcgttattttgtcgttttttcgatttcgggttcggcggttggttggtgtttattttggaaagaggcggcggtgggggtttgatgtttttagttattttttcgggttagtttcgcgggtt

SEQ ID NO: 3736 - DNA, 789 bp, Artificial Sequence
  chemically treated genomic DNA (Homo sapiens) CpG-island No: 3736
aacccgcgaaactaacccgaaaaaataactaaaaacatcaaacccccaccgccgcctctttccaaaataaacaccaaccaaccgccgaacccgaaatcgaaaaaacgacaaaataacgccaacactcacctcctccgaaataacaaaatccgcaaccgaaaaaaccgcgacgccgacgccgacgccgacctcgaactccatatccccgttaaacaaaacctaacccgactccgcgccgccaccaccgccaccgctcaacgccgccatcttataaccgaaaaccgaaacccgaacgaccgctatcgaacgaaaaaaaaaaaaaaaaacgaaaaactaaaaaaaacgaaaacgaaaacgaaaacgaaaaaacgaaaaacgcgaaaaacgcgaaaaaaaacgacccgaacgacgccgcgaacgaaaaacgcctaaaccacctcaaataccgacccgcgaccccgaacgcaaccgaacctaaaaaaattaaaaaaaaaacgctaaacgaaaatacgaaaaaaaacgaaaaaaaaaaacgaaaacgacgaaaaatcgccgcgacaacgacgtcacccgcgtatcacgatcgtaacgtcaccccgatacgtaacgtaatctaaaacgcgccttcgcgccgtcgtccgaaaaaaattttttcccttctaaccacccgcgctctcacactttacctccgctccgccgtttccataactccgatttcctactttcctcttatctcctccgtcctcaacctattctataatataaaatttactaaaaaaacaaaactaa

SEQ ID NO: 3737 - DNA, 541 bp, Artificial Sequence
  chemically treated genomic DNA (Homo sapiens) CpG-island No: 3737
ttcgcgggggtttgggtcgggacggggcggaggacgggggttttttattgttttttttgtcggagttcgacgacgaggcgagtgagagcgttcgggttcggttagtttcgtcgtcgtcggtcgcgtcggtttttagttcgtttcgggagcgtttttttcggtttcgttgcgatcgcgatcgtcgttttttgcggagtttatggtttcgcgtcgggttatttatggttttgttgcgtcggggttttttcgtttgttcgttataggttacggtcgtagttatataaaaaaaaattgatatcgagttttttttttttttttacggttttttttcgtttcgaggagggcgcgggggagacggcggtcgaaagaagggagagaggggaagaaagagaggagaaagaaaagggggaaggggcggagagaggggaggagggacggggagcgagggcgagaggcgaggagtttaagtgtggggttttttatagtatcgagggtcggagatgtttgggagtagcgtcgagtaaagtaatggttgaatata

SEQ ID NO: 3738 - DNA, 541 bp, Artificial Sequence
  chemically treated genomic DNA (Homo sapiens) CpG-island No: 3738
tatattcaaccattactttactcgacgctactcccaaacatctccgaccctcgatactataaaaaaccccacacttaaactcctcgcctctcgccctcgctccccgtccctcctcccctctctccgccccttcccccttttctttctcctctctttcttcccctctctcccttctttcgaccgccgtctcccccgcgccctcctcgaaacgaaaaaaaaccgtaaaaaaaaaaaaaaaactcgatatcaatttttttttatataactacgaccgtaacctataacgaacaaacgaaaaaaccccgacgcaacaaaaccataaataacccgacgcgaaaccataaactccgcaaaaaacgacgatcgcgatcgcaacgaaaccgaaaaaaacgctcccgaaacgaactaaaaaccgacgcgaccgacgacgacgaaactaaccgaacccgaacgctctcactcgcctcgtcgtcgaactccgacaaaaaaaacaataaaaaacccccgtcctccgccccgtcccgacccaaacccccgcgaa

SEQ ID NO: 3739 - DNA, 541 bp, Artificial Sequence
  chemically treated genomic DNA (Homo sapiens) CpG-island No: 3739
tgtgtttagttattattttgttcggcgttgtttttaggtattttcgattttcggtgttgtggggagttttatatttgggtttttcgtttttcgttttcgtttttcgttttttttttttttttttcgtttttttttttttttttttttttttttttttttttttttttttttttttttcggtcgtcgtttttttcgcgtttttttcggggcggagggaagtcgtgaagggggagggagggttcggtgttaatttttttttgtgtggttgcggtcgtagtttgtggcgggtaagcggggagatttcggcgtagtagaattatggatggttcgacgcggggttatggatttcgtaaaaagcggcggtcgcggtcgtagcgagatcgggagaggcgttttcggggcgggttgggggtcggcgcggtcggcggcggcggggttggtcggattcgggcgtttttattcgtttcgtcgtcgggtttcgataaggaagataatgggaagttttcgtttttcgtttcgtttcggtttagattttcgcgga

SEQ ID NO: 3740 - DNA, 541 bp, Artificial Sequence
  chemically treated genomic DNA (Homo sapiens) CpG-island No: 3740
tccgcgaaaatctaaaccgaaacgaaacgaaaaacgaaaacttcccattatcttccttatcgaaacccgacgacgaaacgaataaaaacgcccgaatccgaccaaccccgccgccgccgaccgcgccgacccccaacccgccccgaaaacgcctctcccgatctcgctacgaccgcgaccgccgctttttacgaaatccataaccccgcgtcgaaccatccataattctactacgccgaaatctccccgcttacccgccacaaactacgaccgcaaccacacaaaaaaaaattaacaccgaaccctccctcccccttcacgacttccctccgccccgaaaaaaacgcgaaaaaaacgacgaccgaaaaaaaaaaaaaaaaaaaaaaaaaaaaaaaaaaaaaaaaaaaaaaaaaaacgaaaaaaaaaaaaaaaaaacgaaaaacgaaaacgaaaaacgaaaaacccaaatataaaactccccacaacaccgaaaatcgaaaatacctaaaaacaacgccgaacaaaataataactaaacaca

SEQ ID NO: 3741 - DNA, 570 bp, Artificial Sequence
  chemically treated genomic DNA (Homo sapiens) CpG-island No: 3741
tatttatcgtttcgttttaatcgtcgttaacggttttggttttcgcgagttttggaattatagaggtcgtacggtgagttgttaggtgtggttcgtaatcggagcgtataaaatatgatgggatacgtaacgggattatatagggtatattgggtatttgtaggggcgcgaggtggcggtacgtaatgggagcgcgttgagtatgatggggtatgtgcgggagcgttaggcggggtatgtaattagagcgtgcggggtatgatggggtacggatatggggggttaggtggggtacgtaattggagttcgcggggtaggatggggtatttaattggagcgatagagagtacgatggggtatttataggggtcggaggttgggtacgtaatgagagcgagcgggaaatgatggggtatttaacgagtacgtagagtatgatggggtacgggtgcgaggtggggcgtatagtgggagcgcgtggggtatgatgggatatatggcgaggtcgttagggtataggggaagtatttttggaatacgtgagtgatagggttgtcgtttttgaaggag

SEQ ID NO: 3742 - DNA, 570 bp, Artificial Sequence
  chemically treated genomic DNA (Homo sapiens) CpG-island No: 3742
ctccttcaaaaacgacaaccctatcactcacgtattccaaaaatacttcccctataccctaacgacctcgccatatatcccatcataccccacgcgctcccactatacgccccacctcgcacccgtaccccatcatactctacgtactcgttaaataccccatcatttcccgctcgctctcattacgtacccaacctccgacccctataaataccccatcgtactctctatcgctccaattaaataccccatcctaccccgcgaactccaattacgtaccccacctaaccccccatatccgtaccccatcataccccgcacgctctaattacataccccgcctaacgctcccgcacataccccatcatactcaacgcgctcccattacgtaccgccacctcgcgcccctacaaatacccaatataccctatataatcccgttacgtatcccatcatattttatacgctccgattacgaaccacacctaacaactcaccgtacgacctctataattccaaaactcgcgaaaaccaaaaccgttaacgacgattaaaacgaaacgataaata

SEQ ID NO: 3743 - DNA, 570 bp, Artificial Sequence
  chemically treated genomic DNA (Homo sapiens) CpG-island No: 3743
tttttttaagggcggtagttttgttatttacgtgttttaaaagtgttttttttgtgttttgacggtttcgttatgtgttttattatgttttacgcgtttttattgtgcgttttatttcgtattcgtgttttattatgttttgcgtgttcgttaggtgttttattatttttcgttcgtttttattacgtatttagttttcggtttttgtaagtgttttatcgtgttttttgtcgttttagttagatgttttattttgtttcgcgagttttaattacgtgttttatttaattttttatgttcgtgttttattatgtttcgtacgttttggttatatgtttcgtttggcgttttcgtatatgttttattatgtttagcgcgtttttattacgtgtcgttatttcgcgtttttgtaagtgtttaatgtgttttgtgtggtttcgttacgtgttttattatgttttgtgcgtttcgattacgggttatatttggtaatttatcgtgcgatttttgtagttttagagttcgcgagggttagggtcgttggcggcggttggaacgaaacgatgagtg

SEQ ID NO: 3744 - DNA, 570 bp, Artificial Sequence
  chemically treated genomic DNA (Homo sapiens) CpG-island No: 3744
cactcatcgtttcgttccaaccgccgccaacgaccctaaccctcgcgaactctaaaactacaaaaatcgcacgataaattaccaaatataacccgtaatcgaaacgcacaaaacataataaaacacgtaacgaaaccacacaaaacacattaaacacttacaaaaacgcgaaataacgacacgtaataaaaacgcgctaaacataataaaacatatacgaaaacgccaaacgaaacatataaccaaaacgtacgaaacataataaaacacgaacataaaaaattaaataaaacacgtaattaaaactcgcgaaacaaaataaaacatctaactaaaacgacaaaaaacacgataaaacacttacaaaaaccgaaaactaaatacgtaataaaaacgaacgaaaaataataaaacacctaacgaacacgcaaaacataataaaacacgaatacgaaataaaacgcacaataaaaacgcgtaaaacataataaaacacataacgaaaccgtcaaaacacaaaaaaaacacttttaaaacacgtaaataacaaaactaccgcccttaaaaaaa

SEQ ID NO: 3745 - DNA, 849 bp, Artificial Sequence
  chemically treated genomic DNA (Homo sapiens) CpG-island No: 3745
gtaaaagtggtgaacgcgatgggtcggcggggagggcggtgtggagcgcggcgtcgggcgggcgggtgggcggcggttaggtttatttcgtaggttttggtttttcggagcgggggcgggttgcggcggttcgggtttgtttaggtaattgtttatgaggagtagttcggtagggttaggtttttcgagtagggttcgcggttttaggaggttttcgttggttgtcgatttggtcggaggcgaagcgaatagtgttcgtcgatgtcgcgttttttgaacgaaggaggataaggggcgcgaatttcggggttcgcggtttagtttttattaggtcgcggtagtttttacggttagttaggttagcgtagtcgtagtaggtacgaggtatagtaggaggtcgattagcgataggtcgagaagcgtcgtttcggtcggttcgtcgtagtttcggtttcggtcgtttttgatattcgttatcggtcgtcgtcgttcgtttgttttagtcgtcgtagtcgtcggagatatcgcggtttcgcgtcgcggaggagatttaaatattttagcgtgtatcgcgttacgcgtcgcgttatcgcgcgttcgttacgttatgcgcgcgcgattcggggagacgttatagttcggtagttttcgagatatagttgttttggaaaatgttgtttgtttttaacgtttgtttttgatttttgcggttttttgtatggtttttagcgagacgatttcgttcgggattttattcggtttttattcggaggcgatttcgtgaaaggatcgcgtttaaaataaaaggattcgagatttatgtttatgtaatttttaattcgtgatttt

SEQ ID NO: 3746 - DNA, 849 bp, Artificial Sequence
  chemically treated genomic DNA (Homo sapiens) CpG-island No: 3746
aaaatcacgaattaaaaattacataaacataaatctcgaatccttttattttaaacgcgatcctttcacgaaatcgcctccgaataaaaaccgaataaaatcccgaacgaaatcgtctcgctaaaaaccatacaaaaaaccgcaaaaatcaaaaacaaacgttaaaaacaaacaacattttccaaaacaactatatctcgaaaactaccgaactataacgtctccccgaatcgcgcgcgcataacgtaacgaacgcgcgataacgcgacgcgtaacgcgatacacgctaaaatatttaaatctcctccgcgacgcgaaaccgcgatatctccgacgactacgacgactaaaacaaacgaacgacgacgaccgataacgaatatcaaaaacgaccgaaaccgaaactacgacgaaccgaccgaaacgacgcttctcgacctatcgctaatcgacctcctactatacctcgtacctactacgactacgctaacctaactaaccgtaaaaactaccgcgacctaataaaaactaaaccgcgaaccccgaaattcgcgccccttatcctccttcgttcaaaaaacgcgacatcgacgaacactattcgcttcgcctccgaccaaatcgacaaccaacgaaaacctcctaaaaccgcgaaccctactcgaaaaacctaaccctaccgaactactcctcataaacaattacctaaacaaacccgaaccgccgcaacccgcccccgctccgaaaaaccaaaacctacgaaataaacctaaccgccgcccacccgcccgcccgacgccgcgctccacaccgccctccccgccgacccatcgcgttcaccacttttac

SEQ ID NO: 3747 - DNA, 849 bp, Artificial Sequence
  chemically treated genomic DNA (Homo sapiens) CpG-island No: 3747
aagattacggattaggaattatataagtataggtttcgggtttttttattttggacgcgatttttttacgggatcgttttcggatgggagtcggatgggatttcggacgggatcgtttcgttgggagttatgtaggaaatcgtaagagttagaaataggcgttgaaggtaggtagtattttttaaaatagttgtgtttcgggagttgtcgggttgtagcgttttttcgagtcgcgcgcgtatgacgtggcgggcgcgcgatgacgcgacgcgtggcgcggtgtacgttgggatatttaagtttttttcgcggcgcggagtcgcgatgttttcggcggttgcggcggttggagtaggcgagcggcggcggtcgatagcgagtgttagggacggtcggggtcggggttgcggcgggtcggtcggggcggcgtttttcggtttgtcgttggtcggttttttattgtatttcgtgtttgttgcggttgcgttggtttggttggtcgtggggattatcgcggtttggtggggattgagtcgcgagtttcgaggttcgcgttttttgttttttttcgtttagaaggcgcgatatcggcgaatattgttcgtttcgttttcggttaagtcgatagttaacggaaattttttagagtcgcggattttgttcgaaggatttgattttgtcgaattgttttttatgggtagttatttgggtaagttcgggtcgtcgtagttcgttttcgtttcggagggttaggatttgcggaataggtttggtcgtcgtttattcgttcgttcggcgtcgcgttttatatcgtttttttcgtcgatttatcgcgtttattatttttat

SEQ ID NO: 3748 - DNA, 849 bp, Artificial Sequence
  chemically treated genomic DNA (Homo sapiens) CpG-island No: 3748
ataaaaataataaacgcgataaatcgacgaaaaaaacgatataaaacgcgacgccgaacgaacgaataaacgacgaccaaacctattccgcaaatcctaaccctccgaaacgaaaacgaactacgacgacccgaacttacccaaataactacccataaaaaacaattcgacaaaatcaaatccttcgaacaaaatccgcgactctaaaaaatttccgttaactatcgacttaaccgaaaacgaaacgaacaatattcgccgatatcgcgccttctaaacgaaaaaaaacaaaaaacgcgaacctcgaaactcgcgactcaatccccaccaaaccgcgataatccccacgaccaaccaaaccaacgcaaccgcaacaaacacgaaatacaataaaaaaccgaccaacgacaaaccgaaaaacgccgccccgaccgacccgccgcaaccccgaccccgaccgtccctaacactcgctatcgaccgccgccgctcgcctactccaaccgccgcaaccgccgaaaacatcgcgactccgcgccgcgaaaaaaacttaaatatcccaacgtacaccgcgccacgcgtcgcgtcatcgcgcgcccgccacgtcatacgcgcgcgactcgaaaaaacgctacaacccgacaactcccgaaacacaactattttaaaaaatactacctaccttcaacgcctatttctaactcttacgatttcctacataactcccaacgaaacgatcccgtccgaaatcccatccgactcccatccgaaaacgatcccgtaaaaaaatcgcgtccaaaataaaaaaacccgaaacctatacttatataattcctaatccgtaatctt

SEQ ID NO: 3749 - DNA, 674 bp, Artificial Sequence
  chemically treated genomic DNA (Homo sapiens) CpG-island No: 3749
cgcgaacgttagggaggatttagcgcgcggcggtcggtgacgttagggtagcgagaggtttcgttatcgcggcgcgggggcggggtcgtttgttacgcggcgtcggcggacgcgcggcgttgggcggaggtagcggttcggggattgggcgagggttttgggtttgaggaggcgcggtcgttattgcgtttagcgtttgcgcgacgtttggttgttgggtttcggggtagtttagttcgcgtcgtttttgcgggtcggattggggttgtggcgggagagaagatgtcgtagttcgagttttagaaggcggcgattttgggttgcgggtaaggcggtgagtattttttaggcggcggtttttcggcgttttttagtatttcgagagttgcggcggcggcggcgcgcggggtttgggtaggttgggggcggcggcggggtagcgtttggtttttcgcgggttttgggttttcgtacgttttttgggcgaggttcgtgttttcgggagacgtcgttgttttcgcgttttttttagcgttttttgaggtttgttcgcgggcgtgggggcgaggattagggcgttggtttcgttttcgcgtatttaggacggaggtatatttgattttgtagttttttttagtattttttaaaatgaagtttagattagtattgtttat

SEQ ID NO: 3750 - DNA, 674 bp, Artificial Sequence
  chemically treated genomic DNA (Homo sapiens) CpG-island No: 3750
ataaacaatactaatctaaacttcattttaaaaaatactaaaaaaaactacaaaatcaaatatacctccgtcctaaatacgcgaaaacgaaaccaacgccctaatcctcgcccccacgcccgcgaacaaacctcaaaaaacgctaaaaaaaacgcgaaaacaacgacgtctcccgaaaacacgaacctcgcccaaaaaacgtacgaaaacccaaaacccgcgaaaaaccaaacgctaccccgccgccgcccccaacctacccaaaccccgcgcgccgccgccgccgcaactctcgaaatactaaaaaacgccgaaaaaccgccgcctaaaaaatactcaccgccttacccgcaacccaaaatcgccgccttctaaaactcgaactacgacatcttctctcccgccacaaccccaatccgacccgcaaaaacgacgcgaactaaactaccccgaaacccaacaaccaaacgtcgcgcaaacgctaaacgcaataacgaccgcgcctcctcaaacccaaaaccctcgcccaatccccgaaccgctacctccgcccaacgccgcgcgtccgccgacgccgcgtaacaaacgaccccgcccccgcgccgcgataacgaaacctctcgctaccctaacgtcaccgaccgccgcgcgctaaatcctccctaacgttcgcg

SEQ ID NO: 3751 - DNA, 674 bp, Artificial Sequence
  chemically treated genomic DNA (Homo sapiens) CpG-island No: 3751
gtggataatattgatttggattttattttaggaaatgttgggggaggttgtaggattaggtgtgttttcgttttaaatacgcgaaaacgaggttagcgttttggttttcgtttttacgttcgcgaataagttttaggagacgttgggggaggcgcgggggtagcggcgtttttcggagatacgagtttcgtttagggggcgtgcgggagtttaggattcgcggggagttaggcgttgtttcgtcgtcgtttttagtttgtttaggtttcgcgcgtcgtcgtcgtcgtagttttcgaggtgttgagggacgtcgggaggtcgtcgtttagagggtatttatcgttttgttcgtagtttaggatcgtcgttttttgggattcgggttgcggtattttttttttcgttatagttttagttcgattcgtaggagcggcgcgggttgaattgtttcggggtttagtagttaggcgtcgcgtaggcgttgggcgtagtggcggtcgcgtttttttaggtttagggttttcgtttagttttcgagtcgttgttttcgtttagcgtcgcgcgttcgtcggcgtcgcgtgataggcggtttcgttttcgcgtcgcggtgacgaaatttttcgttgttttgacgttatcggtcgtcgcgcgttgagttttttttagcgttcgcg

SEQ ID NO: 3752 - DNA, 674 bp, Artificial Sequence
  chemically treated genomic DNA (Homo sapiens) CpG-island No: 3752
cgcgaacgctaaaaaaaactcaacgcgcgacgaccgataacgtcaaaacaacgaaaaatttcgtcaccgcgacgcgaaaacgaaaccgcctatcacgcgacgccgacgaacgcgcgacgctaaacgaaaacaacgactcgaaaactaaacgaaaaccctaaacctaaaaaaacgcgaccgccactacgcccaacgcctacgcgacgcctaactactaaaccccgaaacaattcaacccgcgccgctcctacgaatcgaactaaaactataacgaaaaaaaaaataccgcaacccgaatcccaaaaaacgacgatcctaaactacgaacaaaacgataaataccctctaaacgacgacctcccgacgtccctcaacacctcgaaaactacgacgacgacgacgcgcgaaacctaaacaaactaaaaacgacgacgaaacaacgcctaactccccgcgaatcctaaactcccgcacgccccctaaacgaaactcgtatctccgaaaaacgccgctacccccgcgcctcccccaacgtctcctaaaacttattcgcgaacgtaaaaacgaaaaccaaaacgctaacctcgttttcgcgtatttaaaacgaaaacacacctaatcctacaacctcccccaacatttcctaaaataaaatccaaatcaatattatccac

SEQ ID NO: 3753 - DNA, 616 bp, Artificial Sequence
  chemically treated genomic DNA (Homo sapiens) CpG-island No: 3753
gcgaattttagattttagtaggcgtagtatttaaatttcgttttttttagttattaattttcggtcgtcgcggttgtagatatagattcgtttttttcgggacgcggtgatcgcgatttggcgttacggagtttgtttgggggcgttcggagagtcgtgggcggggggagggcgtttgattttttttttaaaaaaaattttttttgtcgacgcgtttcgttgcgcgtttagttcggagaattcgtcgtcgtttttcgttttcgagaagtttttacgtttttttcgttattatcgtttcgcgtttggtattggaatcggggtcggttattcgcgtcgtcgtcgtcgtcgtcgcgttttcggggcgtcgtcgtttgcgttcgcgggtcgaggggtttggtttttgcgtcgtcgtttttttcgggtttttggtcgtttaggaggtgattcgttttcgggggcgcggggaaggatttcgaggtgttgattttgttagtgaatttttggtatagcgaagttatcgggtatcgcgtttttgttggttgtttttggggttttttaatattttgtttttttttcggtttttattttttatttcgttttagattaaaaaaaaaaa

SEQ ID NO: 3754 - DNA, 616 bp, Artificial Sequence
  chemically treated genomic DNA (Homo sapiens) CpG-island No: 3754
tttttttttttaatctaaaacgaaataaaaaataaaaaccgaaaaaaaaacaaaatattaaaaaaccccaaaaacaaccaacaaaaacgcgatacccgataacttcgctataccaaaaattcactaacaaaatcaacacctcgaaatccttccccgcgcccccgaaaacgaatcacctcctaaacgaccaaaaacccgaaaaaaacgacgacgcaaaaaccaaacccctcgacccgcgaacgcaaacgacgacgccccgaaaacgcgacgacgacgacgacgacgcgaataaccgaccccgattccaataccaaacgcgaaacgataataacgaaaaaaacgtaaaaacttctcgaaaacgaaaaacgacgacgaattctccgaactaaacgcgcaacgaaacgcgtcgacaaaaaaaattttttttaaaaaaaaaatcaaacgccctccccccgcccacgactctccgaacgcccccaaacaaactccgtaacgccaaatcgcgatcaccgcgtcccgaaaaaaacgaatctatatctacaaccgcgacgaccgaaaattaataactaaaaaaaacgaaatttaaatactacgcctactaaaatctaaaattcgc

SEQ ID NO: 3755 - DNA, 616 bp, Artificial Sequence
  chemically treated genomic DNA (Homo sapiens) CpG-island No: 3755
tttttttttttaatttggagcggggtggggagtgggaatcggagagaaagtaaaatattaaaaagttttaaagatagttagtaggagcgcggtgttcgatggtttcgttgtattagaggtttattggtaagattaatatttcgaggttttttttcgcgttttcggaggcgagttattttttgggcggttaggggttcgaggaggacggcggcgtaggagttaagtttttcggttcgcgggcgtaggcggcggcgtttcgggagcgcggcggcggcggcggcggcgcgggtggtcggtttcggttttagtattaggcgcggagcgatggtgacgaggaggacgtaagagtttttcgggggcggggggcggcggcgggtttttcgggttgagcgcgtagcgagacgcgtcggtaggggaaattttttttggggggggaattaggcgtttttttttcgtttacgatttttcgggcgtttttagataggtttcgtggcgttagatcgcggttatcgcgtttcggagggagcgggtttgtgtttgtagtcgcggcggtcgggagttggtggttggagagagcggggtttgggtattgcgtttgttgggatttggaattcgt

SEQ ID NO: 3756 - DNA, 616 bp, Artificial Sequence
  chemically treated genomic DNA (Homo sapiens) CpG-island No: 3756
acgaattccaaatcccaacaaacgcaatacccaaaccccgctctctccaaccaccaactcccgaccgccgcgactacaaacacaaacccgctccctccgaaacgcgataaccgcgatctaacgccacgaaacctatctaaaaacgcccgaaaaatcgtaaacgaaaaaaaaacgcctaattccccccccaaaaaaaatttcccctaccgacgcgtctcgctacgcgctcaacccgaaaaacccgccgccgccccccgcccccgaaaaactcttacgtcctcctcgtcaccatcgctccgcgcctaatactaaaaccgaaaccgaccacccgcgccgccgccgccgccgccgcgctcccgaaacgccgccgcctacgcccgcgaaccgaaaaacttaactcctacgccgccgtcctcctcgaacccctaaccgcccaaaaaataactcgcctccgaaaacgcgaaaaaaaacctcgaaatattaatcttaccaataaacctctaatacaacgaaaccatcgaacaccgcgctcctactaactatctttaaaactttttaatattttactttctctccgattcccactccccaccccgctccaaattaaaaaaaaaaa

SEQ ID NO: 3757 - DNA, 616 bp, Artificial Sequence
  chemically treated genomic DNA (Homo sapiens) CpG-island No: 3757
cggacgacgttggtgaagaggtcgttttttttttatagtttagtttttttcgaaatcgtttttttttttcgttttttttcggaggagggtaggaaaggtcgcggggcggtagaggacgtttagaggtttaggcgtttttcgcgggcgatgcgtttcgtagagagttcggttgtgatcgcgattttatttttattattatgaacgtaggcggaggttcggtttttcggttgttcgtaatttttttaaagtttgcgttttattgtgttcgtcgagagcgagggagggcgatatggttttattcgtcgcgcgttttcgggtttgttttttgtttagtcgtaggaaggcgcgttttagcgtttttgtgtggatattcgtattagcgggtttcgttttttcgttttaggttcggtttggtttttttttttttttcggttttttcgcgtttttttcggtttttttttgtattttttttcgtttttttggagttgttgggtacgcgtttttttcgtttcgtttttacgttttttttgcgcgttttttttagtttttttcggtcgggaaggatttattatatttagagagtgaacgtgggtcgggaaattttaattttagaggg

SEQ ID NO: 3758 - DNA, 616 bp, Artificial Sequence
  chemically treated genomic DNA (Homo sapiens) CpG-island No: 3758
ccctctaaaattaaaatttcccgacccacgttcactctctaaatataataaatccttcccgaccgaaaaaaactaaaaaaaacgcgcaaaaaaaacgtaaaaacgaaacgaaaaaaacgcgtacccaacaactccaaaaaaacgaaaaaaaatacaaaaaaaaaccgaaaaaaacgcgaaaaaaccgaaaaaaaaaaaaaaaccaaaccgaacctaaaacgaaaaaacgaaacccgctaatacgaatatccacacaaaaacgctaaaacgcgccttcctacgactaaacaaaaaacaaacccgaaaacgcgcgacgaataaaaccatatcgccctccctcgctctcgacgaacacaataaaacgcaaactttaaaaaaattacgaacaaccgaaaaaccgaacctccgcctacgttcataataataaaaataaaatcgcgatcacaaccgaactctctacgaaacgcatcgcccgcgaaaaacgcctaaacctctaaacgtcctctaccgccccgcgacctttcctaccctcctccgaaaaaaaacgaaaaaaaaaaacgatttcgaaaaaaactaaactataaaaaaaaaacgacctcttcaccaacgtcgtccg

SEQ ID NO: 3759 - DNA, 616 bp, Artificial Sequence
  chemically treated genomic DNA (Homo sapiens) CpG-island No: 3759
ttttttggagttggggtttttcggtttacgtttattttttggatgtgataggtttttttcggtcgggaagggttggaaggggcgcgtaaggaggacgtggggacgagacgagagagacgcgtgtttagtaattttagaaggacggagaggagtgtagaagggagtcggggaggacgcgggagggtcgggaggggaagagaagttaggtcgggtttggagcggaggagcggagttcgttggtgcgggtgtttatataggggcgttggagcgcgtttttttgcggttgggtaggaggtaagttcgagagcgcgcggcgagtggagttatgtcgttttttttcgttttcggcgggtatagtgaggcgtaggttttggaaaagttgcgggtagtcggagagtcgagttttcgtttgcgtttatgataatgagaatggagtcgcggttatagtcgggttttttgcggggcgtatcgttcgcgaggggcgtttgggtttttgggcgttttttgtcgtttcgcgattttttttgttttttttcggagagaggcgaagggaaggggcggtttcggagggagttgggttgtggagggagggcggtttttttattagcgtcgttcg

SEQ ID NO: 3760 - DNA, 616 bp, Artificial Sequence
  chemically treated genomic DNA (Homo sapiens) CpG-island No: 3760
cgaacgacgctaataaaaaaaccgccctccctccacaacccaactccctccgaaaccgccccttcccttcgcctctctccgaaaaaaaacaaaaaaaatcgcgaaacgacaaaaaacgcccaaaaacccaaacgcccctcgcgaacgatacgccccgcaaaaaacccgactataaccgcgactccattctcattatcataaacgcaaacgaaaactcgactctccgactacccgcaacttttccaaaacctacgcctcactatacccgccgaaaacgaaaaaaaacgacataactccactcgccgcgcgctctcgaacttacctcctacccaaccgcaaaaaaacgcgctccaacgcccctatataaacacccgcaccaacgaactccgctcctccgctccaaacccgacctaacttctcttcccctcccgaccctcccgcgtcctccccgactcccttctacactcctctccgtccttctaaaattactaaacacgcgtctctctcgtctcgtccccacgtcctccttacgcgccccttccaacccttcccgaccgaaaaaaacctatcacatccaaaaaataaacgtaaaccgaaaaaccccaactccaaaaaa

SEQ ID NO: 3761 - DNA, 1474 bp, Artificial Sequence
  chemically treated genomic DNA (Homo sapiens) CpG-island No: 3761
ggttttcgggatagtgtagacgcgaggaggagaagattagggtggcgtggaagttagatttcggtaggaatttagcgattatttcgggggttgtattttcgcggcgtgtacggtagggtttcggtgtttttgatttcgtgtggtttttcgaagtttttttatttattcgttttttttcggagtacggcgcgcgtttatttttttatttatttattttatttttattttcgcgagcgttaatcggttgtgagatgggcgagttattttgttagcgtggggttttttttcgggtcggtttttttttcgttagtatacgcgcgaattttcgtatttgggtatatacgcgcgcgcgtgtatatatatatataaagttttgggggtttttttgtagatcggttcggttgcgttgggttcggagtcgtgcgttcgtcgggtttaggtcggtttttttatttattattcggggttcgttttgcgtttagttttttcgcgttgcgcggtagttttttttagcgcggttttttcgggtcgtcggcgcggttttgtttttcggttcggtttttttcgtttcgtattcgtgttatcggcgttcgattgcgcgcggattttttgtggttttttcggtttcgcgtttcgttttcgttttcgttcgtcgttttttttcgttagtaatttttgcggagttttcgcgtttagttatgttgagttgagtttcgtcggttttggtcgcgcgttgttttcggttttcgttttttcgcggattcgttcgggggtcgcggtcgttcggcgtttcggtttcggtcgtttcgttcgttcggtcgtttcgagtttcgagtttcgagtttttcgcgtcgggttcgggcggtagcggcggcggcggcggcggcggcgcgttcggttttttttttcggcgtcggttacgggaggcggtgatgcgggcgcgggcggtttcggttgcgtcgagagcggagatataggtttaagatggtagatttcgattgaggttgggggggtcgagttcgcgcgtcgttttttcgttttcgttgttatgaatcgcggatatttcggtttcgatggttttcgtgtacgaaggtaaggggcgttcggtttcgtcgatttcgcgttcgtcgtttttcgcggttttcgtagttttgttttgttcgcggtttcgcgttcgtagttttcggcgtttgttttagtttttattcggggttcgagggggtcgcgattttttttttcgttcggaagatgatcgggattcggcgtcggtagggttttgtttttagggcggggagaggggtcgggggcgtaggaggggagggggcgtgtgcgagggtgggcggttgttcggggagggtagggacgtcggggaaggcggatcggtgattgtgttttttatttatttgcgataaatgaaggtgatgcggtttagtttttatcgtttttttatattatttttcggagtatttttttt

SEQ ID NO: 3762 - DNA, 1474 bp, Artificial Sequence
  chemically treated genomic DNA (Homo sapiens) CpG-island No: 3762
aaaaaaaatactccgaaaaataatataaaaaaacgataaaaactaaaccgcatcaccttcatttatcgcaaataaataaaaaacacaatcaccgatccgccttccccgacgtccctaccctccccgaacaaccgcccaccctcgcacacgccccctcccctcctacgcccccgacccctctccccgccctaaaaacaaaaccctaccgacgccgaatcccgatcatcttccgaacgaaaaaaaaaatcgcgaccccctcgaaccccgaataaaaactaaaacaaacgccgaaaactacgaacgcgaaaccgcgaacaaaacaaaactacgaaaaccgcgaaaaacgacgaacgcgaaatcgacgaaaccgaacgccccttaccttcgtacacgaaaaccatcgaaaccgaaatatccgcgattcataacaacgaaaacgaaaaaacgacgcgcgaactcgacccccccaacctcaatcgaaatctaccatcttaaacctatatctccgctctcgacgcaaccgaaaccgcccgcgcccgcatcaccgcctcccgtaaccgacgccgaaaaaaaaaaccgaacgcgccgccgccgccgccgccgccgctaccgcccgaacccgacgcgaaaaactcgaaactcgaaactcgaaacgaccgaacgaacgaaacgaccgaaaccgaaacgccgaacgaccgcgacccccgaacgaatccgcgaaaaaacgaaaaccgaaaacaacgcgcgaccaaaaccgacgaaactcaactcaacataactaaacgcgaaaactccgcaaaaattactaacgaaaaaaaacgacgaacgaaaacgaaaacgaaacgcgaaaccgaaaaaaccacaaaaaatccgcgcgcaatcgaacgccgataacacgaatacgaaacgaaaaaaaccgaaccgaaaaacaaaaccgcgccgacgacccgaaaaaaccgcgctaaaaaaaactaccgcgcaacgcgaaaaaactaaacgcaaaacgaaccccgaataataaataaaaaaaccgacctaaacccgacgaacgcacgactccgaacccaacgcaaccgaaccgatctacaaaaaaacccccaaaactttatatatatatatacacgcgcgcgcgtatatacccaaatacgaaaattcgcgcgtatactaacgaaaaaaaaaccgacccgaaaaaaaaccccacgctaacaaaataactcgcccatctcacaaccgattaacgctcgcgaaaataaaaataaaataaataaataaaaaaataaacgcgcgccgtactccgaaaaaaaacgaataaataaaaaaacttcgaaaaaccacacgaaatcaaaaacaccgaaaccctaccgtacacgccgcgaaaatacaacccccgaaataatcgctaaattcctaccgaaatctaacttccacgccaccctaatcttctcctcctcgcgtctacactatcccgaaaacc

SEQ ID NO: 3763 - DNA, 1474 bp, Artificial Sequence
  chemically treated genomic DNA (Homo sapiens) CpG-island No: 3763
aaaggaggtgtttcgaaaggtaatgtgggggggcggtggaagttaagtcgtattatttttatttatcgtaaataaataaaaagtatagttatcggttcgtttttttcggcgtttttgtttttttcgggtagtcgtttattttcgtatacgttttttttttttttgcgttttcggttttttttttcgttttggaagtaagattttgtcggcgtcgggtttcggttatttttcgggcgagggagggggtcgcggttttttcgggtttcgggtgggggttggggtaggcgtcgggggttgcgggcgcggggtcgcgggtagaataaagttgcgggggtcgcggagggcggcgggcgcggggtcggcggggtcgggcgttttttattttcgtatacgggggttatcggggtcggggtgttcgcggtttatggtaacggggacgggaaagcggcgcgcgagttcggtttttttagttttagtcggaatttgttattttgagtttgtgttttcgttttcggcgtagtcgaggtcgttcgcgttcgtattatcgtttttcgtggtcggcgtcgggggagggggtcgggcgcgtcgtcgtcgtcgtcgtcgtcgttgtcgttcgggttcggcgcggggggttcggggttcggggttcggggcggtcgggcgggcggagcggtcgaggtcgaggcgtcgagcggtcgcggttttcgagcggattcgcggaggggcgggagtcgggggtagcgcgcggttagggtcggcggggtttagtttagtatggttgggcgcgggggtttcgtaaaagttgttggcggaggggggcggcgggcgggggcgggggcggggcgcggggtcgggagagttatagggagttcgcgcgtaatcgagcgtcgatggtacggatgcgaggcggggaaggtcgaatcgaagggtagagtcgcgtcggcggttcgaggggatcgcgttgggaggggttgtcgcgtagcgcggggggattgggcgtagggcgggtttcgggtagtgggtgagagggtcggtttggattcggcgggcgtacggtttcgagtttagcgtagtcgagtcggtttgtagaggggtttttagaattttgtgtgtgtgtgtgtacgcgcgcgcgtgtgtgtttaggtgcgagggttcgcgcgtgtgttggcggggagggaatcgattcgaaagagagttttacgttggtaaagtggttcgtttattttatagtcggttggcgttcgcggaggtaggagtggaatgaatgaatgaaggagtgggcgcgcgtcgtgtttcggaggagggcgggtgagtggaggagtttcggaaagttatacgaggttagaggtatcgaagttttgtcgtgtacgtcgcggaaatgtagttttcggggtggtcgttgggtttttgtcggagtttggtttttacgttattttgattttttttttttcgcgtttatattgtttcgagggtt

SEQ ID NO: 3764 - DNA, 1474 bp, Artificial Sequence
  chemically treated genomic DNA (Homo sapiens) CpG-island No: 3764
aaccctcgaaacaatataaacgcgaaaaaaaaaaaatcaaaataacgtaaaaaccaaactccgacaaaaacccaacgaccaccccgaaaactacatttccgcgacgtacacgacaaaacttcgatacctctaacctcgtataactttccgaaactcctccactcacccgccctcctccgaaacacgacgcgcgcccactccttcattcattcattccactcctacctccgcgaacgccaaccgactataaaataaacgaaccactttaccaacgtaaaactctctttcgaatcgattccctccccgccaacacacgcgcgaaccctcgcacctaaacacacacgcgcgcgcgtacacacacacacacaaaattctaaaaacccctctacaaaccgactcgactacgctaaactcgaaaccgtacgcccgccgaatccaaaccgaccctctcacccactacccgaaacccgccctacgcccaatccccccgcgctacgcgacaacccctcccaacgcgatcccctcgaaccgccgacgcgactctacccttcgattcgaccttccccgcctcgcatccgtaccatcgacgctcgattacgcgcgaactccctataactctcccgaccccgcgccccgcccccgcccccgcccgccgcccccctccgccaacaacttttacgaaacccccgcgcccaaccatactaaactaaaccccgccgaccctaaccgcgcgctacccccgactcccgcccctccgcgaatccgctcgaaaaccgcgaccgctcgacgcctcgacctcgaccgctccgcccgcccgaccgccccgaaccccgaaccccgaaccccccgcgccgaacccgaacgacaacgacgacgacgacgacgacgacgcgcccgaccccctcccccgacgccgaccacgaaaaacgataatacgaacgcgaacgacctcgactacgccgaaaacgaaaacacaaactcaaaataacaaattccgactaaaactaaaaaaaccgaactcgcgcgccgctttcccgtccccgttaccataaaccgcgaacaccccgaccccgataacccccgtatacgaaaataaaaaacgcccgaccccgccgaccccgcgcccgccgccctccgcgacccccgcaactttattctacccgcgaccccgcgcccgcaacccccgacgcctaccccaacccccacccgaaacccgaaaaaaccgcgaccccctccctcgcccgaaaaataaccgaaacccgacgccgacaaaatcttacttccaaaacgaaaaaaaaaaccgaaaacgcaaaaaaaaaaaaaacgtatacgaaaataaacgactacccgaaaaaaacaaaaacgccgaaaaaaacgaaccgataactatactttttatttatttacgataaataaaaataatacgacttaacttccaccgcccccccacattacctttcgaaacacctccttt

SEQ ID NO: 3765 - DNA, 841 bp, Artificial Sequence
  chemically treated genomic DNA (Homo sapiens) CpG-island No: 3765
tcgtagtttcggattaagttcgtttcgttcgattcgcgtagttttagttacgttcggtttttcgttcgagtcgaggcgtcgcggttgttagacgcggaggggtagagacgcggtttaaaggaagggataaagagttttttcggtcgcggtcggaggttgtcggttcgtttttaagtcgggttttcgtagtagcggttttagcggggcggggatcggggacgggggcgcggcgggggaggagcggtcggttaggttgaggggcgcgcgagaggtgcgggttcggttggcggattcgttttttatttattatttggtcgtgggtttttcgttacggtcgtcgtcgttacggagtttttgagtcggggcgacgtagcgagagttaataagcgggcgttagttgcgttttatattggcgaagtagtttttagatcgagttggagaaacgtcggtgggtgggagttgggacgaggtttgtttttagtttgtggagattttatttcgttcgtttttcgtattcggttttcgtttcgtttttttgtcggtttttttcgtattcgggggttagtcgttcgcggcgcgcggtattgtgggggatgtagttttagaatgaggaagcggcggtacgtgtttttagtcgttttgtatttattttgggttagaacgacgtagttgcgcggtaattagagagggcggcggggttttttgtgttggaagatgagttcgttagaggtatattttcggttttaattcgttgtaggcgttggaagaagggttttggcgttttgttttcgatttttcggtgaggaattaattttttaatattattgatttgaggttggga

SEQ ID NO: 3766 - DNA, 841 bp, Artificial Sequence
  chemically treated genomic DNA (Homo sapiens) CpG-island No: 3766
tcccaacctcaaatcaataatattaaaaaattaattcctcaccgaaaaatcgaaaacaaaacgccaaaacccttcttccaacgcctacaacgaattaaaaccgaaaatatacctctaacgaactcatcttccaacacaaaaaaccccgccgccctctctaattaccgcgcaactacgtcgttctaacccaaaataaatacaaaacgactaaaaacacgtaccgccgcttcctcattctaaaactacatcccccacaataccgcgcgccgcgaacgactaacccccgaatacgaaaaaaaccgacaaaaaaacgaaacgaaaaccgaatacgaaaaacgaacgaaataaaatctccacaaactaaaaacaaacctcgtcccaactcccacccaccgacgtttctccaactcgatctaaaaactacttcgccaatataaaacgcaactaacgcccgcttattaactctcgctacgtcgccccgactcaaaaactccgtaacgacgacgaccgtaacgaaaaacccacgaccaaataataaataaaaaacgaatccgccaaccgaacccgcacctctcgcgcgcccctcaacctaaccgaccgctcctcccccgccgcgcccccgtccccgatccccgccccgctaaaaccgctactacgaaaacccgacttaaaaacgaaccgacaacctccgaccgcgaccgaaaaaactctttatcccttcctttaaaccgcgtctctacccctccgcgtctaacaaccgcgacgcctcgactcgaacgaaaaaccgaacgtaactaaaactacgcgaatcgaacgaaacgaacttaatccgaaactacga

SEQ ID NO: 3767 - DNA, 841 bp, Artificial Sequence
  chemically treated genomic DNA (Homo sapiens) CpG-island No: 3767
ttttagttttaggttaatagtattaggaggttggttttttatcggagggtcgggaataagacgttagagttttttttttagcgtttgtagcgagttaaggtcgagggtatgtttttggcgggtttattttttaatatagaagatttcgtcgttttttttggttgtcgcgtagttgcgtcgttttgatttagggtaggtgtagggcggttggaagtacgtgtcgtcgtttttttattttgggattatattttttataatgtcgcgcgtcgcgggcggttggttttcgagtgcgggaagggtcggtagggaggcggagcggaagtcgagtgcgagggacgagcggagtaaaatttttataagttgggaataaatttcgttttaatttttatttatcggcgtttttttagttcgatttggaggttgtttcgttagtgtgggacgtagttgacgttcgtttattagttttcgttgcgtcgtttcggtttagaagtttcgtggcggcggcgatcgtgacgagaagtttacggttaggtaatgagtaaggggcgagttcgttagtcgggttcgtatttttcgcgcgttttttagtttagtcggtcgtttttttttcgtcgcgttttcgttttcggttttcgtttcgttagggtcgttgttgcggaaattcggtttaggaacgggtcggtagttttcggtcgcggtcgggaaggttttttgtttttttttttgggtcgcgtttttgttttttcgcgtttgatagtcgcggcgtttcggttcgggcggagagtcgagcgtggttggggttgcgcgagtcgagcggggcgggtttggttcggagttgcgg

SEQ ID NO: 3768 - DNA, 841 bp, Artificial Sequence
  chemically treated genomic DNA (Homo sapiens) CpG-island No: 3768
ccgcaactccgaaccaaacccgccccgctcgactcgcgcaaccccaaccacgctcgactctccgcccgaaccgaaacgccgcgactatcaaacgcgaaaaaacaaaaacgcgacccaaaaaaaaaaacaaaaaaccttcccgaccgcgaccgaaaactaccgacccgttcctaaaccgaatttccgcaacaacgaccctaacgaaacgaaaaccgaaaacgaaaacgcgacgaaaaaaaaacgaccgactaaactaaaaaacgcgcgaaaaatacgaacccgactaacgaactcgccccttactcattacctaaccgtaaacttctcgtcacgatcgccgccgccacgaaacttctaaaccgaaacgacgcaacgaaaactaataaacgaacgtcaactacgtcccacactaacgaaacaacctccaaatcgaactaaaaaaacgccgataaataaaaattaaaacgaaatttattcccaacttataaaaattttactccgctcgtccctcgcactcgacttccgctccgcctccctaccgacccttcccgcactcgaaaaccaaccgcccgcgacgcgcgacattataaaaaatataatcccaaaataaaaaaacgacgacacgtacttccaaccgccctacacctaccctaaatcaaaacgacgcaactacgcgacaaccaaaaaaaacgacgaaatcttctatattaaaaaataaacccgccaaaaacataccctcgaccttaactcgctacaaacgctaaaaaaaaaactctaacgtcttattcccgaccctccgataaaaaaccaacctcctaatactattaacctaaaactaaaa

SEQ ID NO: 3769 - DNA, 552 bp, Artificial Sequence
  chemically treated genomic DNA (Homo sapiens) CpG-island No: 3769
ttcgcggcgtagattacggaggggttcggggcgggggttagcgttcgggtttatttggtgtaggtgttgggcggggggcgcgcgttattttgaggatgttgtcgaagatggtgtcgcggaattttagtagcgttttttggtcgaattcgcggtcgtggatgatgcgtatttgtttgaggaacgtggatttgtcgttttcgttcgcgtttagtagtaggatttttattaggcgtcggatcgttcgtatatcgggttaagtagcgtttcgtatgtcgcggttatcgtttcgggtttcgtttttgcgtcgcgcgcgtcgtatgttcgtatttgcgttcgtcgggtttatttttcggtcggtagtaggtagcggttgagggttcgtattatttcggatatgtttttcgagcgcgtggtcgtttcgtcggcgttcgggggttatggacgttcgtcggcgagggcgagttcgggtcgagtatcgttttacgtttcgtcgttcgttttaggttcgtatcgtcgtcgtcgttgtagtcgtttcgaggttcgtattcgtcg

SEQ ID NO: 3770 - DNA, 552 bp, Artificial Sequence
  chemically treated genomic DNA (Homo sapiens) CpG-island No: 3770
cgacgaatacgaacctcgaaacgactacaacgacgacgacgatacgaacctaaaacgaacgacgaaacgtaaaacgatactcgacccgaactcgccctcgccgacgaacgtccataacccccgaacgccgacgaaacgaccacgcgctcgaaaaacatatccgaaataatacgaaccctcaaccgctacctactaccgaccgaaaaataaacccgacgaacgcaaatacgaacatacgacgcgcgcgacgcaaaaacgaaacccgaaacgataaccgcgacatacgaaacgctacttaacccgatatacgaacgatccgacgcctaataaaaatcctactactaaacgcgaacgaaaacgacaaatccacgttcctcaaacaaatacgcatcatccacgaccgcgaattcgaccaaaaaacgctactaaaattccgcgacaccatcttcgacaacatcctcaaaataacgcgcgccccccgcccaacacctacaccaaataaacccgaacgctaacccccgccccgaacccctccgtaatctacgccgcgaa

SEQ ID NO: 3771 - DNA, 552 bp, Artificial Sequence
  chemically treated genomic DNA (Homo sapiens) CpG-island No: 3771
cgacgagtgcgggtttcggagcgattgtagcggcggcgacggtacgggtttgaggcgagcggcggggcgtggggcggtgttcggttcgggttcgttttcgtcggcggacgtttatggttttcgggcgtcggcggggcggttacgcgttcgaggggtatgttcggggtggtgcggatttttagtcgttgtttgttgtcggtcgaggggtgaattcggcgagcgtaggtgcgggtatgcggcgcgcgcgacgtaaaggcgaggttcggagcgatagtcgcgatatacgaagcgttgtttggttcgatatgcgggcggttcggcgtttggtgaagattttgttgttgggcgcgggcgagagcggtaagtttacgttttttaagtagatgcgtattatttacggtcgcgagttcgattagaaggcgttgttggagtttcgcgatattattttcgataatatttttaaggtgacgcgcgtttttcgtttagtatttgtattaggtgggttcgggcgttaattttcgtttcgggttttttcgtggtttgcgtcgcggg

SEQ ID NO: 3772 - DNA, 552 bp, Artificial Sequence
  chemically treated genomic DNA (Homo sapiens) CpG-island No: 3772
cccgcgacgcaaaccacgaaaaaacccgaaacgaaaattaacgcccgaacccacctaatacaaatactaaacgaaaaacgcgcgtcaccttaaaaatattatcgaaaataatatcgcgaaactccaacaacgccttctaatcgaactcgcgaccgtaaataatacgcatctacttaaaaaacgtaaacttaccgctctcgcccgcgcccaacaacaaaatcttcaccaaacgccgaaccgcccgcatatcgaaccaaacaacgcttcgtatatcgcgactatcgctccgaacctcgcctttacgtcgcgcgcgccgcatacccgcacctacgctcgccgaattcacccctcgaccgacaacaaacaacgactaaaaatccgcaccaccccgaacatacccctcgaacgcgtaaccgccccgccgacgcccgaaaaccataaacgtccgccgacgaaaacgaacccgaaccgaacaccgccccacgccccgccgctcgcctcaaacccgtaccgtcgccgccgctacaatcgctccgaaacccgcactcgtcg

SEQ ID NO: 3773 - DNA, 530 bp, Artificial Sequence
  chemically treated genomic DNA (Homo sapiens) CpG-island No: 3773
gtcgcggggttttcgttcgtcgtcgtcgtcgtcgggagcgggaacggtgcgggcggcggcggcggcgtgggttgcgtttcggttgcgggagtcggtcggttgttgtagtttattcgcgttacggtgttttattagtttttgcggggtagttagtatagttttacgcgttcgttcgtcgtcgttgtcgtcgtttcgttgggtagtttttcggggttcggcgcggttcgcggttttagttcgtttagttcgacgtcgtcggcggtcgtagtttcggtcgagtaggcgtcgcgggttaagggtcgttcgagacggtttttagagagttatcggaggagtagtttatttgagagacggagtttcggttcgttcgtgtgtagaggtagcgagtttaattttttcgttttttcgggttgcgttttttcgacggtgtttttcgtggaaattttagttttttcgggtttttttttgttagtgtattatcgaaggtgtgaaagtggttttgggaattttatttttttgcggtcgttgtg

SEQ ID NO: 3774 - DNA, 530 bp, Artificial Sequence
  chemically treated genomic DNA (Homo sapiens) CpG-island No: 3774
cacaacgaccgcaaaaaaataaaattcccaaaaccactttcacaccttcgataatacactaacaaaaaaaaacccgaaaaaactaaaatttccacgaaaaacaccgtcgaaaaaacgcaacccgaaaaaacgaaaaaattaaactcgctacctctacacacgaacgaaccgaaactccgtctctcaaataaactactcctccgataactctctaaaaaccgtctcgaacgacccttaacccgcgacgcctactcgaccgaaactacgaccgccgacgacgtcgaactaaacgaactaaaaccgcgaaccgcgccgaaccccgaaaaactacccaacgaaacgacgacaacgacgacgaacgaacgcgtaaaactatactaactaccccgcaaaaactaataaaacaccgtaacgcgaataaactacaacaaccgaccgactcccgcaaccgaaacgcaacccacgccgccgccgccgcccgcaccgttcccgctcccgacgacgacgacgacgaacgaaaaccccgcgac

SEQ ID NO: 3775 - DNA, 530 bp, Artificial Sequence
  chemically treated genomic DNA (Homo sapiens) CpG-island No: 3775
tatagcgatcgtaggggggtgagatttttaaagttatttttatattttcgataatgtattagtaaagagaagttcgaagaggttgaagtttttacggagggtatcgtcggggagacgtagttcgggaggacgggagggttgggttcgttatttttgtatacgggcgagtcggggtttcgttttttaggtgagttgttttttcggtggttttttggggatcgtttcgggcggtttttggttcgcggcgtttgttcggtcggggttgcggtcgtcggcggcgtcgggttggacgggttggggtcgcgggtcgcgtcgggtttcgggaggttgtttagcgaggcggcggtagcggcgacgggcggacgcgtgggattgtgttggttgtttcgtaagagttggtagggtatcgtggcgcggatgggttgtagtagtcggtcggttttcgtagtcggggcgtagtttacgtcgtcgtcgtcgttcgtatcgttttcgttttcggcggcggcgacggcgggcggggatttcgcggt

SEQ ID NO: 3776 - DNA, 530 bp, Artificial Sequence
  chemically treated genomic DNA (Homo sapiens) CpG-island No: 3776
accgcgaaatccccgcccgccgtcgccgccgccgaaaacgaaaacgatacgaacgacgacgacgacgtaaactacgccccgactacgaaaaccgaccgactactacaacccatccgcgccacgataccctaccaactcttacgaaacaaccaacacaatcccacgcgtccgcccgtcgccgctaccgccgcctcgctaaacaacctcccgaaacccgacgcgacccgcgaccccaacccgtccaacccgacgccgccgacgaccgcaaccccgaccgaacaaacgccgcgaaccaaaaaccgcccgaaacgatccccaaaaaaccaccgaaaaaacaactcacctaaaaaacgaaaccccgactcgcccgtatacaaaaataacgaacccaaccctcccgtcctcccgaactacgtctccccgacgataccctccgtaaaaacttcaacctcttcgaacttctctttactaatacattatcgaaaatataaaaataactttaaaaatctcacccccctacgatcgctata

SEQ ID NO: 3777 - DNA, 1044 bp, Artificial Sequence
  chemically treated genomic DNA (Homo sapiens) CpG-island No: 3777
attcgtttcggacgggaggagggtaggttcgtttagagggaatcggttgttttaagggaagtttcgttttttggtggtgacgttttattaggttcgttcgcgattggttgcggttagagggcgggatggggttgttaggcgaggaggggattcggcgggttttcgtcgttcggagcgttgagtcgcgggagcggagtcggggttagcggcgttgttggaagatggcgagcggtcgggacgagcggtcgttttggcggttagggcggtttttgttgtttatgtgtttgttgttgttggggagttcggttcgggcggtttatattaagaaggcggaggcgattattataattacgagcgcgggcgtcgaggcggtcgagggttagttcgatcgttattattacgaagaggagttggagtcggcgttgagggaggcggcggtcgcgggttttttcggtttggttcgtttttttagtatcggtcgttcggtggaaggtcggtcgttgtgggtgtttcgttttatcgtcggtttggggtcgttaatttttgagggcgacgcggggtttgacgttgtcgggttcgacgttgcggggtcgttgttgttcggtcggttttaggtgaagttggtgggtaatatgtatggcgacgagatcgtgtcgcgttaggtgttgatttatttggttcgcgagttggcggtcggttatcgtcgcggggattcgcgtttggttcgtttgtttaatattatcgacgtgtatttgttgtttagttttaatttcgatggtttcgagcgtgttcgcgagggcgattgtggtttcggcgacggcggttcgttcggggttagcggtcgcgataatagtcgcggtcgcgattttaatcgaagttttttcgattagtttagtatcggcgaatttttcgttttggacgaggtgttcgaggtgcgcgtttttatcgagtggattcgtagaataagtgagtgttgtttgtttttttttcgttcgtgtgagtttttaagggtcgaggttggtttcggtatttagtaggcgttta

SEQ ID NO: 3778 - DNA, 1044 bp, Artificial Sequence
  chemically treated genomic DNA (Homo sapiens) CpG-island No: 3778
taaacgcctactaaataccgaaaccaacctcgacccttaaaaactcacacgaacgaaaaaaaaacaaacaacactcacttattctacgaatccactcgataaaaacgcgcacctcgaacacctcgtccaaaacgaaaaattcgccgatactaaactaatcgaaaaaacttcgattaaaatcgcgaccgcgactattatcgcgaccgctaaccccgaacgaaccgccgtcgccgaaaccacaatcgccctcgcgaacacgctcgaaaccatcgaaattaaaactaaacaacaaatacacgtcgataatattaaacaaacgaaccaaacgcgaatccccgcgacgataaccgaccgccaactcgcgaaccaaataaatcaacacctaacgcgacacgatctcgtcgccatacatattacccaccaacttcacctaaaaccgaccgaacaacaacgaccccgcaacgtcgaacccgacaacgtcaaaccccgcgtcgccctcaaaaattaacgaccccaaaccgacgataaaacgaaacacccacaacgaccgaccttccaccgaacgaccgatactaaaaaaacgaaccaaaccgaaaaaacccgcgaccgccgcctccctcaacgccgactccaactcctcttcgtaataataacgatcgaactaaccctcgaccgcctcgacgcccgcgctcgtaattataataatcgcctccgccttcttaatataaaccgcccgaaccgaactccccaacaacaacaaacacataaacaacaaaaaccgccctaaccgccaaaacgaccgctcgtcccgaccgctcgccatcttccaacaacgccgctaaccccgactccgctcccgcgactcaacgctccgaacgacgaaaacccgccgaatcccctcctcgcctaacaaccccatcccgccctctaaccgcaaccaatcgcgaacgaacctaataaaacgtcaccaccaaaaaacgaaacttcccttaaaacaaccgattccctctaaacgaacctaccctcctcccgtccgaaacgaat

SEQ ID NO: 3779 - DNA, 1044 bp, Artificial Sequence
  chemically treated genomic DNA (Homo sapiens) CpG-island No: 3779
tgagcgtttattgggtgtcggaattagtttcggtttttggaggtttatacggacggggagggggtaggtaatatttatttgttttgcggatttattcgatgagggcgcgtatttcgggtatttcgtttagggcggggggttcgtcggtgttaaattggtcgggaaagtttcggttgaggtcgcggtcgcgattattgtcgcggtcgttggtttcggacgggtcgtcgtcgtcgaagttatagtcgttttcgcgggtacgttcgaagttatcggggttgaggttgggtagtaggtatacgtcggtggtgttgagtaggcggattaggcgcgggttttcgcggcggtagtcggtcgttagttcgcgggttaagtagattaatatttggcgcgatacggtttcgtcgttatgtatgttgtttattagttttatttggggtcggtcgggtagtagcggtttcgtagcgtcgggttcggtagcgttaggtttcgcgtcgtttttagggattagcgattttaggtcggcggtgaggcgaagtatttatagcggtcggttttttatcgagcggtcgatgttaaagaggcgggttaggtcggggaggttcgcggtcgtcgttttttttagcgtcgattttaattttttttcgtggtagtagcggtcgaattggttttcggtcgtttcggcgttcgcgttcgtagttgtggtagtcgttttcgtttttttgatgtgagtcgttcgggtcgagttttttagtagtagtaggtatatgagtaataggagtcgttttagtcgttaaggcggtcgttcgtttcggtcgttcgttattttttagtagcgtcgttaatttcggtttcgttttcgcggtttagcgtttcgggcggcgggggttcgtcggatttttttttcgtttagtaattttatttcgttttttggtcgtagttaatcgcggacgggtttggtggagcgttattattagggggcggggttttttttaaagtagtcgattttttttgggcgggtttgtttttttttcgttcgggacgagt

SEQ ID NO: 3780 - DNA, 1044 bp, Artificial Sequence
  chemically treated genomic DNA (Homo sapiens) CpG-island No: 3780
actcgtcccgaacgaaaaaaaaacaaacccgcccaaaaaaaatcgactactttaaaaaaaaccccgccccctaataataacgctccaccaaacccgtccgcgattaactacgaccaaaaaacgaaataaaattactaaacgaaaaaaaaatccgacgaacccccgccgcccgaaacgctaaaccgcgaaaacgaaaccgaaattaacgacgctactaaaaaataacgaacgaccgaaacgaacgaccgccttaacgactaaaacgactcctattactcatatacctactactactaaaaaactcgacccgaacgactcacatcaaaaaaacgaaaacgactaccacaactacgaacgcgaacgccgaaacgaccgaaaaccaattcgaccgctactaccacgaaaaaaaattaaaatcgacgctaaaaaaaacgacgaccgcgaacctccccgacctaacccgcctctttaacatcgaccgctcgataaaaaaccgaccgctataaatacttcgcctcaccgccgacctaaaatcgctaatccctaaaaacgacgcgaaacctaacgctaccgaacccgacgctacgaaaccgctactacccgaccgaccccaaataaaactaataaacaacatacataacgacgaaaccgtatcgcgccaaatattaatctacttaacccgcgaactaacgaccgactaccgccgcgaaaacccgcgcctaatccgcctactcaacaccaccgacgtatacctactacccaacctcaaccccgataacttcgaacgtacccgcgaaaacgactataacttcgacgacgacgacccgtccgaaaccaacgaccgcgacaataatcgcgaccgcgacctcaaccgaaactttcccgaccaatttaacaccgacgaaccccccgccctaaacgaaatacccgaaatacgcgccctcatcgaataaatccgcaaaacaaataaatattacctaccccctccccgtccgtataaacctccaaaaaccgaaactaattccgacacccaataaacgctca

SEQ ID NO: 3781 - DNA, 665 bp, Artificial Sequence
  chemically treated genomic DNA (Homo sapiens) CpG-island No: 3781
ggggaggcggagacggagacggagcggttttagtcgtcgcgtcgagtttagtcgagtcgagtcgagtcgagtcgaggcgagtattttttatcgtcgtcgtttacgatattaggcgttcgttttttattcgttttagcggtttgtcgcgggttaaatttttttattatgtttcgtatttcgttcgtttttgcgattttttagtttcgtttagtttcgagcgttcgtagtcgtcgcgtcgtcggtttaagtatgtaggtgagtgagagggatttttacgtttttattcgcggggagttcggtttttgttttttcggtttcgcgttttgcgttttttgtttttttcgacgcggtttttcgttcgggataaggtttttagttttttagcgtttttttttcgaagggttttttattttttcgcggttttggttcgttttcgttttttttggcgtagtcgttttcgttttcgcggttgtttttatttcgtttcggttcggcgggcggtttcgcgtagttttttgtttcgggtttttagttcgttttcggtattttttgtttcggggttttttcgtcgattttttttttttcgtttttttttattttcgtcgttttttagttttgtgcggggagtgcgggtttgcgggatgggtgggatgggggttacgttg

SEQ ID NO: 3782 - DNA, 665 bp, Artificial Sequence
  chemically treated genomic DNA (Homo sapiens) CpG-island No: 3782
caacgtaacccccatcccacccatcccgcaaacccgcactccccgcacaaaactaaaaaacgacgaaaataaaaaaaaacgaaaaaaaaaaaatcgacgaaaaaaccccgaaacaaaaaataccgaaaacgaactaaaaacccgaaacaaaaaactacgcgaaaccgcccgccgaaccgaaacgaaataaaaacaaccgcgaaaacgaaaacgactacgccaaaaaaaacgaaaacgaaccaaaaccgcgaaaaaataaaaaacccttcgaaaaaaaaacgctaaaaaactaaaaaccttatcccgaacgaaaaaccgcgtcgaaaaaaacaaaaaacgcaaaacgcgaaaccgaaaaaacaaaaaccgaactccccgcgaataaaaacgtaaaaatccctctcactcacctacatacttaaaccgacgacgcgacgactacgaacgctcgaaactaaacgaaactaaaaaatcgcaaaaacgaacgaaatacgaaacataataaaaaaatttaacccgcgacaaaccgctaaaacgaataaaaaacgaacgcctaatatcgtaaacgacgacgataaaaaatactcgcctcgactcgactcgactcgactcgactaaactcgacgcgacgactaaaaccgctccgtctccgtctccgcctcccc

SEQ ID NO: 3783 - DNA, 665 bp, Artificial Sequence
  chemically treated genomic DNA (Homo sapiens) CpG-island No: 3783
tagcgtggtttttattttatttatttcgtaggttcgtatttttcgtatagggttggagagcggcgagagtggggggagacgaggaaaaggaggtcggcgaagggatttcgaggtagggagtgtcgagagcggattggggattcgaagtaggagattgcgcggagtcgttcgtcgagtcgaggcgggatggaggtagtcgcggggacggggacggttgcgttagggagggcgggagcgagttaggatcgcggagggatggagagtttttcggggaaggggcgttgggaggttggaggttttgtttcgggcgagggatcgcgtcgggaggggtaggaggcgtagggcgcggagtcgggaaggtaagggtcgggtttttcgcgggtgggggcgtgggggttttttttatttatttgtatgtttaggtcggcggcgcgacgattgcgggcgttcgggattgagcggggttggggggtcgtaggagcgggcggggtgcggggtatggtggggaggtttggttcgcggtaggtcgttggagcgggtggggggcgggcgtttggtatcgtgggcggcggcggtgggagatgttcgtttcggttcggttcggttcggttcggttgggttcggcgcggcggttgggatcgtttcgttttcgttttcgttttttt

SEQ ID NO: 3784 - DNA, 665 bp, Artificial Sequence
  chemically treated genomic DNA (Homo sapiens) CpG-island No: 3784
aaaaaaacgaaaacgaaaacgaaacgatcccaaccgccgcgccgaacccaaccgaaccgaaccgaaccgaaccgaaacgaacatctcccaccgccgccgcccacgataccaaacgcccgccccccacccgctccaacgacctaccgcgaaccaaacctccccaccataccccgcaccccgcccgctcctacgaccccccaaccccgctcaatcccgaacgcccgcaatcgtcgcgccgccgacctaaacatacaaataaataaaaaaaacccccacgcccccacccgcgaaaaacccgacccttaccttcccgactccgcgccctacgcctcctacccctcccgacgcgatccctcgcccgaaacaaaacctccaacctcccaacgccccttccccgaaaaactctccatccctccgcgatcctaactcgctcccgccctccctaacgcaaccgtccccgtccccgcgactacctccatcccgcctcgactcgacgaacgactccgcgcaatctcctacttcgaatccccaatccgctctcgacactccctacctcgaaatcccttcgccgacctccttttcctcgtctccccccactctcgccgctctccaaccctatacgaaaaatacgaacctacgaaataaataaaataaaaaccacgcta

SEQ ID NO: 3785 - DNA, 802 bp, Artificial Sequence
  chemically treated genomic DNA (Homo sapiens) CpG-island No: 3785
cgggcgaaatttcggatgaaatatcgcgttagatttacgtaacgtttaaacggtttttcgtatttttacggacggtcgaaatttgcgggttttcgtaaagaattatttcggttaaattcgggggatttatttcgtttttttaaaaagattaagtttgatcgagcggtcggagttgtcgtgtcgtcgtcgtcgtcgttatcgcgttaggtttcggtcgcggttatttttcgtcgttaagggttttttcgtttcggtttcgggatttcggtttttcgttagtttcggtttcggtttcggtattatgtcggagaaaagcgtggaggtagcggtcgagttgagcgttaaggtacgggcgggggcggcggcggttcggatttcgcgtagttttggggttcggcgcggtttttcgttttaggtcgttttcgacggtttcgcgcggtttttgcgttcgggttttggcggattttattgcgtttttttatcgtttttcggttcggagtttttttttcggtttcgcgcggttagcgttagcgttttttagttgttttgcgcgtattacggcgttcggtttcgtcgtttcggtcgcgtcgtttttcgtagtcgtttttattttttttcggttttatttcgttgatcggatttcgttcggtttttcgttcgaacgtttcgagttttattttgtcgcgttttttttttgcgtttcgttgtcgcgtttttgtttgtaatttgattttattttttttcgttaagcggtttgagatttttaagtgtaaataggattttttttggaggttgttttttt

SEQ ID NO: 3786 - DNA, 802 bp, Artificial Sequence
  chemically treated genomic DNA (Homo sapiens) CpG-island No: 3786
aaaaaaacaacctccaaaaaaaatcctatttacacttaaaaatctcaaaccgcttaacgaaaaaaaataaaatcaaattacaaacaaaaacgcgacaacgaaacgcaaaaaaaaaacgcgacaaaataaaactcgaaacgttcgaacgaaaaaccgaacgaaatccgatcaacgaaataaaaccgaaaaaaaataaaaacgactacgaaaaacgacgcgaccgaaacgacgaaaccgaacgccgtaatacgcgcaaaacaactaaaaaacgctaacgctaaccgcgcgaaaccgaaaaaaaaactccgaaccgaaaaacgataaaaaaacgcaataaaatccgccaaaacccgaacgcaaaaaccgcgcgaaaccgtcgaaaacgacctaaaacgaaaaaccgcgccgaaccccaaaactacgcgaaatccgaaccgccgccgcccccgcccgtaccttaacgctcaactcgaccgctacctccacgcttttctccgacataataccgaaaccgaaaccgaaactaacgaaaaaccgaaatcccgaaaccgaaacgaaaaaacccttaacgacgaaaaataaccgcgaccgaaacctaacgcgataacgacgacgacgacgacacgacaactccgaccgctcgatcaaacttaatctttttaaaaaaacgaaataaatcccccgaatttaaccgaaataattctttacgaaaacccgcaaatttcgaccgtccgtaaaaatacgaaaaaccgtttaaacgttacgtaaatctaacgcgatatttcatccgaaatttcgcccg

SEQ ID NO: 3787 - DNA, 802 bp, Artificial Sequence
  chemically treated genomic DNA (Homo sapiens) CpG-island No: 3787
ggaggagtagtttttagggagagttttgtttatatttgaggattttaaatcgtttagcgaggaaaggtgaggttaggttgtaagtaaagacgcggtagcggggcgtagggagggggcgcggtaaagtgagattcggggcgttcggacgggaagtcggacgggattcggttagcgaggtggggtcgaagaggggtggggacggttgcgggggacggcgcgatcggagcggcgaggtcgggcgtcgtggtgcgcgtagggtagttagagggcgttggcgttagtcgcgcggagtcgggaaaggagtttcgggtcggggagcggtgggagggcgtagtggggttcgttaggattcgggcgtaagggtcgcgcggggtcgtcgggggcggtttggggcgaaggatcgcgtcgggttttagggttgcgcgaggttcgggtcgtcgtcgttttcgttcgtattttggcgtttaattcggtcgttgtttttacgttttttttcgatatggtgtcggggtcggggtcggggttggcggggagtcggggtttcggggtcgagacggaggggtttttgacggcggagggtggtcgcggtcggaatttggcgcggtggcggcggcggcggcgatacggtagtttcggtcgttcggttaaatttggtttttttgaaaaagcggaataagtttttcgggtttggtcggggtggttttttacggaaattcgtaggtttcggtcgttcgtaggggtgcgaaaggtcgtttaagcgttgcgtggatttggcgcggtattttattcggggtttcgttcg

SEQ ID NO: 3788 - DNA, 802 bp, Artificial Sequence
  chemically treated genomic DNA (Homo sapiens) CpG-island No: 3788
cgaacgaaaccccgaataaaataccgcgccaaatccacgcaacgcttaaacgacctttcgcacccctacgaacgaccgaaacctacgaatttccgtaaaaaaccaccccgaccaaacccgaaaaacttattccgctttttcaaaaaaaccaaatttaaccgaacgaccgaaactaccgtatcgccgccgccgccgccaccgcgccaaattccgaccgcgaccaccctccgccgtcaaaaacccctccgtctcgaccccgaaaccccgactccccgccaaccccgaccccgaccccgacaccatatcgaaaaaaaacgtaaaaacaacgaccgaattaaacgccaaaatacgaacgaaaacgacgacgacccgaacctcgcgcaaccctaaaacccgacgcgatccttcgccccaaaccgcccccgacgaccccgcgcgacccttacgcccgaatcctaacgaaccccactacgccctcccaccgctccccgacccgaaactcctttcccgactccgcgcgactaacgccaacgccctctaactaccctacgcgcaccacgacgcccgacctcgccgctccgatcgcgccgtcccccgcaaccgtccccacccctcttcgaccccacctcgctaaccgaatcccgtccgacttcccgtccgaacgccccgaatctcactttaccgcgccccctccctacgccccgctaccgcgtctttacttacaacctaacctcacctttcctcgctaaacgatttaaaatcctcaaatataaacaaaactctccctaaaaactactcctcc

SEQ ID NO: 3789 - DNA, 1040 bp, Artificial Sequence
  chemically treated genomic DNA (Homo sapiens) CpG-island No: 3789
gcggtagcggggcgtagggagggggcgcggtaaagtgagattcggggcgttcggacgggaagtcggacgggattcggttagcgaggtggggtcgaagaggggtggggacggttgcgggggtcggcgcgatcggagcggcgaggtcgggcgtcgtggtgcgcgtagggtagttagagggcgttggcgttagtcgcgcggagtcgggaaaggagtttcgggtcggggagcggtgggagggcgtagtggggttcgttaggattcgggcgtaagggtcgcgcggggtcgtcgggggcggtttggggcgaaggatcgcgtcgggttttagggttgcgcgaggttcgggtcgtcgtcgttttcgttcgtattttggcgtttaattcggtcgttgtttttacgttttttttcgatatggtgtcggggtcggggtcggggttggcggggagtcggggtttcggggtcgagacggaggggttttggacggcggagggtggtcgcggtcggaatttggcgcggtggcggcggcggcggcgatagcggtagcggcggtcgttcggtaagttgggtttttggaagaggcggtagaggcgcgcggggtggggcgggggtgggtttggagcggagattcgtagggttgcggtcgttcggagggcgggcggaagggcggtgtaggcggtggtcggcgcgttcggtcgcggtagttcgatttcgggttcgtcgttttcgtattagtagagtgtcgtcgattagtcgtgtcgttttcgggaagggaattcgtttataaggcggcgttgttcgacgggaggggttttttaggggtggggtaggcgggagcggggaggagaggagaggggagggttatgaaagaggaggttggagaggtggggataggaggatgaaagcgaggggagggagagttagggagtcgggagggaggacgagattaggagggggaaatggagagattgacggtcgcggagaaagagtggggcgaggaggtgggaaggggtggggtttttgcggggaggtatttttttaaattt

SEQ ID NO: 3790 - DNA, 1040 bp, Artificial Sequence
  chemically treated genomic DNA (Homo sapiens) CpG-island No: 3790
aaatttaaaaaaatacctccccgcaaaaaccccaccccttcccacctcctcgccccactctttctccgcgaccgtcaatctctccatttccccctcctaatctcgtcctccctcccgactccctaactctccctcccctcgctttcatcctcctatccccacctctccaacctcctctttcataaccctcccctctcctctcctccccgctcccgcctaccccacccctaaaaaacccctcccgtcgaacaacgccgccttataaacgaattcccttcccgaaaacgacacgactaatcgacgacactctactaatacgaaaacgacgaacccgaaatcgaactaccgcgaccgaacgcgccgaccaccgcctacaccgcccttccgcccgccctccgaacgaccgcaaccctacgaatctccgctccaaacccacccccgccccaccccgcgcgcctctaccgcctcttccaaaaacccaacttaccgaacgaccgccgctaccgctatcgccgccgccgccgccaccgcgccaaattccgaccgcgaccaccctccgccgtccaaaacccctccgtctcgaccccgaaaccccgactccccgccaaccccgaccccgaccccgacaccatatcgaaaaaaaacgtaaaaacaacgaccgaattaaacgccaaaatacgaacgaaaacgacgacgacccgaacctcgcgcaaccctaaaacccgacgcgatccttcgccccaaaccgcccccgacgaccccgcgcgacccttacgcccgaatcctaacgaaccccactacgccctcccaccgctccccgacccgaaactcctttcccgactccgcgcgactaacgccaacgccctctaactaccctacgcgcaccacgacgcccgacctcgccgctccgatcgcgccgacccccgcaaccgtccccacccctcttcgaccccacctcgctaaccgaatcccgtccgacttcccgtccgaacgccccgaatctcactttaccgcgccccctccctacgccccgctaccgc

SEQ ID NO: 3791 - DNA, 1040 bp, Artificial Sequence
  chemically treated genomic DNA (Homo sapiens) CpG-island No: 3791
ggatttggaaaggtgttttttcgtaggaattttatttttttttattttttcgttttatttttttttcgcggtcgttagtttttttattttttttttttggtttcgttttttttttcgattttttagtttttttttttttcgtttttatttttttatttttatttttttaatttttttttttataattttttttttttttttttttttcgttttcgtttgttttatttttgggaagtttttttcgtcgggtagcgtcgttttataagcgggtttttttttcgggggcggtacggttggtcggcggtattttgttggtgcgggggcggcgagttcgggatcgagttatcgcggtcgagcgcgtcggttatcgtttgtatcgttttttcgttcgtttttcggacggtcgtagttttgcgggttttcgttttagatttattttcgttttatttcgcgcgtttttgtcgttttttttagagatttagtttgtcgagcggtcgtcgttgtcgttgtcgtcgtcgtcgtcgttatcgcgttaggtttcggtcgcggttatttttcgtcgtttagggttttttcgtttcggtttcgggatttcggtttttcgttagtttcggtttcggtttcggtattatgtcggagaaaagcgtggaggtagcggtcgagttgagcgttaaggtacgggcgggggcggcggcggttcggatttcgcgtagttttggggttcggcgcggtttttcgttttaggtcgttttcgacggtttcgcgcggtttttgcgttcgggttttggcggattttattgcgtttttttatcgtttttcggttcggagtttttttttcggtttcgcgcggttagcgttagcgttttttagttgttttgcgcgtattacggcgttcggtttcgtcgtttcggtcgcgtcggttttcgtagtcgtttttattttttttcggttttatttcgttgatcggatttcgttcggtttttcgttcgaacgtttcgagttttattttgtcgcgttttttttttgcgtttcgttgtcgt

SEQ ID NO: 3792 - DNA, 1040 bp, Artificial Sequence
  chemically treated genomic DNA (Homo sapiens) CpG-island No: 3792
acgacaacgaaacgcaaaaaaaaaacgcgacaaaataaaactcgaaacgttcgaacgaaaaaccgaacgaaatccgatcaacgaaataaaaccgaaaaaaaataaaaacgactacgaaaaccgacgcgaccgaaacgacgaaaccgaacgccgtaatacgcgcaaaacaactaaaaaacgctaacgctaaccgcgcgaaaccgaaaaaaaaactccgaaccgaaaaacgataaaaaaacgcaataaaatccgccaaaacccgaacgcaaaaaccgcgcgaaaccgtcgaaaacgacctaaaacgaaaaaccgcgccgaaccccaaaactacgcgaaatccgaaccgccgccgcccccgcccgtaccttaacgctcaactcgaccgctacctccacgcttttctccgacataataccgaaaccgaaaccgaaactaacgaaaaaccgaaatcccgaaaccgaaacgaaaaaaccctaaacgacgaaaaataaccgcgaccgaaacctaacgcgataacgacgacgacgacgacaacgacaacgacgaccgctcgacaaactaaatctctaaaaaaaacgacaaaaacgcgcgaaataaaacgaaaataaatctaaaacgaaaacccgcaaaactacgaccgtccgaaaaacgaacgaaaaaacgatacaaacgataaccgacgcgctcgaccgcgataactcgatcccgaactcgccgcccccgcaccaacaaaataccgccgaccaaccgtaccgcccccgaaaaaaaaacccgcttataaaacgacgctacccgacgaaaaaaacttcccaaaaataaaacaaacgaaaacgaaaaaaaaaaaaaaaaaaaaaattataaaaaaaaaaattaaaaaaataaaaataaaaaaataaaaacgaaaaaaaaaaaaactaaaaaatcgaaaaaaaaaacgaaaccaaaaaaaaaaaataaaaaaactaacgaccgcgaaaaaaaaataaaacgaaaaaataaaaaaaaataaaattcctacgaaaaaacacctttccaaatcc

SEQ ID NO: 3793 - DNA, 974 bp, Artificial Sequence
  chemically treated genomic DNA (Homo sapiens) CpG-island No: 3793
gtggcgtcggtggtgacggcggatttttcggattgcgcgagcgtcgttcgcgtttcgttggtggtcgaggttttggttcggtgcggagtgtttaggtcgcgtagggtgttgcggaagttttcggcgttaaagtagtatattagcgggtttagtacgtagttggcgtcggttagtagtattattattattagtatttcgcgtacgcgatcgcgggtaggtacgttggtcgttattagtttgtttcgtagtagttcgtagatcgttagcgtgttgttgtagggtacgaagtatagtaggaagatgacgaggttagttagtaggaggcgtacggtttttcgtcgtcgttggttttgcgtggcgtcggggcgcgttagcgtttagaagattcggttcgacgagtagattatcgtcgttaggggtagtaggaagtttagcgtttcggttagtagtacgaggggtagtagtttgtttttttatagttcgtcgttgaagttttcgaagtataggcgtatttcgaggtttcggtagcggtaacgcgagggtttgtgtacgcgggcggcgggtacggtaaatattaggatgagcgtttatacgtttaggtagagtagtcgcgttacgcggggtcgtcgtaggtggcgtagtcgtagcgggtgtacgatggcggcgtagcggtttacgttgatgagtattaggaagatgtagttgtcgtatatgtttatttggaagatggcgttcgtcgtttggtataggaggtcggggaagggttagtggtgtagtgcgtagtaggagagacgaacgggtagcgagagggtgaagagtaggtcgttggtcgttaggttatatatgtatacgtttattatcgagtgtacgcgtagcgcgcgtaggaagatttagagggttagcgcgttgagggggagttcggtagttagtattaagttgtagattattaagtgtaggcggtgggtaggtcggta

SEQ ID NO: 3794 - DNA, 974 bp, Artificial Sequence
  chemically treated genomic DNA (Homo sapiens) CpG-island No: 3794
taccgacctacccaccgcctacacttaataatctacaacttaatactaactaccgaactccccctcaacgcgctaaccctctaaatcttcctacgcgcgctacgcgtacactcgataataaacgtatacatatataacctaacgaccaacgacctactcttcaccctctcgctacccgttcgtctctcctactacgcactacaccactaacccttccccgacctcctataccaaacgacgaacgccatcttccaaataaacatatacgacaactacatcttcctaatactcatcaacgtaaaccgctacgccgccatcgtacacccgctacgactacgccacctacgacgaccccgcgtaacgcgactactctacctaaacgtataaacgctcatcctaatatttaccgtacccgccgcccgcgtacacaaaccctcgcgttaccgctaccgaaacctcgaaatacgcctatacttcgaaaacttcaacgacgaactataaaaaaacaaactactacccctcgtactactaaccgaaacgctaaacttcctactacccctaacgacgataatctactcgtcgaaccgaatcttctaaacgctaacgcgccccgacgccacgcaaaaccaacgacgacgaaaaaccgtacgcctcctactaactaacctcgtcatcttcctactatacttcgtaccctacaacaacacgctaacgatctacgaactactacgaaacaaactaataacgaccaacgtacctacccgcgatcgcgtacgcgaaatactaataataataatactactaaccgacgccaactacgtactaaacccgctaatatactactttaacgccgaaaacttccgcaacaccctacgcgacctaaacactccgcaccgaaccaaaacctcgaccaccaacgaaacgcgaacgacgctcgcgcaatccgaaaaatccgccgtcaccaccgacgccac

SEQ ID NO: 3795 - DNA, 974 bp, Artificial Sequence
  chemically treated genomic DNA (Homo sapiens) CpG-island No: 3795
tatcgatttatttatcgtttgtatttggtggtttatagtttggtgttggttgtcgggtttttttttaacgcgttagttttttgggtttttttgcgcgcgttgcgcgtgtattcggtggtgagcgtgtatatgtgtaatttggcggttagcgatttgttttttattttttcgttgttcgttcgttttttttattacgtattgtattattggttttttttcgattttttgtgttagacgacgggcgttattttttagatgaatatgtacggtagttgtatttttttgatgtttattaacgtggatcgttacgtcgttatcgtgtattcgttgcgattgcgttatttgcggcggtttcgcgtggcgcggttgttttgtttgggcgtgtgggcgtttattttggtgtttgtcgtgttcgtcgttcgcgtgtataggttttcgcgttgtcgttatcgggatttcgaggtgcgtttatgtttcgagagttttagcgacgagttgtggaaaggtaggttgttgtttttcgtgttgttggtcgaggcgttgggttttttgttgtttttggcggcggtggtttattcgtcgggtcgagttttttggacgttggcgcgtttcgacgttacgtagagttagcggcggcggaagatcgtgcgttttttgttggttaatttcgttatttttttgttgtgtttcgtgttttataatagtacgttggcggtttacgggttgttgcggagtaagttggtggcggttagcgtgtttgttcgcgatcgcgtgcgcggggtgttgatggtgatggtgttgttggtcggcgttaattgcgtgttggattcgttggtgtattattttagcgtcgagggttttcgtaatattttgcgcggtttgggtatttcgtatcgggttaggatttcggttattaacgggacgcgggcggcgttcgcgtaattcgaaaggttcgtcgttattatcgacgttat

SEQ ID NO: 3796 - DNA, 974 bp, Artificial Sequence
  chemically treated genomic DNA (Homo sapiens) CpG-island No: 3796
ataacgtcgataataacgacgaacctttcgaattacgcgaacgccgcccgcgtcccgttaataaccgaaatcctaacccgatacgaaatacccaaaccgcgcaaaatattacgaaaaccctcgacgctaaaataatacaccaacgaatccaacacgcaattaacgccgaccaacaacaccatcaccatcaacaccccgcgcacgcgatcgcgaacaaacacgctaaccgccaccaacttactccgcaacaacccgtaaaccgccaacgtactattataaaacacgaaacacaacaaaaaaataacgaaattaaccaacaaaaaacgcacgatcttccgccgccgctaactctacgtaacgtcgaaacgcgccaacgtccaaaaaactcgacccgacgaataaaccaccgccgccaaaaacaacaaaaaacccaacgcctcgaccaacaacacgaaaaacaacaacctacctttccacaactcgtcgctaaaactctcgaaacataaacgcacctcgaaatcccgataacgacaacgcgaaaacctatacacgcgaacgacgaacacgacaaacaccaaaataaacgcccacacgcccaaacaaaacaaccgcgccacgcgaaaccgccgcaaataacgcaatcgcaacgaatacacgataacgacgtaacgatccacgttaataaacatcaaaaaaatacaactaccgtacatattcatctaaaaaataacgcccgtcgtctaacacaaaaaatcgaaaaaaaaccaataatacaatacgtaataaaaaaaacgaacgaacaacgaaaaaataaaaaacaaatcgctaaccgccaaattacacatatacacgctcaccaccgaatacacgcgcaacgcgcgcaaaaaaacccaaaaaactaacgcgttaaaaaaaaacccgacaaccaacaccaaactataaaccaccaaatacaaacgataaataaatcgata

SEQ ID NO: 3797 - DNA, 507 bp, Artificial Sequence
  chemically treated genomic DNA (Homo sapiens) CpG-island No: 3797
gtgacgcgcgcgcgcgcgttcgaagggggcgtggttagtggttgtttgagcgacgagggggcgggggttgttcgggagatttggggaggagggtggcggtagtggaaggggggggttggagttggttgaggttattatgggttgttcgtgggggggcggggtttgtgcggtgggatttttcggtcggtgttttaggttttttaagaggcgacgttggagtcggagttattttttttttttcggtcgcggcgaggaggagtcggagcgggagtgatatcgagtcggatttagcgcgatttgcggcggtttcggggtgaggagagcgcggggtttttaaagagacgttttttacggttttattagtttcgagggttatttcgttattcgttttttttttaggcgttttcggattcgcggatcgttttttgtttagaggagtcgatttttttttttttggttttgtagggcgttcggttttttttttagttttcgttttaattttgtcgg

SEQ ID NO: 3798 - DNA, 507 bp, Artificial Sequence
  chemically treated genomic DNA (Homo sapiens) CpG-island No: 3798
ccgacaaaattaaaacgaaaactaaaaaaaaaaccgaacgccctacaaaaccaaaaaaaaaaaaatcgactcctctaaacaaaaaacgatccgcgaatccgaaaacgcctaaaaaaaaaacgaataacgaaataaccctcgaaactaataaaaccgtaaaaaacgtctctttaaaaaccccgcgctctcctcaccccgaaaccgccgcaaatcgcgctaaatccgactcgatatcactcccgctccgactcctcctcgccgcgaccgaaaaaaaaaaaataactccgactccaacgtcgcctcttaaaaaacctaaaacaccgaccgaaaaatcccaccgcacaaaccccgcccccccacgaacaacccataataacctcaaccaactccaaccccccccttccactaccgccaccctcctccccaaatctcccgaacaacccccgccccctcgtcgctcaaacaaccactaaccacgcccccttcgaacgcgcgcgcgcgcgtcac

SEQ ID NO: 3799 - DNA, 507 bp, Artificial Sequence
  chemically treated genomic DNA (Homo sapiens) CpG-island No: 3799
tcggtagggttagggcgggggttggggaggaggtcgggcgttttgtagggttaggaaaggaagggtcggtttttttgggtaaggggcggttcgcgggttcggagacgtttgaggaaggggcgggtgacgggatgattttcggggttggtagggtcgtgaggggcgtttttttgggaatttcgcgttttttttatttcggagtcgtcgtaggtcgcgttgggttcggttcggtgttattttcgtttcggttttttttcgtcgcggtcgaaggggggaaaatggtttcggttttagcgtcgttttttaaagggtttgaaatatcggtcgggaaattttatcgtataggtttcgtttttttacggatagtttataataattttaattaattttaattttttttttttattatcgttatttttttttttaggtttttcgggtaattttcgttttttcgtcgtttaggtaattattggttacgtttttttcgagcgcgcgcgcgcgcgttat

SEQ ID NO: 3800 - DNA, 507 bp, Artificial Sequence
  chemically treated genomic DNA (Homo sapiens) CpG-island No: 3800
ataacgcgcgcgcgcgcgctcgaaaaaaacgtaaccaataattacctaaacgacgaaaaaacgaaaattacccgaaaaacctaaaaaaaaaaataacgataataaaaaaaaaaaattaaaattaattaaaattattataaactatccgtaaaaaaacgaaacctatacgataaaatttcccgaccgatatttcaaaccctttaaaaaacgacgctaaaaccgaaaccattttccccccttcgaccgcgacgaaaaaaaaccgaaacgaaaataacaccgaaccgaacccaacgcgacctacgacgactccgaaataaaaaaaacgcgaaattcccaaaaaaacgcccctcacgaccctaccaaccccgaaaatcatcccgtcacccgccccttcctcaaacgtctccgaacccgcgaaccgccccttacccaaaaaaaccgacccttcctttcctaaccctacaaaacgcccgacctcctccccaacccccgccctaaccctaccga

SEQ ID NO: 3801 - DNA, 604 bp, Artificial Sequence
  chemically treated genomic DNA (Homo sapiens) CpG-island No: 3801
  misc_feature (457)..(458): n is either a, c, g or t
  misc_feature (555)..(555): n is either a, c, g or t
ggattcgcgttcgtattcgaagattttatacgtttttcgtattgtttttatagtattttacgttcgcggtgtacgtttatttgtcggtagacgagttatacgtttcggcggtttagattttcgtgtcgattttcgtgggcgagtttacgcgttgggtgttcggcgcgtttttaggagtggttgggatcgcgggttggcgtcgggtagggcggtgggacgtttggagtcggcgggaggagtacgtttaggcgggttcgcgtcgagttcgagcgagcgggcgagtcgggcgggaggggttatttgtaatcgagtagacgttattatcgttttttattcgcggggggcgggggcgggcggttaggtgacggcggtttatttttcgtcgtcgagtcgggtggtttttgttcgggaggagttttttggcgcggtttgattgggattcgcggcgtagttgcgnngggaggggggatacgtgatcgttcgggttaggggggttcggggggttttatttcgcgaatgggtatttatgttttttttttggaaaatcgggggganatagagaaggcggaggagtacgcgcgggtgtaagagaagtttagtagtt

SEQ ID NO: 3802 - DNA, 604 bp, Artificial Sequence
  chemically treated genomic DNA (Homo sapiens) CpG-island No: 3802
  misc_feature (50)..(50): n is either a, c, g or t
  misc_feature (147)..(148): n is either a, c, g or t
aactactaaacttctcttacacccgcgcgtactcctccgccttctctatntccccccgattttccaaaaaaaaaacataaatacccattcgcgaaataaaaccccccgaacccccctaacccgaacgatcacgtatcccccctcccnncgcaactacgccgcgaatcccaatcaaaccgcgccaaaaaactcctcccgaacaaaaaccacccgactcgacgacgaaaaataaaccgccgtcacctaaccgcccgcccccgccccccgcgaataaaaaacgataataacgtctactcgattacaaataacccctcccgcccgactcgcccgctcgctcgaactcgacgcgaacccgcctaaacgtactcctcccgccgactccaaacgtcccaccgccctacccgacgccaacccgcgatcccaaccactcctaaaaacgcgccgaacacccaacgcgtaaactcgcccacgaaaatcgacacgaaaatctaaaccgccgaaacgtataactcgtctaccgacaaataaacgtacaccgcgaacgtaaaatactataaaaacaatacgaaaaacgtataaaatcttcgaatacgaacgcgaatcc

SEQ ID NO: 3803 - DNA, 604 bp, Artificial Sequence
  chemically treated genomic DNA (Homo sapiens) CpG-island No: 3803
  misc_feature (50)..(50): n is either a, c, g or t
  misc_feature (147)..(148): n is either a, c, g or t
ggttgttaagttttttttatattcgcgcgtgttttttcgttttttttgtnttttttcggttttttaaaggagaaatatgggtgtttattcgcgaaatggggtttttcgggtttttttggttcgggcggttacgtgtttttttttttnncgtaattgcgtcgcgagttttaattagatcgcgttagggggtttttttcgggtaggaattattcggttcggcggcggagggtgggtcgtcgttatttgatcgttcgttttcgtttttcgcgagtaaggggcggtggtagcgtttgttcggttataaatggtttttttcgttcggttcgttcgttcgttcgggttcggcgcggattcgtttgggcgtgtttttttcgtcggttttaggcgttttatcgttttgttcggcgttagttcgcggttttagttatttttgagggcgcgtcgggtatttagcgcgtaggttcgtttacggaggtcgatacggaagtttggatcgtcgaggcgtgtggttcgtttatcggtaggtgagcgtgtatcgcgggcgtgggatgttgtggggatagtgcgggggacgtgtggggttttcggatgcgaacgcgagttt

SEQ ID NO: 3804 - DNA, 604 bp, Artificial Sequence
  chemically treated genomic DNA (Homo sapiens) CpG-island No: 3804
  misc_feature (457)..(458): n is either a, c, g or t
  misc_feature (555)..(555): n is either a, c, g or t
aaactcgcgttcgcatccgaaaaccccacacgtcccccgcactatccccacaacatcccacgcccgcgatacacgctcacctaccgataaacgaaccacacgcctcgacgatccaaacttccgtatcgacctccgtaaacgaacctacgcgctaaatacccgacgcgccctcaaaaataactaaaaccgcgaactaacgccgaacaaaacgataaaacgcctaaaaccgacgaaaaaaacacgcccaaacgaatccgcgccgaacccgaacgaacgaacgaaccgaacgaaaaaaaccatttataaccgaacaaacgctaccaccgccccttactcgcgaaaaacgaaaacgaacgatcaaataacgacgacccaccctccgccgccgaaccgaataattcctacccgaaaaaaaccccctaacgcgatctaattaaaactcgcgacgcaattacgnnaaaaaaaaaaacacgtaaccgcccgaaccaaaaaaacccgaaaaaccccatttcgcgaataaacacccatatttctcctttaaaaaaccgaaaaaanacaaaaaaaacgaaaaaacacgcgcgaatataaaaaaaacttaacaacc

SEQ ID NO: 3805 - DNA, 529 bp, Artificial Sequence
  chemically treated genomic DNA (Homo sapiens) CpG-island No: 3805
cgtcggtttttatttaggtcgaggtggttcggttttatgtatcgcgacgtaacgcggggaggtagataaggtatagggcggcgtttataatttatgttaattcgttttatgtgttcgtcgaggcggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgtttgatgaattttcgg

SEQ ID NO: 3806 - DNA, 529 bp, Artificial Sequence
  chemically treated genomic DNA (Homo sapiens) CpG-island No: 3806
ccgaaaattcatcaaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgcctcgacgaacacataaaacgaattaacataaattataaacgccgccctataccttatctacctccccgcgttacgtcgcgatacataaaaccgaaccacctcgacctaaataaaaaccgacg

SEQ ID NO: 3807 - DNA, 529 bp, Artificial Sequence
  chemically treated genomic DNA (Homo sapiens) CpG-island No: 3807
tcgaaagtttattaagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgtttcggcgagtatatggaacgggttggtatggattgtaggcgtcgttttatattttgtttgttttttcgcgttgcgtcgcggtgtatggagtcgggttatttcgatttgaatggaagtcggcg

SEQ ID NO: 3808 - DNA, 529 bp, Artificial Sequence
  chemically treated genomic DNA (Homo sapiens) CpG-island No: 3808
cgccgacttccattcaaatcgaaataacccgactccatacaccgcgacgcaacgcgaaaaaacaaacaaaatataaaacgacgcctacaatccataccaacccgttccatatactcgccgaaacgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgcttaataaactttcga

SEQ ID NO: 3809 - DNA, 527 bp, Artificial Sequence
  chemically treated genomic DNA (Homo sapiens) CpG-island No: 3809
atcgcggcgcgcgcggtttcgattcgggtttttaggggcggcgcgcgggagggggcggggtttgcgcggtagcgtgggcgttaggcgcgcgggaggagggagtcgggaggagggggcggggtcgcgtcgttcgcgtcgcgttgggcgttttcggttaatgagcggcgtttatatgtcgcggcggcggcgaaaggggaggtagcggtcgataaatgttattagagtagtcgtcgcggagtcgttttcgacgttatttttttttttttcgtcgtagtttttttcgtcgttgtcgggcgtgcggcgttgagggattcgggcgagcgcgtcgcgtatcgtttcgtcggttcgtttttttcgtcgcgtttcgtttttagtggtttgtcgggcgttttttttttcggttcgggcggggtttttgatcgttttaagagagcggggagggggttcgggggtcgcggtttgttttttcggcgggcggttgagggcgagggaggtttttttttttggcgaggggagggagggtgggt

SEQ ID NO: 3810 - DNA, 527 bp, Artificial Sequence
  chemically treated genomic DNA (Homo sapiens) CpG-island No: 3810
acccaccctccctcccctcgccaaaaaaaaaaacctccctcgccctcaaccgcccgccgaaaaaacaaaccgcgacccccgaaccccctccccgctctcttaaaacgatcaaaaaccccgcccgaaccgaaaaaaaaaacgcccgacaaaccactaaaaacgaaacgcgacgaaaaaaacgaaccgacgaaacgatacgcgacgcgctcgcccgaatccctcaacgccgcacgcccgacaacgacgaaaaaaactacgacgaaaaaaaaaaaaataacgtcgaaaacgactccgcgacgactactctaataacatttatcgaccgctacctcccctttcgccgccgccgcgacatataaacgccgctcattaaccgaaaacgcccaacgcgacgcgaacgacgcgaccccgccccctcctcccgactccctcctcccgcgcgcctaacgcccacgctaccgcgcaaaccccgccccctcccgcgcgccgcccctaaaaacccgaatcgaaaccgcgcgcgccgcgat

SEQ ID NO: 3811 - DNA, 527 bp, Artificial Sequence
  chemically treated genomic DNA (Homo sapiens) CpG-island No: 3811
atttatttttttttttttcgttagaagggagggtttttttcgtttttagtcgttcgtcgggagggtaggtcgcggttttcgagtttttttttcgtttttttgaggcgattagaggtttcgttcgggtcggaggagggggcgttcggtagattattgagggcggaacgcggcgagggaggcgagtcggcggggcggtgcgcggcgcgttcgttcgggttttttagcgtcgtacgttcgatagcggcggaggaaattgcggcgaaggaaaaggaggtggcgtcggggacggtttcgcggcggttgttttaatagtatttatcggtcgttgttttttttttcgtcgtcgtcgcggtatgtggacgtcgtttattggtcgagagcgtttagcgcggcgcgggcggcgcggtttcgtttttttttttcggtttttttttttcgcgcgtttggcgtttacgttgtcgcgtaggtttcgttttttttcgcgcgtcgtttttaggaattcggatcgaggtcgcgcgcgtcgcggt

SEQ ID NO: 3812 - DNA, 527 bp, Artificial Sequence
  chemically treated genomic DNA (Homo sapiens) CpG-island No: 3812
accgcgacgcgcgcgacctcgatccgaattcctaaaaacgacgcgcgaaaaaaaacgaaacctacgcgacaacgtaaacgccaaacgcgcgaaaaaaaaaaaccgaaaaaaaaaaacgaaaccgcgccgcccgcgccgcgctaaacgctctcgaccaataaacgacgtccacataccgcgacgacgacgaaaaaaaaaacaacgaccgataaatactattaaaacaaccgccgcgaaaccgtccccgacgccacctccttttccttcgccgcaatttcctccgccgctatcgaacgtacgacgctaaaaaacccgaacgaacgcgccgcgcaccgccccgccgactcgcctccctcgccgcgttccgccctcaataatctaccgaacgccccctcctccgacccgaacgaaacctctaatcgcctcaaaaaaacgaaaaaaaaactcgaaaaccgcgacctaccctcccgacgaacgactaaaaacgaaaaaaaccctcccttctaacgaaaaaaaaaaaaataaat

SEQ ID NO: 3813 - DNA, 723 bp, Artificial Sequence
  chemically treated genomic DNA (Homo sapiens) CpG-island No: 3813
gggggcgcggggtgatttagcgttcggcgaggcggaagcggtcgtaagaggaggaggggagagttcgttcgcgtttgggttttcggggtggtacgagttcgcggtcggagtgcgaggcggaggcgaggaggtcgcggggacgggaggcgaggtcggtcgggttttcgaagttatggagaacgcgtatattaagacggtggaggaggtgttgggttatttcggcgttaacgagagtacggggttgagtttggaataggttaagaagtttaaggagagatggggttttaacggtaggtgtagggcgtttcgttgtaggggttcggcgcggtcgggagagttagggaagatggttgatcgggttttatttcgtgggtttcggtttcgcgttcgtcgatagttgcgggcggagggtcgggttagcgcgtcggtttcgcgggagagaaaggggttgcggttttcgtttcgttttttttggattttttcgtttttcgggttttcgattttttcggcgcgtaaggttcggaggtttttttttagtagtagtcggtttcggtggagggagggacgtggtttttgtagttaggttgagttcggtaagacgttttttcgttttttgtcgatttatgaggagtcgaggtcgttggaaggtttttgatcgtttttgttttatttaaagttatatatttggtagaagtgatgatatcgttgaaattatttttaggt

SEQ ID NO: 3814 - DNA, 723 bp, Artificial Sequence
  chemically treated genomic DNA (Homo sapiens) CpG-island No: 3814
acctaaaaataatttcaacgatatcatcacttctaccaaatatataactttaaataaaacaaaaacgatcaaaaaccttccaacgacctcgactcctcataaatcgacaaaaaacgaaaaaacgtcttaccgaactcaacctaactacaaaaaccacgtccctccctccaccgaaaccgactactactaaaaaaaaacctccgaaccttacgcgccgaaaaaatcgaaaacccgaaaaacgaaaaaatccaaaaaaaacgaaacgaaaaccgcaacccctttctctcccgcgaaaccgacgcgctaacccgaccctccgcccgcaactatcgacgaacgcgaaaccgaaacccacgaaataaaacccgatcaaccatcttccctaactctcccgaccgcgccgaacccctacaacgaaacgccctacacctaccgttaaaaccccatctctccttaaacttcttaacctattccaaactcaaccccgtactctcgttaacgccgaaataacccaacacctcctccaccgtcttaatatacgcgttctccataacttcgaaaacccgaccgacctcgcctcccgtccccgcgacctcctcgcctccgcctcgcactccgaccgcgaactcgtaccaccccgaaaacccaaacgcgaacgaactctcccctcctcctcttacgaccgcttccgcctcgccgaacgctaaatcaccccgcgccccc

SEQ ID NO: 3815 - DNA, 723 bp, Artificial Sequence
  chemically treated genomic DNA (Homo sapiens) CpG-island No: 3815
atttaggagtggttttagcgatgttattatttttgttagatgtgtaattttgggtaggataagaacggttagaggttttttaacgatttcgattttttataaatcggtaggggacgagaaaacgttttgtcgggtttaatttagttgtagaagttacgtttttttttttatcggggtcggttgttgttggagagaagttttcgagttttgcgcgtcgaaaaggtcgagggttcgagaagcgaagaggtttagggaaggcgaggcgaggatcgtagtttttttttttttcgcggggtcggcgcgttggttcgatttttcgttcgtagttgtcggcgggcgcggagtcgaagtttacgaggtggagttcggttagttattttttttggttttttcggtcgcgtcgggtttttgtagcggagcgttttgtatttatcgttggagttttatttttttttaagttttttgatttgttttaggtttagtttcgtattttcgttgacgtcgaagtggtttagtattttttttatcgttttggtgtgcgcgttttttatggtttcgggggttcggtcggtttcgtttttcgttttcgcggttttttcgttttcgtttcgtatttcggtcgcgggttcgtgttatttcgggagtttaggcgcggacgggttttttttttttttttttgcggtcgttttcgtttcgtcgggcgttgaattatttcgcgttttt

SEQ ID NO: 3816 - DNA, 723 bp, Artificial Sequence
  chemically treated genomic DNA (Homo sapiens) CpG-island No: 3816
aaaaacgcgaaataattcaacgcccgacgaaacgaaaacgaccgcaaaaaaaaaaaaaaaaaacccgtccgcgcctaaactcccgaaataacacgaacccgcgaccgaaatacgaaacgaaaacgaaaaaaccgcgaaaacgaaaaacgaaaccgaccgaacccccgaaaccataaaaaacgcgcacaccaaaacgataaaaaaaatactaaaccacttcgacgtcaacgaaaatacgaaactaaacctaaaacaaatcaaaaaacttaaaaaaaaataaaactccaacgataaatacaaaacgctccgctacaaaaacccgacgcgaccgaaaaaaccaaaaaaaataactaaccgaactccacctcgtaaacttcgactccgcgcccgccgacaactacgaacgaaaaatcgaaccaacgcgccgaccccgcgaaaaaaaaaaaaactacgatcctcgcctcgccttccctaaacctcttcgcttctcgaaccctcgaccttttcgacgcgcaaaactcgaaaacttctctccaacaacaaccgaccccgataaaaaaaaaaacgtaacttctacaactaaattaaacccgacaaaacgttttctcgtcccctaccgatttataaaaaatcgaaatcgttaaaaaacctctaaccgttcttatcctacccaaaattacacatctaacaaaaataataacatcgctaaaaccactcctaaat

SEQ ID NO: 3817 - DNA, 816 bp, Artificial Sequence
  chemically treated genomic DNA (Homo sapiens) CpG-island No: 3817
  misc_feature (453)..(453): n is either a, c, g or t
  misc_feature (560)..(560): n is either a, c, g or t
gttgtatacgtttgattcggttatttgtttattcgattattaagcgaaatatcgtatcgagcgagtacgtattcggatggaagtcggttttgtcgattaggatgatttggacgaagagtattaggggttcgcgttagtcgaatttgttgttaggtttaaggcgcgtatgttcgacggcgaggatttcgtcgtgatttatggcgatgtttgtttgtcgaatattatggtggaaaatggtcgtttttttggatttatcgattgtggtcggttgggtgtggcggatcgttattaggatatagcgttggttattcgtgatattgttgaagagtttggcggcgaatgggttgatcgttttttcgtgttttacggtatcgtcgttttcgattcgtagcgtatcgttttttatcgtttttttgacgaatttttttgagcgggattttggggttcgaaatnatcgattaagcgacgtttaatttgttattacgagatttcgattttatcgtcgttttttatgaaaggttgggtttcggaatcgtttttcgggacgtcggttggatgantttttagcgcggggattttatgttggagtttttcgtttatttcgggttcgattttttcgcgagttggtttagttgttgtttgaggttggacgatttcgcggagttttatcggtagtgtaaattcgtcggtatttaggaaattagtagcggttattcgcgtatttatgttttcgaattgtaggagtggggaggtacgatggtcgttttggttcggatttttgtgaaggaattttatttttgtggtgtgatataattg

SEQ ID NO: 3818 - DNA, 816 bp, Artificial Sequence
  chemically treated genomic DNA (Homo sapiens) CpG-island No: 3818
  misc_feature (257)..(257): n is either a, c, g or t
  misc_feature (364)..(364): n is either a, c, g or t
caattatatcacaccacaaaaataaaattccttcacaaaaatccgaaccaaaacgaccatcgtacctccccactcctacaattcgaaaacataaatacgcgaataaccgctactaatttcctaaataccgacgaatttacactaccgataaaactccgcgaaatcgtccaacctcaaacaacaactaaaccaactcgcgaaaaaatcgaacccgaaataaacgaaaaactccaacataaaatccccgcgctaaaaantcatccaaccgacgtcccgaaaaacgattccgaaacccaacctttcataaaaaacgacgataaaatcgaaatctcgtaataacaaattaaacgtcgcttaatcgatnatttcgaaccccaaaatcccgctcaaaaaaattcgtcaaaaaaacgataaaaaacgatacgctacgaatcgaaaacgacgataccgtaaaacacgaaaaaacgatcaacccattcgccgccaaactcttcaacaatatcacgaataaccaacgctatatcctaataacgatccgccacacccaaccgaccacaatcgataaatccaaaaaaacgaccattttccaccataatattcgacaaacaaacatcgccataaatcacgacgaaatcctcgccgtcgaacatacgcgccttaaacctaacaacaaattcgactaacgcgaacccctaatactcttcgtccaaatcatcctaatcgacaaaaccgacttccatccgaatacgtactcgctcgatacgatatttcgcttaataatcgaataaacaaataaccgaatcaaacgtatacaac

SEQ ID NO: 3819 - DNA, 816 bp, Artificial Sequence
  chemically treated genomic DNA (Homo sapiens) CpG-island No: 3819
  misc_feature (257)..(257): n is either a, c, g or t
  misc_feature (364)..(364): n is either a, c, g or t
taattatgttatattatagaagtaaggtttttttataaagattcggattaaagcggttatcgtgtttttttatttttgtagttcgggggtatggatgcgcggatagtcgttgttggttttttggatgtcgacggatttgtattgtcggtagaatttcgcgaggtcgtttagttttaggtagtagttgaattaattcgcgaggggatcgagttcggggtgggcgaagaattttagtatgagattttcgcgttggaggnttatttagtcggcgtttcggaaaacgatttcgaagtttaattttttatagaaggcggcggtggaatcgaaatttcgtgatggtaggttgggcgtcgtttggtcggtnatttcgaattttagagtttcgtttagaagaattcgttaagaaggcgatagaaggcgatgcgttgcgaatcgggagcggcgatatcgtaaagtacgaggaagcggttagtttattcgtcgttaagttttttagtaatattacgggtagttaacgttatgttttgatagcggttcgttatatttagtcggttatagtcgatgaatttagaaaagcggttattttttattatgatattcggtaagtaggtatcgttatgggttacgacgagattttcgtcgtcgggtatgcgcgttttgagtttggtaataagttcggttggcgcgagtttttgatgtttttcgtttagattattttgatcgataagatcggtttttattcgagtacgtgttcgttcgatgcgatgtttcgtttggtggtcgaatgggtaggtagtcggattaagcgtatgtagt

SEQ ID NO: 3820 - DNA, 816 bp, Artificial Sequence
  chemically treated genomic DNA (Homo sapiens) CpG-island No: 3820
  misc_feature (453)..(453): n is either a, c, g or t
  misc_feature (560)..(560): n is either a, c, g or t
actacatacgcttaatccgactacctacccattcgaccaccaaacgaaacatcgcatcgaacgaacacgtactcgaataaaaaccgatcttatcgatcaaaataatctaaacgaaaaacatcaaaaactcgcgccaaccgaacttattaccaaactcaaaacgcgcatacccgacgacgaaaatctcgtcgtaacccataacgatacctacttaccgaatatcataataaaaaataaccgcttttctaaattcatcgactataaccgactaaatataacgaaccgctatcaaaacataacgttaactacccgtaatattactaaaaaacttaacgacgaataaactaaccgcttcctcgtactttacgatatcgccgctcccgattcgcaacgcatcgccttctatcgccttcttaacgaattcttctaaacgaaactctaaaattcgaaatnaccgaccaaacgacgcccaacctaccatcacgaaatttcgattccaccgccgccttctataaaaaattaaacttcgaaatcgttttccgaaacgccgactaaataancctccaacgcgaaaatctcatactaaaattcttcgcccaccccgaactcgatcccctcgcgaattaattcaactactacctaaaactaaacgacctcgcgaaattctaccgacaatacaaatccgtcgacatccaaaaaaccaacaacgactatccgcgcatccatacccccgaactacaaaaataaaaaaacacgataaccgctttaatccgaatctttataaaaaaaccttacttctataatataacataatta

SEQ ID NO: 3821 - DNA, 704 bp, Artificial Sequence
  chemically treated genomic DNA (Homo sapiens) CpG-island No: 3821
tgtcgtcggtttttatttaggtcgaggtggttcggttttatgtatcgcgacgtaacgcggggaggtagataaggtatagggcggcgtttataatttatgttaattcgttttatgtgttcgtcgaggcggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcggtcgaggaattttcggcggttttgttgtgcgataggtttacgtttaaaaggaaataaattatgggtta

SEQ ID NO: 3822 - DNA, 704 bp, Artificial Sequence
  chemically treated genomic DNA (Homo sapiens) CpG-island No: 3822
taacccataatttatttccttttaaacgtaaacctatcgcacaacaaaaccgccgaaaattcctcgaccgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgcctcgacgaacacataaaacgaattaacataaattataaacgccgccctataccttatctacctccccgcgttacgtcgcgatacataaaaccgaaccacctcgacctaaataaaaaccgacgaca

SEQ ID NO: 3823 - DNA, 704 bp, Artificial Sequence
  chemically treated genomic DNA (Homo sapiens) CpG-island No: 3823
tgatttatgatttatttttttttagacgtgagtttgtcgtatagtaaagtcgtcgaaagtttttcgatcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgtttcggcgagtatatggaacgggttggtatggattgtaggcgtcgttttatattttgtttgttttttcgcgttgcgtcgcggtgtatggagtcgggttatttcgatttgaatggaagtcggcggta

SEQ ID NO: 3824 - DNA, 704 bp, Artificial Sequence
  chemically treated genomic DNA (Homo sapiens) CpG-island No: 3824
taccgccgacttccattcaaatcgaaataacccgactccatacaccgcgacgcaacgcgaaaaaacaaacaaaatataaaacgacgcctacaatccataccaacccgttccatatactcgccgaaacgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgatcgaaaaactttcgacgactttactatacgacaaactcacgtctaaaaaaaaataaatcataaatca

SEQ ID NO: 3825 - DNA, 1260 bp, Artificial Sequence
  chemically treated genomic DNA (Homo sapiens) CpG-island No: 3825
cgcggcggttcgttttttttttacgattagggtcgggaattgcgggtgcgcggggcgggagtcgggcgggtttaggcgcggtcgatacgtggggagggaggtcgcggtttaggaggcgggttcggagtgggtgtgggtgtgttcgtgcgtgggagaaattaattttagtttttttcgaggcgttacgttttagtacggttcgttgggttcgggaggtcggaaattagtttttacgtttcggatttttttttggagggataacgaatataggcgcgggacggtttcggttacgttcgcgtcgttttttgttttcgtgtttgttcgcgcgttattttcgtttcggtgcggtggtagggttcggcgcgacgttatttattgtttataaattaattcgagtcggtaggatttcggttttagcggttgtaggcgcgtggttcgagtgtttggcgggttttggttttcgcgttcgttttttgtttcggtttcgttcgtagtttcgcgtttcgcggtaataagtttttagcgaagttcgtatagtttcgggtgttaggacggggggttatgtcgtgtcggagggaggaggaagaggaagtcggcgaggaggcggagggggaggaagaggaggacgatagtttttttttgttgtagtagtcggtgacgttgggtagttcgggcgaggtggatcggttggtggtttagatcggcgagacgttgtagttggacgcggcgtagatagttcggtttcgtcgtgcgcgttttcgggggtgtcgttgcgggtttcggggtttttgttgcgcggtgtcgacggataaggttcggttttcggcggtgtcgttgttgttgtcgttcgtttcggttgagacggtggttcggcgttttttgggttttgtcgtgcgttttaggggatcgcggcgcgtgcgcggacgtcgtgcgttttattgcgtggcggaggtcgtcgtaggttttagcgcgttgtcggggtcgtgtcggcgaggatggtttagggacgcggttatttttcgtcgtttgtagtagcgtcgatggatttaagtcgggggtacgcgtcggcgacgacgattcgtatcggtttttttagtagttcgtgttttcggggaaaattttattaaggaagtcgtgcggagattttaacgagtcgtcgtcgcggttgtagttacgggtttcgtaagcgtttttgggttcgggggaggtcgtagcggatttgatcgtattgttttgtagtttttaggttttttgttttga

SEQ ID NO: 3826 - DNA, 1260 bp, Artificial Sequence
  chemically treated genomic DNA (Homo sapiens) CpG-island No: 3826
tcaaaacaaaaaacctaaaaactacaaaacaatacgatcaaatccgctacgacctcccccgaacccaaaaacgcttacgaaacccgtaactacaaccgcgacgacgactcgttaaaatctccgcacgacttccttaataaaattttccccgaaaacacgaactactaaaaaaaccgatacgaatcgtcgtcgccgacgcgtacccccgacttaaatccatcgacgctactacaaacgacgaaaaataaccgcgtccctaaaccatcctcgccgacacgaccccgacaacgcgctaaaacctacgacgacctccgccacgcaataaaacgcacgacgtccgcgcacgcgccgcgatcccctaaaacgcacgacaaaacccaaaaaacgccgaaccaccgtctcaaccgaaacgaacgacaacaacaacgacaccgccgaaaaccgaaccttatccgtcgacaccgcgcaacaaaaaccccgaaacccgcaacgacacccccgaaaacgcgcacgacgaaaccgaactatctacgccgcgtccaactacaacgtctcgccgatctaaaccaccaaccgatccacctcgcccgaactacccaacgtcaccgactactacaacaaaaaaaaactatcgtcctcctcttcctccccctccgcctcctcgccgacttcctcttcctcctccctccgacacgacataaccccccgtcctaacacccgaaactatacgaacttcgctaaaaacttattaccgcgaaacgcgaaactacgaacgaaaccgaaacaaaaaacgaacgcgaaaaccaaaacccgccaaacactcgaaccacgcgcctacaaccgctaaaaccgaaatcctaccgactcgaattaatttataaacaataaataacgtcgcgccgaaccctaccaccgcaccgaaacgaaaataacgcgcgaacaaacacgaaaacaaaaaacgacgcgaacgtaaccgaaaccgtcccgcgcctatattcgttatccctccaaaaaaaaatccgaaacgtaaaaactaatttccgacctcccgaacccaacgaaccgtactaaaacgtaacgcctcgaaaaaaactaaaattaatttctcccacgcacgaacacacccacacccactccgaacccgcctcctaaaccgcgacctccctccccacgtatcgaccgcgcctaaacccgcccgactcccgccccgcgcacccgcaattcccgaccctaatcgtaaaaaaaaaacgaaccgccgcg

SEQ ID NO: 3827 - DNA, 1260 bp, Artificial Sequence
  chemically treated genomic DNA (Homo sapiens) CpG-island No: 3827
ttagagtaaggagtttgagggttgtagggtaatgcggttaggttcgttgcggtttttttcgggtttaggggcgtttgcggggttcgtggttgtaatcgcggcgacggttcgttggagttttcgtacggtttttttgatgaggtttttttcgagagtacgagttgttggaggagtcgatgcgggtcgtcgtcgtcggcgcgtgttttcggtttgggtttatcggcgttgttgtaagcggcgggaggtgatcgcgtttttgagttattttcgtcggtacggtttcggtagcgcgttggggtttgcggcgattttcgttacgtagtagggcgtacggcgttcgcgtacgcgtcgcggttttttagggcgtacggtagggtttagagggcgtcgggttatcgttttagtcgaagcgggcggtagtagtagcggtatcgtcgggggtcgggttttgttcgtcggtatcgcgtagtaggggtttcggggttcgtagcggtattttcgggggcgcgtacggcgaggtcgggttgtttgcgtcgcgtttagttgtagcgtttcgtcgatttgggttattagtcggtttatttcgttcgagttgtttagcgttatcgattgttgtagtaggaggaagttgtcgttttttttttttttttttttcgttttttcgtcggttttttttttttttttttttcggtacggtatggtttttcgttttggtattcggagttgtgcgggtttcgttgggggtttgttgtcgcggggcgcggagttgcgggcgaagtcggagtagggggcggacgcggaagttagagttcgttaggtattcgagttacgcgtttgtagtcgttggagtcggaattttgtcggttcgggttgatttgtaaataatgggtgacgtcgcgtcgggttttattatcgtatcggggcgggggtgacgcgcgagtaggtacgggggtaaagggcggcgcgggcgtgatcgaagtcgtttcgcgtttgtgttcgttgtttttttaggagggggttcggggcgtggggattgattttcgatttttcgggtttaacgagtcgtgttgaaacgtggcgtttcggaggaggttgaggttggttttttttacgtacggatatatttatatttatttcgggttcgttttttgggtcgcggtttttttttttacgtgtcggtcgcgtttaagttcgttcgattttcgtttcgcgtattcgtagttttcggttttggtcgtgggggaggggcgggtcgtcgcg

SEQ ID NO: 3828 - DNA, 1260 bp, Artificial Sequence
  chemically treated genomic DNA (Homo sapiens) CpG-island No: 3828
cgcgacgacccgcccctcccccacgaccaaaaccgaaaactacgaatacgcgaaacgaaaatcgaacgaacttaaacgcgaccgacacgtaaaaaaaaaaaccgcgacccaaaaaacgaacccgaaataaatataaatatatccgtacgtaaaaaaaaccaacctcaacctcctccgaaacgccacgtttcaacacgactcgttaaacccgaaaaatcgaaaatcaatccccacgccccgaaccccctcctaaaaaaacaacgaacacaaacgcgaaacgacttcgatcacgcccgcgccgccctttacccccgtacctactcgcgcgtcacccccgccccgatacgataataaaacccgacgcgacgtcacccattatttacaaatcaacccgaaccgacaaaattccgactccaacgactacaaacgcgtaactcgaatacctaacgaactctaacttccgcgtccgccccctactccgacttcgcccgcaactccgcgccccgcgacaacaaacccccaacgaaacccgcacaactccgaataccaaaacgaaaaaccataccgtaccgaaaaaaaaaaaaaaaaaaaaccgacgaaaaaacgaaaaaaaaaaaaaaaaaaaacgacaacttcctcctactacaacaatcgataacgctaaacaactcgaacgaaataaaccgactaataacccaaatcgacgaaacgctacaactaaacgcgacgcaaacaacccgacctcgccgtacgcgcccccgaaaataccgctacgaaccccgaaacccctactacgcgataccgacgaacaaaacccgacccccgacgataccgctactactaccgcccgcttcgactaaaacgataacccgacgccctctaaaccctaccgtacgccctaaaaaaccgcgacgcgtacgcgaacgccgtacgccctactacgtaacgaaaatcgccgcaaaccccaacgcgctaccgaaaccgtaccgacgaaaataactcaaaaacgcgatcacctcccgccgcttacaacaacgccgataaacccaaaccgaaaacacgcgccgacgacgacgacccgcatcgactcctccaacaactcgtactctcgaaaaaaacctcatcaaaaaaaccgtacgaaaactccaacgaaccgtcgccgcgattacaaccacgaaccccgcaaacgcccctaaacccgaaaaaaaccgcaacgaacctaaccgcattaccctacaaccctcaaactccttactctaa

SEQ ID NO: 3829 - DNA, 519 bp, Artificial Sequence
  chemically treated genomic DNA (Homo sapiens) CpG-island No: 3829
ttcgtgggtggtcgcgagcgttttcgttgggaagttttgggcgggtatcggtttataggtttcgttcgtgggtgtgcgagcgcgtcggtgtttttcgttttttcgggttttttttacgcggacgcggtgatcgttttattttcgttcggttcgttcgttacggttattattttgttcgcgatatttgcgtttgagattcggcgggaggagcgggcggagaagttatcggtcggattcgtggggttcgttttggtttgtaggcgtttgatttttatttttcgattttttcgtagggagcgagtttttcggtaattcgtatagttatttttagtatacggtttataacgaggtttggagatttagtaatttcgttttattaagtgagtacgttatttggttggtcggcggtttagcgcggtcgcgcggtttttgggtacggttttattttcggcgattcgatttttggggattcggtcgggttagggggataggtttgttagtgtagtattgaggttcggg

SEQ ID NO: 3830 - DNA, 519 bp, Artificial Sequence
  chemically treated genomic DNA (Homo sapiens) CpG-island No: 3830
cccgaacctcaatactacactaacaaacctatccccctaacccgaccgaatccccaaaaatcgaatcgccgaaaataaaaccgtacccaaaaaccgcgcgaccgcgctaaaccgccgaccaaccaaataacgtactcacttaataaaacgaaattactaaatctccaaacctcgttataaaccgtatactaaaaataactatacgaattaccgaaaaactcgctccctacgaaaaaatcgaaaaataaaaatcaaacgcctacaaaccaaaacgaaccccacgaatccgaccgataacttctccgcccgctcctcccgccgaatctcaaacgcaaatatcgcgaacaaaataataaccgtaacgaacgaaccgaacgaaaataaaacgatcaccgcgtccgcgtaaaaaaaacccgaaaaaacgaaaaacaccgacgcgctcgcacacccacgaacgaaacctataaaccgatacccgcccaaaacttcccaacgaaaacgctcgcgaccacccacgaa

SEQ ID NO: 3831 - DNA, 519 bp, Artificial Sequence
  chemically treated genomic DNA (Homo sapiens) CpG-island No: 3831
ttcgggttttagtgttgtattaataagtttgtttttttggttcggtcgggtttttagaggtcgggtcgtcgggagtgggatcgtgtttagaagtcgcgcggtcgcgttgagtcgtcggttagttaggtggcgtatttatttagtaaggcggggttgttgaatttttaagtttcgttgtaggtcgtgtattgggggtggttgtacgggttgtcggagaattcgttttttgcgggagggtcggggagtggggattagacgtttgtaagttagggcggattttacgagttcggtcggtggttttttcgttcgtttttttcgtcgggttttaggcgtaggtgtcgcgggtagggtaatggtcgtggcgggcgggtcgggcggaggtggggcgattatcgcgttcgcgtggagagagttcggggaggcgggaggtatcgacgcgttcgtatatttacgggcgggatttgtgggtcggtgttcgtttagggttttttagcggaggcgttcgcggttatttacgaa

SEQ ID NO: 3832 - DNA, 519 bp, Artificial Sequence
  chemically treated genomic DNA (Homo sapiens) CpG-island No: 3832
ttcgtaaataaccgcgaacgcctccgctaaaaaaccctaaacgaacaccgacccacaaatcccgcccgtaaatatacgaacgcgtcgatacctcccgcctccccgaactctctccacgcgaacgcgataatcgccccacctccgcccgacccgcccgccacgaccattaccctacccgcgacacctacgcctaaaacccgacgaaaaaaacgaacgaaaaaaccaccgaccgaactcgtaaaatccgccctaacttacaaacgtctaatccccactccccgaccctcccgcaaaaaacgaattctccgacaacccgtacaaccacccccaatacacgacctacaacgaaacttaaaaattcaacaaccccgccttactaaataaatacgccacctaactaaccgacgactcaacgcgaccgcgcgacttctaaacacgatcccactcccgacgacccgacctctaaaaacccgaccgaaccaaaaaaacaaacttattaatacaacactaaaacccgaa

SEQ ID NO: 3833 - DNA, 575 bp, Artificial Sequence
  chemically treated genomic DNA (Homo sapiens) CpG-island No: 3833
gtcgttgtttatgatcgttattagttatcgcggggattatattaagttttaggtcgatagtttcggtttttatatcgttttcgtttgattttatttcggagggagggaggatcgacgcgacgcgatgtttttcggttatcgttttagttttattttattttacgattttcgtaattttttatattatttttttcgaaggtcggataggacgggtggagtcgtgggcgggatttttaggttcgggttcgtcgtttttagtttcgtttgtcgttttttttcgtttgtttggattgcgcggcgtcgtgagggggattcggtttagttcgtttcggtttttattaagttagtttcgaagttcgttagttattttgtcggattcgggcgcgatttgttggcgcgcgtcggatgtttttgtgatatataattagcgcggatcgtagcgcggtttagtttcgggtattcgtttcggacgttcgggcgttaggaggtttcgttggaggggttgggttaaggagattaagaagaaaacgattttttgtaggaggaagagttcgttgtcgaatttttgggaaaaa

SEQ ID NO: 3834 - DNA, 575 bp, Artificial Sequence
  chemically treated genomic DNA (Homo sapiens) CpG-island No: 3834
tttttcccaaaaattcgacaacgaactcttcctcctacaaaaaatcgttttcttcttaatctccttaacccaacccctccaacgaaacctcctaacgcccgaacgtccgaaacgaatacccgaaactaaaccgcgctacgatccgcgctaattatatatcacaaaaacatccgacgcgcgccaacaaatcgcgcccgaatccgacaaaataactaacgaacttcgaaactaacttaataaaaaccgaaacgaactaaaccgaatccccctcacgacgccgcgcaatccaaacaaacgaaaaaaaacgacaaacgaaactaaaaacgacgaacccgaacctaaaaatcccgcccacgactccacccgtcctatccgaccttcgaaaaaaataatataaaaaattacgaaaatcgtaaaataaaataaaactaaaacgataaccgaaaaacatcgcgtcgcgtcgatcctccctccctccgaaataaaatcaaacgaaaacgatataaaaaccgaaactatcgacctaaaacttaatataatccccgcgataactaataacgatcataaacaacgac

SEQ ID NO: 3835 - DNA, 575 bp, Artificial Sequence
  chemically treated genomic DNA (Homo sapiens) CpG-island No: 3835
ttttttttagggattcggtagcgggtttttttttttgtagaaagtcgttttttttttaatttttttggtttagtttttttagcgaagttttttggcgttcgagcgttcgaggcgggtgttcggggttgggtcgcgttgcggttcgcgttgattgtgtgttatagaaatattcggcgcgcgttagtaggtcgcgttcgagttcggtagggtggttggcgggtttcggggttggtttggtggaggtcgggacgagttgggtcgaattttttttacggcgtcgcgtagtttaggtaggcggggaggggcggtaggcggggttgggggcggcgggttcgggtttgagggtttcgtttacggttttattcgttttgttcgattttcgaggggggtgatgtgaagggttgcgggggtcgtgggatggggtgaggttggggcggtggtcgggaggtatcgcgtcgcgtcggtttttttttttttcggggtggggttagacggggacgatgtggaggtcgaagttgtcggtttgaagtttgatgtggttttcgcggtaattagtggcggttataggtagcggt

SEQ ID NO: 3836 - DNA, 575 bp, Artificial Sequence
  chemically treated genomic DNA (Homo sapiens) CpG-island No: 3836
accgctacctataaccgccactaattaccgcgaaaaccacatcaaacttcaaaccgacaacttcgacctccacatcgtccccgtctaaccccaccccgaaaaaaaaaaaaaccgacgcgacgcgatacctcccgaccaccgccccaacctcaccccatcccacgacccccgcaacccttcacatcacccccctcgaaaatcgaacaaaacgaataaaaccgtaaacgaaaccctcaaacccgaacccgccgcccccaaccccgcctaccgcccctccccgcctacctaaactacgcgacgccgtaaaaaaaattcgacccaactcgtcccgacctccaccaaaccaaccccgaaacccgccaaccaccctaccgaactcgaacgcgacctactaacgcgcgccgaatatttctataacacacaatcaacgcgaaccgcaacgcgacccaaccccgaacacccgcctcgaacgctcgaacgccaaaaaacttcgctaaaaaaactaaaccaaaaaaattaaaaaaaaaacgactttctacaaaaaaaaaaacccgctaccgaatccctaaaaaaaa

SEQ ID NO: 3837 - DNA, 815 bp, Artificial Sequence
  chemically treated genomic DNA (Homo sapiens) CpG-island No: 3837
tttcgtataggtcggttcgaagaagcggaaggagggatgtcggcgggggttatttatcgcgattacgatcgtgttttttttttgaaatttggcgatgtatttgtcgtcgcggtttattttagattcgttgagaggtttgaagcgatatattattttgatgttgtattcggttaggttcgttatttttttcgtagtcggggtcggcggtcgggagttatttttcgtcgtttagttttgtagggaacgcgtcggatttgagggtttgtggtcgcgagggtcgtgagaggtagtagttagttgcgtcgcgttgcgttttttcgggtggaggcggtcggggagtcgggatttgaagagtcggcgtcggtagtcgttaattttaatgtttattttcgatttattatggtagttatggcggcggcggcggcggcggtatcggggagagcgttcgcggttttttagcgtttttttttacggtttgggcggattgcgggggttggggaggttttggggatcgggagagtggttatttttttttttttcgcgaagagtaggtcgggtttattcgttcgttcgttttgtcgttcgttggtcggtcgattgttgttcgattatttttgaggtcgtcgttgggcgatagggcggtgcgggaggaggattgcgtaggcgtagtgggttaggcggttcggcgattaatcggtgcgcgcgttcgtattttgtcgcggcggtcgggttgttgtttttattattatttttggttcggggtcgtagatttaaattttattgtattgtttttgtcgtagaagtttttggggagg

SEQ ID NO: 3838 - DNA, 815 bp, Artificial Sequence
  chemically treated genomic DNA (Homo sapiens) CpG-island No: 3838
cctccccaaaaacttctacgacaaaaacaatacaataaaatttaaatctacgaccccgaaccaaaaataataataaaaacaacaacccgaccgccgcgacaaaatacgaacgcgcgcaccgattaatcgccgaaccgcctaacccactacgcctacgcaatcctcctcccgcaccgccctatcgcccaacgacgacctcaaaaataatcgaacaacaatcgaccgaccaacgaacgacaaaacgaacgaacgaataaacccgacctactcttcgcgaaaaaaaaaaaaataaccactctcccgatccccaaaacctccccaacccccgcaatccgcccaaaccgtaaaaaaaaacgctaaaaaaccgcgaacgctctccccgataccgccgccgccgccgccgccataactaccataataaatcgaaaataaacattaaaattaacgactaccgacgccgactcttcaaatcccgactccccgaccgcctccacccgaaaaaacgcaacgcgacgcaactaactactacctctcacgaccctcgcgaccacaaaccctcaaatccgacgcgttccctacaaaactaaacgacgaaaaataactcccgaccgccgaccccgactacgaaaaaaataacgaacctaaccgaatacaacatcaaaataatatatcgcttcaaacctctcaacgaatctaaaataaaccgcgacgacaaatacatcgccaaatttcaaaaaaaaaacacgatcgtaatcgcgataaataacccccgccgacatccctccttccgcttcttcgaaccgacctatacgaaa

SEQ ID NO: 3839 - DNA, 815 bp, Artificial Sequence
  chemically treated genomic DNA (Homo sapiens) CpG-island No: 3839
tttttttaggaatttttgcgataggggtagtgtagtaaaatttgaatttgcgatttcgggttaggagtggtggtggaaatagtagttcggtcgtcgcggtagggtgcgagcgcgcgtatcgattggtcgtcgggtcgtttggtttattgcgtttgcgtagtttttttttcgtatcgttttgtcgtttaacggcggttttaggagtgatcgggtagtagtcggtcggttagcggacggtagagcgggcggacgggtaggttcggtttgtttttcgcgaggaggaagaaggtggttattttttcggtttttagaatttttttagttttcgtagttcgtttagatcgtaaagggggacgttgaggagtcgcggacgtttttttcggtgtcgtcgtcgtcgtcgtcgttatggttgttatgatggatcggaagtgagtattagggttaacggttgtcggcgtcggttttttaagtttcggtttttcggtcgtttttattcggggaagcgtagcgcggcgtagttgattgttgttttttacggttttcgcgattataagtttttaggttcggcgcgttttttgtaagattgagcggcggggagtggttttcggtcgtcggtttcggttgcgagaaagatggcggatttggtcgagtgtaatattaaagtgatgtgtcgttttagattttttaacgagtttgaagtgaatcgcggcgataagtatatcgttaagttttagggagaagatacggtcgtgatcgcggtgagtgattttcgtcggtattttttttttcgttttttcgggtcggtttgtgcgggg

SEQ ID NO: 3840 - DNA, 815 bp, Artificial Sequence
  chemically treated genomic DNA (Homo sapiens) CpG-island No: 3840
ccccgcacaaaccgacccgaaaaaacgaaaaaaaaaataccgacgaaaatcactcaccgcgatcacgaccgtatcttctccctaaaacttaacgatatacttatcgccgcgattcacttcaaactcgttaaaaaatctaaaacgacacatcactttaatattacactcgaccaaatccgccatctttctcgcaaccgaaaccgacgaccgaaaaccactccccgccgctcaatcttacaaaaaacgcgccgaacctaaaaacttataatcgcgaaaaccgtaaaaaacaacaatcaactacgccgcgctacgcttccccgaataaaaacgaccgaaaaaccgaaacttaaaaaaccgacgccgacaaccgttaaccctaatactcacttccgatccatcataacaaccataacgacgacgacgacgacgacaccgaaaaaaacgtccgcgactcctcaacgtccccctttacgatctaaacgaactacgaaaactaaaaaaattctaaaaaccgaaaaaataaccaccttcttcctcctcgcgaaaaacaaaccgaacctacccgtccgcccgctctaccgtccgctaaccgaccgactactacccgatcactcctaaaaccgccgttaaacgacaaaacgatacgaaaaaaaaactacgcaaacgcaataaaccaaacgacccgacgaccaatcgatacgcgcgctcgcaccctaccgcgacgaccgaactactatttccaccaccactcctaacccgaaatcgcaaattcaaattttactacactacccctatcgcaaaaattcctaaaaaaa

SEQ ID NO: 3841 - DNA, 689 bp, Artificial Sequence
  chemically treated genomic DNA (Homo sapiens) CpG-island No: 3841
  misc_feature (62)..(62): n is either a, c, g or t
  misc_feature (81)..(81): n is either a, c, g or t
  misc_feature (280)..(280): n is either a, c, g or t
  misc_feature (360)..(360): n is either a, c, g or t
  misc_feature (586)..(586): n is either a, c, g or t
  misc_feature (623)..(623): n is either a, c, g or t
  misc_feature (625)..(625): n is either a, c, g or t
  misc_feature (630)..(630): n is either a, c, g or t
  misc_feature (637)..(637): n is either a, c, g or t
  misc_feature (639)..(639): n is either a, c, g or t
  misc_feature (643)..(643): n is either a, c, g or t
  misc_feature (655)..(655): n is either a, c, g or t
tgtcgtcggtttttatttaggtcgaggtggttcggttttatgtatcgcgacgtaacgcgggnaagtagataaggtataggncggcgtttataatttatgttaattcgttttatgtgttcgtcgaggcggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcganaagaattattatggggaaggttatttagtttcgcgtcgcgaacgttagtaagacgtagtttagcgcgtcggtcgttatgncggcgataatggtttgtttttcgtcgaaacgtttggtggcgggattagtgacgacggtttgagcgagggcgtgtaagatttcgaatatcgtaagcgataggtcgattatcgtcgcgttttaacgaaagcggttttcgtcgaaaatgatttagagcgttgtcggtatttgttttacgagttgtatgataaagaagatagttataagtgcggcgacgatagttatgtntcgcgtttatcggaaaggagttgattgggttgaaggntnttaanggtattngncgangaattttcggtngttttgttgtgcggataggtttacgtttaaaagg

SEQ ID NO: 3842 - DNA, 689 bp, Artificial Sequence
  chemically treated genomic DNA (Homo sapiens) CpG-island No: 3842
  misc_feature (35)..(35): n is either a, c, g or t
  misc_feature (47)..(47): n is either a, c, g or t
  misc_feature (51)..(51): n is either a, c, g or t
  misc_feature (53)..(53): n is either a, c, g or t
  misc_feature (60)..(60): n is either a, c, g or t
  misc_feature (65)..(65): n is either a, c, g or t
  misc_feature (67)..(67): n is either a, c, g or t
  misc_feature (104)..(104): n is either a, c, g or t
  misc_feature (330)..(330): n is either a, c, g or t
  misc_feature (410)..(410): n is either a, c, g or t
  misc_feature (609)..(609): n is either a, c, g or t
  misc_feature (628)..(628): n is either a, c, g or t
ccttttaaacgtaaacctatccgcacaacaaaacnaccgaaaattcntcgncnaataccnttaananccttcaacccaatcaactcctttccgataaacgcganacataactatcgtcgccgcacttataactatcttctttatcatacaactcgtaaaacaaataccgacaacgctctaaatcattttcgacgaaaaccgctttcgttaaaacgcgacgataatcgacctatcgcttacgatattcgaaatcttacacgccctcgctcaaaccgtcgtcactaatcccgccaccaaacgtttcgacgaaaaacaaaccattatcgccgncataacgaccgacgcgctaaactacgtcttactaacgttcgcgacgcgaaactaaataaccttccccataataattcttntcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgcctcgacgaacacataaaacgaattaacataaattataaacgccgncctataccttatctacttncccgcgttacgtcgcgatacataaaaccgaaccacctcgacctaaataaaaaccgacgaca

SEQ ID NO: 3843 - DNA, 689 bp, Artificial Sequence
  chemically treated genomic DNA (Homo sapiens) CpG-island No: 3843
  misc_feature (35)..(35): n is either a, c, g or t
  misc_feature (47)..(47): n is either a, c, g or t
  misc_feature (51)..(51): n is either a, c, g or t
  misc_feature (53)..(53): n is either a, c, g or t
  misc_feature (60)..(60): n is either a, c, g or t
  misc_feature (65)..(65): n is either a, c, g or t
  misc_feature (67)..(67): n is either a, c, g or t
  misc_feature (104)..(104): n is either a, c, g or t
  misc_feature (330)..(330): n is either a, c, g or t
  misc_feature (410)..(410): n is either a, c, g or t
  misc_feature (609)..(609): n is either a, c, g or t
  misc_feature (628)..(628): n is either a, c, g or t
ttttttagacgtgagtttgttcgtatagtaaagtngtcgaaagtttntcgntngatgttnttganantttttaatttagttagttttttttcggtgggcgcggngtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagtcgtcgttattggtttcgttattaaacgtttcggcgagaagtaggttattatcgtcgntatggcggtcgacgcgttgggttacgttttgttggcgttcgcgacgcgaggttggatggttttttttataatgatttttntcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgtttcggcgagtatatggaacgggttggtatggattgtaggcgtcgntttatattttgtttgtttnttcgcgttgcgtcgcggtgtatggagtcgggttatttcgatttgaatggaagtcggcggta

SEQ ID NO: 3844 - DNA, 689 bp, Artificial Sequence
  chemically treated genomic DNA (Homo sapiens) CpG-island No: 3844
  misc_feature (62)..(62): n is either a, c, g or t
  misc_feature (81)..(81): n is either a, c, g or t
  misc_feature (280)..(280): n is either a, c, g or t
  misc_feature (360)..(360): n is either a, c, g or t
  misc_feature (586)..(586): n is either a, c, g or t
  misc_feature (623)..(623): n is either a, c, g or t
  misc_feature (625)..(625): n is either a, c, g or t
  misc_feature (630)..(630): n is either a, c, g or t
  misc_feature (637)..(637): n is either a, c, g or t
  misc_feature (639)..(639): n is either a, c, g or t
  misc_feature (643)..(643): n is either a, c, g or t
  misc_feature (655)..(655): n is either a, c, g or t
taccgccgacttccattcaaatcgaaataacccgactccatacaccgcgacgcaacgcgaanaaacaaacaaaatataaancgacgcctacaatccataccaacccgttccatatactcgccgaaacgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacganaaaaatcattataaaaaaaaccatccaacctcgcgtcgcgaacgccaacaaaacgtaacccaacgcgtcgaccgccatancgacgataataacctacttctcgccgaaacgtttaataacgaaaccaataacgacgacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcatacnccgcgcccaccgaaaaaaaactaactaaattaaaaantntcaanaacatcnancganaaactttcgacnactttactatacgaacaaactcacgtctaaaaaa

SEQ ID NO: 3845 - DNA, 816 bp, Artificial Sequence
  chemically treated genomic DNA (Homo sapiens) CpG-island No: 3845
  misc_feature (32)..(32): n is either a, c, g or t
  misc_feature (47)..(48): n is either a, c, g or t
  misc_feature (288)..(288): n is either a, c, g or t
  misc_feature (332)..(332): n is either a, c, g or t
  misc_feature (390)..(390): n is either a, c, g or t
  misc_feature (542)..(542): n is either a, c, g or t
  misc_feature (544)..(544): n is either a, c, g or t
  misc_feature (566)..(566): n is either a, c, g or t
  misc_feature (570)..(570): n is either a, c, g or t
  misc_feature (585)..(586): n is either a, c, g or t
  misc_feature (591)..(591): n is either a, c, g or t
  misc_feature (602)..(602): n is either a, c, g or t
  misc_feature (608)..(608): n is either a, c, g or t
  misc_feature (610)..(610): n is either a, c, g or t
  misc_feature (631)..(631): n is either a, c, g or t
  misc_feature (637)..(637): n is either a, c, g or t
ggatgcgcggatagtcgttgttggttttttgnatgtcgacggatttnnattgtcggtagaatttcgcgaggtcgtttagttttaggtagtagttgaattaattcgcgaggggatcgagttcggggtgggcgaagaattttagtatgagattttcgcgttggaggattatttagtcggcgtttcggaaaacgatttcgaagtttaattttttatagaaggcggcggtggaatcgaaatttcgtgatggtaggttgggcgtcgtttggtcggttatttcgaattttagantttcgtttagaagaattcgtgtaagaaggcgatagaaggcgatncgttgcgaatcgggagcggcgatatcgtaaagtacgaggaagcggttagtttattcgncgttaagttttttagtaatattacgggtagttaacgttatgttttgatacggttcgttatatttagtcggttatagtcgatgaatttagaaaagcggttattttttattatgatattcggtaagtaggtatcgttatgggttacgacgagantntcgtcgtcgggtatgcgcgttntgantttggcgaatagttnngttgngcgcgagtttntgatgntnttcgtttagattattttgatngataanatcggtttttattcgagtacgtgttcgttcgatgcgatgtttcgtttggtggtcgaatgggtaggtagtcggattaagcgtatgtagtcgtcgtattgtattagttatgatggatattttttcggtaggagtaaggtgagatgataggagattttgtttcggtatttcgtttaatagta

SEQ ID NO: 3846 - DNA, 816 bp, Artificial Sequence
  chemically treated genomic DNA (Homo sapiens) CpG-island No: 3846
  misc_feature (180)..(180): n is either a, c, g or t
  misc_feature (186)..(186): n is either a, c, g or t
  misc_feature (207)..(207): n is either a, c, g or t
  misc_feature (209)..(209): n is either a, c, g or t
  misc_feature (215)..(215): n is either a, c, g or t
  misc_feature (226)..(226): n is either a, c, g or t
  misc_feature (231)..(232): n is either a, c, g or t
  misc_feature (247)..(247): n is either a, c, g or t
  misc_feature (251)..(251): n is either a, c, g or t
  misc_feature (273)..(273): n is either a, c, g or t
  misc_feature (275)..(275): n is either a, c, g or t
  misc_feature (427)..(427): n is either a, c, g or t
  misc_feature (485)..(485): n is either a, c, g or t
  misc_feature (529)..(529): n is either a, c, g or t
  misc_feature (769)..(770): n is either a, c, g or t
  misc_feature (785)..(785): n is either a, c, g or t
tactattaaacgaaataccgaaacaaaatctcctatcatctcaccttactcctaccgaaaaaatatccatcataactaatacaatacgacgactacatacgcttaatccgactacctacccattcgaccaccaaacgaaacatcgcatcgaacgaacacgtactcgaataaaaaccgatnttatcnatcaaaataatctaaacgaanancatcanaaactcgcgcncaacnnaactattcgccaaantcanaacgcgcatacccgacgacganantctcgtcgtaacccataacgatacctacttaccgaatatcataataaaaaataaccgcttttctaaattcatcgactataaccgactaaatataacgaaccgtatcaaaacataacgttaactacccgtaatattactaaaaaacttaacgncgaataaactaaccgcttcctcgtactttacgatatcgccgctcccgattcgcaacgnatcgccttctatcgccttcttacacgaattcttctaaacgaaantctaaaattcgaaataaccgaccaaacgacgcccaacctaccatcacgaaatttcgattccaccgccgccttctataaaaaattaaacttcgaaatcgttttccgaaacgccgactaaataatcctccaacgcgaaaatctcatactaaaattcttcgcccaccccgaactcgatcccctcgcgaattaattcaactactacctaaaactaaacgacctcgcgaaattctaccgacaatnnaaatccgtcgacatncaaaaaaccaacaacgactatccgcgcatcc

SEQ ID NO: 3847 - DNA, 816 bp, Artificial Sequence
  chemically treated genomic DNA (Homo sapiens) CpG-island No: 3847
  misc_feature (180)..(180): n is either a, c, g or t
  misc_feature (186)..(186): n is either a, c, g or t
  misc_feature (207)..(207): n is either a, c, g or t
  misc_feature (209)..(209): n is either a, c, g or t
  misc_feature (215)..(215): n is either a, c, g or t
  misc_feature (226)..(226): n is either a, c, g or t
  misc_feature (231)..(232): n is either a, c, g or t
  misc_feature (247)..(247): n is either a, c, g or t
  misc_feature (251)..(251): n is either a, c, g or t
  misc_feature (273)..(273): n is either a, c, g or t
  misc_feature (275)..(275): n is either a, c, g or t
  misc_feature (427)..(427): n is either a, c, g or t
  misc_feature (485)..(485): n is either a, c, g or t
  misc_feature (529)..(529): n is either a, c, g or t
  misc_feature (769)..(770): n is either a, c, g or t
  misc_feature (785)..(785): n is either a, c, g or t
tgttattgggcgaagtgtcggggtaggattttttgttattttattttgtttttgtcgagaaagtatttattatggttgatgtaatgcggcggttgtatacgtttgattcggttatttgtttattcgattattaagcgaaatatcgtatcgagcgagtacgtattcggatggaagtcggtnttgttnattaggatgatttggacgaanantattangggttcgcgtntaatnnaattgttcgttaggnttanggcgcgtatgttcgacggcgangntttcgtcgtgatttatggcgatgtttgtttgtcgaatattatggtggaaaatggtcgtttttttggatttatcgattgtggtcggttgggtgtggcggatcgtattaggatatagcgttggttattcgtgatattgttgaagagtttggcgncgaatgggttgatcgttttttcgtgttttacggtatcgtcgttttcgattcgtagcgnatcgttttttatcgtttttttatacgagtttttttgagcgggantttggggttcgaaatgatcgattaagcgacgtttaatttgttattacgagatttcgattttatcgtcgttttttatgaaaggttgggtttcggaatcgtttttcgggacgtcggttggatgattttttagcgcggggattttatgttggagtttttcgtttatttcgggttcgattttttcgcgagttggtttagttgttgtttgaggttggacgatttcgcggagttttatcggtagtnnaaattcgtcggtatntaggaaattagtagcggttattcgcgtattt

SEQ ID NO: 3848 - DNA, 816 bp, Artificial Sequence
  chemically treated genomic DNA (Homo sapiens) CpG-island No: 3848
  misc_feature (32)..(32): n is either a, c, g or t
  misc_feature (47)..(48): n is either a, c, g or t
  misc_feature (288)..(288): n is either a, c, g or t
  misc_feature (332)..(332): n is either a, c, g or t
  misc_feature (390)..(390): n is either a, c, g or t
  misc_feature (542)..(542): n is either a, c, g or t
  misc_feature (544)..(544): n is either a, c, g or t
  misc_feature (566)..(566): n is either a, c, g or t
  misc_feature (570)..(570): n is either a, c, g or t
  misc_feature (585)..(586): n is either a, c, g or t
  misc_feature (591)..(591): n is either a, c, g or t
  misc_feature (602)..(602): n is either a, c, g or t
  misc_feature (608)..(608): n is either a, c, g or t
  misc_feature (610)..(610): n is either a, c, g or t
  misc_feature (631)..(631): n is either a, c, g or t
  misc_feature (637)..(637): n is either a, c, g or t
aaatacgcgaataaccgctactaatttcctanataccgacgaatttnnactaccgataaaactccgcgaaatcgtccaacctcaaacaacaactaaaccaactcgcgaaaaaatcgaacccgaaataaacgaaaaactccaacataaaatccccgcgctaaaaaatcatccaaccgacgtcccgaaaaacgattccgaaacccaacctttcataaaaaacgacgataaaatcgaaatctcgtaataacaaattaaacgtcgcttaatcgatcatttcgaaccccaaantcccgctcaaaaaaactcgtataaaaaaacgataaaaaacgatncgctacgaatcgaaaacgacgataccgtaaaacacgaaaaaacgatcaacccattcgncgccaaactcttcaacaatatcacgaataaccaacgctatatcctaatacgatccgccacacccaaccgaccacaatcgataaatccaaaaaaacgaccattttccaccataatattcgacaaacaaacatcgccataaatcacgacgaaancntcgccgtcgaacatacgcgccntaancctaacgaacaattnnattanacgcgaacccntaatantnttcgtccaaatcatcctaatnaacaanaccgacttccatccgaatacgtactcgctcgatacgatatttcgcttaataatcgaataaacaaataaccgaatcaaacgtatacaaccgccgcattacatcaaccataataaatactttctcgacaaaaacaaaataaaataacaaaaaatcctaccccgacacttcgcccaataaca

SEQ ID NO: 3849 - DNA, 687 bp, Artificial Sequence
  chemically treated genomic DNA (Homo sapiens) CpG-island No: 3849
taaggggcggattttttcgttttttttaattcggcgatttacggaaaggggttgaggggtttttcgtttgggaaaagggttgttaaagattttaacggttttaaagttagacggagaatttcgattttcggattggttcggacggagattatcgtggggattcggattcgttatttttttttttttaggcgggtttcggtttttttttattcgagtgcggtttttgttttttcgtcggggttgcgggtttgtcgaggttacggagttagcgagggagacgggcgagaaaggttttttttttttaggaaagagagaacggttcgaaatgataggattttcgtttttcgggtgtcgatttttagttttatagttcggttttttttattttcggcgtcgtcgcggtatttttttaacggagattcgcgcgtttgcgtatgcgtcgttcgcgttttcgcggagtattgtttgcgcgtaggcgtagagcgggcgcgcgcggtggtgcggtagtttcgttttcggtttttttttgcggcgtcgggcgcgggttcgcggcggttagcgttttcggtcggtaggaggcggggcgaggcggaagcggcgtttgttttaggtggagtttgttagtttttgagaaagagttagggcgagtttaaggtattgtggtagttgtgagataaagtttggttt

SEQ ID NO: 3850 - DNA, 687 bp, Artificial Sequence
  chemically treated genomic DNA (Homo sapiens) CpG-island No: 3850
aaaccaaactttatctcacaactaccacaataccttaaactcgccctaactctttctcaaaaactaacaaactccacctaaaacaaacgccgcttccgcctcgccccgcctcctaccgaccgaaaacgctaaccgccgcgaacccgcgcccgacgccgcaaaaaaaaaccgaaaacgaaactaccgcaccaccgcgcgcgcccgctctacgcctacgcgcaaacaatactccgcgaaaacgcgaacgacgcatacgcaaacgcgcgaatctccgttaaaaaaataccgcgacgacgccgaaaataaaaaaaaccgaactataaaactaaaaatcgacacccgaaaaacgaaaatcctatcatttcgaaccgttctctctttcctaaaaaaaaaaaacctttctcgcccgtctccctcgctaactccgtaacctcgacaaacccgcaaccccgacgaaaaaacaaaaaccgcactcgaataaaaaaaaaccgaaacccgcctaaaaaaaaaaaaataacgaatccgaatccccacgataatctccgtccgaaccaatccgaaaatcgaaattctccgtctaactttaaaaccgttaaaatctttaacaacccttttcccaaacgaaaaacccctcaacccctttccgtaaatcgccgaattaaaaaaaacgaaaaaatccgcccctta

SEQ ID NO: 3851 - DNA, 687 bp, Artificial Sequence
  chemically treated genomic DNA (Homo sapiens) CpG-island No: 3851
gaattagattttattttatagttgttatagtgttttaaattcgttttaatttttttttaaaaattaatagattttatttgaagtaagcgtcgttttcgtttcgtttcgttttttgtcgatcggaagcgttggtcgtcgcgggttcgcgttcggcgtcgtagaggaagatcggaagcgaggttgtcgtattatcgcgcgcgttcgttttgcgtttgcgcgtaggtaatgtttcgcgggggcgcgggcggcgtatgcgtaggcgcgcgagttttcgttaagaaggtgtcgcggcggcgtcggaggtaggaggagtcgggttgtggggttgggagtcggtattcgggaggcggaggttttgttatttcgggtcgtttttttttttttaagggagaagagtttttttcgttcgtttttttcgttggtttcgtggtttcggtaggttcgtagtttcgacggagaggtaggagtcgtattcgggtggagaggggtcggggttcgtttggagggaggagggtggcggattcggatttttacggtggttttcgttcgggttagttcggggatcggggtttttcgtttgattttagagtcgttagagtttttggtagttttttttttagacggggaattttttagttttttttcgtaggtcgtcgggttgggggaagcgggagggttcgtttttta

SEQ ID NO: 3852 - DNA, 687 bp, Artificial Sequence
  chemically treated genomic DNA (Homo sapiens) CpG-island No: 3852
taaaaaacgaaccctcccgcttcccccaacccgacgacctacgaaaaaaaactaaaaaattccccgtctaaaaaaaaaactaccaaaaactctaacgactctaaaatcaaacgaaaaaccccgatccccgaactaacccgaacgaaaaccaccgtaaaaatccgaatccgccaccctcctccctccaaacgaaccccgacccctctccacccgaatacgactcctacctctccgtcgaaactacgaacctaccgaaaccacgaaaccaacgaaaaaaacgaacgaaaaaaactcttctcccttaaaaaaaaaaaaacgacccgaaataacaaaacctccgcctcccgaataccgactcccaaccccacaacccgactcctcctacctccgacgccgccgcgacaccttcttaacgaaaactcgcgcgcctacgcatacgccgcccgcgcccccgcgaaacattacctacgcgcaaacgcaaaacgaacgcgcgcgataatacgacaacctcgcttccgatcttcctctacgacgccgaacgcgaacccgcgacgaccaacgcttccgatcgacaaaaaacgaaacgaaacgaaaacgacgcttacttcaaataaaatctattaatttttaaaaaaaaattaaaacgaatttaaaacactataacaactataaaataaaatctaattc

SEQ ID NO: 3853 - DNA, 593 bp, Artificial Sequence
  chemically treated genomic DNA (Homo sapiens) CpG-island No: 3853
cgtaggcgtagcgtttttaatatcgttaacgggtataaagttacgtttttacggtcgaatttacgtttacgtatttagttattagcggaattttttttattaggtttcgcgtcgaggttttacggggcgttaatacgtacgcgtattttgtgttttaggtagttcgttttttagttatgtacgtttttgtatttcggttattgggagcggggtcgtgggggttgtatatgcgtattgcgagttttcgtttatttttagaaattattcgggcgtatacgcggtgcggtcgttgttttaggtcggcgggttttagggagatttgggtgggtagcgtcgtcgtttttttttttttgggtagtattttttttagcgttacgcggaggttgggttattatgaggtttgtgttgcgtcggggcggttcgttttagaggcgtttcggggaggagtgggcggttgaatggttagaggtttagggattcgtttaggttagcgttggcgttcgggtttgagtttggaggtggcgggtgttttataagaatgttcgcgtgattagtgtgttggcgtttgtgtatatagaggatattattaaaat

SEQ ID NO: 3854 - DNA, 593 bp, Artificial Sequence
  chemically treated genomic DNA (Homo sapiens) CpG-island No: 3854
attttaataatatcctctatatacacaaacgccaacacactaatcacgcgaacattcttataaaacacccgccacctccaaactcaaacccgaacgccaacgctaacctaaacgaatccctaaacctctaaccattcaaccgcccactcctccccgaaacgcctctaaaacgaaccgccccgacgcaacacaaacctcataataacccaacctccgcgtaacgctaaaaaaaatactacccaaaaaaaaaaaaacgacgacgctacccacccaaatctccctaaaacccgccgacctaaaacaacgaccgcaccgcgtatacgcccgaataatttctaaaaataaacgaaaactcgcaatacgcatatacaacccccacgaccccgctcccaataaccgaaatacaaaaacgtacataactaaaaaacgaactacctaaaacacaaaatacgcgtacgtattaacgccccgtaaaacctcgacgcgaaacctaataaaaaaaattccgctaataactaaatacgtaaacgtaaattcgaccgtaaaaacgtaactttatacccgttaacgatattaaaaacgctacgcctacg

SEQ ID NO: 3855 - DNA, 593 bp, Artificial Sequence
  chemically treated genomic DNA (Homo sapiens) CpG-island No: 3855
attttaataatgttttttgtgtatataaacgttaatatattgattacgcgagtatttttgtaaggtattcgttatttttaaatttaggttcggacgttagcgttgatttgaacggatttttgggtttttggttatttagtcgtttattttttttcggagcgtttttgagacggatcgtttcgacgtaatataaattttataatggtttagttttcgcgtggcgttgggaaaaatattgtttaagaaaggagaaacggcgacgttgtttatttaggtttttttggagttcgtcgatttgaagtagcggtcgtatcgcgtatgcgttcgggtggtttttgggagtaggcgaggattcgtagtgcgtatgtgtagtttttacggtttcgtttttagtgatcggaatgtagaggcgtatatggttaagagacgagttatttgggatataaagtacgcgtgcgtattgacgtttcgtagggtttcgacgcggagtttggtggagagggtttcgttggtgattgagtacgtaggcgtgagttcggtcgtgggggcgtggttttgtgttcgttggcggtgttgagaacgttgcgtttgcg

SEQ ID NO: 3856 - DNA, 593 bp, Artificial Sequence
  chemically treated genomic DNA (Homo sapiens) CpG-island No: 3856
cgcaaacgcaacgttctcaacaccgccaacgaacacaaaaccacgcccccacgaccgaactcacgcctacgtactcaatcaccaacgaaaccctctccaccaaactccgcgtcgaaaccctacgaaacgtcaatacgcacgcgtactttatatcccaaataactcgtctcttaaccatatacgcctctacattccgatcactaaaaacgaaaccgtaaaaactacacatacgcactacgaatcctcgcctactcccaaaaaccacccgaacgcatacgcgatacgaccgctacttcaaatcgacgaactccaaaaaaacctaaataaacaacgtcgccgtttctcctttcttaaacaatatttttcccaacgccacgcgaaaactaaaccattataaaatttatattacgtcgaaacgatccgtctcaaaaacgctccgaaaaaaaataaacgactaaataaccaaaaacccaaaaatccgttcaaatcaacgctaacgtccgaacctaaatttaaaaataacgaataccttacaaaaatactcgcgtaatcaatatattaacgtttatatacacaaaaaacattattaaaat

SEQ ID NO: 3857 - DNA, 638 bp, Artificial Sequence
  chemically treated genomic DNA (Homo sapiens) CpG-island No: 3857
gtaggagcgtcgttatggtaacggggtcgcgcgtacgtcgttatttgtgggtggagaaatgttcgcgcggaagttttcgtttttagtttggggcgtcggtggtcgtcgtcgtcgggaacgtcgttatggtaatcgtatcgtaggttagaggggtggagtagggggcggggaaatgcgagcgcgaaagttttcgttttcgggttgttgggcggcggcgatttagcggttcgtaaggatttgaaatcgtttggtaggggcggcggtggcggcggcgttggcggtagcggtcgagcggaaagtttgcgtgtggtggtgttaggttttcgtttttttttgaatttttttttttcgttttttttattaggtttttgagtggaattttgcgtcggtggttgtcgtttcgtttttgcgggttcgttcgggaaggggcgtcgtttttaggttttgggttcgtttttcgggtttggggggcgcgcgtttttggggtttcggcgttgttcgttgtggtgttttcggtaggtagagcgcgatttaggtcgggacgatttgggaaagttttaagtaaagtttgattagtcggtttgatcggtttgacgtggtttaagagtttgatttaagggtttgcgattgggagagga

SEQ ID NO: 3858 - DNA, 638 bp, Artificial Sequence
  chemically treated genomic DNA (Homo sapiens) CpG-island No: 3858
tcctctcccaatcgcaaacccttaaatcaaactcttaaaccacgtcaaaccgatcaaaccgactaatcaaactttacttaaaactttcccaaatcgtcccgacctaaatcgcgctctacctaccgaaaacaccacaacgaacaacgccgaaaccccaaaaacgcgcgccccccaaacccgaaaaacgaacccaaaacctaaaaacgacgccccttcccgaacgaacccgcaaaaacgaaacgacaaccaccgacgcaaaattccactcaaaaacctaataaaaaaaacgaaaaaaaaaaattcaaaaaaaaacgaaaacctaacaccaccacacgcaaactttccgctcgaccgctaccgccaacgccgccgccaccgccgcccctaccaaacgatttcaaatccttacgaaccgctaaatcgccgccgcccaacaacccgaaaacgaaaactttcgcgctcgcatttccccgccccctactccacccctctaacctacgatacgattaccataacgacgttcccgacgacgacgaccaccgacgccccaaactaaaaacgaaaacttccgcgcgaacatttctccacccacaaataacgacgtacgcgcgaccccgttaccataacgacgctcctac

SEQ ID NO: 3859 - DNA, 638 bp, Artificial Sequence
  chemically treated genomic DNA (Homo sapiens) CpG-island No: 3859
tttttttttagtcgtaaatttttgggttagatttttggattacgttagatcgattaaatcggttgattaaattttatttagaatttttttaagtcgtttcggtttggatcgcgttttgtttgtcggggatattatagcgggtagcgtcgggattttaggggcgcgcgttttttaggttcggagaacgggtttagggtttgagggcgacgttttttttcgaacgggttcgtaagggcggggcggtagttatcggcgtaaaattttatttaagaatttggtgggaggggcgggggaaggaaatttagaaaaaaacgagaatttggtattattatacgtaagtttttcgttcggtcgttgtcgttaacgtcgtcgttatcgtcgtttttgttaaacggttttaaatttttgcgggtcgttgggtcgtcgtcgtttagtagttcgggggcggggattttcgcgttcgtattttttcgttttttattttatttttttagtttgcggtgcggttgttatggcgacgttttcggcggcggcgattatcggcgttttaggttgggggcggagattttcgcgcgggtatttttttatttataggtggcggcgtgcgcgcggtttcgttgttatggcgacgtttttgt

SEQ ID NO: 3860 - DNA, 638 bp, Artificial Sequence
  chemically treated genomic DNA (Homo sapiens) CpG-island No: 3860
acaaaaacgtcgccataacaacgaaaccgcgcgcacgccgccacctataaataaaaaaatacccgcgcgaaaatctccgcccccaacctaaaacgccgataatcgccgccgccgaaaacgtcgccataacaaccgcaccgcaaactaaaaaaataaaataaaaaacgaaaaaatacgaacgcgaaaatccccgcccccgaactactaaacgacgacgacccaacgacccgcaaaaatttaaaaccgtttaacaaaaacgacgataacgacgacgttaacgacaacgaccgaacgaaaaacttacgtataataataccaaattctcgtttttttctaaatttccttcccccgcccctcccaccaaattcttaaataaaattttacgccgataactaccgccccgcccttacgaacccgttcgaaaaaaaacgtcgccctcaaaccctaaacccgttctccgaacctaaaaaacgcgcgcccctaaaatcccgacgctacccgctataatatccccgacaaacaaaacgcgatccaaaccgaaacgacttaaaaaaattctaaataaaatttaatcaaccgatttaatcgatctaacgtaatccaaaaatctaacccaaaaatttacgactaaaaaaaaa

SEQ ID NO: 3861 - DNA, 966 bp, Artificial Sequence
  chemically treated genomic DNA (Homo sapiens) CpG-island No: 3861
ggaagtcggtttcggggaggtagaagagggttttggggaggcggaagtaggtttcggggaggcggaagcgggttttggggaggcggaagcgggttttggggaggcggaagtgggtttcggggaggtagaagcgggttttggggaggcggaagtgggtttcggggagacggaagcgggtttcggggaggtagacgtatgtttcgggggacggggaagtgggtttcggggaggtagacgcgggtttcggcggagggggaagtgggtttcggggaggcggaagcgggttttggggaggcggaagtgggtttcggggaggcggaagcgggttttggggaggcggaagcgggtttcggggagatagaagcgggtttcggggaggcggaagcgggtttcggggaggcggaatcgggtttcggggaggcggaagcgggttttggggaggtagaagcgggttttggggaggcggaagtgggtttcggggaggtagacgtatgtttcgggggacggggaagtaggtttcggggaggcggaagcgggttttggggaggcggattcgggtttcggggaggtggaagcgggttttggggaggcggaagcgggtttcgggggacggggaagtgggttttagggaggcggacgcgggtttcggggaggcggaagtcggttttggggaggcggaagtgggtttcgggggagggggaagcgggtttcggggaggcggaagcgggttttggggaggcggaagtgggtttcggggaggcggaagcgggtttcggggaggcggaggcgggtttcggggaggcggaagcgggttttggggaggcggaagcgggttttggggaggcggaagagggtttcggggaggcggaagcgggttttggggaggtagaagtcggttgtattgcgtaggtcgagcgcgtttggggattatacgtgggggagtgaggttttatagttagtttttgg

SEQ ID NO: 3862 - DNA, 966 bp, Artificial Sequence
  chemically treated genomic DNA (Homo sapiens) CpG-island No: 3862
ccaaaaactaactataaaacctcactcccccacgtataatccccaaacgcgctcgacctacgcaatacaaccgacttctacctccccaaaacccgcttccgcctccccgaaaccctcttccgcctccccaaaacccgcttccgcctccccaaaacccgcttccgcctccccgaaacccgcctccgcctccccgaaacccgcttccgcctccccgaaacccacttccgcctccccaaaacccgcttccgcctccccgaaacccgcttccccctcccccgaaacccacttccgcctccccaaaaccgacttccgcctccccgaaacccgcgtccgcctccctaaaacccacttccccgtcccccgaaacccgcttccgcctccccaaaacccgcttccacctccccgaaacccgaatccgcctccccaaaacccgcttccgcctccccgaaacctacttccccgtcccccgaaacatacgtctacctccccgaaacccacttccgcctccccaaaacccgcttctacctccccaaaacccgcttccgcctccccgaaacccgattccgcctccccgaaacccgcttccgcctccccgaaacccgcttctatctccccgaaacccgcttccgcctccccaaaacccgcttccgcctccccgaaacccacttccgcctccccaaaacccgcttccgcctccccgaaacccacttccccctccgccgaaacccgcgtctacctccccgaaacccacttccccgtcccccgaaacatacgtctacctccccgaaacccgcttccgtctccccgaaacccacttccgcctccccaaaacccgcttctacctccccgaaacccacttccgcctccccaaaacccgcttccgcctccccaaaacccgcttccgcctccccgaaacctacttccgcctccccaaaaccctcttctacctccccgaaaccgacttcc

SEQ ID NO: 3863 - DNA, 966 bp, Artificial Sequence
  chemically treated genomic DNA (Homo sapiens) CpG-island No: 3863
ttagaagttggttgtgaaattttatttttttacgtgtggtttttaggcgcgttcggtttgcgtagtataatcggtttttgtttttttaggattcgttttcgttttttcggaattttttttcgtttttttaagattcgttttcgtttttttaggattcgttttcgttttttcggaattcgttttcgttttttcgggattcgttttcgttttttcggaatttattttcgtttttttaagattcgttttcgttttttcggaattcgtttttttttttttcggaatttattttcgtttttttaagatcggttttcgttttttcggaattcgcgttcgtttttttggaatttattttttcgtttttcggaattcgttttcgtttttttaggattcgtttttattttttcggaattcgaattcgtttttttaggattcgttttcgttttttcggaatttgttttttcgtttttcggaatatgcgtttgttttttcggaatttattttcgtttttttaagattcgtttttgtttttttaggattcgttttcgttttttcggaattcgatttcgttttttcgggattcgttttcgttttttcggaattcgtttttgttttttcggaattcgttttcgtttttttaagattcgttttcgttttttcgggatttattttcgtttttttaagattcgttttcgttttttcggaatttattttttttttcgtcggaattcgcgtttgttttttcggaatttattttttcgtttttcggaatatgcgtttgttttttcggaattcgttttcgttttttcggaatttattttcgtttttttaagattcgtttttgttttttcgggatttattttcgtttttttaagattcgttttcgtttttttaagattcgttttcgttttttcggaatttattttcgtttttttaagatttttttttgttttttcgggatcggttttt

SEQ ID NO: 3864 - DNA, 966 bp, Artificial Sequence
  chemically treated genomic DNA (Homo sapiens) CpG-island No: 3864
aaaaaccgatcccgaaaaaacaaaaaaaaatcttaaaaaaacgaaaataaattccgaaaaaacgaaaacgaatcttaaaaaaacgaaaacgaatcttaaaaaaacgaaaataaatcccgaaaaaacaaaaacgaatcttaaaaaaacgaaaataaattccgaaaaaacgaaaacgaattccgaaaaaacaaacgcatattccgaaaaacgaaaaaataaattccgaaaaaacaaacgcgaattccgacgaaaaaaaaaataaattccgaaaaaacgaaaacgaatcttaaaaaaacgaaaataaatcccgaaaaaacgaaaacgaatcttaaaaaaacgaaaacgaattccgaaaaaacaaaaacgaattccgaaaaaacgaaaacgaatcccgaaaaaacgaaatcgaattccgaaaaaacgaaaacgaatcctaaaaaaacaaaaacgaatcttaaaaaaacgaaaataaattccgaaaaaacaaacgcatattccgaaaaacgaaaaaacaaattccgaaaaaacgaaaacgaatcctaaaaaaacgaattcgaattccgaaaaaataaaaacgaatcctaaaaaaacgaaaacgaattccgaaaaacgaaaaaataaattccaaaaaaacgaacgcgaattccgaaaaaacgaaaaccgatcttaaaaaaacgaaaataaattccgaaaaaaaaaaaaacgaattccgaaaaaacgaaaacgaatcttaaaaaaacgaaaataaattccgaaaaaacgaaaacgaatcccgaaaaaacgaaaacgaattccgaaaaaacgaaaacgaatcctaaaaaaacgaaaacgaatcttaaaaaaacgaaaaaaaattccgaaaaaacgaaaacgaatcctaaaaaaacaaaaaccgattatactacgcaaaccgaacgcgcctaaaaaccacacgtaaaaaaataaaatttcacaaccaacttctaa

SEQ ID NO: 3865 - DNA, 1243 bp, Artificial Sequence
  chemically treated genomic DNA (Homo sapiens) CpG-island No: 3865
ttcgtttgttattcgtgaatagttgttcggggggtttcggtggtagagacgtttcggtcgttcgtcgttttcggtttcgttcgtttagttcgagtggggggcggtgtatttgcgtatgcgcgtttttttttcgtcgtttttttttcgtttttttttacgtgacgtcgtgggaattcggattttagcgttttcgggtgggggtagtcgtcggtcgtcggtcggggatgggggttcggggtggcgggagagtaggaaggatggggaggggatatttggttcgcggggttcgggggtttcggaggagagggtgggggaggggaggtcgtcgcgaacgggttttcggggggggtgggggggatttattcgtacgacgtaggagatttcgggttttaggattttggcgtcggggtgtagttagtcgtgcgcgggtttgtggatgaagttgttttttcggatttattcggcggcggcggcggcgttttcggatttcgtcgtttttcgttcgtttcgcgattttcgcgatttcgcgtttcgatagcggttgagcgcgggtaggggatagggcgcggcgtagcggggttcgtaggcgtttaggacggcggtcgttagcgtcgggacgtttttcgggttcgtcggttcgggttgggggttcgcgtttttcgaggttttagtcgttcgcgtcgtcgtcgggtcgcggtttaggaagtcgttcggggtcgcgaatttttattgcggtattcggggtagtaacgcgtagaaggtggtgggcgtttcgggttcggggggcgcggggggcgtcgggggcgcgcgttcgttcggattttgcgttatggtcgcggtcgttcgacggagttcgatcgggcgttgcgtttggcgcggaggaagttttttcgtttcgttcgttttttttcgtttttcggttcggtgatgttattcgttcggtttagcgcgtagtcgcggggggttgcgtttttgggatttcggtttttttcgtttcggagtttggtcgcgaggttggggaaattgaggtttttcgaggatatcgggcgttggtttggaattcgtagttaaggcgggacggggttttgaatttagaatttcgttagcgatttttttcgttgcgttttttattttcgttcgtcgtttaagttcgtagaaggatcgagttggagaagtttagaaattttatatttttttttttttttattttttagtggggaaattgaggtttcgggaggcgcgg

SEQ ID NO: 3866 - DNA, 1243 bp, Artificial Sequence
  chemically treated genomic DNA (Homo sapiens) CpG-island No: 3866
ccgcgcctcccgaaacctcaatttccccactaaaaaataaaaaaaaaaaaaaatataaaatttctaaacttctccaactcgatccttctacgaacttaaacgacgaacgaaaataaaaaacgcaacgaaaaaaatcgctaacgaaattctaaattcaaaaccccgtcccgccttaactacgaattccaaaccaacgcccgatatcctcgaaaaacctcaatttccccaacctcgcgaccaaactccgaaacgaaaaaaaccgaaatcccaaaaacgcaaccccccgcgactacgcgctaaaccgaacgaataacatcaccgaaccgaaaaacgaaaaaaaacgaacgaaacgaaaaaacttcctccgcgccaaacgcaacgcccgatcgaactccgtcgaacgaccgcgaccataacgcaaaatccgaacgaacgcgcgcccccgacgccccccgcgccccccgaacccgaaacgcccaccaccttctacgcgttactaccccgaataccgcaataaaaattcgcgaccccgaacgacttcctaaaccgcgacccgacgacgacgcgaacgactaaaacctcgaaaaacgcgaacccccaacccgaaccgacgaacccgaaaaacgtcccgacgctaacgaccgccgtcctaaacgcctacgaaccccgctacgccgcgccctatcccctacccgcgctcaaccgctatcgaaacgcgaaatcgcgaaaatcgcgaaacgaacgaaaaacgacgaaatccgaaaacgccgccgccgccgccgaataaatccgaaaaaacaacttcatccacaaacccgcgcacgactaactacaccccgacgccaaaatcctaaaacccgaaatctcctacgtcgtacgaataaatcccccccaccccccccgaaaacccgttcgcgacgacctcccctcccccaccctctcctccgaaacccccgaaccccgcgaaccaaatatcccctccccatccttcctactctcccgccaccccgaacccccatccccgaccgacgaccgacgactacccccacccgaaaacgctaaaatccgaattcccacgacgtcacgtaaaaaaaaacgaaaaaaaaacgacgaaaaaaaaacgcgcatacgcaaatacaccgccccccactcgaactaaacgaacgaaaccgaaaacgacgaacgaccgaaacgtctctaccaccgaaaccccccgaacaactattcacgaataacaaacgaa

SEQ ID NO: 3867 - DNA, 1243 bp, Artificial Sequence
  chemically treated genomic DNA (Homo sapiens) CpG-island No: 3867
tcgcgtttttcggggttttagtttttttattaggaaataggggaaagaagggatgtggaatttttaagtttttttagttcggtttttttgcgaatttgggcggcgggcgggggtggggggcgtagcggggagggtcgttgacggggttttgggtttaaagtttcgtttcgttttggttgcgggttttaggttagcgttcggtgttttcggagggttttagtttttttagtttcgcggttaggtttcgggacgaggagggtcggggttttaggggcgtagtttttcgcggttgcgcgttgggtcgggcggatgatattatcgggtcggggggcgggagggagcgggcggagcgggagggtttttttcgcgttaggcgtagcgttcggtcgggtttcgtcgggcggtcgcggttatgacgtagggttcgggcgggcgcgcgttttcggcgtttttcgcgtttttcgagttcgaggcgtttattattttttgcgcgttgttgtttcgaatgtcgtagtggaagttcgcggtttcgggcggttttttgggtcgcggttcggcggcggcgcgggcggttggggtttcggggggcgcggatttttaattcgagtcggcgggttcggggggcgtttcggcgttggcggtcgtcgttttgggcgtttgcgagtttcgttgcgtcgcgttttgttttttgttcgcgtttagtcgttgtcggggcgcggggtcgcgggggtcgcggggcgggcggggggcggcggggttcggggacgtcgtcgtcgtcgtcgagtggattcggaagggtagttttatttataaattcgcgtacggttggttatatttcgacgttagggttttggggttcggggttttttacgtcgtgcgggtgagttttttttatttttttcgggagttcgttcgcggcggtttttttttttttattttttttttcgggattttcggatttcgcgagttaggtgttttttttttattttttttgttttttcgttatttcggatttttattttcggtcggcggtcggcggttgtttttattcggaggcgttggggttcgggtttttacggcgttacgtggggaggggcggggagagggcggcgggggaggggcgcgtatgcgtaggtgtatcgttttttattcggattgggcgggcgaggtcgagagcggcgagcggtcggggcgtttttgttatcggagtttttcggatagttgtttacgaatgatagacggg

SEQ ID NO: 3868 - DNA, 1243 bp, Artificial Sequence
  chemically treated genomic DNA (Homo sapiens) CpG-island No: 3868
cccgtctatcattcgtaaacaactatccgaaaaactccgataacaaaaacgccccgaccgctcgccgctctcgacctcgcccgcccaatccgaataaaaaacgatacacctacgcatacgcgcccctcccccgccgccctctccccgcccctccccacgtaacgccgtaaaaacccgaaccccaacgcctccgaataaaaacaaccgccgaccgccgaccgaaaataaaaatccgaaataacgaaaaaacaaaaaaaataaaaaaaaaacacctaactcgcgaaatccgaaaatcccgaaaaaaaaaataaaaaaaaaaaaaccgccgcgaacgaactcccgaaaaaaataaaaaaaactcacccgcacgacgtaaaaaaccccgaaccccaaaaccctaacgtcgaaatataaccaaccgtacgcgaatttataaataaaactacccttccgaatccactcgacgacgacgacgacgtccccgaaccccgccgccccccgcccgccccgcgacccccgcgaccccgcgccccgacaacgactaaacgcgaacaaaaaacaaaacgcgacgcaacgaaactcgcaaacgcccaaaacgacgaccgccaacgccgaaacgccccccgaacccgccgactcgaattaaaaatccgcgccccccgaaaccccaaccgcccgcgccgccgccgaaccgcgacccaaaaaaccgcccgaaaccgcgaacttccactacgacattcgaaacaacaacgcgcaaaaaataataaacgcctcgaactcgaaaaacgcgaaaaacgccgaaaacgcgcgcccgcccgaaccctacgtcataaccgcgaccgcccgacgaaacccgaccgaacgctacgcctaacgcgaaaaaaaccctcccgctccgcccgctccctcccgccccccgacccgataatatcatccgcccgacccaacgcgcaaccgcgaaaaactacgcccctaaaaccccgaccctcctcgtcccgaaacctaaccgcgaaactaaaaaaactaaaaccctccgaaaacaccgaacgctaacctaaaacccgcaaccaaaacgaaacgaaactttaaacccaaaaccccgtcaacgaccctccccgctacgccccccacccccgcccgccgcccaaattcgcaaaaaaaccgaactaaaaaaacttaaaaattccacatcccttctttcccctatttcctaataaaaaaactaaaaccccgaaaaacgcga

SEQ ID NO: 3869 - DNA, 743 bp, Artificial Sequence
  chemically treated genomic DNA (Homo sapiens) CpG-island No: 3869
tagcggtagtttgcgacgggcggaggtttttagttattcggttagggtttcgtggtagtcgcgtaggtagacgtcgaaggcgtttaggtcggcggggtaggcgggcgttaggcggtttcgtattacggttatattttttagtagtcgcgttcgtagcgtttttagttgttcggttaggttttcgggcgtttcgggagtcgttgtttttaggcgttttcgggtcgcgcgcgttacggtttcggtttagcgtgcgcgtagtttgcgggtcgtttcgggatttcgacgttcgtcggtcgtttttttttgtattagtatttggtttagttgcgttatcgcgttagtttcggcgtacgttttcggttcggggttcgttagcgtttcgcgtattagcgtttatagttcgcgttgtagggtttcgtatagtagcgttacgtttcgcgttcggcggttttcgttagcgttttcggttttgggaggtttaggcgcgtcgtttttcgacggcgttagtttttcggtttttagttttaggatgtgttcgttcgtacgcgttagttcgcgttgttggattaggtttaggatttttagtattgcgggagtaaagcgggaggttagtagtgcgcgggggggaggagggcgatgtcggacgcggggttgggggtgtttaggaaggggagagagatgaggggaaaagggttataggaggcgggaaagtgtgggggtagagaagagttcggagaagagta

SEQ ID NO: 3870 - DNA, 743 bp, Artificial Sequence
  chemically treated genomic DNA (Homo sapiens) CpG-island No: 3870
tactcttctccgaactcttctctacccccacactttcccgcctcctataacccttttcccctcatctctctccccttcctaaacacccccaaccccgcgtccgacatcgccctcctcccccccgcgcactactaacctcccgctttactcccgcaatactaaaaatcctaaacctaatccaacaacgcgaactaacgcgtacgaacgaacacatcctaaaactaaaaaccgaaaaactaacgccgtcgaaaaacgacgcgcctaaacctcccaaaaccgaaaacgctaacgaaaaccgccgaacgcgaaacgtaacgctactatacgaaaccctacaacgcgaactataaacgctaatacgcgaaacgctaacgaaccccgaaccgaaaacgtacgccgaaactaacgcgataacgcaactaaaccaaatactaatacaaaaaaaaacgaccgacgaacgtcgaaatcccgaaacgacccgcaaactacgcgcacgctaaaccgaaaccgtaacgcgcgcgacccgaaaacgcctaaaaacaacgactcccgaaacgcccgaaaacctaaccgaacaactaaaaacgctacgaacgcgactactaaaaaatataaccgtaatacgaaaccgcctaacgcccgcctaccccgccgacctaaacgccttcgacgtctacctacgcgactaccacgaaaccctaaccgaataactaaaaacctccgcccgtcgcaaactaccgcta

SEQ ID NO: 3871 - DNA, 743 bp, Artificial Sequence
  chemically treated genomic DNA (Homo sapiens) CpG-island No: 3871
tgttttttttcgggtttttttttgtttttatattttttcgttttttgtaatttttttttttttattttttttttttttttaagtatttttaatttcgcgttcggtatcgtttttttttttttcgcgtattgttgatttttcgttttgttttcgtagtgttggagattttgagtttgatttagtagcgcgaattagcgcgtgcggacgagtatattttggagttagaggtcgaggagttggcgtcgtcgaggggcggcgcgtttgggttttttaaggtcgagggcgttggcgggggtcgtcgggcgcgggacgtggcgttgttgtacgaggttttgtagcgcgagttgtgggcgttggtgcgcgagacgttggcgggtttcgggtcgggagcgtgcgtcggggttggcgcggtggcgtagttgggttaggtgttggtataggaggaggcggtcgacgggcgtcggggtttcggggcggttcgtaaattacgcgtacgttgggtcgaagtcgtggcgcgcgcggttcgggagcgtttagaggtagcggttttcggggcgttcgggggtttggtcgggtagttggaggcgttgcgggcgcggttgttggaggatatggtcgtggtgcggggtcgtttggcgttcgtttatttcgtcggtttgggcgttttcggcgtttatttgcgcggttattacggggttttggtcgagtggttgggggttttcgttcgtcgtaggttgtcgttg

SEQ ID NO: 3872 - DNA, 743 bp, Artificial Sequence
  chemically treated genomic DNA (Homo sapiens) CpG-island No: 3872
caacgacaacctacgacgaacgaaaacccccaaccactcgaccaaaaccccgtaataaccgcgcaaataaacgccgaaaacgcccaaaccgacgaaataaacgaacgccaaacgaccccgcaccacgaccatatcctccaacaaccgcgcccgcaacgcctccaactacccgaccaaacccccgaacgccccgaaaaccgctacctctaaacgctcccgaaccgcgcgcgccacgacttcgacccaacgtacgcgtaatttacgaaccgccccgaaaccccgacgcccgtcgaccgcctcctcctataccaacacctaacccaactacgccaccgcgccaaccccgacgcacgctcccgacccgaaacccgccaacgtctcgcgcaccaacgcccacaactcgcgctacaaaacctcgtacaacaacgccacgtcccgcgcccgacgacccccgccaacgccctcgaccttaaaaaacccaaacgcgccgcccctcgacgacgccaactcctcgacctctaactccaaaatatactcgtccgcacgcgctaattcgcgctactaaatcaaactcaaaatctccaacactacgaaaacaaaacgaaaaatcaacaatacgcgaaaaaaaaaaaaacgataccgaacgcgaaattaaaaatacttaaaaaaaaaaaaaaaataaaaaaaaaaaaattacaaaaaacgaaaaaatataaaaacaaaaaaaaacccgaaaaaaaaca

SEQ ID NO: 3873 - DNA, 1274 bp, Artificial Sequence
  chemically treated genomic DNA (Homo sapiens) CpG-island No: 3873
cgtagcgcgatgacgttacgtttgcgggtttcgtttttacgtaggtttcggtttttcggattcggcgtttagttttcgttcgttttgttaggttcgggtcgttcgtttgtatttattttttgttcggataaggggtcgtttcgtgaggaaattagtttggagtttttacgttcgtttcggaggaggacgcgggcggggcgttcgaattgcggggagagggcgatttcgtttcgggttgaaattagttcgtttagaagttagtgttttcgtagggcgggatagttacgcgtgttcgtaacgttttcgttatttatcggtagggggtgggttttagggaattatttagttaggacgggcgggggcggggtcgagataagtatttaatgagggacgtttaatcggaattcggggaattgtttaatttatagcgttaggggacggattggggaattttttaattagagtcgtcgacgttggtagtattgtttaattagaagcgcggtttttcgagttttgtttaattaggtttttgggacgggacgtttttgttttagtcgtgagtgtttcgtttgtttttagcggtttttggcgtttcggtttttgtcgcgtttatttgcgtcggtagcgaagaaatcgtttcgggatatggtgagtgtggcgtaggagaggatttcggtgcggggtagtaggaatcggcgatcgttcgagatcgcggtttggggggagttgagggacgcggggggcggtttcggcgagggcggcgtaggacgggagtttgggtttcgggggtttcgttcggtttcgtttttcgcgttgaggtcgcggttagggcgtttcgagtttcgggttttcgttcgtttttggttttaaggttgtagagcggggagcggcgttcggagttcgatttcgttttcgtcgtttcggggttttcgcgtttttgcgttttcgattttttacgtttcgttcggggtcgcgacgtttcggagcgtttcgttgcggtttcgggattttcgggtcgcgggaggtagagtcgttcgagatttcgaggtgcggtttaggttttttcgggattcgttttggggtcgacgtcgcggtgttttttggggtgcgggtttttggtcggtgtcgttttcgttcgcgttttcgcggtttagttttttggaggtttcgcgttttcggtcgcggtttttgggggattttgggtttttttcgggatagttcgggagcggtggggtttcggcgggggcggagacgtttttatttgtaaaggtagt

SEQ ID NO: 3874 - DNA, 1274 bp, Artificial Sequence
  chemically treated genomic DNA (Homo sapiens) CpG-island No: 3874
actacctttacaaataaaaacgtctccgcccccgccgaaaccccaccgctcccgaactatcccgaaaaaaacccaaaatcccccaaaaaccgcgaccgaaaacgcgaaacctccaaaaaactaaaccgcgaaaacgcgaacgaaaacgacaccgaccaaaaacccgcaccccaaaaaacaccgcgacgtcgaccccaaaacgaatcccgaaaaaacctaaaccgcacctcgaaatctcgaacgactctacctcccgcgacccgaaaatcccgaaaccgcaacgaaacgctccgaaacgtcgcgaccccgaacgaaacgtaaaaaatcgaaaacgcaaaaacgcgaaaaccccgaaacgacgaaaacgaaatcgaactccgaacgccgctccccgctctacaaccttaaaaccaaaaacgaacgaaaacccgaaactcgaaacgccctaaccgcgacctcaacgcgaaaaacgaaaccgaacgaaacccccgaaacccaaactcccgtcctacgccgccctcgccgaaaccgccccccgcgtccctcaactccccccaaaccgcgatctcgaacgatcgccgattcctactaccccgcaccgaaatcctctcctacgccacactcaccatatcccgaaacgatttcttcgctaccgacgcaaataaacgcgacaaaaaccgaaacgccaaaaaccgctaaaaacaaacgaaacactcacgactaaaacaaaaacgtcccgtcccaaaaacctaattaaacaaaactcgaaaaaccgcgcttctaattaaacaatactaccaacgtcgacgactctaattaaaaaattccccaatccgtcccctaacgctataaattaaacaattccccgaattccgattaaacgtccctcattaaatacttatctcgaccccgcccccgcccgtcctaactaaataattccctaaaacccaccccctaccgataaataacgaaaacgttacgaacacgcgtaactatcccgccctacgaaaacactaacttctaaacgaactaatttcaacccgaaacgaaatcgccctctccccgcaattcgaacgccccgcccgcgtcctcctccgaaacgaacgtaaaaactccaaactaatttcctcacgaaacgaccccttatccgaacaaaaaataaatacaaacgaacgacccgaacctaacaaaacgaacgaaaactaaacgccgaatccgaaaaaccgaaacctacgtaaaaacgaaacccgcaaacgtaacgtcatcgcgctacg

SEQ ID NO: 3875 - DNA, 1274 bp, Artificial Sequence
  chemically treated genomic DNA (Homo sapiens) CpG-island No: 3875
gttgtttttgtaggtgggggcgttttcgttttcgtcgaggttttatcgttttcgggttgtttcgggaggaatttagggttttttagagatcgcggtcggaggcgcggggtttttaaggagttgagtcgcgggagcgcgagcggaggcggtatcgattagggattcgtattttaggaggtatcgcggcgtcggttttagggcgggtttcgggggagtttggatcgtatttcggggtttcgggcgattttgtttttcgcggttcgggggtttcgaagtcgtagcgaaacgtttcgaggcgtcgcggtttcgggcggggcgtggggggtcgggagcgtagggacgcggggatttcgggacgacggggacggagtcgggtttcgggcgtcgtttttcgttttgtagttttggggttagaggcgggcggggattcggagttcggagcgttttagtcgcgattttagcgcgggaggcggggtcgggcgggattttcggggtttaggttttcgttttgcgtcgttttcgtcggggtcgtttttcgcgttttttagttttttttaagtcgcggtttcgggcggtcgtcggtttttgttgtttcgtatcgggatttttttttgcgttatatttattatgtttcggggcgattttttcgttatcggcgtaggtgagcgcgataggaatcgggacgttagggatcgttaggggtaggcggggtatttacggttaggatagaggcgtttcgttttaggggtttgattagatagagttcgggaagtcgcgtttttgattggatagtgttgttaacgtcggcgattttgattggagaattttttagttcgttttttggcgttgtaaattgggtagtttttcggatttcgattgggcgttttttattggatatttgtttcggtttcgttttcgttcgttttgattgggtagttttttagggtttattttttgtcggtgagtgacgggagcgttgcgaatacgcgtggttgtttcgttttgcggggatattggtttttgggcgaattggttttagttcggggcggaatcgtttttttttcgtagttcgggcgtttcgttcgcgttttttttcgggacgggcgtgggaattttagattagtttttttacgaggcgattttttgttcggataggaggtggatgtaagcgggcggttcgggtttggtagggcgaacgggggttgggcgtcgggttcgaagggtcgagatttacgtgggggcgggattcgtagacgtgacgttatcgcgttgcg

SEQ ID NO: 3876 - DNA, 1274 bp, Artificial Sequence
  chemically treated genomic DNA (Homo sapiens) CpG-island No: 3876
cgcaacgcgataacgtcacgtctacgaatcccgcccccacgtaaatctcgacccttcgaacccgacgcccaacccccgttcgccctaccaaacccgaaccgcccgcttacatccacctcctatccgaacaaaaaatcgcctcgtaaaaaaactaatctaaaattcccacgcccgtcccgaaaaaaaacgcgaacgaaacgcccgaactacgaaaaaaaaacgattccgccccgaactaaaaccaattcgcccaaaaaccaatatccccgcaaaacgaaacaaccacgcgtattcgcaacgctcccgtcactcaccgacaaaaaataaaccctaaaaaactacccaatcaaaacgaacgaaaacgaaaccgaaacaaatatccaataaaaaacgcccaatcgaaatccgaaaaactacccaatttacaacgccaaaaaacgaactaaaaaattctccaatcaaaatcgccgacgttaacaacactatccaatcaaaaacgcgacttcccgaactctatctaatcaaacccctaaaacgaaacgcctctatcctaaccgtaaataccccgcctacccctaacgatccctaacgtcccgattcctatcgcgctcacctacgccgataacgaaaaaatcgccccgaaacataataaatataacgcaaaaaaaaatcccgatacgaaacaacaaaaaccgacgaccgcccgaaaccgcgacttaaaaaaaactaaaaaacgcgaaaaacgaccccgacgaaaacgacgcaaaacgaaaacctaaaccccgaaaatcccgcccgaccccgcctcccgcgctaaaatcgcgactaaaacgctccgaactccgaatccccgcccgcctctaaccccaaaactacaaaacgaaaaacgacgcccgaaacccgactccgtccccgtcgtcccgaaatccccgcgtccctacgctcccgaccccccacgccccgcccgaaaccgcgacgcctcgaaacgtttcgctacgacttcgaaacccccgaaccgcgaaaaacaaaatcgcccgaaaccccgaaatacgatccaaactcccccgaaacccgccctaaaaccgacgccgcgatacctcctaaaatacgaatccctaatcgataccgcctccgctcgcgctcccgcgactcaactccttaaaaaccccgcgcctccgaccgcgatctctaaaaaaccctaaattcctcccgaaacaacccgaaaacgataaaacctcgacgaaaacgaaaacgcccccacctacaaaaacaac

SEQ ID NO: 3877 - DNA, 600 bp, Artificial Sequence
  chemically treated genomic DNA (Homo sapiens) CpG-island No: 3877
tttaaaatcgtttttttttttttatatttttagtgttttattgtatcgatttatatttttattttagattttaggcgttagtttcgtttttttttcgttttattcgtatttttttttttttattttggttttttcgtgttttagtttttcgcggtttttttcgtttatttcgtttttttggtacgtttcgtttttatttttttttttttcgggtttttttaagtgagatttttttttttttttttcgtttttttttttttcgaggttgtattttttttttttttttcgttttttcgattgtcgtttttatttcggcgttcgttttttttttcgttttttttttgtttttttagttttcgttcgtttttttatttttcgttgtcgcgcgtcgttcgtgacgttagagtttttttttagttttatattttttttttgtttttttttttttttttcgtcggttagttagttcgcgaggagagttcgcggtggcggcgacggtggcgagagtcgcgggggtcgtaggaagttaattttttttgttttttcggggttttcgtttttttttttttataaaattagggatggaggcgttttttcggt

SEQ ID NO: 3878 - DNA, 600 bp, Artificial Sequence
  chemically treated genomic DNA (Homo sapiens) CpG-island No: 3878
accgaaaaaacgcctccatccctaattttataaaaaaaaaaaaacgaaaaccccgaaaaaacaaaaaaaattaacttcctacgacccccgcgactctcgccaccgtcgccgccaccgcgaactctcctcgcgaactaactaaccgacgaaaaaaaaaaaaaaaaacaaaaaaaaaatataaaactaaaaaaaaactctaacgtcacgaacgacgcgcgacaacgaaaaataaaaaaacgaacgaaaactaaaaaaacaaaaaaaaaacgaaaaaaaaaacgaacgccgaaataaaaacgacaatcgaaaaaacgaaaaaaaaaaaaaaaatacaacctcgaaaaaaaaaaaaacgaaaaaaaaaaaaaaaaatctcacttaaaaaaacccgaaaaaaaaaaaaataaaaacgaaacgtaccaaaaaaacgaaataaacgaaaaaaaccgcgaaaaactaaaacacgaaaaaaccaaaataaaaaaaaaaaaatacgaataaaacgaaaaaaaaacgaaactaacgcctaaaatctaaaataaaaatataaatcgatacaataaaacactaaaaatataaaaaaaaaaaaacgattttaaa

SEQ ID NO: 3879 - DNA, 600 bp, Artificial Sequence
  chemically treated genomic DNA (Homo sapiens) CpG-island No: 3879
gtcggggaggcgtttttatttttgattttgtggggaggagggggcgagggtttcggagaagtagggaaggttggttttttacggttttcgcggttttcgttatcgtcgtcgttatcgcggatttttttcgcggattgattgatcgacggaggggaggaggaggagtaggagggagatgtggggttgggagggggttttgacgttacgggcggcgcgcggtagcggggggtgggggggcgggcgggagttggggaggtaggaagggggcggggagggaagcgagcgtcgaggtgggagcgatagtcggaggggcggggaggggaggggggatgtaatttcgaggaggaaaggaacgaaagaggaagggagggattttatttaaggggattcgaggggaggagaaatggggacggggcgtgttaggagggcggggtgggcggagggagtcgcgggaggttgaagtacggaggaattagggtaggaagggaaggatgcgagtgggacgggagagaaacggggttggcgtttgaggtttgaagtgggagtatgagtcgatatagtgaagtattgaggatgtgggggagaggaaacggttttgga

SEQ ID NO: 3880 - DNA, 600 bp, Artificial Sequence
  chemically treated genomic DNA (Homo sapiens) CpG-island No: 3880
tccaaaaccgtttcctctcccccacatcctcaatacttcactatatcgactcatactcccacttcaaacctcaaacgccaaccccgtttctctcccgtcccactcgcatccttcccttcctaccctaattcctccgtacttcaacctcccgcgactccctccgcccaccccgccctcctaacacgccccgtccccatttctcctcccctcgaatccccttaaataaaatccctcccttcctctttcgttcctttcctcctcgaaattacatcccccctcccctccccgcccctccgactatcgctcccacctcgacgctcgcttccctccccgcccccttcctacctccccaactcccgcccgcccccccaccccccgctaccgcgcgccgcccgtaacgtcaaaaccccctcccaaccccacatctccctcctactcctcctcctcccctccgtcgatcaatcaatccgcgaaaaaaatccgcgataacgacgacgataacgaaaaccgcgaaaaccgtaaaaaaccaaccttccctacttctccgaaaccctcgccccctcctccccacaaaatcaaaaataaaaacgcctccccgac

SEQ ID NO: 3881 - DNA, 783 bp, Artificial Sequence
  chemically treated genomic DNA (Homo sapiens) CpG-island No: 3881
gcgatacgaatttgtttcgtgtttggttgtagcgttgcgcgggttgtaggtaggtgtagatggtcgagtcgtagaataggtagacggttgttaggtgggatttatacgtgtttatcgttttttttcggttttcgttgaatcgtatgtaatagatagttcgggttacggtatcgtaggaggttaggatgacggtaaacggtagtagtaggatgattacgcgggcggcgaatatttggttttcggtagtgttttcgtcgttttcgtaggttagtttgagtaacgtcggtagtttatagatgaagtggtttagtaggcggggcgcgtatagcggtcgtttagttaggagcgcggtttgcgtaatcgagttggtgaggtcgtttagttaggaggcgttggttagcgtgcgatataggcgcggggagacgagtttcgtatagcgtagcgggcggtatattgcggtcgcgcggtttagagttattatcgttaggaggacgtattcggtcgaatttagagttagcgatgcgtatagttgggtcgtgtagtggttgcgcggtagttagagcgttggttcgcgtaggttggttagtagcggcggtattacgttagtagtgaagttcgcgtttattaaggttaggtggtagaggaagtagtatatgggcgtgtgtaggcgcgggtcgcgtatcgttagtagtattagcgtcgagttgttcgttaaggttaggaggtagtataggaggataagggcgaagaggatcggttgtagggaaggttagtcggagaaat

SEQ ID NO: 3882 - DNA, 783 bp, Artificial Sequence
  chemically treated genomic DNA (Homo sapiens) CpG-island No: 3882
atttctccgactaaccttccctacaaccgatcctcttcgcccttatcctcctatactacctcctaaccttaacgaacaactcgacgctaatactactaacgatacgcgacccgcgcctacacacgcccatatactacttcctctaccacctaaccttaataaacgcgaacttcactactaacgtaataccgccgctactaaccaacctacgcgaaccaacgctctaactaccgcgcaaccactacacgacccaactatacgcatcgctaactctaaattcgaccgaatacgtcctcctaacgataataactctaaaccgcgcgaccgcaatataccgcccgctacgctatacgaaactcgtctccccgcgcctatatcgcacgctaaccaacgcctcctaactaaacgacctcaccaactcgattacgcaaaccgcgctcctaactaaacgaccgctatacgcgccccgcctactaaaccacttcatctataaactaccgacgttactcaaactaacctacgaaaacgacgaaaacactaccgaaaaccaaatattcgccgcccgcgtaatcatcctactactaccgtttaccgtcatcctaacctcctacgataccgtaacccgaactatctattacatacgattcaacgaaaaccgaaaaaaaacgataaacacgtataaatcccacctaacaaccgtctacctattctacgactcgaccatctacacctacctacaacccgcgcaacgctacaaccaaacacgaaacaaattcgtatcgc

SEQ ID NO: 3883 - DNA, 783 bp, Artificial Sequence
  chemically treated genomic DNA (Homo sapiens) CpG-island No: 3883
gttttttcgattggttttttttgtagtcggtttttttcgtttttgtttttttgtgttattttttgattttgacgggtaattcggcgttggtgttgttggcggtgcgcgattcgcgtttgtatacgtttatgtattattttttttgttatttggttttggtagacgcgggttttattattagcgtggtgtcgtcgttgttggttaatttgcgcggattagcgttttggttgtcgcgtagttattgtacggtttagttgtgcgtatcgttggttttgggttcggtcgaatgcgtttttttggcggtgatggttttggatcgcgcggtcgtagtgtgtcgttcgttgcgttatgcggggttcgttttttcgcgtttatgtcgtacgttggttagcgttttttggttaagcggttttattaattcggttgcgtaaatcgcgtttttggttgagcggtcgttgtgcgcgtttcgtttgttggattattttatttgtgagttgtcggcgttgtttaagttggtttgcggaggcgacggagatattatcgagaattagatgttcgtcgttcgcgtggttattttgttgttgtcgtttgtcgttattttggttttttacggtgtcgtggttcgagttgtttgttgtatgcggtttagcggaggtcggaggagggcggtgggtacgtgtgggttttatttgatagtcgtttgtttgttttacggttcggttatttatatttatttgtagttcgcgtagcgttataattaggtacggggtaagttcgtatcgt

SEQ ID NO: 3884 - DNA, 783 bp, Artificial Sequence
  chemically treated genomic DNA (Homo sapiens) CpG-island No: 3884
acgatacgaacttaccccgtacctaattataacgctacgcgaactacaaataaatataaataaccgaaccgtaaaacaaacaaacgactatcaaataaaacccacacgtacccaccgccctcctccgacctccgctaaaccgcatacaacaaacaactcgaaccacgacaccgtaaaaaaccaaaataacgacaaacgacaacaacaaaataaccacgcgaacgacgaacatctaattctcgataatatctccgtcgcctccgcaaaccaacttaaacaacgccgacaactcacaaataaaataatccaacaaacgaaacgcgcacaacgaccgctcaaccaaaaacgcgatttacgcaaccgaattaataaaaccgcttaaccaaaaaacgctaaccaacgtacgacataaacgcgaaaaaacgaaccccgcataacgcaacgaacgacacactacgaccgcgcgatccaaaaccatcaccgccaaaaaaacgcattcgaccgaacccaaaaccaacgatacgcacaactaaaccgtacaataactacgcgacaaccaaaacgctaatccgcgcaaattaaccaacaacgacgacaccacgctaataataaaacccgcgtctaccaaaaccaaataacaaaaaaaataatacataaacgtatacaaacgcgaatcgcgcaccgccaacaacaccaacgccgaattacccgtcaaaatcaaaaaataacacaaaaaaacaaaaacgaaaaaaaccgactacaaaaaaaaccaatcgaaaaaac

SEQ ID NO: 3885 - DNA, 532 bp, Artificial Sequence
  chemically treated genomic DNA (Homo sapiens) CpG-island No: 3885
atttgggattcgaagattcgaggggattcgcgtcgttcgtgggggatggggaggggtcgtgatttgtttttttggtcggggttatttatcggtttcgttttgattgtagtagtcgcgtagcgttcgtagatttattcggaaaatttgtgcggtgtttttggcgtttcgtgtttttcggttttaatattttgattttttttgttttatttacggcgttcgcggtattattttcggattcgcggcgtcgttgtcgaagcgtacgaattgggtgtcgtttacgtagtttatagagatgaagcggggtttttcgcggtcgggtcgggatacggaagtgtggaaatattttaaggagtgggagtttgggggcgaggaggggttgagatcggttcgatttttttttcggcgcggtttttcgagtttttcgttttcgtcgggtcggtttttttttattttcggtagaggtcgtttttatttcgatttcgtatttattcgtttaggtttgggtaagggttagggttttcgagaggagtaa

SEQ ID NO: 3886 - DNA, 532 bp, Artificial Sequence
  chemically treated genomic DNA (Homo sapiens) CpG-island No: 3886
ttactcctctcgaaaaccctaacccttacccaaacctaaacgaataaatacgaaatcgaaataaaaacgacctctaccgaaaataaaaaaaaaccgacccgacgaaaacgaaaaactcgaaaaaccgcgccgaaaaaaaaatcgaaccgatctcaacccctcctcgcccccaaactcccactccttaaaatatttccacacttccgtatcccgacccgaccgcgaaaaaccccgcttcatctctataaactacgtaaacgacacccaattcgtacgcttcgacaacgacgccgcgaatccgaaaataataccgcgaacgccgtaaataaaacaaaaaaaatcaaaatattaaaaccgaaaaacacgaaacgccaaaaacaccgcacaaattttccgaataaatctacgaacgctacgcgactactacaatcaaaacgaaaccgataaataaccccgaccaaaaaaacaaatcacgacccctccccatcccccacgaacgacgcgaatcccctcgaatcttcgaatcccaaat

SEQ ID NO: 3887 - DNA, 532 bp, Artificial Sequence
  chemically treated genomic DNA (Homo sapiens) CpG-island No: 3887
ttatttttttcggaggttttggtttttatttagatttgggcgggtgagtgcggggtcgggatggaaacggtttttatcgggagtagagaggggtcggttcggcgggggcgaaggattcggggagtcgcgtcgggaggagggtcgggtcgattttagttttttttcgtttttaggtttttattttttgaagtatttttatattttcgtgtttcggttcggtcgcggggagtttcgttttatttttgtgggttacgtggacgatatttagttcgtgcgtttcgataacgacgtcgcgagttcgaggatggtgtcgcgggcgtcgtggatggagtaggaggggttagagtattgggatcgggagatacggagcgttagggatatcgtatagatttttcgagtgaatttgcggacgttgcgcggttattataattagagcgaggtcggtgagtgatttcggttaggggagtaggttacgatttttttttattttttacggacggcgcgggttttttcgaattttcgggttttagat

SEQ ID NO: 3888 - DNA, 532 bp, Artificial Sequence
  chemically treated genomic DNA (Homo sapiens) CpG-island No: 3888
atctaaaacccgaaaattcgaaaaaacccgcgccgtccgtaaaaaataaaaaaaaatcgtaacctactcccctaaccgaaatcactcaccgacctcgctctaattataataaccgcgcaacgtccgcaaattcactcgaaaaatctatacgatatccctaacgctccgtatctcccgatcccaatactctaacccctcctactccatccacgacgcccgcgacaccatcctcgaactcgcgacgtcgttatcgaaacgcacgaactaaatatcgtccacgtaacccacaaaaataaaacgaaactccccgcgaccgaaccgaaacacgaaaatataaaaatacttcaaaaaataaaaacctaaaaacgaaaaaaaactaaaatcgacccgaccctcctcccgacgcgactccccgaatccttcgcccccgccgaaccgacccctctctactcccgataaaaaccgtttccatcccgaccccgcactcacccgcccaaatctaaataaaaaccaaaacctccgaaaaaaataa

SEQ ID NO: 3889 - DNA, 824 bp, Artificial Sequence
  chemically treated genomic DNA (Homo sapiens) CpG-island No: 3889
gttacgtggtaagaggttgcgtaggtttttttcggttttcggggtttcggcggcggcggttcgcgaggggtttgggcgtatgcgtagcgaggttttacgtgagcgtttgcgtttttttttaaatttaacgatgtcgtcggagcggaggagacgaatgaaattggatcggagaatcggagcgaagtcgaagcggaagttcggaatgaggtcggattggaaagtcggagcggggttaggcgggtttttttaaaagtttgtttttttattttagcggaaatcgtcggttcggtcgagcgcggcggtcgttgcgattgtagtcgcggcggcggaggaagagagacggtttcggtagcggaatcgtttgaggttggaggaggataaatcggtcgtggagcggtgtttggaggagttggttttcggcgacgtcgagaacgacgaggacgcgttgttgcggcgtttgcgaggttcgagggtgagggaggtcgcggcgcgcgggttgggcgtattcgggcggggcgcgcggtgggcggtgaagtttcggggggcggagtttgggcgatttgcggcggcggggagcgtttaggtgggagggagttcgagaacgcgggcgcggagggtcgtagttgcgggtttttcgtttttttgttttagattgaaagtgtttggagggcggggatcgcgttttttttcgtttttggaggcgtcgttgttcgggtatttgttttgcgaattgtggtcgtgagtatttttcgttgttgttcgatttcgttagtttttttttaaattgagggtggttttttgattatttgttttagttttttgtg

SEQ ID NO: 3890 - DNA, 824 bp, Artificial Sequence
  chemically treated genomic DNA (Homo sapiens) CpG-island No: 3890
cacaaaaaactaaaacaaataatcaaaaaaccaccctcaatttaaaaaaaaactaacgaaatcgaacaacaacgaaaaatactcacgaccacaattcgcaaaacaaatacccgaacaacgacgcctccaaaaacgaaaaaaaacgcgatccccgccctccaaacactttcaatctaaaacaaaaaaacgaaaaacccgcaactacgaccctccgcgcccgcgttctcgaactccctcccacctaaacgctccccgccgccgcaaatcgcccaaactccgccccccgaaacttcaccgcccaccgcgcgccccgcccgaatacgcccaacccgcgcgccgcgacctccctcaccctcgaacctcgcaaacgccgcaacaacgcgtcctcgtcgttctcgacgtcgccgaaaaccaactcctccaaacaccgctccacgaccgatttatcctcctccaacctcaaacgattccgctaccgaaaccgtctctcttcctccgccgccgcgactacaatcgcaacgaccgccgcgctcgaccgaaccgacgatttccgctaaaataaaaaaacaaacttttaaaaaaacccgcctaaccccgctccgactttccaatccgacctcattccgaacttccgcttcgacttcgctccgattctccgatccaatttcattcgtctcctccgctccgacgacatcgttaaatttaaaaaaaaacgcaaacgctcacgtaaaacctcgctacgcatacgcccaaacccctcgcgaaccgccgccgccgaaaccccgaaaaccgaaaaaaacctacgcaacctcttaccacgtaac

SEQ ID NO: 3891 - DNA, 824 bp, Artificial Sequence
  chemically treated genomic DNA (Homo sapiens) CpG-island No: 3891
tataaggaattgaggtaggtgattaaaagattatttttagtttgggaagaggttagcggagtcgagtagtagcgaaagatgtttacgattatagttcgtaaagtagatattcgagtagcggcgtttttaggggcggagaaagacgcggttttcgttttttaggtatttttagtttggagtagggaggcgagggattcgtagttgcgatttttcgcgttcgcgttttcgggtttttttttatttgagcgtttttcgtcgtcgtaggtcgtttaggtttcgtttttcggagttttatcgtttatcgcgcgtttcgttcgagtgcgtttagttcgcgcgtcgcggttttttttattttcgggtttcgtagacgtcgtagtaacgcgttttcgtcgttttcgacgtcgtcgaagattagtttttttaagtatcgttttacggtcggtttgtttttttttagttttaggcggtttcgttgtcggagtcgttttttttttttcgtcgtcgcgattgtaatcgtagcggtcgtcgcgttcggtcgggtcggcggttttcgttgggatgaaggggtaggtttttggggaggttcgtttggtttcgtttcggttttttagttcggttttatttcgggttttcgtttcggtttcgtttcggtttttcggtttagttttattcgtttttttcgtttcggcggtatcgttaggtttgaggagaaacgtaggcgtttacgtggaatttcgttgcgtatgcgtttaggtttttcgcgggtcgtcgtcgtcgaagtttcgggggtcggaaggagtttgcgtagttttttgttacgtgat

SEQ ID NO: 3892 - DNA, 824 bp, Artificial Sequence
  chemically treated genomic DNA (Homo sapiens) CpG-island No: 3892
atcacgtaacaaaaaactacgcaaactccttccgacccccgaaacttcgacgacgacgacccgcgaaaaacctaaacgcatacgcaacgaaattccacgtaaacgcctacgtttctcctcaaacctaacgataccgccgaaacgaaaaaaacgaataaaactaaaccgaaaaaccgaaacgaaaccgaaacgaaaacccgaaataaaaccgaactaaaaaaccgaaacgaaaccaaacgaacctccccaaaaacctaccccttcatcccaacgaaaaccgccgacccgaccgaacgcgacgaccgctacgattacaatcgcgacgacgaaaaaaaaaaaacgactccgacaacgaaaccgcctaaaactaaaaaaaaacaaaccgaccgtaaaacgatacttaaaaaaactaatcttcgacgacgtcgaaaacgacgaaaacgcgttactacgacgtctacgaaacccgaaaataaaaaaaaccgcgacgcgcgaactaaacgcactcgaacgaaacgcgcgataaacgataaaactccgaaaaacgaaacctaaacgacctacgacgacgaaaaacgctcaaataaaaaaaaacccgaaaacgcgaacgcgaaaaatcgcaactacgaatccctcgcctccctactccaaactaaaaatacctaaaaaacgaaaaccgcgtctttctccgcccctaaaaacgccgctactcgaatatctactttacgaactataatcgtaaacatctttcgctactactcgactccgctaacctcttcccaaactaaaaataatcttttaatcacctacctcaattccttata

SEQ ID NO: 3893 - DNA, 565 bp, Artificial Sequence
  chemically treated genomic DNA (Homo sapiens) CpG-island No: 3893
ttcgcgtcggattttttttttttagtcgcggggagtttgagaaagcgtatttgtttcgcgatcgttacgtatttttttttcgtttgtcgcgatgtatcgttatttggttaaagcgttgttgtcgtttcgggtcgggttcgttgttttgggtttcgcggttaattattcggtcgcgttgttgggtcggggtcgcggatagttcgtcgtcgtttcgtagtcggggttcgtattggtcgttcggcgttattatagcgagttggtggtcgatcgcgaggacgattttaatttttttaagatggtggagggttttttcgatcgcggcgttagtatcgtggaggataagttggtgaaggatttgaggatttaggaaagcgaggagtagaagcggaatcgggtgcgcggtattttgcggattattaagttttgtaattatgtgttgagtttttttttttttattcggcgcgacgacggtttttgggaggttatcgaaggttatcgggtttagtatagttagtatcgtacgttttgtaagggaggtattcgttatagtattgatgtgagtgta

SEQ ID NO: 3894 - DNA, 565 bp, Artificial Sequence
  chemically treated genomic DNA (Homo sapiens) CpG-island No: 3894
tacactcacatcaatactataacgaatacctcccttacaaaacgtacgatactaactatactaaacccgataaccttcgataacctcccaaaaaccgtcgtcgcgccgaataaaaaaaaaaaaactcaacacataattacaaaacttaataatccgcaaaataccgcgcacccgattccgcttctactcctcgctttcctaaatcctcaaatccttcaccaacttatcctccacgatactaacgccgcgatcgaaaaaaccctccaccatcttaaaaaaattaaaatcgtcctcgcgatcgaccaccaactcgctataataacgccgaacgaccaatacgaaccccgactacgaaacgacgacgaactatccgcgaccccgacccaacaacgcgaccgaataattaaccgcgaaacccaaaacaacgaacccgacccgaaacgacaacaacgctttaaccaaataacgatacatcgcgacaaacgaaaaaaaaatacgtaacgatcgcgaaacaaatacgctttctcaaactccccgcgactaaaaaaaaaaaatccgacgcgaa

SEQ ID NO: 3895 - DNA, 565 bp, Artificial Sequence
  chemically treated genomic DNA (Homo sapiens) CpG-island No: 3895
tatatttatattagtgttgtaacggatattttttttgtagggcgtgcggtgttggttgtgttgggttcggtagttttcgatgattttttaggagtcgtcgtcgcgtcggatggggaaggagagatttagtatatggttgtagggtttgatgattcgtaggatgtcgcgtattcggtttcgtttttgtttttcgtttttttgggtttttaggttttttattaatttgttttttacgatgttggcgtcgcgatcgaagaagttttttattattttgaagaagttggggtcgttttcgcggtcggttattaattcgttgtagtggcgtcgggcggttaatgcgagtttcggttgcgaggcggcggcgggttgttcgcggtttcggtttagtaacgcggtcgagtggttggtcgcggagtttagggtagcgggttcggttcgggacggtagtagcgttttggttaggtagcggtatatcgcggtaggcggaggaggggtgcgtgacggtcgcggaataggtgcgtttttttagatttttcgcgattaggaaggaagggttcggcgcggg

SEQ ID NO: 3896 - DNA, 565 bp, Artificial Sequence
  chemically treated genomic DNA (Homo sapiens) CpG-island No: 3896
cccgcgccgaacccttccttcctaatcgcgaaaaatctaaaaaaacgcacctattccgcgaccgtcacgcacccctcctccgcctaccgcgatataccgctacctaaccaaaacgctactaccgtcccgaaccgaacccgctaccctaaactccgcgaccaaccactcgaccgcgttactaaaccgaaaccgcgaacaacccgccgccgcctcgcaaccgaaactcgcattaaccgcccgacgccactacaacgaattaataaccgaccgcgaaaacgaccccaacttcttcaaaataataaaaaacttcttcgatcgcgacgccaacatcgtaaaaaacaaattaataaaaaacctaaaaacccaaaaaaacgaaaaacaaaaacgaaaccgaatacgcgacatcctacgaatcatcaaaccctacaaccatatactaaatctctccttccccatccgacgcgacgacgactcctaaaaaatcatcgaaaactaccgaacccaacacaaccaacaccgcacgccctacaaaaaaaatatccgttacaacactaatataaatata

SEQ ID NO: 3897 - DNA, 918 bp, Artificial Sequence
  chemically treated genomic DNA (Homo sapiens) CpG-island No: 3897
ttcgtgtacgttggtaggggaaggggttttcgcgttaagtttttttagttggttagtttttcgtcgcgtttttcgggtttgggtttcgttacgttagtcggtttttacggatattacgtttttttttagcggaggaggagtagtcggattttcgagtcgtcgcgggtcgtcgggtggggagggtttttttggcggggtcgcgttcgggtgggcgggggtcgcgcgtaagttgcgtagttgtataaatatcgcggggttgcgttgtatacgtagttgcgggtcgagggcgcggatcgcgggggagggggcggcgggttgtaggcggttttcgtacggttatacgcgttcgttttatcgtcgtttaggtcgtagaagttcgagcgtagcggttttcgcggtttttttttcgggtcgcgtttgtagagttgtaattcgtcgtgcgagtagttatagttcgcgcgtcgtttggggttttttcgtcggtttcgtcgcgtgtaggtttcggtcgtcggttaggtagttttatttatttagtttttgttcgggtttcgggtttcgggttcggttgtttttttttcgtcgcgggtcgtcgttttcggtcgttttcgggattttagtcgtttgtacgtattttcgattttaaaaataaataggcgtcgtcgttttttcgcggcgttcgcggggttttcgttagttcgcgtttttcgaggttgagaagtttgttggtagggttcgggcgggacgcgcgggttgttatttttcgtttgcgatgtaggagtttcggcgcgtttcgtattcgtgtcgttcgtttcgcgagcgttttgttttttttcgtgttatttttagttttgcgatgtagtgttaggattgtacggttttgatttatcggttgagtttatagtttgaaaaaaaaaaaaa

SEQ ID NO: 3898 - DNA, 918 bp, Artificial Sequence
  chemically treated genomic DNA (Homo sapiens) CpG-island No: 3898
tttttttttttttcaaactataaactcaaccgataaatcaaaaccgtacaatcctaacactacatcgcaaaactaaaaataacacgaaaaaaaacaaaacgctcgcgaaacgaacgacacgaatacgaaacgcgccgaaactcctacatcgcaaacgaaaaataacaacccgcgcgtcccgcccgaaccctaccaacaaacttctcaacctcgaaaaacgcgaactaacgaaaaccccgcgaacgccgcgaaaaaacgacgacgcctatttatttttaaaatcgaaaatacgtacaaacgactaaaatcccgaaaacgaccgaaaacgacgacccgcgacgaaaaaaaaacaaccgaacccgaaacccgaaacccgaacaaaaactaaataaataaaactacctaaccgacgaccgaaacctacacgcgacgaaaccgacgaaaaaaccccaaacgacgcgcgaactataactactcgcacgacgaattacaactctacaaacgcgacccgaaaaaaaaaccgcgaaaaccgctacgctcgaacttctacgacctaaacgacgataaaacgaacgcgtataaccgtacgaaaaccgcctacaacccgccgccccctcccccgcgatccgcgccctcgacccgcaactacgtatacaacgcaaccccgcgatatttatacaactacgcaacttacgcgcgacccccgcccacccgaacgcgaccccgccaaaaaaaccctccccacccgacgacccgcgacgactcgaaaatccgactactcctcctccgctaaaaaaaaacgtaatatccgtaaaaaccgactaacgtaacgaaacccaaacccgaaaaacgcgacgaaaaactaaccaactaaaaaaacttaacgcgaaaaccccttcccctaccaacgtacacgaa

SEQ ID NO: 3899 - DNA, 918 bp, Artificial Sequence
  chemically treated genomic DNA (Homo sapiens) CpG-island No: 3899
ttttttttttttttaagttgtgagtttaatcgatgagttagagtcgtgtaattttgatattgtatcgtaggattgggggtgatacggagggaggtagagcgttcgcgaggcggacggtacgggtgcggggcgcgtcgaggtttttgtatcgtaagcggggggtgatagttcgcgcgtttcgttcgggttttgttagtaaattttttagtttcgggaggcgcgggttggcggaagtttcgcgagcgtcgcggggaggcgacggcgtttgtttgtttttaaaatcgggagtgcgtgtaggcggttggagtttcggaggcgatcgaaggcggcgattcgcggcggaagggggatagtcgagttcggagttcggagttcgggtaagagttgggtaagtggggttgtttggtcggcggtcgaggtttgtacgcggcggggtcggcgaggggattttaggcggcgcgcgagttgtggttgttcgtacggcgggttgtagttttgtaggcgcggttcggagagggggtcgcgggggtcgttgcgttcgaatttttgcggtttgggcggcggtggagcgggcgcgtgtggtcgtgcgggggtcgtttgtagttcgtcgttttttttttcgcggttcgcgttttcggttcgtagttgcgtgtgtagcgtagtttcgcggtgtttgtgtagttacgtagtttgcgcgcggttttcgtttattcgggcgcggtttcgttaggaaagttttttttattcggcggttcgcggcggttcgggaattcggttgtttttttttcgttggagagaaacgtggtgttcgtggggatcggttgacgtgacggagtttaggttcggaaggcgcggcgaggggttagttagttgagggaatttggcgcgggagtttttttttttgttagcgtgtacggg

SEQ ID NO: 3900 - DNA, 918 bp, Artificial Sequence
  chemically treated genomic DNA (Homo sapiens) CpG-island No: 3900
cccgtacacgctaacaaaaaaaaaaactcccgcgccaaattccctcaactaactaacccctcgccgcgccttccgaacctaaactccgtcacgtcaaccgatccccacgaacaccacgtttctctccaacgaaaaaaaaacaaccgaattcccgaaccgccgcgaaccgccgaataaaaaaaactttcctaacgaaaccgcgcccgaataaacgaaaaccgcgcgcaaactacgtaactacacaaacaccgcgaaactacgctacacacgcaactacgaaccgaaaacgcgaaccgcgaaaaaaaaaacgacgaactacaaacgacccccgcacgaccacacgcgcccgctccaccgccgcccaaaccgcaaaaattcgaacgcaacgacccccgcgaccccctctccgaaccgcgcctacaaaactacaacccgccgtacgaacaaccacaactcgcgcgccgcctaaaatcccctcgccgaccccgccgcgtacaaacctcgaccgccgaccaaacaaccccacttacccaactcttacccgaactccgaactccgaactcgactatcccccttccgccgcgaatcgccgccttcgatcgcctccgaaactccaaccgcctacacgcactcccgattttaaaaacaaacaaacgccgtcgcctccccgcgacgctcgcgaaacttccgccaacccgcgcctcccgaaactaaaaaatttactaacaaaacccgaacgaaacgcgcgaactatcaccccccgcttacgatacaaaaacctcgacgcgccccgcacccgtaccgtccgcctcgcgaacgctctacctccctccgtatcacccccaatcctacgatacaatatcaaaattacacgactctaactcatcgattaaactcacaacttaaaaaaaaaaaaaa

SEQ ID NO: 3901 - DNA, 803 bp, Artificial Sequence
  chemically treated genomic DNA (Homo sapiens) CpG-island No: 3901
tttcgcgagtcgtcggagtaggcgtgtttcgcgtcggttgggatatcgttgttatggagacgttcgagtagtttcgtcgcgggggcgggacggggcggggcggggcggacgtcgttcgtcggttggttttattttttattgtagtagtaacgtcgcggcgggttgcgggtaggattggacgttagagtagtcgcgtagcgtttgaatcgttgcgggtcgtcgcggtcgtttttttttattttcgtttttgttgtttttagtttcgttttttcgatttttttgtttttttgttgttttcgtttttggttttcggtcgttttcgtcgttcgtttagaggagttttcgcgttcgttaagaagtcgtttttcgttggttcgtagtcgtcgcgatttcggtatagtttttttttttggttagttttttaaacggtcgtttttcgttcgcgggaagattaggttgcgatcgcgaacgttcgattttttttaggagtcgtagcgagcgttcggcggttacgtttcgcgattatatttcggcggttttcggtttagcgcgtttgttttcgtcgttcgtcgtcgtttttcgttcgttgtacgacgacgcgacgtttttgttgtaggcggcggattcgatcggatttagatttagacgtaagatggcgacggtcgcgtgattgttttagcgttttcgagttcggtttcgagtgtatttacggattgattgtgggggtagagaagggcgagattaggattttgtttttgttaatcgtgattgtatgaaggtcgtttttttcgggtttatttggt

SEQ ID NO: 3902 - DNA, 803 bp, Artificial Sequence
  chemically treated genomic DNA (Homo sapiens) CpG-island No: 3902
accaaataaacccgaaaaaaacgaccttcatacaatcacgattaacaaaaacaaaatcctaatctcgcccttctctacccccacaatcaatccgtaaatacactcgaaaccgaactcgaaaacgctaaaacaatcacgcgaccgtcgccatcttacgtctaaatctaaatccgatcgaatccgccgcctacaacaaaaacgtcgcgtcgtcgtacaacgaacgaaaaacgacgacgaacgacgaaaacaaacgcgctaaaccgaaaaccgccgaaatataatcgcgaaacgtaaccgccgaacgctcgctacgactcctaaaaaaaatcgaacgttcgcgatcgcaacctaatcttcccgcgaacgaaaaacgaccgtttaaaaaactaaccaaaaaaaaaaactataccgaaatcgcgacgactacgaaccaacgaaaaacgacttcttaacgaacgcgaaaactcctctaaacgaacgacgaaaacgaccgaaaaccaaaaacgaaaacaacaaaaaaacaaaaaaatcgaaaaaacgaaactaaaaacaacaaaaacgaaaataaaaaaaaacgaccgcgacgacccgcaacgattcaaacgctacgcgactactctaacgtccaatcctacccgcaacccgccgcgacgttactactacaataaaaaataaaaccaaccgacgaacgacgtccgccccgccccgccccgtcccgcccccgcgacgaaactactcgaacgtctccataacaacgatatcccaaccgacgcgaaacacgcctactccgacgactcgcgaaa

SEQ ID NO: 3903 - DNA, 803 bp, Artificial Sequence
  chemically treated genomic DNA (Homo sapiens) CpG-island No: 3903
attaagtaggttcgagggaggcgatttttatgtagttacgattaataaagatagagttttgatttcgtttttttttgtttttatagttagttcgtaggtgtattcggagtcgagttcggggacgttgaggtagttacgcggtcgtcgttattttgcgtttgggtttgggttcggtcgggttcgtcgtttgtagtaggggcgtcgcgtcgtcgtgtagcgggcgaggagcgacggcgggcggcgaaggtaggcgcgttgggtcgagagtcgtcggggtgtggtcgcggggcgtggtcgtcgggcgttcgttgcggtttttggagaggatcgggcgttcgcggtcgtagtttggttttttcgcgggcgaggagcggtcgtttgggagattagttagagggagaaattgtgtcgaagtcgcggcggttgcgggttagcggaaagcggttttttggcgggcgcggggatttttttgggcgggcggcgaggacggtcgaggattagaaacgaaggtagtagaggagtaggaaagtcggagaagcgaggttggagatagtagaggcgagggtgggaaggggcggtcgcggcggttcgtagcggtttaggcgttgcgcggttgttttggcgtttagttttattcgtaattcgtcgcgacgttattgttgtagtggaggatggggttagtcggcgagcggcgttcgtttcgtttcgtttcgtttcgttttcgcggcggagttgttcgggcgtttttatggtaacggtgttttagtcggcgcgaggtacgtttgtttcggcggttcgcgggg

SEQ ID NO: 3904 - DNA, 803 bp, Artificial Sequence
  chemically treated genomic DNA (Homo sapiens) CpG-island No: 3904
ccccgcgaaccgccgaaacaaacgtacctcgcgccgactaaaacaccgttaccataaaaacgcccgaacaactccgccgcgaaaacgaaacgaaacgaaacgaaacgaacgccgctcgccgactaaccccatcctccactacaacaataacgtcgcgacgaattacgaataaaactaaacgccaaaacaaccgcgcaacgcctaaaccgctacgaaccgccgcgaccgccccttcccaccctcgcctctactatctccaacctcgcttctccgactttcctactcctctactaccttcgtttctaatcctcgaccgtcctcgccgcccgcccaaaaaaatccccgcgcccgccaaaaaaccgctttccgctaacccgcaaccgccgcgacttcgacacaatttctccctctaactaatctcccaaacgaccgctcctcgcccgcgaaaaaaccaaactacgaccgcgaacgcccgatcctctccaaaaaccgcaacgaacgcccgacgaccacgccccgcgaccacaccccgacgactctcgacccaacgcgcctaccttcgccgcccgccgtcgctcctcgcccgctacacgacgacgcgacgcccctactacaaacgacgaacccgaccgaacccaaacccaaacgcaaaataacgacgaccgcgtaactacctcaacgtccccgaactcgactccgaatacacctacgaactaactataaaaacaaaaaaaaacgaaatcaaaactctatctttattaatcgtaactacataaaaatcgcctccctcgaacctacttaat

SEQ ID NO: 3905 - DNA, 1262 bp, Artificial Sequence
  chemically treated genomic DNA (Homo sapiens) CpG-island No: 3905
gtgcgtaagtagtggtgacggcgggcgcgcggagaaaaggaacgttgtgacggaaattttagttgtcggagattttatcgtagtgaggttattggatttttcggattcggggcgtgatcggcgtcgattcggggcgtcgagaggtttatcgggcggagggggtttaattattatttcgtatttttttgggtttttttttcgggcggtgacgtgacgtgttgacggcgggttcgtgtcggggagttgggtcgttttttgttagtttcgaattcggtttttttttttttttttcgttcgttttattagtcggagttcggtttagtgttttagagaaaggtcgttttgtagtattcgtcgttgtcgtcgatcgttcgtatattcgtcgggtgagtttcgcgtgttttcgcggtcgcggggtttagtgcgcgcgtagtaatttgtttgtggtttggtcggcgtttcgtagggcgttttttcgcgttaggtcggtcggcgtggcgttcggcgtcgaataggtttcgaggaggtcgtagttaggtttagtgattatttagttgttttgagcggttgcggaggtgcgttttataagcgggtagggtgggaaaagttcgttcgtttgttcggaaggtagttgatggatttggggtcgatattattgcggacgtagggtacggtacgggggcgagaaggcgaaggttgtaggcgtgaggtgaaggtcggaggtttgttgggtttattttcgttatgtaaatgttcgcgaaggggaggagggacgggggggtaagatggcggttgttaggcgtttgttgttggggagtattgagagtgttgtcgggaggcggagtcgttattttgaaggcggtatttggaaaaaaaattcggttatgatttttgaggcggggatggggaaaaggacggcggcggcggcggtagcgtagttttcggcgcgacggcgtgtttgcgtaatagggcgtgttcgtttttttggcggtttttgtttttgtcgttatatgcgcgcgtacgttttagacgtttgcggtagcgttatttttcggttttttttttatagtttatttttggttgggtgtagtgtcggttacgttttaggtgatatgtcgtaggcgttcgttcgggcgtcggggttatttcgttttttagcgttttcggttttgtgttttttcgagagtttatagttattcgttttagtaggtggtaattcgggtatttaggtttacgagagtatataaattttagaaaatttt

SEQ ID NO: 3906 - DNA, 1262 bp, Artificial Sequence
  chemically treated genomic DNA (Homo sapiens) CpG-island No: 3906
aaaattttctaaaatttatatactctcgtaaacctaaatacccgaattaccacctactaaaacgaataactataaactctcgaaaaaacacaaaaccgaaaacgctaaaaaacgaaataaccccgacgcccgaacgaacgcctacgacatatcacctaaaacgtaaccgacactacacccaaccaaaaataaactataaaaaaaaaaccgaaaaataacgctaccgcaaacgtctaaaacgtacgcgcgcatataacgacaaaaacaaaaaccgccaaaaaaacgaacacgccctattacgcaaacacgccgtcgcgccgaaaactacgctaccgccgccgccgccgtccttttccccatccccgcctcaaaaatcataaccgaattttttttccaaataccgccttcaaaataacgactccgcctcccgacaacactctcaatactccccaacaacaaacgcctaacaaccgccatcttacccccccgtccctcctccccttcgcgaacatttacataacgaaaataaacccaacaaacctccgaccttcacctcacgcctacaaccttcgccttctcgcccccgtaccgtaccctacgtccgcaataatatcgaccccaaatccatcaactaccttccgaacaaacgaacgaacttttcccaccctacccgcttataaaacgcacctccgcaaccgctcaaaacaactaaataatcactaaacctaactacgacctcctcgaaacctattcgacgccgaacgccacgccgaccgacctaacgcgaaaaaacgccctacgaaacgccgaccaaaccacaaacaaattactacgcgcgcactaaaccccgcgaccgcgaaaacacgcgaaactcacccgacgaatatacgaacgatcgacgacaacgacgaatactacaaaacgacctttctctaaaacactaaaccgaactccgactaataaaacgaacgaaaaaaaaaaaaaaaaaccgaattcgaaactaacaaaaaacgacccaactccccgacacgaacccgccgtcaacacgtcacgtcaccgcccgaaaaaaaaacccaaaaaaatacgaaataataattaaaccccctccgcccgataaacctctcgacgccccgaatcgacgccgatcacgccccgaatccgaaaaatccaataacctcactacgataaaatctccgacaactaaaatttccgtcacaacgttccttttctccgcgcgcccgccgtcaccactacttacgcac

SEQ ID NO: 3907 - DNA, 1262 bp, Artificial Sequence
  chemically treated genomic DNA (Homo sapiens) CpG-island No: 3907
aaaattttttggaatttatgtgttttcgtgagtttagatgttcgaattgttatttgttgaaacgggtggttgtagattttcggaagggtatagagtcgggagcgttgaggggcgaaatgatttcggcgttcgaacggacgtttgcggtatgttatttaaagcgtagtcgatattgtatttagttaaggatgggttgtgaggggaaggtcgaaaggtggcgttgtcgtaggcgtttggaacgtacgcgcgtatatggcgataaaggtaagggtcgttaagggaacgagtacgttttgttgcgtagatacgtcgtcgcgtcggaggttgcgttgtcgtcgtcgtcgtcgtttttttttttattttcgttttaaggattataatcgaattttttttttagatatcgtttttaagatggcggtttcgtttttcgataatatttttaatattttttagtagtaggcgtttagtagtcgttattttgttttttcgttttttttttttttcgcggatatttatatagcgaaaataggtttagtaggttttcggtttttattttacgtttgtagttttcgttttttcgttttcgtgtcgtgttttgcgttcgtagtggtgtcgattttaggtttattaattgtttttcggataaacgggcgaattttttttattttgttcgtttatggagcgtattttcgtagtcgtttagggtaattggataattattaggtttaattgcggttttttcggggtttgttcggcgtcgagcgttacgtcggtcggtttagcgcgggagggcgttttacgggacgtcgattaggttataaataggttattgcgcgcgtattaggtttcgcggtcgcgggggtacgcgggatttattcgacggatgtgcgggcggtcggcgatagcggcgggtgttgtaggacggtttttttttggagtattgggtcgggtttcggttggtagggcgggcggagggagggaggaggggtcgagttcggagttgataaaaagcggtttagtttttcggtacgggttcgtcgttagtacgttacgttatcgttcgggagagagatttaggaaaatgcgggatggtagttgggtttttttcgttcggtgggtttttcggcgtttcgggtcggcgtcggttacgtttcgagttcggggagtttagtgattttattgcggtggggttttcggtagttggagttttcgttataacgtttttttttttcgcgcgttcgtcgttattattatttgcgtat

SEQ ID NO: 3908 - DNA, 1262 bp, Artificial Sequence
  chemically treated genomic DNA (Homo sapiens) CpG-island No: 3908
atacgcaaataataataacgacgaacgcgcgaaaaaaaaaaacgttataacgaaaactccaactaccgaaaaccccaccgcaataaaatcactaaactccccgaactcgaaacgtaaccgacgccgacccgaaacgccgaaaaacccaccgaacgaaaaaaacccaactaccatcccgcattttcctaaatctctctcccgaacgataacgtaacgtactaacgacgaacccgtaccgaaaaactaaaccgctttttatcaactccgaactcgacccctcctccctccctccgcccgccctaccaaccgaaacccgacccaatactccaaaaaaaaaccgtcctacaacacccgccgctatcgccgaccgcccgcacatccgtcgaataaatcccgcgtacccccgcgaccgcgaaacctaatacgcgcgcaataacctatttataacctaatcgacgtcccgtaaaacgccctcccgcgctaaaccgaccgacgtaacgctcgacgccgaacaaaccccgaaaaaaccgcaattaaacctaataattatccaattaccctaaacgactacgaaaatacgctccataaacgaacaaaataaaaaaaattcgcccgtttatccgaaaaacaattaataaacctaaaatcgacaccactacgaacgcaaaacacgacacgaaaacgaaaaaacgaaaactacaaacgtaaaataaaaaccgaaaacctactaaacctattttcgctatataaatatccgcgaaaaaaaaaaaaaacgaaaaaacaaaataacgactactaaacgcctactactaaaaaatattaaaaatattatcgaaaaacgaaaccgccatcttaaaaacgatatctaaaaaaaaaattcgattataatccttaaaacgaaaataaaaaaaaaaacgacgacgacgacgacaacgcaacctccgacgcgacgacgtatctacgcaacaaaacgtactcgttcccttaacgacccttacctttatcgccatatacgcgcgtacgttccaaacgcctacgacaacgccacctttcgaccttcccctcacaacccatccttaactaaatacaatatcgactacgctttaaataacataccgcaaacgtccgttcgaacgccgaaatcatttcgcccctcaacgctcccgactctatacccttccgaaaatctacaaccacccgtttcaacaaataacaattcgaacatctaaactcacgaaaacacataaattccaaaaaatttt

SEQ ID NO: 3909 - DNA, 688 bp, Artificial Sequence
  chemically treated genomic DNA (Homo sapiens) CpG-island No: 3909
ttttttttagggttacggtggcgtacggaaatttgttaagaatttttgttacgcgggcgttttggtgacggtggtatcggggaagggtgcgatttttagatttgcggggttaattcggtagtaatggtgggacgggttagggcggggttgaggggcgttcgtatttttcggttttagcggggatttgggagttcgaatttcgggttttattttgagatgcgagttgagtcggtggggatttcggttttggttcgagttcgcgaatttttcggggtcggcgtattcgaggtcgttgtggtggttgtaggagtcgtcgtttatgaagagttgtacgttcgtttttttcgtttttagttttatcgtagttttggtgcgcggtcgttgtagtcggttgggcggtgcggttttcggttcgcgcggtttttttttttcgtagcgttcgtttcgttttttttcgtttcgtttagttttgcgaggttcgggcggcggacgttttacgttgtgggttttagtttttagttcgcgtttcgagttcgtttcgtttcgtcgttttttttcgtttatttttttcggggcgtagggaatcgtttttacgagttatagttcgggttttgtagtgggcgacgacgtcggtagttgggacgaggagggttttttggttatttttttgggggttcgtattgttatg

SEQ ID NO: 3910 - DNA, 688 bp, Artificial Sequence
  chemically treated genomic DNA (Homo sapiens) CpG-island No: 3910
cataacaatacgaacccccaaaaaaataaccaaaaaaccctcctcgtcccaactaccgacgtcgtcgcccactacaaaacccgaactataactcgtaaaaacgattccctacgccccgaaaaaaataaacgaaaaaaaacgacgaaacgaaacgaactcgaaacgcgaactaaaaactaaaacccacaacgtaaaacgtccgccgcccgaacctcgcaaaactaaacgaaacgaaaaaaaacgaaacgaacgctacgaaaaaaaaaaaccgcgcgaaccgaaaaccgcaccgcccaaccgactacaacgaccgcgcaccaaaactacgataaaactaaaaacgaaaaaaacgaacgtacaactcttcataaacgacgactcctacaaccaccacaacgacctcgaatacgccgaccccgaaaaattcgcgaactcgaaccaaaaccgaaatccccaccgactcaactcgcatctcaaaataaaacccgaaattcgaactcccaaatccccgctaaaaccgaaaaatacgaacgcccctcaaccccgccctaacccgtcccaccattactaccgaattaaccccgcaaatctaaaaatcgcacccttccccgataccaccgtcaccaaaacgcccgcgtaacaaaaattcttaacaaatttccgtacgccaccgtaaccctaaaaaaaa

SEQ ID NO: 3911 - DNA, 688 bp, Artificial Sequence
  chemically treated genomic DNA (Homo sapiens) CpG-island No: 3911
tatgatagtacgggtttttagaagggtgattaggaggtttttttcgttttagttgtcggcgtcgtcgtttattgtagggttcgggttgtgattcgtggggacggttttttgcgtttcgggggaggtgggcggggaggggcggcggggcggggcgggttcgggacgcgggttgggagttggagtttatagcgtgaagcgttcgtcgttcgggtttcgtagggttaggcgaggcgagggggggcggggcgggcgttacgggaaggggaggtcgcgcggatcgggagtcgtatcgtttagtcggttgtagcggtcgcgtattaaggttgcgatggggttggagacggagaaggcggacgtatagttttttatggacgacgatttttatagttattatagcggtttcgagtacgtcgatttcgagaagttcgcggattcggattaggatcgggatttttatcggtttaattcgtattttaaggtgaagttcggggttcgggtttttaagttttcgttgaggtcgggaagtgcgggcgttttttagtttcgttttaattcgttttattattgttatcgggttggtttcgtaggtttgaggatcgtattttttttcggtattatcgttattagggcgttcgcgtagtaggaatttttagtaggttttcgtgcgttatcgtgattttaagaaaga

SEQ ID NO: 3912 - DNA, 688 bp, Artificial Sequence
  chemically treated genomic DNA (Homo sapiens) CpG-island No: 3912
tctttcttaaaatcacgataacgcacgaaaacctactaaaaattcctactacgcgaacgccctaataacgataataccgaaaaaaaatacgatcctcaaacctacgaaaccaacccgataacaataataaaacgaattaaaacgaaactaaaaaacgcccgcacttcccgacctcaacgaaaacttaaaaacccgaaccccgaacttcaccttaaaatacgaattaaaccgataaaaatcccgatcctaatccgaatccgcgaacttctcgaaatcgacgtactcgaaaccgctataataactataaaaatcgtcgtccataaaaaactatacgtccgccttctccgtctccaaccccatcgcaaccttaatacgcgaccgctacaaccgactaaacgatacgactcccgatccgcgcgacctccccttcccgtaacgcccgccccgccccccctcgcctcgcctaaccctacgaaacccgaacgacgaacgcttcacgctataaactccaactcccaacccgcgtcccgaacccgccccgccccgccgcccctccccgcccacctcccccgaaacgcaaaaaaccgtccccacgaatcacaacccgaaccctacaataaacgacgacgccgacaactaaaacgaaaaaaacctcctaatcacccttctaaaaacccgtactatcata

SEQ ID NO: 3913 - DNA, 916 bp, Artificial Sequence
  chemically treated genomic DNA (Homo sapiens) CpG-island No: 3913
ttcgggttattgttaggatcgcgggtgacgattggagtaagtgcgcggtcgagtggagtcgggtaaagggcggttataattattattttttagtttcgagtaggggaatcgcgtttttaatacgatcgttggggtttttagcggtttaggtcgattttcgtaaggagagaattttttttttaaattgatttttgtaatttggtttgggcgtttaggatatcgcggtttcgattagtttcgtagttttagtagtttacgggtagggttttagcggcggattatgagcgagtcgtcgttttttattttcgttatgtttgcggtggagagatttcggttttcgaaacgttttacggttagacgtcggacgattattcgtttcgtagtcggaagaggtagtaagaatattttgtcggttcggtttttcgtatcgttttttagcgagtacgtggagagcggtgggcgggcgcgttttggggcggggttttcggggcgtagacggcgtgcgcgcggattggttcgggcgtcgggcgagcggacgtgcgtttagggggcgggacggatgggtagtatcggtcgattggatcgttgggattaaatcgcggttgtggaggggatttaagggtgcgttcgtattcgtgtgcgttcgtattcgtgtgcgttcgtattcgtgtgcgttcgcgtatgcgggcgggggcgaaaaggcggggttttcggacgcggttgatagtttcgggagtaacgcgaagtagaggggcgggatcgatatggtgacgttatacgatgggtggggcggaggcggggcgagttttgtaagcgggcgtgggcggagcgttgggtaattttcgggaaatagaaattgagtgttagagtttgttgttaaggttgttgaatagacgattgtatagtgaagatattt

SEQ ID NO: 3914 - DNA, 916 bp, Artificial Sequence
  chemically treated genomic DNA (Homo sapiens) CpG-island No: 3914
aaatatcttcactatacaatcgtctattcaacaaccttaacaacaaactctaacactcaatttctatttcccgaaaattacccaacgctccgcccacgcccgcttacaaaactcgccccgcctccgccccacccatcgtataacgtcaccatatcgatcccgcccctctacttcgcgttactcccgaaactatcaaccgcgtccgaaaaccccgccttttcgcccccgcccgcatacgcgaacgcacacgaatacgaacgcacacgaatacgaacgcacacgaatacgaacgcacccttaaatcccctccacaaccgcgatttaatcccaacgatccaatcgaccgatactacccatccgtcccgccccctaaacgcacgtccgctcgcccgacgcccgaaccaatccgcgcgcacgccgtctacgccccgaaaaccccgccccaaaacgcgcccgcccaccgctctccacgtactcgctaaaaaacgatacgaaaaaccgaaccgacaaaatattcttactacctcttccgactacgaaacgaataatcgtccgacgtctaaccgtaaaacgtttcgaaaaccgaaatctctccaccgcaaacataacgaaaataaaaaacgacgactcgctcataatccgccgctaaaaccctacccgtaaactactaaaactacgaaactaatcgaaaccgcgatatcctaaacgcccaaaccaaattacaaaaatcaatttaaaaaaaaaattctctccttacgaaaatcgacctaaaccgctaaaaaccccaacgatcgtattaaaaacgcgattcccctactcgaaactaaaaaataataattataaccgccctttacccgactccactcgaccgcgcacttactccaatcgtcacccgcgatcctaacaataacccgaa

SEQ ID NO: 3915 - DNA, 916 bp, Artificial Sequence
  chemically treated genomic DNA (Homo sapiens) CpG-island No: 3915
gagtgtttttattatgtagtcgtttatttagtaattttgataataagttttggtatttagtttttatttttcgggagttgtttagcgtttcgtttacgttcgtttgtagaattcgtttcgttttcgttttatttatcgtgtgacgttattatatcggtttcgtttttttatttcgcgttgttttcgggattgttaatcgcgttcggaagtttcgttttttcgttttcgttcgtatgcgcgggcgtatacgaatgcgggcgtatacgaatgcgggcgtatacgaatgcgggcgtatttttgagttttttttataatcgcggtttgattttagcggtttagtcggtcggtgttgtttattcgtttcgttttttagacgtacgttcgttcgttcggcgttcgagttagttcgcgcgtacgtcgtttgcgtttcgaaagtttcgttttaaggcgcgttcgtttatcgttttttacgtgttcgttggagggcggtgcgaggggtcgagtcgataagatgtttttgttgtttttttcggttgcggggcgagtagtcgttcgacgtttggtcgtgagacgtttcgggagtcggagtttttttatcgtagatatgacgaaggtgagaggcggcggttcgtttatggttcgtcgttggggttttgttcgtgggttattggggttgcggggttggtcgaagtcgcggtgttttgggcgtttaagttaagttgtaaaaattagtttaaaagaaaaattttttttttgcggggatcggtttaggtcgttgaggattttagcggtcgtattgagggcgcgatttttttgttcggggttagggggtgatggttgtagtcgttttttattcggttttattcggtcgcgtatttgttttagtcgttattcgcggttttggtagtaattcggg

SEQ ID NO: 3916 - DNA, 916 bp, Artificial Sequence
  chemically treated genomic DNA (Homo sapiens) CpG-island No: 3916
cccgaattactaccaaaaccgcgaataacgactaaaacaaatacgcgaccgaataaaaccgaataaaaaacgactacaaccatcaccccctaaccccgaacaaaaaaatcgcgccctcaatacgaccgctaaaatcctcaacgacctaaaccgatccccgcaaaaaaaaaatttttcttttaaactaatttttacaacttaacttaaacgcccaaaacaccgcgacttcgaccaaccccgcaaccccaataacccacgaacaaaaccccaacgacgaaccataaacgaaccgccgcctctcaccttcgtcatatctacgataaaaaaactccgactcccgaaacgtctcacgaccaaacgtcgaacgactactcgccccgcaaccgaaaaaaacaacaaaaacatcttatcgactcgacccctcgcaccgccctccaacgaacacgtaaaaaacgataaacgaacgcgccttaaaacgaaactttcgaaacgcaaacgacgtacgcgcgaactaactcgaacgccgaacgaacgaacgtacgtctaaaaaacgaaacgaataaacaacaccgaccgactaaaccgctaaaatcaaaccgcgattataaaaaaaactcaaaaatacgcccgcattcgtatacgcccgcattcgtatacgcccgcattcgtatacgcccgcgcatacgaacgaaaacgaaaaaacgaaacttccgaacgcgattaacaatcccgaaaacaacgcgaaataaaaaaacgaaaccgatataataacgtcacacgataaataaaacgaaaacgaaacgaattctacaaacgaacgtaaacgaaacgctaaacaactcccgaaaaataaaaactaaataccaaaacttattatcaaaattactaaataaacgactacataataaaaacactc

SEQ ID NO: 3917 - DNA, 642 bp, Artificial Sequence
  chemically treated genomic DNA (Homo sapiens) CpG-island No: 3917
  misc_feature (51)..(51): n is either a, c, g or t
cgttcgatttattattcgttttttttgggttcgggttcgtttatttcgggnttcgtcggaggcggaggtaacgtcgtgcgtacgcgtaggtcgtggtgcggttttttggagcgtcggaagttcgtagtgtcggaggttcgtagcgtcggaattttagaggcgggtcgtagcggcgtagaggaggttagttgcgggagcgttttcggggacggtgtcgttatgagattgatttcgcgcgcgttgtgtagcgtcgtttaggtcgtttggcgggagaatttttttttgtgcggtcgcgacgtggcgcgttggttttcgggttatatggttaagggtgaggtacggcggggaggggtaaggttatgtttacggtcgcggcgtttttgttttttttttatttcggtttcggtcgtcgtttgtttttttcggtcgttttgggttggtttcgtttttttttttttgtttttttttttttttcgtttttattcgttttcggagtcgtcgggatttttttttttgcgtagttgcgggagaggttcgttttcgcgagtgttttcgcggcgtagtttcggatttagggtttgtttgattttttatttttggttcgtcgtttttgttttttgtttttagtaagttttttttgtt

SEQ ID NO: 3918 - DNA, 642 bp, Artificial Sequence
  chemically treated genomic DNA (Homo sapiens) CpG-island No: 3918
  misc_feature (592)..(592): n is either a, c, g or t
aacaaaaaaaacttactaaaaacaaaaaacaaaaacgacgaaccaaaaataaaaaatcaaacaaaccctaaatccgaaactacgccgcgaaaacactcgcgaaaacgaacctctcccgcaactacgcaaaaaaaaaaatcccgacgactccgaaaacgaataaaaacgaaaaaaaaaaaaaaacaaaaaaaaaaaaacgaaaccaacccaaaacgaccgaaaaaaacaaacgacgaccgaaaccgaaataaaaaaaaaacaaaaacgccgcgaccgtaaacataaccttacccctccccgccgtacctcacccttaaccatataacccgaaaaccaacgcgccacgtcgcgaccgcacaaaaaaaaattctcccgccaaacgacctaaacgacgctacacaacgcgcgcgaaatcaatctcataacgacaccgtccccgaaaacgctcccgcaactaacctcctctacgccgctacgacccgcctctaaaattccgacgctacgaacctccgacactacgaacttccgacgctccaaaaaaccgcaccacgacctacgcgtacgcacgacgttacctccgcctccgacgaancccgaaataaacgaacccgaacccaaaaaaaacgaataataaatcgaacg

SEQ ID NO: 3919 - DNA, 642 bp, Artificial Sequence
  chemically treated genomic DNA (Homo sapiens) CpG-island No: 3919
  misc_feature (592)..(592): n is either a, c, g or t
ggtagaaggaatttgttgggaatagaggataggggcggcgggttagaggtaggaggttaagtaggttttgggttcgaggttgcgtcgcgggggtattcgcgggaacgggtttttttcgtagttgcgtaggggaaggggtttcggcggtttcgggagcgggtgagagcggggaaggaggggagataagggaggaggggcggggttagtttaggacgatcgggagaagtaggcgacggtcgaaatcggggtgggagggaagtagaggcgtcgcggtcgtaggtatgattttgttttttttcgtcgtgttttatttttggttatgtggttcgggaattagcgcgttacgtcgcgatcgtatagggggaagttttttcgttaggcggtttgggcggcgttgtatagcgcgcgcggggttaattttatggcggtatcgttttcggaaacgttttcgtagttgattttttttgcgtcgttgcgattcgtttttgaggtttcggcgttgcgggttttcggtattgcgggttttcggcgttttaaggggtcgtattacggtttgcgcgtgcgtacgacgttgttttcgttttcggcgaanttcggagtgggcgggttcgggtttaaggaggacgaatggtgggtcgagcg

SEQ ID NO: 3920 - DNA, 642 bp, Artificial Sequence
  chemically treated genomic DNA (Homo sapiens) CpG-island No: 3920
  misc_feature (51)..(51): n is either a, c, g or t
cgctcgacccaccattcgtcctccttaaacccgaacccgcccactccgaanttcgccgaaaacgaaaacaacgtcgtacgcacgcgcaaaccgtaatacgaccccttaaaacgccgaaaacccgcaataccgaaaacccgcaacgccgaaacctcaaaaacgaatcgcaacgacgcaaaaaaaatcaactacgaaaacgtttccgaaaacgataccgccataaaattaaccccgcgcgcgctatacaacgccgcccaaaccgcctaacgaaaaaacttccccctatacgatcgcgacgtaacgcgctaattcccgaaccacataaccaaaaataaaacacgacgaaaaaaaacaaaatcatacctacgaccgcgacgcctctacttccctcccaccccgatttcgaccgtcgcctacttctcccgatcgtcctaaactaaccccgcccctcctcccttatctcccctccttccccgctctcacccgctcccgaaaccgccgaaaccccttcccctacgcaactacgaaaaaaacccgttcccgcgaatacccccgcgacgcaacctcgaacccaaaacctacttaacctcctacctctaacccgccgcccctatcctctattcccaacaaattccttctacc

SEQ ID NO: 3921 - DNA, 724 bp, Artificial Sequence
  chemically treated genomic DNA (Homo sapiens) CpG-island No: 3921
ggaagtgtttcgcgtgggagggttcgcgaggataggcgttagggagcgtttcgcgttgtcgggcggtgcgcgcgagcgtttttatggagggagaagtcggtcggtcgggcgggttagtgttttttgtaagggagacgagggcgtagcgagcgtttttttttagggattcgcgtcgagtgcgagggcgtagtgggtttgggggtgttacggtgttaggggtgggatttgggagagtttaacgcgttcggaggggggttgtgaaagtttttagtatcgttagcgagtcgttagttcgcgtgtgcgcgcgtttgcgtgtgcgcgtgtagttatagggttgtagggatataggattaaagtataaagtatattcgtaaagtataaagtttagaagtcgagggtaagtgtagaaacgtttttcgttcgggaagttgagcgtatatttaggtacgtttgtgtttttggaggaatttttcggtgtaggcggtcgagttttttgttgtatcgtagttcgcgggggttggaaaggttttcgttttgtttttaggcgcgttttcgttttttgagtttcggttttttgcggaggggtcgcgcgttttagtttgttagcgtgagttttatttttcgttttcggcgtgggttttttgagtcgtgttttatttttttttgattttttttcgttttagttggagaaaaggttttcggaagggtgatttggtgtcgttgg

SEQ ID NO: 3922 - DNA, 724 bp, Artificial Sequence
  chemically treated genomic DNA (Homo sapiens) CpG-island No: 3922
ccaacgacaccaaatcacccttccgaaaaccttttctccaactaaaacgaaaaaaaatcaaaaaaaaataaaacacgactcaaaaaacccacgccgaaaacgaaaaataaaactcacgctaacaaactaaaacgcgcgacccctccgcaaaaaaccgaaactcaaaaaacgaaaacgcgcctaaaaacaaaacgaaaacctttccaacccccgcgaactacgatacaacaaaaaactcgaccgcctacaccgaaaaattcctccaaaaacacaaacgtacctaaatatacgctcaacttcccgaacgaaaaacgtttctacacttaccctcgacttctaaactttatactttacgaatatactttatactttaatcctatatccctacaaccctataactacacgcgcacacgcaaacgcgcgcacacgcgaactaacgactcgctaacgatactaaaaactttcacaacccccctccgaacgcgttaaactctcccaaatcccacccctaacaccgtaacacccccaaacccactacgccctcgcactcgacgcgaatccctaaaaaaaaacgctcgctacgccctcgtctcccttacaaaaaacactaacccgcccgaccgaccgacttctccctccataaaaacgctcgcgcgcaccgcccgacaacgcgaaacgctccctaacgcctatcctcgcgaaccctcccacgcgaaacacttcc

SEQ ID NO: 3923 - DNA, 724 bp, Artificial Sequence
  chemically treated genomic DNA (Homo sapiens) CpG-island No: 3923
ttagcgatattaggttattttttcgggagttttttttttagttgggacgagagggaattaaaggaaagtaagatacggtttaggaggtttacgtcgagagcgaagagtgaagtttacgttggtaaattggagcgcgcggttttttcgtagaggatcggggtttaggaggcggggacgcgtttgaaaatagggcgggagtttttttaattttcgcgggttgcgatgtagtagaaaattcggtcgtttgtatcggggaatttttttagaaatataggcgtgtttgggtgtgcgtttaatttttcgggcgagggacgtttttgtatttgttttcggtttttgaattttgtattttgcgagtgtattttgtattttggttttgtgtttttgtagttttgtgattatacgcgtatacgtaggcgcgcgtatacgcgaattgacggttcgttggcgatgttggaggtttttatagttttttttcggacgcgttaagtttttttaggttttatttttgatatcgtggtatttttagatttattgcgttttcgtattcgacgcgggtttttgggggaaagcgttcgttgcgttttcgttttttttgtaggagatattggttcgttcggtcggtcggtttttttttttatggggacgttcgcgcgtatcgttcggtagcgcgggacgttttttgacgtttgttttcgcgggtttttttacgcggggtattttt

SEQ ID NO: 3924 - DNA, 724 bp, Artificial Sequence
  chemically treated genomic DNA (Homo sapiens) CpG-island No: 3924
aaaaataccccgcgtaaaaaaacccgcgaaaacaaacgtcaaaaaacgtcccgcgctaccgaacgatacgcgcgaacgtccccataaaaaaaaaaaccgaccgaccgaacgaaccaatatctcctacaaaaaaaacgaaaacgcaacgaacgctttcccccaaaaacccgcgtcgaatacgaaaacgcaataaatctaaaaataccacgatatcaaaaataaaacctaaaaaaacttaacgcgtccgaaaaaaaactataaaaacctccaacatcgccaacgaaccgtcaattcgcgtatacgcgcgcctacgtatacgcgtataatcacaaaactacaaaaacacaaaaccaaaatacaaaatacactcgcaaaatacaaaattcaaaaaccgaaaacaaatacaaaaacgtccctcgcccgaaaaattaaacgcacacccaaacacgcctatatttctaaaaaaattccccgatacaaacgaccgaattttctactacatcgcaacccgcgaaaattaaaaaaactcccgccctattttcaaacgcgtccccgcctcctaaaccccgatcctctacgaaaaaaccgcgcgctccaatttaccaacgtaaacttcactcttcgctctcgacgtaaacctcctaaaccgtatcttactttcctttaattccctctcgtcccaactaaaaaaaaaactcccgaaaaaataacctaatatcgctaa

SEQ ID NO: 3925 - DNA, 961 bp, Artificial Sequence
  chemically treated genomic DNA (Homo sapiens) CpG-island No: 3925
  misc_feature (42)..(42): n is either a, c, g or t
  misc_feature (261)..(261): n is either a, c, g or t
tacgtttcggcgtttagtttcgtttcgattttttttaggagnttcgtttcgttttcgttttttttagaagtttcgtttatgtttcgtttttagcgttcgtaatttacggggcgggttttatcgtttagaagagcgtacggcgggcgttgtcggtttcgagcgttttcgttattattgtcgttttcggttttgtcggtcggttatgtttcgagtttcggttgtcgcgcgtatttagattcggcgatgaggagtggcgtcgancgtaggggtagtagcgtcgcggcgttttcgggttcgtcgtttttcggtcgcgcgcgtttcgtcggtttcgacgcgttttcggttttgtcgtcgttcgttgttggttagtttcgggttcgggattcgggcgatgttcgttcgtagtcgcgttttttgttttagtggagtaagtggaagaagaggatgggttcgtttatgtcggcggttatcgcgcggaggtcggtgtttgacgataaggaggacggtgagtgcgggtacggggacgacgtgggggtcgcgcgttattgtaggggcgggcgcggttgggcggttttttttcgtaggggttttttcggtgttcgggacggtttttcggggcgtttcggttttcggagaagttcgcgtcgggtggttgcggttttacgcgagttttgggcgttcgttcgcgtttttcgtttttagtggcggcgtcgtaggaggagtaggttgggttcgggttttcggggcgagggtttttcgcggttgtggcgttttcgggtttgcgcgcgttttcgtttatcgttcgtggtagttttgtttttcgtttttcgtgattcgttcgggtttacgtgcgggttcgtttgtattttgtagttagagaggcgtttatttgtgtcgttcgagtgcgagtgaggtttttgttttataggtggcggggttcggtcgtttagaggtttagttt

SEQ ID NO: 3926 - DNA, 961 bp, Artificial Sequence
  chemically treated genomic DNA (Homo sapiens) CpG-island No: 3926
  misc_feature (701)..(701): n is either a, c, g or t
  misc_feature (920)..(920): n is either a, c, g or t
aaactaaacctctaaacgaccgaaccccgccacctataaaacaaaaacctcactcgcactcgaacgacacaaataaacgcctctctaactacaaaatacaaacgaacccgcacgtaaacccgaacgaatcacgaaaaacgaaaaacaaaactaccacgaacgataaacgaaaacgcgcgcaaacccgaaaacgccacaaccgcgaaaaaccctcgccccgaaaacccgaacccaacctactcctcctacgacgccgccactaaaaacgaaaaacgcgaacgaacgcccaaaactcgcgtaaaaccgcaaccacccgacgcgaacttctccgaaaaccgaaacgccccgaaaaaccgtcccgaacaccgaaaaaacccctacgaaaaaaaaccgcccaaccgcgcccgcccctacaataacgcgcgacccccacgtcgtccccgtacccgcactcaccgtcctccttatcgtcaaacaccgacctccgcgcgataaccgccgacataaacgaacccatcctcttcttccacttactccactaaaacaaaaaacgcgactacgaacgaacatcgcccgaatcccgaacccgaaactaaccaacaacgaacgacgacaaaaccgaaaacgcgtcgaaaccgacgaaacgcgcgcgaccgaaaaacgacgaacccgaaaacgccgcgacgctactacccctacgntcgacgccactcctcatcgccgaatctaaatacgcgcgacaaccgaaactcgaaacataaccgaccgacaaaaccgaaaacgacaataataacgaaaacgctcgaaaccgacaacgcccgccgtacgctcttctaaacgataaaacccgccccgtaaattacgaacgctaaaaacgaaacataaacgaaacttctaaaaaaaacgaaaacgaaacgaanctcctaaaaaaaatcgaaacgaaactaaacgccgaaacgta

SEQ ID NO: 3927 - DNA, 961 bp, Artificial Sequence
  chemically treated genomic DNA (Homo sapiens) CpG-island No: 3927
  misc_feature (701)..(701): n is either a, c, g or t
  misc_feature (920)..(920): n is either a, c, g or t
agattgagtttttgagcggtcgggtttcgttatttgtggggtaggagttttattcgtattcgggcggtataggtgagcgtttttttaattgtaaagtataaacgagttcgtacgtgggttcgagcggattacggaaagcggaaagtagggttgttacgggcggtgggcggaggcgcgcgtaagttcggagacgttatagtcgcgggggattttcgtttcgagggttcgggtttagtttgttttttttgcggcgtcgttattagaaacggaggacgcgggcgggcgtttagaattcgcgtggggtcgtagttattcggcgcgagttttttcggaagtcggggcgtttcgggaagtcgtttcggatatcgggggaatttttgcgggaaaaagtcgtttagtcgcgttcgtttttgtaatagcgcgcggtttttacgtcgttttcgtgttcgtatttatcgttttttttgtcgttaaatatcggttttcgcgcggtggtcgtcgatatggacgagtttattttttttttttatttgttttattgaaatagggggcgcggttgcgaacggatatcgttcgagtttcgggttcggggttggttagtagcgggcggcggtagggtcgaaggcgcgtcggagtcggcggggcgcgcgcggtcggggggcggcgagttcggggacgtcgcggcgttgttgtttttgcgntcggcgttattttttatcgtcgggtttgggtgcgcgcggtagtcggaattcggggtatggtcggtcggtagggtcgggagcggtagtggtagcgggagcgttcggggtcggtagcgttcgtcgtgcgtttttttgggcggtggaattcgtttcgtagattgcgagcgttgggggcggggtatgggcggggtttttggaaggggcgggggcggggcggantttttggaaggggtcgaggcggagttgagcgtcggggcgtg

SEQ ID NO: 3928 - DNA, 961 bp, Artificial Sequence
  chemically treated genomic DNA (Homo sapiens) CpG-island No: 3928
  misc_feature (42)..(42): n is either a, c, g or t
  misc_feature (261)..(261): n is either a, c, g or t
cacgccccgacgctcaactccgcctcgaccccttccaaaaantccgccccgcccccgccccttccaaaaaccccgcccataccccgcccccaacgctcgcaatctacgaaacgaattccaccgcccaaaaaaacgcacgacgaacgctaccgaccccgaacgctcccgctaccactaccgctcccgaccctaccgaccgaccataccccgaattccgactaccgcgcgcacccaaacccgacgataaaaaataacgccgancgcaaaaacaacaacgccgcgacgtccccgaactcgccgccccccgaccgcgcgcgccccgccgactccgacgcgccttcgaccctaccgccgcccgctactaaccaaccccgaacccgaaactcgaacgatatccgttcgcaaccgcgccccctatttcaataaaacaaataaaaaaaaaaaataaactcgtccatatcgacgaccaccgcgcgaaaaccgatatttaacgacaaaaaaaacgataaatacgaacacgaaaacgacgtaaaaaccgcgcgctattacaaaaacgaacgcgactaaacgactttttcccgcaaaaattcccccgatatccgaaacgacttcccgaaacgccccgacttccgaaaaaactcgcgccgaataactacgaccccacgcgaattctaaacgcccgcccgcgtcctccgtttctaataacgacgccgcaaaaaaaacaaactaaacccgaaccctcgaaacgaaaatcccccgcgactataacgtctccgaacttacgcgcgcctccgcccaccgcccgtaacaaccctactttccgctttccgtaatccgctcgaacccacgtacgaactcgtttatactttacaattaaaaaaacgctcacctataccgcccgaatacgaataaaactcctaccccacaaataacgaaacccgaccgctcaaaaactcaatct

SEQ ID NO: 3929 - DNA, 685 bp, Artificial Sequence
  chemically treated genomic DNA (Homo sapiens) CpG-island No: 3929
  misc_feature (53)..(53): n is either a, c, g or t
cgcgttatcgaattgttcgttaggtttaaggcgcgatatttcgacggtaaggntttcgtcgtgatttatggcgatgtttgtttgtcgaatattatggtggaaaatggtcgtttttttggatttatcgattgtggtcggttgggtgtggcggattttattaggatatagcgttggttattcgtgatattgttgaagagtttggcggcgaatgggttgatcgttttttcgtgttttacggtatcgtcgttttcgattcgtagcgtatcgttttttatcgtttttttgacgagtttttttgagcgggattttggggttcgaaatgatcgattaagcgacgtttaatttgttattacgagatttcgattttatcgtcgttttttatgaaaggttgggtttcggaatcgtttttcgggacgtcggttggatgattttttagcgcggggattttatgttggagtttttcgtttatttcgggttcgattttttcgcgagttggtttagttgttgtttgaggtggacgatttcgcggagttttatcggtagtgtaaattcgtcggtattttaggaaattagtagcggttattcgcgtatttatgttttcgaattgtaggagtggggaggtacgatggtcgttttggttcggaatttttgtgaaggaattttatttttgtggtgtgatataatt

SEQ ID NO: 3930 - DNA, 685 bp, Artificial Sequence
  chemically treated genomic DNA (Homo sapiens) CpG-island No: 3930
  misc_feature (633)..(633): n is either a, c, g or t
aattatatcacaccacaaaaataaaattccttcacaaaaattccgaaccaaaacgaccatcgtacctccccactcctacaattcgaaaacataaatacgcgaataaccgctactaatttcctaaaataccgacgaatttacactaccgataaaactccgcgaaatcgtccacctcaaacaacaactaaaccaactcgcgaaaaaatcgaacccgaaataaacgaaaaactccaacataaaatccccgcgctaaaaaatcatccaaccgacgtcccgaaaaacgattccgaaacccaacctttcataaaaaacgacgataaaatcgaaatctcgtaataacaaattaaacgtcgcttaatcgatcatttcgaaccccaaaatcccgctcaaaaaaactcgtcaaaaaaacgataaaaaacgatacgctacgaatcgaaaacgacgataccgtaaaacacgaaaaaacgatcaacccattcgccgccaaactcttcaacaatatcacgaataaccaacgctatatcctaataaaatccgccacacccaaccgaccacaatcgataaatccaaaaaaacgaccattttccaccataatattcgacaaacaaacatcgccataaatcacgacgaaanccttaccgtcgaaatatcgcgccttaaacctaacgaacaattcgataacgcg

SEQ ID NO: 3931 - DNA, 685 bp, Artificial Sequence
  chemically treated genomic DNA (Homo sapiens) CpG-island No: 3931
  misc_feature (633)..(633): n is either a, c, g or t
aattatgttatattatagaagtaaggtttttttataaagatttcggattaaagcggttatcgtgtttttttatttttgtagttcgggggtatggatgcgcggatagtcgttgttggttttttgggatgtcgacggatttgtattgtcggtagaatttcgcgaggtcgtttattttaggtagtagttgaattaattcgcgaggggatcgagttcggggtgggcgaagaattttagtatgagattttcgcgttggaggattatttagtcggcgtttcggaaaacgatttcgaagtttaattttttatagaaggcggcggtggaatcgaaatttcgtgatggtaggttgggcgtcgtttggtcggttatttcgaattttagagtttcgtttagaagaattcgttaagaaggcgatagaaggcgatgcgttgcgaatcgggagcggcgatatcgtaaagtacgaggaagcggttagtttattcgtcgttaagttttttagtaatattacgggtagttaacgttatgttttgatagggttcgttatatttagtcggttatagtcgatgaatttagaaaagcggttattttttattatgatattcggtaagtaggtatcgttatgggttacgacgaganttttgtcgtcgggatgtcgcgttttgagtttggcgaatagttcggtggcgcg

SEQ ID NO: 3932 - DNA, 685 bp, Artificial Sequence
  chemically treated genomic DNA (Homo sapiens) CpG-island No: 3932
  misc_feature (53)..(53): n is either a, c, g or t
cgcgccaccgaactattcgccaaactcaaaacgcgacatcccgacgacaaaantctcgtcgtaacccataacgatacctacttaccgaatatcataataaaaaataaccgcttttctaaattcatcgactataaccgactaaatataacgaaccctatcaaaacataacgttaactacccgtaatattactaaaaaacttaacgacgaataaactaaccgcttcctcgtactttacgatatcgccgctcccgattcgcaacgcatcgccttctatcgccttcttaacgaattcttctaaacgaaactctaaaattcgaaataaccgaccaaacgacgcccaacctaccatcacgaaatttcgattccaccgccgccttctataaaaaattaaacttcgaaatcgttttccgaaacgccgactaaataatcctccaacgcgaaaatctcatactaaaattcttcgcccaccccgaactcgatcccctcgcgaattaattcaactactacctaaaataaacgacctcgcgaaattctaccgacaatacaaatccgtcgacatcccaaaaaaccaacaacgactatccgcgcatccatacccccgaactacaaaaataaaaaaacacgataaccgctttaatccgaaatctttataaaaaaaccttacttctataatataacataatt

SEQ ID NO: 3933 - DNA, 858 bp, Artificial Sequence
  chemically treated genomic DNA (Homo sapiens) CpG-island No: 3933
  misc_feature (109)..(109): n is either a, c, g or t
  misc_feature (126)..(126): n is either a, c, g or t
ttattggcgatcgttagcggggttataaataaattgtgttgcggtaaatgtatttgtaacgtcgggaattgtttgcgaaatagtttcgttacgttcggttgtatataanagtcgttcgttagttanaaattagtaatgttttgttttttaatatgtcgggcgataatgttcgttattttttcgtatatcggttttatcgtaggttaaatttttttatcgtgatcgcgtttgtattgtttcgttttttttagcgaaatacggcgattttcggcgaaagttaaaaagatgtgatgttcgtcggtggttttattcgtcgagtacgttattttgtttttttttataatggtaatgtcggtagtgtcgtcgtcgatatttattatatcggcgttgtttagttgtagtaaattcgtaattgcggttggtttatttagtatatggtttatttttagttcggtagattttagtacgttgatggaaatacgcgggttcgtatttggaggaaatgaagtcgtcgtatggttaaaacgacgatcgaattgttgttcgagcgtgtcgaaatggcgacgaataatggtgatagcgtcgaagaaattttagacgatgtcgtcgcgaattatatcggtttagtcgaggtatatcgttattggttgatcgtcgcggtcgataattatcgatattatatcgtaggtgtttagatttatttttagttatagcggagattcgtcgcggggggcgttttggttatatagcgttgtcgtcgtttgtagaacgttggggtaagttattgttcgtcgtgcgttatttgttattttttaaataatgcgaaacgtatcgattaatatatagcgacgtagacgg

SEQ ID NO: 3934 - DNA, 858 bp, Artificial Sequence
  chemically treated genomic DNA (Homo sapiens) CpG-island No: 3934
  misc_feature (733)..(733): n is either a, c, g or t
  misc_feature (750)..(750): n is either a, c, g or t
ccgtctacgtcgctatatattaatcgatacgtttcgcattatttaaaaaataacaaataacgcacgacgaacaataacttaccccaacgttctacaaacgacgacaacgctatataaccaaaacgccccccgcgacgaatctccgctataactaaaaataaatctaaacacctacgatataatatcgataattatcgaccgcgacgatcaaccaataacgatatacctcgactaaaccgatataattcgcgacgacatcgtctaaaatttcttcgacgctatcaccattattcgtcgccatttcgacacgctcgaacaacaattcgatcgtcgttttaaccatacgacgacttcatttcctccaaatacgaacccgcgtatttccatcaacgtactaaaatctaccgaactaaaaataaaccatatactaaataaaccaaccgcaattacgaatttactacaactaaacaacgccgatataataaatatcgacgacgacactaccgacattaccattataaaaaaaaacaaaataacgtactcgacgaataaaaccaccgacgaacatcacatctttttaactttcgccgaaaatcgccgtatttcgctaaaaaaaacgaaacaatacaaacgcgatcacgataaaaaaatttaacctacgataaaaccgatatacgaaaaaataacgaacattatcgcccgacatattaaaaaacaaaacattactaatttntaactaacgaacgactnttatatacaaccgaacgtaacgaaactatttcgcaaacaattcccgacgttacaaatacatttaccgcaacacaatttatttataaccccgctaacgatcgccaataa

SEQ ID NO: 3935 - DNA, 858 bp, Artificial Sequence
  chemically treated genomic DNA (Homo sapiens) CpG-island No: 3935
  misc_feature (733)..(733): n is either a, c, g or t
  misc_feature (750)..(750): n is either a, c, g or t
tcgtttgcgtcgttgtgtattagtcgatgcgtttcgtattgtttaaggagtaatagatggcgtacgacgaataatggtttattttaacgttttgtaaacggcggtaacgttgtgtaattagaacgtttttcgcgacggattttcgttgtggttgggggtggatttgggtatttgcgatgtggtgtcgatggttgtcgatcgcgacggttagttagtggcggtatgtttcgattgggtcgatgtggttcgcgacggtatcgtttgggattttttcggcgttgttattattgttcgtcgttatttcgatacgttcgagtagtaattcggtcgtcgttttagttatgcggcgattttattttttttaggtacggattcgcgtatttttattaacgtgttggaatttgtcggattggaagtgagttatgtgttggatgagttaatcgtagttgcggatttgttgtaattggataacgtcggtgtagtggatatcggcggcggtattatcggtattgttattgtgaaaaagggtaaggtgacgtattcggcggatgaagttatcggcggatattatatttttttgattttcgtcggaaatcgtcgtatttcgttggaagaggcggagtagtataagcgcggttacggtgaagagatttggtttgcggtgaaatcggtgtacgaaaaaatggcggatattgtcgttcggtatattgaagggtagggtattattgatttntggttggcgggcggttnttgtatgtaatcgggcgtggcggaattgtttcgtaaataattttcggcgttataggtgtatttatcgtagtatagtttgtttatgatttcgttggcgatcgttagtag

SEQ ID NO: 3936 - DNA, 858 bp, Artificial Sequence
  chemically treated genomic DNA (Homo sapiens) CpG-island No: 3936
  misc_feature (109)..(109): n is either a, c, g or t
  misc_feature (126)..(126): n is either a, c, g or t
ctactaacgatcgccaacgaaatcataaacaaactatactacgataaatacacctataacgccgaaaattatttacgaaacaattccgccacgcccgattacatacaanaaccgcccgccaaccanaaatcaataataccctacccttcaatataccgaacgacaatatccgccattttttcgtacaccgatttcaccgcaaaccaaatctcttcaccgtaaccgcgcttatactactccgcctcttccaacgaaatacgacgatttccgacgaaaatcaaaaaaatataatatccgccgataacttcatccgccgaatacgtcaccttaccctttttcacaataacaataccgataataccgccgccgatatccactacaccgacgttatccaattacaacaaatccgcaactacgattaactcatccaacacataactcacttccaatccgacaaattccaacacgttaataaaaatacgcgaatccgtacctaaaaaaaataaaatcgccgcataactaaaacgacgaccgaattactactcgaacgtatcgaaataacgacgaacaataataacaacgccgaaaaaatcccaaacgataccgtcgcgaaccacatcgacccaatcgaaacataccgccactaactaaccgtcgcgatcgacaaccatcgacaccacatcgcaaatacccaaatccacccccaaccacaacgaaaatccgtcgcgaaaaacgttctaattacacaacgttaccgccgtttacaaaacgttaaaataaaccattattcgtcgtacgccatctattactccttaaacaatacgaaacgcatcgactaatacacaacgacgcaaacga

SEQ ID NO: 3937 - DNA, 522 bp, Artificial Sequence
  chemically treated genomic DNA (Homo sapiens) CpG-island No: 3937
  misc_feature (303)..(303): n is either a, c, g or t
aacgtacgcgcgttggttatttttttatcggttggcgtggtgatggttatggtggtttagtttttttcgtttagttttagttcggtaatgtacggttcgtttttaacgaaaatgttggtattaatagtattcgttatttggtttatgttttcgatgttgcgcgagtgtattgtcgtcgtgtggtggtaatcgttttttagttttatcgttagcgtaatggtattcgttacgttggcgacgcgtacgacgggtaatatcggtattattagtttagttacggtaaacggatgttttgcggtggtntttataaatagtaggcgcgttttttgcggaattttaaggtcgattgtcgtcgcgattttgtttgcgtcgcgattaatttagttacggttgacggtgtttttttcgcgttcgtcgatattttttagtaatatcggttgtagttgttgcgtttgttttgcggttagttttatcgcgtgttggttttttattagacgtattagtttatcggttacgttatta

SEQ ID NO: 3938 - DNA, 522 bp, Artificial Sequence
  chemically treated genomic DNA (Homo sapiens) CpG-island No: 3938
  misc_feature (220)..(220): n is either a, c, g or t
taataacgtaaccgataaactaatacgtctaataaaaaaccaacacgcgataaaactaaccgcaaaacaaacgcaacaactacaaccgatattactaaaaaatatcgacgaacgcgaaaaaaacaccgtcaaccgtaactaaattaatcgcgacgcaaacaaaatcgcgacgacaatcgaccttaaaattccgcaaaaaacgcgcctactatttataaanaccaccgcaaaacatccgtttaccgtaactaaactaataataccgatattacccgtcgtacgcgtcgccaacgtaacgaataccattacgctaacgataaaactaaaaaacgattaccaccacacgacgacaatacactcgcgcaacatcgaaaacataaaccaaataacgaatactattaataccaacattttcgttaaaaacgaaccgtacattaccgaactaaaactaaacgaaaaaaactaaaccaccataaccatcaccacgccaaccgataaaaaaataaccaacgcgcgtacgtt

SEQ ID NO: 3939 - DNA, 522 bp, Artificial Sequence
  chemically treated genomic DNA (Homo sapiens) CpG-island No: 3939
  misc_feature (220)..(220): n is either a, c, g or t
tgatagcgtagtcgatgaattgatgcgtttgatggaaggttagtacgcggtgaaattgatcgtagaataggcgtagtagttgtaatcggtgttgttgaaaaatatcgacgagcgcggaaaaggtatcgttagtcgtgattgggttggtcgcgacgtaggtaaaatcgcggcggtaatcggttttaaagtttcgtaagaaacgcgtttgttgtttgtgganattatcgtagaatattcgtttgtcgtgattgaattgatgatgtcggtgttgttcgtcgtgcgcgtcgttaacgtggcggatgttattgcgttagcggtgaaattggaaggcggttgttattatacggcggtaatgtattcgcgtaatatcgaaaatatgaattagatggcgaatgttattgatattagtattttcgttaagaacggatcgtgtattgtcgggttggggttgggcggggaaggttggattattatgattattattacgttaatcggtgaaggggtaattagcgcgcgtacgtt

SEQ ID NO: 3940 - DNA, 522 bp, Artificial Sequence
  chemically treated genomic DNA (Homo sapiens) CpG-island No: 3940
  misc_feature (303)..(303): n is either a, c, g or t
aacgtacgcgcgctaattaccccttcaccgattaacgtaataataatcataataatccaaccttccccgcccaaccccaacccgacaatacacgatccgttcttaacgaaaatactaatatcaataacattcgccatctaattcatattttcgatattacgcgaatacattaccgccgtataataacaaccgccttccaatttcaccgctaacgcaataacatccgccacgttaacgacgcgcacgacgaacaacaccgacatcatcaattcaatcacgacaaacgaatattctacgataatntccacaaacaacaaacgcgtttcttacgaaactttaaaaccgattaccgccgcgattttacctacgtcgcgaccaacccaatcacgactaacgataccttttccgcgctcgtcgatatttttcaacaacaccgattacaactactacgcctattctacgatcaatttcaccgcgtactaaccttccatcaaacgcatcaattcatcgactacgctatca

SEQ ID NO: 3941 - DNA, 1001 bp, Artificial Sequence
  chemically treated genomic DNA (Homo sapiens) CpG-island No: 3941
tgttcgcgtgcgttgcgtttaggttgtgcggtcgcgtaggaatcgagggaggttttttcgggaaagagacgcggaggattcggggagcggcgcgcgggggcgggaatgtcgggaggggtttttcgggggattcggtcgtttttagttttaattcggtttttttgggggatttatttcggggttatcgtaggagtttttgtattcgggcgcgggcggttttttgattttatttcgagttggaagggtcggagttattgtttcgtacggcggggtaggaatttcgcgtcggcggcgggattggtgcgttttcgttaagttaggttgtttttattgtggttagggcgcgggtagagtcgtcggtgattgtggcgtttaaattttacggggacgttttgagtacgggttttcgggacggttatagttacgcgcggtcgttgtttttacgaatttgagtttcgagttgtttgcgttttcgcgttttcgggtcgtttgcgcgtcggcgtggggcgcggggatcgacgtgatcgggtgggaggtagttatgtcgagggtaggacggtgtttttcgcgtattggtttggggttcgtacggcgttttcggcggtcggagttaggcggaggcgtaggttcggttttcgaagttatgcggggtttcggcgtagacgcggggtttacggagtagtttcgattttcggttaggttttgatcgcggttgttttagcgtttacgtcgttcgcggaaattagaaagatcggcgggtttcgttttacggttacgttcgttttagttagtcgagtttttcgggttgagtaaagaggttggagttcgggaggcgggcgttggggcgggattttagtcgggaatcgatcggcggtttatttggggttataggagaggggtcgcggaacggatcgtgtcgtcgttgattttggtttttttcggattttgtcggtttagttaggttattgggtttttaaggggaagttggcgggggtggggcg

SEQ ID NO: 3942 - DNA, 1001 bp, Artificial Sequence
  chemically treated genomic DNA (Homo sapiens) CpG-island No: 3942
cgccccacccccgccaacttccccttaaaaacccaataacctaactaaaccgacaaaatccgaaaaaaaccaaaatcaacgacgacacgatccgttccgcgacccctctcctataaccccaaataaaccgccgatcgattcccgactaaaatcccgccccaacgcccgcctcccgaactccaacctctttactcaacccgaaaaactcgactaactaaaacgaacgtaaccgtaaaacgaaacccgccgatctttctaatttccgcgaacgacgtaaacgctaaaacaaccgcgatcaaaacctaaccgaaaatcgaaactactccgtaaaccccgcgtctacgccgaaaccccgcataacttcgaaaaccgaacctacgcctccgcctaactccgaccgccgaaaacgccgtacgaaccccaaaccaatacgcgaaaaacaccgtcctaccctcgacataactacctcccacccgatcacgtcgatccccgcgccccacgccgacgcgcaaacgacccgaaaacgcgaaaacgcaaacaactcgaaactcaaattcgtaaaaacaacgaccgcgcgtaactataaccgtcccgaaaacccgtactcaaaacgtccccgtaaaatttaaacgccacaatcaccgacgactctacccgcgccctaaccacaataaaaacaacctaacttaacgaaaacgcaccaatcccgccgccgacgcgaaattcctaccccgccgtacgaaacaataactccgacccttccaactcgaaataaaatcaaaaaaccgcccgcgcccgaatacaaaaactcctacgataaccccgaaataaatcccccaaaaaaaccgaattaaaactaaaaacgaccgaatcccccgaaaaacccctcccgacattcccgcccccgcgcgccgctccccgaatcctccgcgtctctttcccgaaaaaacctccctcgattcctacgcgaccgcacaacctaaacgcaacgcacgcgaaca

SEQ ID NO: 3943 - DNA, 1001 bp, Artificial Sequence
  chemically treated genomic DNA (Homo sapiens) CpG-island No: 3943
cgttttattttcgttagtttttttttgagggtttagtgatttaattgggtcggtagggttcgaggaagattagggttagcggcggtacggttcgtttcgcgattttttttttgtgattttaggtaggtcgtcgatcggttttcggttgaggtttcgttttagcgttcgtttttcgggttttaatttttttgtttagttcgggaggttcggttggttggggcgggcgtaatcgtggggcgaggttcgtcggtttttttgattttcgcgggcggcgtgggcgttgaggtagtcgcggttaggatttggtcgggagtcggggttgtttcgtggatttcgcgtttgcgtcgaaatttcgtatggtttcgggggtcggatttgcgttttcgtttaatttcggtcgtcggagacgtcgtgcggattttaagttagtgcgcggaagatatcgttttattttcggtatggttgttttttattcggttacgtcggttttcgcgttttacgtcgacgcgtaggcgattcggggacgcggagacgtagatagttcgggatttaggttcgtgggagtagcggtcgcgcgtggttatgatcgtttcgggggttcgtgtttagggcgttttcgtgaggtttgggcgttatagttatcggcggttttgttcgcgttttggttatagtggggatagtttggtttggcggggacgtattagtttcgtcgtcgacgcggagtttttatttcgtcgtgcgaggtagtggtttcggtttttttagttcgggatggagttagggagtcgttcgcgttcgaatgtagaggtttttgcgatggtttcggagtgagttttttagaggagtcggattagggttggaggcggtcgagtttttcgagaggtttttttcgatattttcgttttcgcgcgtcgtttttcgggtttttcgcgtttttttttcgggaaagtttttttcggtttttgcgcggtcgtatagtttggacgtagcgtacgcgggta

SEQ ID NO: 3944 - DNA, 1001 bp, Artificial Sequence
  chemically treated genomic DNA (Homo sapiens) CpG-island No: 3944
tacccgcgtacgctacgtccaaactatacgaccgcgcaaaaaccgaaaaaaactttcccgaaaaaaaaacgcgaaaaacccgaaaaacgacgcgcgaaaacgaaaatatcgaaaaaaacctctcgaaaaactcgaccgcctccaaccctaatccgactcctctaaaaaactcactccgaaaccatcgcaaaaacctctacattcgaacgcgaacgactccctaactccatcccgaactaaaaaaaccgaaaccactacctcgcacgacgaaataaaaactccgcgtcgacgacgaaactaatacgtccccgccaaaccaaactatccccactataaccaaaacgcgaacaaaaccgccgataactataacgcccaaacctcacgaaaacgccctaaacacgaacccccgaaacgatcataaccacgcgcgaccgctactcccacgaacctaaatcccgaactatctacgtctccgcgtccccgaatcgcctacgcgtcgacgtaaaacgcgaaaaccgacgtaaccgaataaaaaacaaccataccgaaaataaaacgatatcttccgcgcactaacttaaaatccgcacgacgtctccgacgaccgaaattaaacgaaaacgcaaatccgacccccgaaaccatacgaaatttcgacgcaaacgcgaaatccacgaaacaaccccgactcccgaccaaatcctaaccgcgactacctcaacgcccacgccgcccgcgaaaatcaaaaaaaccgacgaacctcgccccacgattacgcccgccccaaccaaccgaacctcccgaactaaacaaaaaaattaaaacccgaaaaacgaacgctaaaacgaaacctcaaccgaaaaccgatcgacgacctacctaaaatcacaaaaaaaaaatcgcgaaacgaaccgtaccgccgctaaccctaatcttcctcgaaccctaccgacccaattaaatcactaaaccctcaaaaaaaaactaacgaaaataaaacg

SEQ ID NO: 3945 - DNA, 697 bp, Artificial Sequence
  chemically treated genomic DNA (Homo sapiens) CpG-island No: 3945
cgtcgtacggttttttgggattcgtagttttgtagtgttattcgggagttgtagttttttttttataatcggttgggcgaggcggcgttagcgattagagtagcgttgggtgtttaggggttaagatgcggcgcgtcggggacggagagacggagtcgcgtcgttttcgagtgggggtttcggttcggattttggcgggggagttcgcggtagtggttggggaagtcgaagttaagcgtcgtatgggattttgggcgttgtgagcggcggcgagtaggtgagaggttggttggcggttcgcgataggtagtaaagcggtgtgtgtcgggcggtgatacgtggacgttataggaaagagaggaagcgttttagagtcgatgtcgggtggtcgcgggagtcgggtcggagtaagtggttttaggtcgtttgttgggggtaggcgggtagaggtagcgtttttacggttatttttgggggacgtcggagggggagagcggggtgtcggaaatataattcgcggttgggggttaggggttcggatttggggtcgaaggttgagatttttatgtaaggatgtttagtgagtttttcgagttcggcgtcgtagtttttttttcggagttacgtggggtggggggagtaattttttcgggagaatttgtttgttttttttttttttttaggcggttcgggtatt

SEQ ID NO: 3946 - DNA, 697 bp, Artificial Sequence
  chemically treated genomic DNA (Homo sapiens) CpG-island No: 3946
aatacccgaaccgcctaaaaaaaaaaaaaaaacaaacaaattctcccgaaaaaattactccccccaccccacgtaactccgaaaaaaaaactacgacgccgaactcgaaaaactcactaaacatccttacataaaaatctcaaccttcgaccccaaatccgaacccctaacccccaaccgcgaattatatttccgacaccccgctctccccctccgacgtcccccaaaaataaccgtaaaaacgctacctctacccgcctacccccaacaaacgacctaaaaccacttactccgacccgactcccgcgaccacccgacatcgactctaaaacgcttcctctctttcctataacgtccacgtatcaccgcccgacacacaccgctttactacctatcgcgaaccgccaaccaacctctcacctactcgccgccgctcacaacgcccaaaatcccatacgacgcttaacttcgacttccccaaccactaccgcgaactcccccgccaaaatccgaaccgaaacccccactcgaaaacgacgcgactccgtctctccgtccccgacgcgccgcatcttaacccctaaacacccaacgctactctaatcgctaacgccgcctcgcccaaccgattataaaaaaaaaactacaactcccgaataacactacaaaactacgaatcccaaaaaaccgtacgacg

SEQ ID NO: 3947 - DNA, 697 bp, Artificial Sequence
  chemically treated genomic DNA (Homo sapiens) CpG-island No: 3947
gatgttcgggtcgtttagagggggaggggaggtagataagttttttcgggaaaattgttttttttattttacgtggtttcgaaaagggaattgcggcgtcgggttcggggagtttattgggtatttttatatggaggttttagttttcgattttaagttcgaatttttgatttttagtcgcgggttatgttttcgatatttcgtttttttttttcggcgttttttaggaatggtcgtagagacgttgtttttgttcgtttatttttagtaaacggtttagggttatttgtttcggttcggttttcgcggttattcggtatcgattttaaggcgtttttttttttttttgtggcgtttacgtgttatcgttcggtatatatcgttttgttgtttgtcgcgggtcgttagttaattttttatttgttcgtcgtcgtttatagcgtttaaagttttatacggcgtttggtttcgatttttttaattattgtcgcgggttttttcgttagggttcggatcggggtttttattcgggggcggcgcgatttcgttttttcgttttcggcgcgtcgtattttggtttttgaatatttagcgttgttttgatcgttggcgtcgtttcgtttagtcgattgtgggaaaggaattataattttcgaatgatattgtaagattacgaattttagagagtcgtgcggcg

SEQ ID NO: 3948 - DNA, 697 bp, Artificial Sequence
  chemically treated genomic DNA (Homo sapiens) CpG-island No: 3948
cgccgcacgactctctaaaattcgtaatcttacaatatcattcgaaaattataattcctttcccacaatcgactaaacgaaacgacgccaacgatcaaaacaacgctaaatattcaaaaaccaaaatacgacgcgccgaaaacgaaaaaacgaaatcgcgccgcccccgaataaaaaccccgatccgaaccctaacgaaaaaacccgcgacaataattaaaaaaatcgaaaccaaacgccgtataaaactttaaacgctataaacgacgacgaacaaataaaaaattaactaacgacccgcgacaaacaacaaaacgatatataccgaacgataacacgtaaacgccacaaaaaaaaaaaaaaacgccttaaaatcgataccgaataaccgcgaaaaccgaaccgaaacaaataaccctaaaccgtttactaaaaataaacgaacaaaaacaacgtctctacgaccattcctaaaaaacgccgaaaaaaaaaaacgaaatatcgaaaacataacccgcgactaaaaatcaaaaattcgaacttaaaatcgaaaactaaaacctccatataaaaatacccaataaactccccgaacccgacgccgcaattcccttttcgaaaccacgtaaaataaaaaaaacaattttcccgaaaaaacttatctacctcccctccccctctaaacgacccgaacatc

SEQ ID NO: 3949 - DNA, 815 bp, Artificial Sequence
  chemically treated genomic DNA (Homo sapiens) CpG-island No: 3949
  misc_feature (733)..(733): n is either a, c, g or t
  misc_feature (751)..(751): n is either a, c, g or t
gttgtatacgtttgatttcgggttatttgtttattcgattattaagcgaaatatcgtatcgagcgagtacgtattcggatggaagtcggttttgtcgattaggatgatttggacgaagagtattaggggttcgcgttatcgaattgttcgttaggtttaaggcgcgtatgttcgacggcgaggatttcgtcgtgatttatggcgatgtttgtttgtcgaatattatggtggaaaatggtcgtttttttggatttatcgattgtggtcggttgggtgtggcggatcgttattaggatatagcgttggttattcgtgatattgttgaagagtttggcggcgaatgggttgatcgttttttcgtgttttacggtatggtcgttttcgattcgtagcgatcgttttttatcgtttttttgacgagtttttttgagcgggattttggggttcgaaatgatcgattaagcgacgtttaatttgttattacgagatttcgattttatcgtcgttttttatgaaaggttgggtttcggaatcgtttttcgggacgtcggttggatgattttttagcgcggggattttatgttggagtttttcgtttatttcgggttcgattttttcgcgagttggtttagttgttgtttgaggttggacgattcgcggagttttatcggtagtgtaaattcgtcggtatttaggaaattagtagcggttattcgcgtatttatgttttcgnattgtaggagtggggagntacgatggtcgttttggttcgggatttttgtgaaggaattttatttttgtggtgtgaatataat

SEQ ID NO: 3950 - DNA, 815 bp, Artificial Sequence
  chemically treated genomic DNA (Homo sapiens) CpG-island No: 3950
  misc_feature (65)..(65): n is either a, c, g or t
  misc_feature (83)..(83): n is either a, c, g or t
attatattcacaccacaaaaataaaattccttcacaaaaatcccgaaccaaaacgaccatcgtanctccccactcctacaatncgaaaacataaatacgcgaataaccgctactaatttcctaaataccgacgaatttacactaccgataaaactccgcgaatcgtccaacctcaaacaacaactaaaccaactcgcgaaaaaatcgaacccgaaataaacgaaaaactccaacataaaatccccgcgctaaaaaatcatccaaccgacgtcccgaaaaacgattccgaaacccaacctttcataaaaaacgacgataaaatcgaaatctcgtaataacaaattaaacgtcgcttaatcgatcatttcgaaccccaaaatcccgctcaaaaaaactcgtcaaaaaaacgataaaaaacgatcgctacgaatcgaaaacgaccataccgtaaaacacgaaaaaacgatcaacccattcgccgccaaactcttcaacaatatcacgaataaccaacgctatatcctaataacgatccgccacacccaaccgaccacaatcgataaatccaaaaaaacgaccattttccaccataatattcgacaaacaaacatcgccataaatcacgacgaaatcctcgccgtcgaacatacgcgccttaaacctaacgaacaattcgataacgcgaacccctaatactcttcgtccaaatcatcctaatcgacaaaaccgacttccatccgaatacgtactcgctcgatacgatatttcgcttaataatcgaataaacaaataacccgaaatcaaacgtatacaac

SEQ ID NO: 3951 - DNA, 815 bp, Artificial Sequence
  chemically treated genomic DNA (Homo sapiens) CpG-island No: 3951
  misc_feature (65)..(65): n is either a, c, g or t
  misc_feature (83)..(83): n is either a, c, g or t
attatgtttatattatagaagtaaggtttttttataaagatttcggattaaagcggttatcgtgnttttttatttttgtagtncgggggtatggatgcgcggatagtcgttgttggttttttggatgtcgacggatttgtattgtcggtagaatttcgcgagtcgtttagttttaggtagtagttgaattaattcgcgaggggatcgagttcggggtgggcgaagaattttagtatgagattttcgcgttggaggattatttagtcggcgtttcggaaaacgatttcgaagtttaattttttatagaaggcggcggtggaatcgaaatttcgtgatggtaggttgggcgtcgtttggtcggttatttcgaattttagagtttcgtttagaagaattcgttaagaaggcgatagaaggcgatcgttgcgaatcgggagcggttatatcgtaaagtacgaggaagcggttagtttattcgtcgttaagttttttagtaatattacgggtagttaacgttatgttttgatagcggttcgttatatttagtcggttatagtcgatgaatttagaaaagcggttattttttattatgatattcggtaagtaggtatcgttatgggttacgacgagattttcgtcgtcgggtatgcgcgttttgagtttggcgaatagttcggtggcgcgagtttttgatgtttttcgtttagattattttgatcgataagatcggtttttattcgagtacgtgttcgttcgatgcgatgtttcgtttggtggtcgaatgggtaggtagttcggaattaagcgtatgtagt

SEQ ID NO: 3952 - DNA, 815 bp, Artificial Sequence
  chemically treated genomic DNA (Homo sapiens) CpG-island No: 3952
  misc_feature (733)..(733): n is either a, c, g or t
  misc_feature (751)..(751): n is either a, c, g or t
actacatacgcttaattccgaactacctacccattcgaccaccaaacgaaacatcgcatcgaacgaacacgtactcgaataaaaaccgatcttatcgatcaaaataatctaaacgaaaaacatcaaaaactcgcgccaccgaactattcgccaaactcaaaacgcgcatacccgacgacgaaaatctcgtcgtaacccataacgatacctacttaccgaatatcataataaaaaataaccgcttttctaaattcatcgactataaccgactaaatataacgaaccgctatcaaaacataacgttaactacccgtaatattactaaaaaacttaacgacgaataaactaaccgcttcctcgtactttacgatataaccgctcccgattcgcaacgatcgccttctatcgccttcttaacgaattcttctaaacgaaactctaaaattcgaaataaccgaccaaacgacgcccaacctaccatcacgaaatttcgattccaccgccgccttctataaaaaattaaacttcgaaatcgttttccgaaacgccgactaaataatcctccaacgcgaaaatctcatactaaaattcttcgcccaccccgaactcgatcccctcgcgaattaattcaactactacctaaaactaaacgactcgcgaaattctaccgacaatacaaatccgtcgacatccaaaaaaccaacaacgactatccgcgcatccatacccccgnactacaaaaataaaaaancacgataaccgctttaatccgaaatctttataaaaaaaccttacttctataatataaacataat

SEQ ID NO: 3953 - DNA, 708 bp, Artificial Sequence
  chemically treated genomic DNA (Homo sapiens) CpG-island No: 3953
  misc_feature (13)..(13): n is either a, c, g or t
  misc_feature (20)..(20): n is either a, c, g or t
  misc_feature (23)..(23): n is either a, c, g or t
  misc_feature (48)..(48): n is either a, c, g or t
  misc_feature (64)..(65): n is either a, c, g or t
  misc_feature (70)..(70): n is either a, c, g or t
  misc_feature (73)..(73): n is either a, c, g or t
  misc_feature (114)..(114): n is either a, c, g or t
  misc_feature (118)..(119): n is either a, c, g or t
  misc_feature (160)..(160): n is either a, c, g or t
  misc_feature (203)..(203): n is either a, c, g or t
  misc_feature (205)..(205): n is either a, c, g or t
  misc_feature (210)..(210): n is either a, c, g or t
  misc_feature (483)..(483): n is either a, c, g or t
  misc_feature (606)..(607): n is either a, c, g or t
tagttagtttttncggtggncgnggggtatgattatcgtcgtcgtatntatgattgtttttttnnttatntanttcgtaggataggtgtcggtagcgttttgggttattttcgngagnnattcgtttgttggagcgcgacgatgatcggtttgtcgtttncggtattcggaattttgtacgttttcgtttaaagttttcgttnantggtntcgttatttaaacgtttcggcgagaagtaggttattatcgcggtatggcggtcgatcgcgttgggttacgttttgttggcgttcgcgacgcgaggttggatggttttttttattatgatttttttcgttttcggcggtatcgggatgtcgcgttgtaggttatgttgtttaggtaggtagatgacgattattagggatagttttaaggatcgttcgcggtttttattagtttaatttcgattattggatcgttgatcgttacggcgatttatngcgtttcggcgagtatatggaacgggttggtatggattgtaggcgtcgtttatattttgtttgtttttttcgcgttgcgtcgcggtgtaatggagtcgggttattttttatttgaatggaganncggcggtatttcgtttaacggatttattattttaagaattggagttaattaatttttgcggagaattgtgaatgcgtaaattaatttttggtagaatatat

SEQ ID NO: 3954 - DNA, 708 bp, Artificial Sequence
  chemically treated genomic DNA (Homo sapiens) CpG-island No: 3954
  misc_feature (102)..(103): n is either a, c, g or t
  misc_feature (226)..(226): n is either a, c, g or t
  misc_feature (499)..(499): n is either a, c, g or t
  misc_feature (504)..(504): n is either a, c, g or t
  misc_feature (506)..(506): n is either a, c, g or t
  misc_feature (549)..(549): n is either a, c, g or t
  misc_feature (590)..(591): n is either a, c, g or t
  misc_feature (595)..(595): n is either a, c, g or t
  misc_feature (636)..(636): n is either a, c, g or t
  misc_feature (639)..(639): n is either a, c, g or t
  misc_feature (644)..(645): n is either a, c, g or t
  misc_feature (661)..(661): n is either a, c, g or t
  misc_feature (686)..(686): n is either a, c, g or t
  misc_feature (689)..(689): n is either a, c, g or t
  misc_feature (696)..(696): n is either a, c, g or t
atatattctaccaaaaattaatttacgcattcacaattctccgcaaaaattaattaactccaattcttaaaataataaatccgttaaacgaaataccgccgnntctccattcaaataaaaaataacccgactccattacaccgcgacgcaacgcgaaaaaaacaaacaaaatataaacgacgcctacaatccataccaacccgttccatatactcgccgaaacgcnataaatcgccgtaacgatcaacgatccaataatcgaaattaaactaataaaaaccgcgaacgatccttaaaactatccctaataatcgtcatctacctacctaaacaacataacctacaacgcgacatcccgataccgccgaaaacgaaaaaaatcataataaaaaaaaccatccaacctcgcgtcgcgaacgccaacaaaacgtaacccaacgcgatcgaccgccataccgcgataataacctacttctcgccgaaacgtttaaataacganaccantnaacgaaaactttaaacgaaaacgtacaaaattccgaataccgnaaacgacaaaccgatcatcgtcgcgctccaacaaacgaatnnctcncgaaaataacccaaaacgctaccgacacctatcctacgaantanataannaaaaaaacaatcatanatacgacgacgataatcataccccncgnccaccgnaaaaactaacta

SEQ ID NO: 3955 - DNA, 708 bp, Artificial Sequence
  chemically treated genomic DNA (Homo sapiens) CpG-island No: 3955
  misc_feature (102)..(103): n is either a, c, g or t
  misc_feature (226)..(226): n is either a, c, g or t
  misc_feature (499)..(499): n is either a, c, g or t
  misc_feature (504)..(504): n is either a, c, g or t
  misc_feature (506)..(506): n is either a, c, g or t
  misc_feature (549)..(549): n is either a, c, g or t
  misc_feature (590)..(591): n is either a, c, g or t
  misc_feature (595)..(595): n is either a, c, g or t
  misc_feature (636)..(636): n is either a, c, g or t
  misc_feature (639)..(639): n is either a, c, g or t
  misc_feature (644)..(645): n is either a, c, g or t
  misc_feature (661)..(661): n is either a, c, g or t
  misc_feature (686)..(686): n is either a, c, g or t
  misc_feature (689)..(689): n is either a, c, g or t
  misc_feature (696)..(696): n is either a, c, g or t
atatgttttgttaagggttggtttgcgtatttatagtttttcgtaagaattgattggttttaatttttggagtggtgaattcgttaggcgaggtgtcgtcgnntttttatttaggtgggaggtggttcggttttattgtatcgcgacgtaacgcggggagggtagataaggtataggcggcgtttataatttatgttaattcgttttatgtgttcgtcgaggcgtnataaatcgtcgtgacgattagcggtttaatgatcgaagttaggttggtaagagtcgcgagcgatttttgaagttgtttttgatggtcgttatttatttgtttggatagtatggtttgtaacgcggtatttcgatgtcgtcggaagcgagaagaattataatggggaaggttatttagtttcgcgtcgcgaacgttagtaagacgtagtttagcgcggtcggtcgttatgtcgcgataatggtttgtttttcgtcgaaacgtttgggtggcggnattantnaacgaaggttttgagcgagggcgtgtaagatttcgaatatcgnaagcgataggtcgattatcgtcgcgttttagtaaacgggtnntttncgaaaataatttagagcgttgtcggtatttgttttgcgggntgnatgannaagaagatagttatangtgcggcgacgatagttatgttttncgnttatcgnaagagttgattg

SEQ ID NO: 3956 - DNA, 708 bp, Artificial Sequence
  chemically treated genomic DNA (Homo sapiens) CpG-island No: 3956
  misc_feature (13)..(13): n is either a, c, g or t
  misc_feature (20)..(20): n is either a, c, g or t
  misc_feature (23)..(23): n is either a, c, g or t
  misc_feature (48)..(48): n is either a, c, g or t
  misc_feature (64)..(65): n is either a, c, g or t
  misc_feature (70)..(70): n is either a, c, g or t
  misc_feature (73)..(73): n is either a, c, g or t
  misc_feature (114)..(114): n is either a, c, g or t
  misc_feature (118)..(119): n is either a, c, g or t
  misc_feature (160)..(160): n is either a, c, g or t
  misc_feature (203)..(203): n is either a, c, g or t
  misc_feature (205)..(205): n is either a, c, g or t
  misc_feature (210)..(210): n is either a, c, g or t
  misc_feature (483)..(483): n is either a, c, g or t
  misc_feature (606)..(607): n is either a, c, g or t
caatcaactcttncgataancgnaaaacataactatcgtcgccgcacntataactatcttcttnntcatncancccgcaaaacaaataccgacaacgctctaaattattttcgnaaannacccgtttactaaaacgcgacgataatcgacctatcgcttncgatattcgaaatcttacacgccctcgctcaaaaccttcgttnantaatnccgccacccaaacgtttcgacgaaaaacaaaccattatcgcgacataacgaccgaccgcgctaaactacgtcttactaacgttcgcgacgcgaaactaaataaccttccccattataattcttctcgcttccgacgacatcgaaataccgcgttacaaaccatactatccaaacaaataaataacgaccatcaaaaacaacttcaaaaatcgctcgcgactcttaccaacctaacttcgatcattaaaccgctaatcgtcacgacgatttatnacgcctcgacgaacacataaaacgaattaacataaattataaacgccgcctataccttatctaccctccccgcgttacgtcgcgatacaataaaaccgaaccacctcccacctaaataaaaanncgacgacacctcgcctaacgaattcaccactccaaaaattaaaaccaatcaattcttacgaaaaactataaatacgcaaaccaacccttaacaaaacatat

SEQ ID NO: 3957 - DNA, 702 bp, Artificial Sequence
  chemically treated genomic DNA (Homo sapiens) CpG-island No: 3957
  misc_feature (46)..(46): n is either a, c, g or t
  misc_feature (59)..(59): n is either a, c, g or t
  misc_feature (255)..(256): n is either a, c, g or t
  misc_feature (316)..(316): n is either a, c, g or t
gtcgtcgtttttattttaggtcgaggtggttcggttttatgtattncgacgtaacgcgnaggtagataaggtatagggcggcgttataatttatgttaattcgttttatgtgttcgtcgaggggtataaaaatcgtcgtgacgattagcggtttaatgatcgaagttaggttggtaagagtcgcgagcgatttttgaagttgtttttgatggtcgttatttatttttttggataagtatggtttgtaacgcgggnntttcgatgtcgtcggaagcgagaagaattataatggggaaggttatttagtttcgcgttngtaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcggtaagcgataggtcgattatcgtcgcgttttagcgaaacgtttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcggtcgaggaattttcggcggttttgttgtgcgataggtttacgtttaaaaggaaataaattatgggtta

SEQ ID NO: 3958 - DNA, 702 bp, Artificial Sequence
  chemically treated genomic DNA (Homo sapiens) CpG-island No: 3958
  misc_feature (387)..(387): n is either a, c, g or t
  misc_feature (447)..(448): n is either a, c, g or t
  misc_feature (644)..(644): n is either a, c, g or t
  misc_feature (657)..(657): n is either a, c, g or t
taacccataatttatttccttttaaacgtaaacctatcgcacaacaaaaccgccgaaaattcctcgaccgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaacgtttcgctaaaacgcgacgataatcgacctatcgcttaccgatattcgaaatcttacacgccctcgctcaaaccttcgtcactaatcccgccaccaaacgtttcgacgaaaaacaaaccattatcgccgacataacgaccgacgcgctaaactacgtcttactaacgttacnaacgcgaaactaaataaccttccccattataattcttctcgcttccgacgacatcgaaanncccgcgttacaaaccatacttatccaaaaaaataaataacgaccatcaaaaacaacttcaaaaatcgctcgcgactcttaccaacctaacttcgatcattaaaccgctaatcgtcacgacgatttttatacccctcgacgaacacataaaacgaattaacataaattataacgccgccctataccttatctacctncgcgttacgtcgnaatacataaaaccgaaccacctcgacctaaaataaaaacgacgac

SEQ ID NO: 3959 - DNA, 702 bp, Artificial Sequence
  chemically treated genomic DNA (Homo sapiens) CpG-island No: 3959
  misc_feature (387)..(387): n is either a, c, g or t
  misc_feature (447)..(448): n is either a, c, g or t
  misc_feature (644)..(644): n is either a, c, g or t
  misc_feature (657)..(657): n is either a, c, g or t
tgatttatgatttatttttttttagacgtgagtttgtcgtatagtaaagtcgtcgaaagtttttcgatcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggaacgtttcgttggagcgcgacgatgatcggtttgtcgtttgtcggtattcggaattttgtacgttttcgtttaagttttcgttattggtttcgttattaaacgtttcggcgagaagtaggttattatcgtcggtatggcggtcgacgcgttgggttacgttttgttggcgttgtngacgcgaggttggatggttttttttattatgatttttttcgttttcggcggtatcgggannttcgcgttgtaggttatgtttgtttaggaaggtagatgacgattattagggatagttttaaggatcgttcgcggtttttattagtttaatttcgattattggatcgttgatcgttacggcgatttttatgtttttcggcgagtatatggaacgggttggtatggattgtagcgtcgttttatattttgtttgtttncgcgttgcgtcgnggtgtatggagtcgggttatttcgatttgaaatggaagcggcggt

SEQ ID NO: 3960 - DNA, 702 bp, Artificial Sequence
  chemically treated genomic DNA (Homo sapiens) CpG-island No: 3960
  misc_feature (46)..(46): n is either a, c, g or t
  misc_feature (59)..(59): n is either a, c, g or t
  misc_feature (255)..(256): n is either a, c, g or t
  misc_feature (316)..(316): n is either a, c, g or t
accgccgcttccatttcaaatcgaaataacccgactccatacaccncgacgcaacgcgnaaacaaacaaaatataaaacgacgctacaatccataccaacccgttccatatactcgccgaaaaacataaaaatcgccgtaacgatcaacgatccaataatcgaaattaaactaataaaaaccgcgaacgatccttaaaactatccctaataatcgtcatctaccttcctaaacaaacataacctacaacgcgaanntcccgataccgccgaaaacgaaaaaaatcataataaaaaaaaccatccaacctcgcgtcnacaacgccaacaaaacgtaacccaacgcgtcgaccgccataccgacgataataacctacttctcgccgaaacgtttaataacgaaaccaataacgaaaacttaaacgaaaacgtacaaaattccgaataccgacaaacgacaaaccgatcatcgtcgcgctccaacgaaacgttcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgatcgaaaaactttcgacgactttactatacgacaaactcacgtctaaaaaaaaataaatcataaatca

SEQ ID NO: 3961 - DNA, 738 bp, Artificial Sequence
  chemically treated genomic DNA (Homo sapiens) CpG-island No: 3961
aggtcgcgttttttttttttggttttttcggttttcggcgtggggagcgcgcgggggacgtaggtttcgttttatttgagtcggttcggcgtgcgcgtttggggcggggtttttttcgttttatatcggtatagacgaggaaatttgtgggggcggcgattttcggtttgggttttgagtcgggtagcgaggtcgtcgggaagtgattatttattttcggggttttttttaatttcgtttttttcgtttgtcgtgggcgcgtgttcgtttcgaggaggcggtcgcgtacggatagttatgtattaggtagggtttttttacgcgttcggagagcgcggatcgttgtttcgggtcgtcgtcgtcgtttgtcgtttgtcgtcgttcgcggagttcgagttttagttcgagtcgtcgtttattttaggtcggggcgtcgagtagtcggcggtttggttatgtggggttagttttcgcgtttggtttgtagtaggattagtaatatggaggcggtcgtcggcgttttcgacggcgaggattagggcggcgcggggtttcgcgaggacgcgacgtttatggacgtttatttgcggaaattgggtttgtatcggaaattggtcgttaaggacgggtcgtgtttgtttcgggtcgtggcggagtaggtattgtatttttagtttcgttatgttgaagttagaatggtttgtatttattgttttcgagagaatagagagaaatttg

SEQ ID NO: 3962 - DNA, 738 bp, Artificial Sequence
  chemically treated genomic DNA (Homo sapiens) CpG-island No: 3962
caaatttctctctattctctcgaaaacaataaatacaaaccattctaacttcaacataacgaaactaaaaatacaatacctactccgccacgacccgaaacaaacacgacccgtccttaacgaccaatttccgatacaaacccaatttccgcaaataaacgtccataaacgtcgcgtcctcgcgaaaccccgcgccgccctaatcctcgccgtcgaaaacgccgacgaccgcctccatattactaatcctactacaaaccaaacgcgaaaactaaccccacataaccaaaccgccgactactcgacgccccgacctaaaataaacgacgactcgaactaaaactcgaactccgcgaacgacgacaaacgacaaacgacgacgacgacccgaaacaacgatccgcgctctccgaacgcgtaaaaaaaccctacctaatacataactatccgtacgcgaccgcctcctcgaaacgaacacgcgcccacgacaaacgaaaaaaacgaaattaaaaaaaaccccgaaaataaataatcacttcccgacgacctcgctacccgactcaaaacccaaaccgaaaatcgccgcccccacaaatttcctcgtctataccgatataaaacgaaaaaaaccccgccccaaacgcgcacgccgaaccgactcaaataaaacgaaacctacgtcccccgcgcgctccccacgccgaaaaccgaaaaaaccaaaaaaaaaaaacgcgacct

SEQ ID NO: 3963 - DNA, 738 bp, Artificial Sequence
  chemically treated genomic DNA (Homo sapiens) CpG-island No: 3963
taaatttttttttgttttttcgaagatagtgaatataggttattttgattttaatatggcgagattgagagtgtaatatttgtttcgttacggttcggaataggtacgattcgtttttggcgattagttttcgatataagtttagttttcgtagataggcgtttatgggcgtcgcgttttcgcggggtttcgcgtcgttttggttttcgtcgtcggggacgtcgacggtcgtttttatgttgttggttttgttgtaggttaggcgcgagggttagttttatatggttaggtcgtcggttgttcgacgtttcggtttggggtaggcggcggttcgggttggggttcgggtttcgcgagcggcggtaggcggtaggcggcggcggcggttcgaggtagcggttcgcgtttttcgggcgcgtaggggagttttgtttaatgtatggttgttcgtacgcggtcgttttttcggagcgaatacgcgtttacgataaacggggggagcgggattaaggaaaatttcgagagtgagtagttatttttcgacggtttcgttgttcgatttaggatttaggtcgggggtcgtcgtttttataagttttttcgtttgtatcggtgtgaagcgagaaaagtttcgttttaggcgcgtacgtcgggtcggtttaggtgaagcggggtttgcgtttttcgcgcgttttttacgtcgggagtcgaggaaattaaaaaagaaagacgcggttt

SEQ ID NO: 3964 - DNA, 738 bp, Artificial Sequence
  chemically treated genomic DNA (Homo sapiens) CpG-island No: 3964
aaaccgcgtctttcttttttaatttcctcgactcccgacgtaaaaaacgcgcgaaaaacgcaaaccccgcttcacctaaaccgacccgacgtacgcgcctaaaacgaaacttttctcgcttcacaccgatacaaacgaaaaaacttataaaaacgacgacccccgacctaaatcctaaatcgaacaacgaaaccgtcgaaaaataactactcactctcgaaattttccttaatcccgctccccccgtttatcgtaaacgcgtattcgctccgaaaaaacgaccgcgtacgaacaaccatacattaaacaaaactcccctacgcgcccgaaaaacgcgaaccgctacctcgaaccgccgccgccgcctaccgcctaccgccgctcgcgaaacccgaaccccaacccgaaccgccgcctaccccaaaccgaaacgtcgaacaaccgacgacctaaccatataaaactaaccctcgcgcctaacctacaacaaaaccaacaacataaaaacgaccgtcgacgtccccgacgacgaaaaccaaaacgacgcgaaaccccgcgaaaacgcgacgcccataaacgcctatctacgaaaactaaacttatatcgaaaactaatcgccaaaaacgaatcgtacctattccgaaccgtaacgaaacaaatattacactctcaatctcgccatattaaaatcaaaataacctatattcactatcttcgaaaaaacaaaaaaaaattta

SEQ ID NO: 3965 - DNA, 1006 bp, Artificial Sequence
  chemically treated genomic DNA (Homo sapiens) CpG-island No: 3965
gcgttattcgttcgcgtcggcggtagacgttattaaggcgcgacggttttgtttcgtttttgggttcgtttttcgtttgtcggatagtagatgcgggtatgcgttcgaaggcgaacgcgtacgcgcggagggacgggggcgaaggggagggacgggggcgaaggggaggggcggggcgggacgggacgggggcgaaggggaggggcggggcgggacgggggcgaaggggagggtcgggacgaggcgggcgaagggaagagggggttcgggcgatgttgagcgttgaggttcgagaggaggggcgggacgggtagtattaggttcgggtgttgcgaggggaggggcggagcgggcgaggggaaaaggcggggtcgggaagtgttgggcgtaggtggggcgagaggaggggcggggtaggttaggggaaaaggcggggatgggcggggttgggcgcggatggtgggagaggagggacggggcggggcggcgaacggaaggggcgggggcgggtgttgggcgttgaggcgcgagaggaggggatgggcggggcgcgcggtcgttagcgcgcggtcgttagcggtcggtttttattaacggtaggcgtcgtcgcgattttcgaaggttatagttcgcgtgatttattttcgtttgcgcgttcgtagttttcgtcggcgtagttatcgcgtagggcggtcgttcggaggtagttattacggtttgtgttaacgattaaagttttagtatagcggcgtttttagatagttgggagggtggttttggtcgggagcggcggtcggtgagttatcgcgaggaggagcggcggaggcgatttcggttcggttttgtattggtcgttcggtaggcgcgatatgagtttggtttggtattcgcgggatgttttttaagtttttttttcggttgttaattttcggggaacggttgtgattatatcgatacgtattttatagataaattatttttgcggcggcgggtcgaatacgtttat

SEQ ID NO: 3966 - DNA, 1006 bp, Artificial Sequence
  chemically treated genomic DNA (Homo sapiens) CpG-island No: 3966
ataaacgtattcgacccgccgccgcaaaaataatttatctataaaatacgtatcgatataatcacaaccgttccccgaaaattaacaaccgaaaaaaaaacttaaaaaacatcccgcgaataccaaaccaaactcatatcgcgcctaccgaacgaccaatacaaaaccgaaccgaaatcgcctccgccgctcctcctcgcgataactcaccgaccgccgctcccgaccaaaaccaccctcccaactatctaaaaacgccgctatactaaaactttaatcgttaacacaaaccgtaataactacctccgaacgaccgccctacgcgataactacgccgacgaaaactacgaacgcgcaaacgaaaataaatcacgcgaactataaccttcgaaaatcgcgacgacgcctaccgttaataaaaaccgaccgctaacgaccgcgcgctaacgaccgcgcgccccgcccatcccctcctctcgcgcctcaacgcccaacacccgcccccgccccttccgttcgccgccccgccccgtccctcctctcccaccatccgcgcccaaccccgcccatccccgccttttcccctaacctaccccgcccctcctctcgccccacctacgcccaacacttcccgaccccgccttttcccctcgcccgctccgcccctcccctcgcaacacccgaacctaatactacccgtcccgcccctcctctcgaacctcaacgctcaacatcgcccgaaccccctcttcccttcgcccgcctcgtcccgaccctccccttcgcccccgtcccgccccgcccctccccttcgcccccgtcccgtcccgccccgcccctccccttcgcccccgtccctccccttcgcccccgtccctccgcgcgtacgcgttcgccttcgaacgcatacccgcatctactatccgacaaacgaaaaacgaacccaaaaacgaaacaaaaccgtcgcgccttaataacgtctaccgccgacgcgaacgaataacgc

SEQ ID NO: 3967 - DNA, 1006 bp, Artificial Sequence
  chemically treated genomic DNA (Homo sapiens) CpG-island No: 3967
ataaacgtgttcgattcgtcgtcgtaagaatgatttatttgtaaaatacgtgtcggtgtggttataatcgtttttcggaggttaatagtcggagaaggggtttaaggagtatttcgcggatgttagattaggtttatgtcgcgtttgtcgggcggttagtgtagggtcgggtcgaggtcgttttcgtcgttttttttcgcggtagtttatcggtcgtcgttttcggttagagttatttttttagttgtttgagggcgtcgttgtattggagttttagtcgttgatataggtcgtggtagttattttcgggcggtcgttttgcgcggtgattgcgtcggcgaagattgcgagcgcgtaaacgggggtgggttacgcggattatgattttcgggaatcgcggcgacgtttatcgttagtagaaatcgatcgttaacggtcgcgcgttaacggtcgcgcgtttcgtttatttttttttttcgcgttttagcgtttaatattcgttttcgtttttttcgttcgtcgtttcgtttcgtttttttttttttattattcgcgtttagtttcgtttattttcgtttttttttttagtttgtttcgttttttttttcgttttatttgcgtttagtatttttcggtttcgtttttttttttcgttcgtttcgttttttttttcgtagtattcgggtttagtattgttcgtttcgttttttttttcgagttttagcgtttagtatcgttcggattttttttttttttcgttcgtttcgtttcgattttttttttcgttttcgtttcgtttcgtttttttttttcgttttcgtttcgtttcgtttcgtttttttttttcgttttcgtttttttttttcgttttcgttttttcgcgcgtgcgcgttcgttttcgagcgtatgttcgtatttgttgttcgataggcggaagacgagtttagaggcggagtagggtcgtcgcgttttggtgacgtttgtcgtcggcgcgggcgggtgacgt

SEQ ID NO: 3968 - DNA, 1006 bp, Artificial Sequence
  chemically treated genomic DNA (Homo sapiens) CpG-island No: 3968
acgtcacccgcccgcgccgacgacaaacgtcaccaaaacgcgacgaccctactccgcctctaaactcgtcttccgcctatcgaacaacaaatacgaacatacgctcgaaaacgaacgcgcacgcgcgaaaaaacgaaaacgaaaaaaaaaaacgaaaacgaaaaaaaaaaacgaaacgaaacgaaacgaaaacgaaaaaaaaaaacgaaacgaaacgaaaacgaaaaaaaaaatcgaaacgaaacgaacgaaaaaaaaaaaaaatccgaacgatactaaacgctaaaactcgaaaaaaaaaacgaaacgaacaatactaaacccgaatactacgaaaaaaaaaacgaaacgaacgaaaaaaaaaaacgaaaccgaaaaatactaaacgcaaataaaacgaaaaaaaaaacgaaacaaactaaaaaaaaaaacgaaaataaacgaaactaaacgcgaataataaaaaaaaaaaaacgaaacgaaacgacgaacgaaaaaaacgaaaacgaatattaaacgctaaaacgcgaaaaaaaaaaataaacgaaacgcgcgaccgttaacgcgcgaccgttaacgatcgatttctactaacgataaacgtcgccgcgattcccgaaaatcataatccgcgtaacccacccccgtttacgcgctcgcaatcttcgccgacgcaatcaccgcgcaaaacgaccgcccgaaaataactaccacgacctatatcaacgactaaaactccaatacaacgacgccctcaaacaactaaaaaaataactctaaccgaaaacgacgaccgataaactaccgcgaaaaaaaacgacgaaaacgacctcgacccgaccctacactaaccgcccgacaaacgcgacataaacctaatctaacatccgcgaaatactccttaaaccccttctccgactattaacctccgaaaaacgattataaccacaccgacacgtattttacaaataaatcattcttacgacgacgaatcgaacacgtttat

SEQ ID NO: 3969 - DNA, 644 bp, Artificial Sequence
  chemically treated genomic DNA (Homo sapiens) CpG-island No: 3969
gcgttacgtaggtagattacgtaagcgagtatttcgtacgcgcgttttgagtggtttttgttagttacgcgcgggggcggggcgagggcgtaggaagaaggcggggttaagatggcggcgtagcgcgcggcgggggcgacgggcggcgggggtcggggggcggtgggacgttgatttcgttttttgttgttgttagtttgcgtcgggcggcggtggcggcggagattcgaatatggcgatcgcgcgtattttcgggttcgagcgggaagtcgagtcggttaaggaagcgcgcgtcgtgggttcggagtttgtggatatttatacggtgtgttgggggcgcgggtattcgaagcgggggtggtggttggaatcgggagttcgattcgggggtttggggaggggttcgggatttgtagtttcgaggagcgggtagaagggtttgcgattgcgaggagggggttgggacgggggatttaggaaagggatttgggtttcgtaggttcgggagaagggttgttcggggttcggggaggcggtttggaaaagggtacgcgattagaaagggaggttcgggttgggggcggtatttggggataaagggggtttggggaggggggtgtttagatgaggcggaatttttttag

SEQ ID NO: 3970 - DNA, 644 bp, Artificial Sequence
  chemically treated genomic DNA (Homo sapiens) CpG-island No: 3970
ctaaaaaaattccgcctcatctaaacacccccctccccaaaccccctttatccccaaataccgcccccaacccgaacctccctttctaatcgcgtacccttttccaaaccgcctccccgaaccccgaacaacccttctcccgaacctacgaaacccaaatccctttcctaaatcccccgtcccaaccccctcctcgcaatcgcaaacccttctacccgctcctcgaaactacaaatcccgaacccctccccaaacccccgaatcgaactcccgattccaaccaccacccccgcttcgaatacccgcgcccccaacacaccgtataaatatccacaaactccgaacccacgacgcgcgcttccttaaccgactcgacttcccgctcgaacccgaaaatacgcgcgatcgccatattcgaatctccgccgccaccgccgcccgacgcaaactaacaacaacaaaaaacgaaatcaacgtcccaccgccccccgacccccgccgcccgtcgcccccgccgcgcgctacgccgccatcttaaccccgccttcttcctacgccctcgccccgcccccgcgcgtaactaacaaaaaccactcaaaacgcgcgtacgaaatactcgcttacgtaatctacctacgtaacgc

SEQ ID NO: 3971 - DNA, 644 bp, Artificial Sequence
  chemically treated genomic DNA (Homo sapiens) CpG-island No: 3971
ttagaggggtttcgttttatttagatatttttttttttaagttttttttatttttagatgtcgtttttaattcgagtttttttttttgatcgcgtatttttttttaaatcgttttttcgggtttcgagtaatttttttttcggatttgcggggtttagattttttttttagatttttcgttttagtttttttttcgtaatcgtagatttttttattcgtttttcggggttgtagatttcggatttttttttaagttttcgagtcggattttcggttttagttattattttcgtttcgggtgttcgcgtttttaatatatcgtataagtgtttataagtttcgagtttacgacgcgcgtttttttggtcggttcggtttttcgttcgggttcgaaggtgcgcgcggtcgttatgttcgggttttcgtcgttatcgtcgttcggcgtagattagtagtagtagggggcggggttaacgttttatcgtttttcggttttcgtcgttcgtcgttttcgtcgcgcgttgcgtcgttattttggtttcgttttttttttgcgttttcgtttcgttttcgcgcgtgattgataggggttatttagggcgcgcgtgcgaggtgttcgtttgcgtaatttatttgcgtggcgt

SEQ ID NO: 3972 - DNA, 644 bp, Artificial Sequence
  chemically treated genomic DNA (Homo sapiens) CpG-island No: 3972
acgccacgcaaataaattacgcaaacgaacacctcgcacgcgcgccctaaataacccctatcaatcacgcgcgaaaacgaaacgaaaacgcaaaaaaaaaacgaaaccaaaataacgacgcaacgcgcgacgaaaacgacgaacgacgaaaaccgaaaaacgataaaacgttaaccccgccccctactactactaatctacgccgaacgacgataacgacgaaaacccgaacataacgaccgcgcgcaccttcgaacccgaacgaaaaaccgaaccgaccaaaaaaacgcgcgtcgtaaactcgaaacttataaacacttatacgatatattaaaaacgcgaacacccgaaacgaaaataataactaaaaccgaaaatccgactcgaaaacttaaaaaaaaatccgaaatctacaaccccgaaaaacgaataaaaaaatctacgattacgaaaaaaaaactaaaacgaaaaatctaaaaaaaaaatctaaaccccgcaaatccgaaaaaaaaattactcgaaacccgaaaaaacgatttaaaaaaaaatacgcgatcaaaaaaaaaaactcgaattaaaaacgacatctaaaaataaaaaaaacttaaaaaaaaaaatatctaaataaaacgaaacccctctaa

SEQ ID NO: 3973 - DNA, 517 bp, Artificial Sequence
  chemically treated genomic DNA (Homo sapiens) CpG-island No: 3973
  misc_feature (374)..(374): n is either a, c, g or t
  misc_feature (406)..(406): n is either a, c, g or t
  misc_feature (420)..(421): n is either a, c, g or t
  misc_feature (469)..(469): n is either a, c, g or t
ttgaatttcgaagatcgttattcggcgcggaacgcgggtatcgtcgacgttaaaatatcgggtttgggggtcgcggtttacgcgtttttcgggtttcgcgtttttcgttcgatttgattggatggtggcgggaagaaggcggggagattttcggaggaggggcgcgtaggtcggtcgggggtttttacggaggcgtttagggggcgaaggggcgggagcgggtttcggagcgtcgcgcgtgcgtaattgggatatagtcggttggggattgttgggagggtcggattttgcgagaacgggtgggcgtgtgttcggtgggcgcgggaggggtttcggttgtacgagcgcgcgtgcgcgtcggaattggagtcgtngggagggaggcggaagttgaaggaaggcggtnggaggggggtcggnntcgcggtcggggtcgtttaacgtttcggtaagtttaggagggtttttntcgggtttttttaatttaattcggggtttcggggggttttttttaaaa

SEQ ID NO: 3974 - DNA, 517 bp, Artificial Sequence
  chemically treated genomic DNA (Homo sapiens) CpG-island No: 3974
  misc_feature (49)..(49): n is either a, c, g or t
  misc_feature (97)..(98): n is either a, c, g or t
  misc_feature (112)..(112): n is either a, c, g or t
  misc_feature (144)..(144): n is either a, c, g or t
ttttaaaaaaaaccccccgaaaccccgaattaaattaaaaaaacccganaaaaaccctcctaaacttaccgaaacgttaaacgaccccgaccgcgannccgacccccctccnaccgccttccttcaacttccgcctccctcccnacgactccaattccgacgcgcacgcgcgctcgtacaaccgaaacccctcccgcgcccaccgaacacacgcccacccgttctcgcaaaatccgaccctcccaacaatccccaaccgactatatcccaattacgcacgcgcgacgctccgaaacccgctcccgccccttcgccccctaaacgcctccgtaaaaacccccgaccgacctacgcgcccctcctccgaaaatctccccgccttcttcccgccaccatccaatcaaatcgaacgaaaaacgcgaaacccgaaaaacgcgtaaaccgcgacccccaaacccgatattttaacgtcgacgatacccgcgttccgcgccgaataacgatcttcgaaattcaa

SEQ ID NO: 3975 - DNA, 517 bp, Artificial Sequence
  chemically treated genomic DNA (Homo sapiens) CpG-island No: 3975
  misc_feature (49)..(49): n is either a, c, g or t
  misc_feature (97)..(98): n is either a, c, g or t
  misc_feature (112)..(112): n is either a, c, g or t
  misc_feature (144)..(144): n is either a, c, g or t
ttttggggggggtttttcggggtttcgggttgggttgggaaggttcggnaagggtttttttgggtttgtcgggacgttgggcggtttcgatcgcganntcggtttttttttngtcgtttttttttagttttcgttttttttttngcggttttagtttcgacgcgtacgcgcgttcgtgtagtcggggtttttttcgcgtttatcgggtatacgtttattcgttttcgtagggttcggtttttttagtagtttttagtcggttgtgttttaattgcgtacgcgcgacgtttcgaggttcgttttcgttttttcgttttttggacgttttcgtgggaattttcggtcggtttgcgcgtttttttttcgggggttttttcgtttttttttcgttattatttaattaaatcgggcgaggggcgcgaagttcgggagacgcgtaggtcgcggtttttaggttcggtgttttgacgtcggcggtgttcgcgtttcgcgtcgagtaacggttttcggaatttag

SEQ ID NO: 3976 - DNA, 517 bp, Artificial Sequence
  chemically treated genomic DNA (Homo sapiens) CpG-island No: 3976
  misc_feature (374)..(374): n is either a, c, g or t
  misc_feature (406)..(406): n is either a, c, g or t
  misc_feature (420)..(421): n is either a, c, g or t
  misc_feature (469)..(469): n is either a, c, g or t
ctaaattccgaaaaccgttactcgacgcgaaacgcgaacaccgccgacgtcaaaacaccgaacctaaaaaccgcgacctacgcgtctcccgaacttcgcgcccctcgcccgatttaattaaataataacgaaaaaaaaacgaaaaaacccccgaaaaaaaaacgcgcaaaccgaccgaaaattcccacgaaaacgtccaaaaaacgaaaaaacgaaaacgaacctcgaaacgtcgcgcgtacgcaattaaaacacaaccgactaaaaactactaaaaaaaccgaaccctacgaaaacgaataaacgtatacccgataaacgcgaaaaaaaccccgactacacgaacgcgcgtacgcgtcgaaactaaaaccgcnaaaaaaaaaacgaaaactaaaaaaaaacgacnaaaaaaaaaccganntcgcgatcgaaaccgcccaacgtcccgacaaacccaaaaaaacccttnccgaaccttcccaacccaacccgaaaccccgaaaaaccccccccaaaa

SEQ ID NO: 3977 - DNA, 558 bp, Artificial Sequence
  chemically treated genomic DNA (Homo sapiens) CpG-island No: 3977
ggggtcgttagggaggattacggcgttgggggaaggtaggttaaagtgtcgcgggagagtcggggggacgttagaaaagtcgtggaaaaggagtattggggattttcggggtgggaggcgggttatggaaaggaattagagtcgttttcgtcggagttcgaataatgcggggagtttatttcggtagatattcggttttgcgttagaattattttcgaaatatagagttttttatttattttcgggaggtttattataatagatagcgcgtgtttttagatttgttagtttttttaagggtcggtacggtttttacggggcgtttcggacgtttttcgcgcgtttttttttagggttaattttttgtttcgagtttttttttcgtttcgcggggaggggtttttagggcgttttattaataacgattattagttgattcgagttttaagtttaattttattttcgttgggaaagtttggaggtagagggaagtttcgcgcgttttagggttttttatagaaacgtagtcgaaggaatttcgttggttttgaggttatt

SEQ ID NO: 3978 - DNA, 558 bp, Artificial Sequence
  chemically treated genomic DNA (Homo sapiens) CpG-island No: 3978
aataacctcaaaaccaacgaaattccttcgactacgtttctataaaaaaccctaaaacgcgcgaaacttccctctacctccaaactttcccaacgaaaataaaattaaacttaaaactcgaatcaactaataatcgttattaataaaacgccctaaaaacccctccccgcgaaacgaaaaaaaaactcgaaacaaaaaattaaccctaaaaaaaaacgcgcgaaaaacgtccgaaacgccccgtaaaaaccgtaccgacccttaaaaaaactaacaaatctaaaaacacgcgctatctattataataaacctcccgaaaataaataaaaaactctatatttcgaaaataattctaacgcaaaaccgaatatctaccgaaataaactccccgcattattcgaactccgacgaaaacgactctaattcctttccataacccgcctcccaccccgaaaatccccaatactccttttccacgacttttctaacgtccccccgactctcccgcgacactttaacctaccttcccccaacgccgtaatcctccctaacgacccc

SEQ ID NO: 3979 - DNA, 558 bp, Artificial Sequence
  chemically treated genomic DNA (Homo sapiens) CpG-island No: 3979
ggtagttttaaggttagcggggttttttcggttgcgtttttgtgggaggttttgaaacgcgcggagtttttttttgtttttaggtttttttagcgagagtgaaattaaatttgaaattcggattaattggtagtcgttgttggtagaacgttttaaggattttttttcgcgggacggagggaggattcgggatagggaattggttttgggagaaaacgcgcggggggcgttcgagacgtttcgtgaaagtcgtgtcgatttttgggaggattgataggtttagagatacgcgttgtttgttgtggtgggtttttcgggaataagtgaggggttttgtgtttcgaggatggttttagcgtagagtcgggtgtttgtcggggtgggtttttcgtattgttcgggtttcggcgggggcggttttgatttttttttatggttcgttttttatttcgggaatttttagtgttttttttttacggtttttttggcgttttttcgattttttcgcggtattttggtttatttttttttagcgtcgtggttttttttggcgatttt

SEQ ID NO: 3980 - DNA, 558 bp, Artificial Sequence
  chemically treated genomic DNA (Homo sapiens) CpG-island No: 3980
aaaatcgccaaaaaaaaccacgacgctaaaaaaaaataaaccaaaataccgcgaaaaaatcgaaaaaacgccaaaaaaaccgtaaaaaaaaaacactaaaaattcccgaaataaaaaacgaaccataaaaaaaaatcaaaaccgcccccgccgaaacccgaacaatacgaaaaacccaccccgacaaacacccgactctacgctaaaaccatcctcgaaacacaaaacccctcacttattcccgaaaaacccaccacaacaaacaacgcgtatctctaaacctatcaatcctcccaaaaatcgacacgactttcacgaaacgtctcgaacgccccccgcgcgttttctcccaaaaccaattccctatcccgaatcctccctccgtcccgcgaaaaaaaatccttaaaacgttctaccaacaacgactaccaattaatccgaatttcaaatttaatttcactctcgctaaaaaaacctaaaaacaaaaaaaaactccgcgcgtttcaaaacctcccacaaaaacgcaaccgaaaaaaccccgctaaccttaaaactacc

SEQ ID NO: 3981 - DNA, 505 bp, Artificial Sequence
  chemically treated genomic DNA (Homo sapiens) CpG-island No: 3981
tacggcggtttcgcggtttcggtcgtttgggttcggatcgggaaaaacgaggggttgggttttttttattcggattttatatttttagtacgcgagaaagagcgagaagttacgcggcggttgggtcgagcgtggggtgtcggcggagataatgaaatttgtaggcgtataaataaggcgttgagcgtgttttttgataacgtgttagtagcgtggagaggttcgttttataatagtttttcgtgttgtgtttagtaggaaaatagtcgttgtcgttttagacgtagttttaataaagagtacggtcgttattttagtatgagagtttttgggcggaaaagtttattaagtgatttcgcgcggcgcggttcggttagtacgttttttcggattcgcgttttttggtgcgcgtagttcgcggtcgttttattttttttgttttttattttggatttttttttttagcgcgaggtaaggttggggtttggaggggttaggagcgggg

SEQ ID NO: 3982 - DNA, 505 bp, Artificial Sequence
  chemically treated genomic DNA (Homo sapiens) CpG-island No: 3982
ccccgctcctaacccctccaaaccccaaccttacctcgcgctaaaaaaaaaaatccaaaataaaaaacaaaaaaaataaaacgaccgcgaactacgcgcaccaaaaaacgcgaatccgaaaaaacgtactaaccgaaccgcgccgcgcgaaatcacttaataaacttttccgcccaaaaactctcatactaaaataacgaccgtactctttattaaaactacgtctaaaacgacaacgactattttcctactaaacacaacacgaaaaactattataaaacgaacctctccacgctactaacacgttatcaaaaaacacgctcaacgccttatttatacgcctacaaatttcattatctccgccgacaccccacgctcgacccaaccgccgcgtaacttctcgctctttctcgcgtactaaaaatataaaatccgaataaaaaaaacccaacccctcgtttttcccgatccgaacccaaacgaccgaaaccgcgaaaccgccgta

SEQ ID NO: 3983 - DNA, 505 bp, Artificial Sequence
  chemically treated genomic DNA (Homo sapiens) CpG-island No: 3983
tttcgtttttggtttttttagattttagttttgtttcgcgttgggaggggagatttagaatgaaaggtaagaaaggtaaggcggtcgcgggttgcgcgtattagaagacgcgagttcggggaaacgtgttggtcgggtcgcgtcgcgcggagttatttggtggattttttcgtttaggggtttttatgttggagtggcggtcgtgttttttgttgaggttgcgtttgaaacggtagcggttgtttttttgttagatataatacgaggggttgttgtggggcgagtttttttacgttgttggtacgttgttaagaaatacgtttagcgttttgtttgtgcgtttgtaagttttattgttttcgtcgatattttacgttcggtttagtcgtcgcgtggtttttcgttttttttcgcgtgttggggatatggggttcgagtagggaggatttagtttttcgtttttttcgattcggatttaggcggtcggggtcgcgggatcgtcgtg

SEQ ID NO: 3984 - DNA, 505 bp, Artificial Sequence
  chemically treated genomic DNA (Homo sapiens) CpG-island No: 3984
cacgacgatcccgcgaccccgaccgcctaaatccgaatcgaaaaaaacgaaaaactaaatcctccctactcgaaccccatatccccaacacgcgaaaaaaaacgaaaaaccacgcgacgactaaaccgaacgtaaaatatcgacgaaaacaataaaacttacaaacgcacaaacaaaacgctaaacgtatttcttaacaacgtaccaacaacgtaaaaaaactcgccccacaacaacccctcgtattatatctaacaaaaaaacaaccgctaccgtttcaaacgcaacctcaacaaaaaacacgaccgccactccaacataaaaacccctaaacgaaaaaatccaccaaataactccgcgcgacgcgacccgaccaacacgtttccccgaactcgcgtcttctaatacgcgcaacccgcgaccgccttacctttcttacctttcattctaaatctcccctcccaacgcgaaacaaaactaaaatctaaaaaaaccaaaaacgaaa

SEQ ID NO: 3985 - DNA, 534 bp, Artificial Sequence
  chemically treated genomic DNA (Homo sapiens) CpG-island No: 3985
tagtcgtacgagatagtcgtttttgatttaaggggcggggtacgggaggaaaagtattcgagataagaattaattttttttagaatgcgcggttgttattgatacgcgggcgcggcgcggcgtattttttttttttcggggttttttttttagtagcgatagtgggaggtcggcgggggtggggcgggggggaatgatgagatatagtttaaacgaacgtttgttttttcgggttaaagttgcgagtttcggattggattgtaaggtagtttcgaaatttgatacgttgcggatagatatttgttacgtttatatgttttttaaacgtttttgttcggggacggtcgggcgcgcgtttgttttattaagatttcgtttgatatttcgagtcgtcgaatttcggtagcggttatttttatagttaaggggtgattacgtcgtggttgttcgtttgtttcggttaatagtgtttatttttcggattggaattttgttaggggatttttttttttattttaaatagaaattagttat

SEQ ID NO: 3986 - DNA, 534 bp, Artificial Sequence
  chemically treated genomic DNA (Homo sapiens) CpG-island No: 3986
ataactaatttctatttaaaataaaaaaaaaaatcccctaacaaaattccaatccgaaaaataaacactattaaccgaaacaaacgaacaaccacgacgtaatcaccccttaactataaaaataaccgctaccgaaattcgacgactcgaaatatcaaacgaaatcttaataaaacaaacgcgcgcccgaccgtccccgaacaaaaacgtttaaaaaacatataaacgtaacaaatatctatccgcaacgtatcaaatttcgaaactaccttacaatccaatccgaaactcgcaactttaacccgaaaaaacaaacgttcgtttaaactatatctcatcattcccccccgccccacccccgccgacctcccactatcgctactaaaaaaaaaaccccgaaaaaaaaaaaatacgccgcgccgcgcccgcgtatcaataacaaccgcgcattctaaaaaaaattaattcttatctcgaatacttttcctcccgtaccccgccccttaaatcaaaaacgactatctcgtacgacta

SEQ ID NO: 3987 - DNA, 534 bp, Artificial Sequence
  chemically treated genomic DNA (Homo sapiens) CpG-island No: 3987
atggttagtttttgtttgaaatgggaggagggattttttagtagggttttaattcgaagagtagatattgttgatcgaaatagacgagtagttacggcgtggttattttttagttataaaagtggtcgttgtcggggttcggcgattcggggtgttaggcggagttttggtgaggtaggcgcgcgttcggtcgttttcgggtagagacgtttaaagagtatgtgagcgtgataagtgtttgttcgtaacgtgttagatttcgaaattgttttgtaatttagttcggaattcgtagttttagttcgggggaatagacgttcgtttaggttgtgttttattattttttttcgttttattttcgtcgattttttattgtcgttgttggaggaagagtttcgggaggagaagggtgcgtcgcgtcgcgttcgcgtgttaatggtagtcgcgtattttggaagaagttggtttttgtttcgaatattttttttttcgtgtttcgttttttgaattagaggcggttgtttcgtgcggtta

SEQ ID NO: 3988 - DNA, 534 bp, Artificial Sequence
  chemically treated genomic DNA (Homo sapiens) CpG-island No: 3988
taaccgcacgaaacaaccgcctctaattcaaaaaacgaaacacgaaaaaaaaaatattcgaaacaaaaaccaacttcttccaaaatacgcgactaccattaacacgcgaacgcgacgcgacgcacccttctcctcccgaaactcttcctccaacaacgacaataaaaaatcgacgaaaataaaacgaaaaaaaataataaaacacaacctaaacgaacgtctattcccccgaactaaaactacgaattccgaactaaattacaaaacaatttcgaaatctaacacgttacgaacaaacacttatcacgctcacatactctttaaacgtctctacccgaaaacgaccgaacgcgcgcctacctcaccaaaactccgcctaacaccccgaatcgccgaaccccgacaacgaccacttttataactaaaaaataaccacgccgtaactactcgtctatttcgatcaacaatatctactcttcgaattaaaaccctactaaaaaatccctcctcccatttcaaacaaaaactaaccat

SEQ ID NO: 3989 - DNA, 698 bp, Artificial Sequence
  chemically treated genomic DNA (Homo sapiens) CpG-island No: 3989
tgtaagttggcgcggaattcgatcgtattcgtgtttcgggggttgttcggtaggacgtatcgtgaagtcggtttattttttagtttcgtagtgcggcggtggtttggtagcgcggtgcgggtttcgagaagaaagagtgtggttcggggcgggcgtattaggaggtgtcgaggtcgtggttcggaagtggtcggggtcgttgcgggcggaagggcgtttgtgtttcgttcgttcggcggtggtttagttaggttcgcgggatttagattagcggggagcgcgattttcgtttttggggttttttcgttgggtcggagatttaagtttttaacgttaggttttgttttggaagcgttcgcggttcggcgtttggacggggaagttgtgagtgaacgcggacgggtagcggtaaggtcggcgtgtcgggtcggtgtcggcgggcgcggagtttttttgtgggatgcggtggaaggtcggttgatttttttttcggagttattaatttaaacgtgtatttcgcgaacgtttttcggattttcgtgtgtaattatcgacgttaggttttggggatacggtttattatggatcgagtacggtggtcgagtttagtttgatgggttattttagaggggcggatacgggaagattaaggttgttggaggagaaacgtggagtaggttttttgttttgatttcgta

SEQ ID NO: 3990 - DNA, 698 bp, Artificial Sequence
  chemically treated genomic DNA (Homo sapiens) CpG-island No: 3990
tacgaaatcaaaacaaaaaacctactccacgtttctcctccaacaaccttaatcttcccgtatccgcccctctaaaataacccatcaaactaaactcgaccaccgtactcgatccataataaaccgtatccccaaaacctaacgtcgataattacacacgaaaatccgaaaaacgttcgcgaaatacacgtttaaattaataactccgaaaaaaaaatcaaccgaccttccaccgcatcccacaaaaaaactccgcgcccgccgacaccgacccgacacgccgaccttaccgctacccgtccgcgttcactcacaacttccccgtccaaacgccgaaccgcgaacgcttccaaaacaaaacctaacgttaaaaacttaaatctccgacccaacgaaaaaaccccaaaaacgaaaatcgcgctccccgctaatctaaatcccgcgaacctaactaaaccaccgccgaacgaacgaaacacaaacgcccttccgcccgcaacgaccccgaccacttccgaaccacgacctcgacacctcctaatacgcccgccccgaaccacactctttcttctcgaaacccgcaccgcgctaccaaaccaccgccgcactacgaaactaaaaaataaaccgacttcacgatacgtcctaccgaacaacccccgaaacacgaatacgatcgaattccgcgccaacttaca

SEQ ID NO: 3991 - DNA, 698 bp, Artificial Sequence
  chemically treated genomic DNA (Homo sapiens) CpG-island No: 3991
tgcggaattaagataaaaagtttattttacgttttttttttaataattttaattttttcgtattcgtttttttggggtaatttattaaattgagttcggttatcgtgttcggtttatagtgggtcgtatttttaaggtttagcgtcgataattgtatacgggagttcgggaaacgttcgcggagtatacgtttgaattaatgatttcgaaggggggattagtcgattttttatcgtattttataaagaaatttcgcgttcgtcgatatcggttcgatacgtcgattttgtcgttattcgttcgcgtttatttataattttttcgtttaggcgtcgggtcgcgagcgtttttagggtagggtttagcgttgggggtttgggttttcggtttagcgggagagttttaagggcggaggtcgcgtttttcgttggtttgagtttcgcgggtttggttgggttatcgtcgagcggacgaagtataggcgttttttcgttcgtagcggtttcgattattttcgggttacggtttcgatattttttaatgcgttcgtttcgggttatatttttttttttcggagttcgtatcgcgttgttagattatcgtcgtattgcggggttgaggagtggatcggttttacgatgcgttttgtcgggtagttttcgaaatacggatgcggtcggatttcgcgttaatttata

SEQ ID NO: 3992 - DNA, 698 bp, Artificial Sequence
  chemically treated genomic DNA (Homo sapiens) CpG-island No: 3992
tataaattaacgcgaaatccgaccgcatccgtatttcgaaaactacccgacaaaacgcatcgtaaaaccgatccactcctcaaccccgcaatacgacgataatctaacaacgcgatacgaactccgaaaaaaaaaaatataacccgaaacgaacgcattaaaaaatatcgaaaccgtaacccgaaaataatcgaaaccgctacgaacgaaaaaacgcctatacttcgtccgctcgacgataacccaaccaaacccgcgaaactcaaaccaacgaaaaacgcgacctccgcccttaaaactctcccgctaaaccgaaaacccaaacccccaacgctaaaccctaccctaaaaacgctcgcgacccgacgcctaaacgaaaaaattataaataaacgcgaacgaataacgacaaaatcgacgtatcgaaccgatatcgacgaacgcgaaatttctttataaaatacgataaaaaatcgactaatccccccttcgaaatcattaattcaaacgtatactccgcgaacgtttcccgaactcccgtatacaattatcgacgctaaaccttaaaaatacgacccactataaaccgaacacgataaccgaactcaatttaataaattaccccaaaaaaacgaatacgaaaaaattaaaattattaaaaaaaaaacgtaaaataaactttttatcttaattccgca

SEQ ID NO: 3993 - DNA, 578 bp, Artificial Sequence
  chemically treated genomic DNA (Homo sapiens) CpG-island No: 3993
atttgcgttttgttatttttttatttcgcgcgcgtcgtatttatttgagtcgcgtttttgtttagttcgttcggcgttttaaataggtttttaggttgggttatgggtagtattgtcgagtattcgcggcgggtagagtaagtttttggatggttcggggtaggcgggcggggagaaggcgtaggtatttattgagattcggttgtcgtggcggcgatttttggttgttagggcgtagaggattttgtaggcgggcgttttggtgtttaatttcgaggagggggaggagcgggaggaggagcgggagtaaaaggaggggacggaggaggtcgggttcggagggagagcgcgttgggtagaggaggatcgcgagcgtttattgttgttcggttcgttcgggtgtcgtttagagttcggttcgttaggtgtttggtgtttcgttttgcgtttagttgtttcgtatagtttcgtttggtacgtagttttagcggttggtcgggtagtagtcggtttcgtttattcggtgcggtggtttttggggttttagtttaaggggagggattagcgttttaagaagg

SEQ ID NO: 3994 - DNA, 578 bp, Artificial Sequence
  chemically treated genomic DNA (Homo sapiens) CpG-island No: 3994
ccttcttaaaacgctaatccctccccttaaactaaaaccccaaaaaccaccgcaccgaataaacgaaaccgactactacccgaccaaccgctaaaactacgtaccaaacgaaactatacgaaacaactaaacgcaaaacgaaacaccaaacacctaacgaaccgaactctaaacgacacccgaacgaaccgaacaacaataaacgctcgcgatcctcctctacccaacgcgctctccctccgaacccgacctcctccgtcccctccttttactcccgctcctcctcccgctcctccccctcctcgaaattaaacaccaaaacgcccgcctacaaaatcctctacgccctaacaaccaaaaatcgccgccacgacaaccgaatctcaataaatacctacgccttctccccgcccgcctaccccgaaccatccaaaaacttactctacccgccgcgaatactcgacaatactacccataacccaacctaaaaacctatttaaaacgccgaacgaactaaacaaaaacgcgactcaaataaatacgacgcgcgcgaaataaaaaaataacaaaacgcaaat

SEQ ID NO: 3995 - DNA, 578 bp, Artificial Sequence
  chemically treated genomic DNA (Homo sapiens) CpG-island No: 3995
tttttttggagcgttggtttttttttttggattgaaattttaggggttatcgtatcgggtgggcgggatcgattattattcgattagtcgttggagttgcgtgttaggcggggttgtgcggagtagttgagcgtagagcggagtattaggtatttagcgggtcggattttgggcggtattcgagcgggtcgggtagtagtgggcgttcgcgatttttttttgtttaacgcgtttttttttcgggttcggtttttttcgttttttttttttgttttcgttttttttttcgttttttttttttttcgggattgagtattaaaacgttcgtttgtaaggttttttgcgttttggtagttaggagtcgtcgttacgatagtcgggttttagtgggtgtttgcgtttttttttcgttcgtttgtttcgggttatttagaaatttgttttattcgtcgcgggtgttcggtagtgttgtttatggtttagtttaggagtttatttagggcgtcggacgggttggatagaggcgcggtttaggtgagtgcggcgcgcgcggggtgggagagtggtaggacgtaggt

SEQ ID NO: 3996 - DNA, 578 bp, Artificial Sequence
  chemically treated genomic DNA (Homo sapiens) CpG-island No: 3996
acctacgtcctaccactctcccaccccgcgcgcgccgcactcacctaaaccgcgcctctatccaacccgtccgacgccctaaataaactcctaaactaaaccataaacaacactaccgaacacccgcgacgaataaaacaaatttctaaataacccgaaacaaacgaacgaaaaaaaaacgcaaacacccactaaaacccgactatcgtaacgacgactcctaactaccaaaacgcaaaaaaccttacaaacgaacgttttaatactcaatcccgaaaaaaaaaaaaaacgaaaaaaaaaacgaaaacaaaaaaaaaaaacgaaaaaaaccgaacccgaaaaaaaaacgcgttaaacaaaaaaaaatcgcgaacgcccactactacccgacccgctcgaataccgcccaaaatccgacccgctaaatacctaatactccgctctacgctcaactactccgcacaaccccgcctaacacgcaactccaacgactaatcgaataataatcgatcccgcccacccgatacgataacccctaaaatttcaatccaaaaaaaaaaaccaacgctccaaaaaaa

SEQ ID NO: 3997 - DNA, 1426 bp, Artificial Sequence
  chemically treated genomic DNA (Homo sapiens) CpG-island No: 3997
aagtttcgttattatgaatttataatttttcgtttgcggttgacgtatcgtttttgttcgtacgtatttgggttcgtgttaatagtatcgggtagttttcgttaggtatttttaaggattttttattttttcggcgcgttttatatttgacggtcgagttttaaatttggcggaaaggtgataagcgacgtttttcgcggaattcgagggtcggttgtagcgagtttttttcgggtcggggtaggggtcggggggcggtttttatttttaaggggtttcgcgtcgtgttttagttttttcgcgtcgttgatagtcgggagcgggcgatagacgtagtttgcgttatttttagagtttatttttcgtcgtagtttagagcgtacgttttcgggtgtttagtcgtttacgtttcgtcgaagtacgtcgtcggtttttggggttaaggacgcgggtttaggcggatcgcggcgcgggcgggatcggacgtttaggaggcgttttcgcgggatcgtaagatggcggcggcggcggcgttagggtcgggttttttttcgtttcgtttcggtcggcgcgcgtatcgtagcgagggcgggcgggaggggatgaagcgggtcggagtaaggggtaggtcggtcgaggtggcggtaagaaagtagtcgggaaagggaaggcgtcggggcgtgggggagggggcgttttttcgggttagggtcgcggacgtgtttttcgcgttttttcgtcgatagttagcggttcgcgcgttttattttattcgggggtgttttcgttttgtttatttttgaatttgaggtttgtgggcggatcgaggattaggatttgttcgtgtttcgttatggtttttgaggcggacgttatcggagagatagcgtagagcgggggcgcgttcgcggcggcggtttgttgattgggggcgggggacgacggcggcgacggttcggtcgagttttaggacgaggttaggttcgcggttttcgagttttaacgtttgtcgttgtgttatcggttcggtgggttattcgttgggttagtagtttcgggttttataattgatttaattttatattagtcgttacggttacgcgtatttgcgagtttcggcgatttacgtgacggtttttgcgtgtttacgtgcgcgttttcggtcgggagtttttagcgtttgtttcgttttttaggtcggtttagcgcggcgcggggttgttgcgtttgcgcgttcgcggtttgtcgcggttcggagcgtagtttagttgttaagggaacgggtgtggaaggaggcggggtaaaggttcgcgggatcgacgcgatgcgtagcgtagggttggaagcgtagttttttgttattttgagtttcgagtacggaattagagaaattgttttggtagcgtattatatttttttaagtggg

SEQ ID NO: 3998 - DNA, 1426 bp, Artificial Sequence
  chemically treated genomic DNA (Homo sapiens) CpG-island No: 3998
cccacttaaaaaaatataatacgctaccaaaacaatttctctaattccgtactcgaaactcaaaataacaaaaaactacgcttccaaccctacgctacgcatcgcgtcgatcccgcgaacctttaccccgcctccttccacacccgttcccttaacaactaaactacgctccgaaccgcgacaaaccgcgaacgcgcaaacgcaacaaccccgcgccgcgctaaaccgacctaaaaaacgaaacaaacgctaaaaactcccgaccgaaaacgcgcacgtaaacacgcaaaaaccgtcacgtaaatcgccgaaactcgcaaatacgcgtaaccgtaacgactaatataaaattaaatcaattataaaacccgaaactactaacccaacgaataacccaccgaaccgataacacaacgacaaacgttaaaactcgaaaaccgcgaacctaacctcgtcctaaaactcgaccgaaccgtcgccgccgtcgtcccccgcccccaatcaacaaaccgccgccgcgaacgcgcccccgctctacgctatctctccgataacgtccgcctcaaaaaccataacgaaacacgaacaaatcctaatcctcgatccgcccacaaacctcaaattcaaaaataaacaaaacgaaaacacccccgaataaaataaaacgcgcgaaccgctaactatcgacgaaaaaacgcgaaaaacacgtccgcgaccctaacccgaaaaaacgccccctcccccacgccccgacgccttccctttcccgactactttcttaccgccacctcgaccgacctaccccttactccgacccgcttcatcccctcccgcccgccctcgctacgatacgcgcgccgaccgaaacgaaacgaaaaaaaacccgaccctaacgccgccgccgccgccatcttacgatcccgcgaaaacgcctcctaaacgtccgatcccgcccgcgccgcgatccgcctaaacccgcgtccttaaccccaaaaaccgacgacgtacttcgacgaaacgtaaacgactaaacacccgaaaacgtacgctctaaactacgacgaaaaataaactctaaaaataacgcaaactacgtctatcgcccgctcccgactatcaacgacgcgaaaaaactaaaacacgacgcgaaaccccttaaaaataaaaaccgccccccgacccctaccccgacccgaaaaaaactcgctacaaccgaccctcgaattccgcgaaaaacgtcgcttatcacctttccgccaaatttaaaactcgaccgtcaaatataaaacgcgccgaaaaaataaaaaatccttaaaaatacctaacgaaaactacccgatactattaacacgaacccaaatacgtacgaacaaaaacgatacgtcaaccgcaaacgaaaaattataaattcataataacgaaactt

SEQ ID NO: 3999 - DNA, 1426 bp, Artificial Sequence
  chemically treated genomic DNA (Homo sapiens) CpG-island No: 3999
tttatttggaagagtgtgatgcgttgttagagtagtttttttagtttcgtattcggagtttaaggtgatagaggattgcgtttttagttttgcgttgcgtatcgcgtcggtttcgcggatttttgtttcgtttttttttatattcgtttttttgatagttgggttgcgtttcgggtcgcggtaagtcgcgagcgcgtaggcgtagtagtttcgcgtcgcgttaggtcggtttggagggcgggataagcgttagaagttttcggtcgggggcgcgtacgtaggtacgtagaggtcgttacgtgggtcgtcgaggttcgtaagtgcgcgtggtcgtggcggttggtgtggggttgagttagttgtgggattcggagttgttgatttagcgggtggtttatcgaatcggtgatatagcggtaggcgttagggttcgggagtcgcgagtttggtttcgttttagagttcggtcgagtcgtcgtcgtcgtcgtttttcgtttttagttagtaaatcgtcgtcgcgggcgcgttttcgttttgcgttgttttttcgatggcgttcgttttaggggttatggcgaagtacgagtagattttggttttcgattcgtttatagattttaaatttaaaggtaggtagaacggggatattttcgggtggggtggggcgcgcggatcgttggttgtcggcgggggggcgcggagggtacgttcgcggttttggttcgagggagcgtttttttttttacgtttcggcgttttttttttttcggttgtttttttgtcgttatttcggtcggtttgttttttgtttcggttcgttttattttttttcgttcgttttcgttgcggtgcgcgcgtcggtcggggcgaggcggaggggagttcggttttggcgtcgtcgtcgtcgttattttgcggtttcgcgggggcgttttttgggcgttcggtttcgttcgcgtcgcggttcgtttgggttcgcgtttttggttttagaggtcgacggcgtgtttcggcggggcgtgggcggttgggtattcgagggcgtgcgttttgggttgcggcggggagtgggttttggaggtggcgtaagttgcgtttgtcgttcgttttcggttgttagcggcgcggggaggttagggtacggcgcgggattttttgggagtgagagtcgtttttcgatttttgtttcggttcggggagagttcgttgtagtcggttttcgggtttcgcggagggcgtcgtttgttattttttcgttaggtttagaattcggtcgttaggtgtaggacgcgtcggggaggtggagagtttttggaggtgtttggcgagggttgttcggtgttgttggtacggatttaggtgcgtgcgggtaggagcgatgcgttagtcgtaaacggagagttgtaggtttatagtagcggggttt

SEQ ID NO: 4000 - DNA, 1426 bp, Artificial Sequence
  chemically treated genomic DNA (Homo sapiens) CpG-island No: 4000
aaaccccgctactataaacctacaactctccgtttacgactaacgcatcgctcctacccgcacgcacctaaatccgtaccaacaacaccgaacaaccctcgccaaacacctccaaaaactctccacctccccgacgcgtcctacacctaacgaccgaattctaaacctaacgaaaaaataacaaacgacgccctccgcgaaacccgaaaaccgactacaacgaactctccccgaaccgaaacaaaaatcgaaaaacgactctcactcccaaaaaatcccgcgccgtaccctaacctccccgcgccgctaacaaccgaaaacgaacgacaaacgcaacttacgccacctccaaaacccactccccgccgcaacccaaaacgcacgccctcgaatacccaaccgcccacgccccgccgaaacacgccgtcgacctctaaaaccaaaaacgcgaacccaaacgaaccgcgacgcgaacgaaaccgaacgcccaaaaaacgcccccgcgaaaccgcaaaataacgacgacgacgacgccaaaaccgaactcccctccgcctcgccccgaccgacgcgcgcaccgcaacgaaaacgaacgaaaaaaaataaaacgaaccgaaacaaaaaacaaaccgaccgaaataacgacaaaaaaacaaccgaaaaaaaaaaaacgccgaaacgtaaaaaaaaaaacgctccctcgaaccaaaaccgcgaacgtaccctccgcgcccccccgccgacaaccaacgatccgcgcgccccaccccacccgaaaatatccccgttctacctacctttaaatttaaaatctataaacgaatcgaaaaccaaaatctactcgtacttcgccataacccctaaaacgaacgccatcgaaaaaacaacgcaaaacgaaaacgcgcccgcgacgacgatttactaactaaaaacgaaaaacgacgacgacgacgactcgaccgaactctaaaacgaaaccaaactcgcgactcccgaaccctaacgcctaccgctatatcaccgattcgataaaccacccgctaaatcaacaactccgaatcccacaactaactcaaccccacaccaaccgccacgaccacgcgcacttacgaacctcgacgacccacgtaacgacctctacgtacctacgtacgcgcccccgaccgaaaacttctaacgcttatcccgccctccaaaccgacctaacgcgacgcgaaactactacgcctacgcgctcgcgacttaccgcgacccgaaacgcaacccaactatcaaaaaaacgaatataaaaaaaaacgaaacaaaaatccgcgaaaccgacgcgatacgcaacgcaaaactaaaaacgcaatcctctatcaccttaaactccgaatacgaaactaaaaaaactactctaacaacgcatcacactcttccaaataaa

SEQ ID NO: 4001 - DNA, 1095 bp, Artificial Sequence
  chemically treated genomic DNA (Homo sapiens) CpG-island No: 4001
tcgaaagaataagtgcgttcggagtcgttacgggttagaagttttcgtttttagagcgaagatcgtattttcgttttagtattttaaaattcgattttcggcgttcgtttcggtcgtttcgttttcggggaagtgttcgattcgttagcgttttcgcggagttaggatagaattcgcggtcggggcgtttcgagatttaacgtagcgtcgcgtagtcggggtttttacgtttttacgttcggtttcggtttttttcgggtattcgcggttcgtttcgggggattagggttcggttcgatatatacggttcgtttcggggcgtcggggatagggaggttcgttcgcgtcgttttttaggtcgtcggggattcgtattaatttttttcgttttcgaaggataagtcggttcgtattttttgttcgggttaaggcggacgaggggtattggaatttcgttttttttttaggtcgcgaggatttcgattagcgcgttttcgttttcgtttagtagcgcggttcgcgttttttttttaggtcgcggggaaacgtagcgcgcgtttcgtatttgttcgcgggtttagttttttatttatttagagttcggtgttttagtttatggtgtaggggacgcgaaggggcgtttcgcgcggcgggcgcggttttttggttttttttttcggcgatttttttgtttttcgagattttcgcgacggcggaaagttcggagttcgcgcggtttttttcggttcgtagtttttcgttcggggttttttcggcggtttttttttttcgtcgttttatagtaaaatggttcgaggaagtagtagtcgcggtcgtcgtagcgttcgttcgttttatattcggagagcgggggaggggcgggaggggaggggcggggtcggtttgatagttcgcgtacgcgcgttcgttttatttcggttcggttttttttttcgggttttttcggtcgggttcgcgtcgttttggggttcggaaggacgcggagggaggtgtgagggacggcgggattcggatttttaggattttttttgttaatttggtaatgattttttagtgattattgtttgttcgtag

SEQ ID NO: 4002 - DNA, 1095 bp, Artificial Sequence
  chemically treated genomic DNA (Homo sapiens) CpG-island No: 4002
ctacgaacaaacaataatcactaaaaaatcattaccaaattaacaaaaaaaatcctaaaaatccgaatcccgccgtccctcacacctccctccgcgtccttccgaaccccaaaacgacgcgaacccgaccgaaaaaacccgaaaaaaaaaaccgaaccgaaataaaacgaacgcgcgtacgcgaactatcaaaccgaccccgcccctcccctcccgcccctcccccgctctccgaatataaaacgaacgaacgctacgacgaccgcgactactacttcctcgaaccattttactataaaacgacgaaaaaaaaaaaccgccgaaaaaaccccgaacgaaaaactacgaaccgaaaaaaaccgcgcgaactccgaactttccgccgtcgcgaaaatctcgaaaaacaaaaaaatcgccgaaaaaaaaaaccaaaaaaccgcgcccgccgcgcgaaacgccccttcgcgtcccctacaccataaactaaaacaccgaactctaaataaataaaaaactaaacccgcgaacaaatacgaaacgcgcgctacgtttccccgcgacctaaaaaaaaaacgcgaaccgcgctactaaacgaaaacgaaaacgcgctaatcgaaatcctcgcgacctaaaaaaaaaacgaaattccaatacccctcgtccgccttaacccgaacaaaaaatacgaaccgacttatccttcgaaaacgaaaaaaattaatacgaatccccgacgacctaaaaaacgacgcgaacgaacctccctatccccgacgccccgaaacgaaccgtatatatcgaaccgaaccctaatcccccgaaacgaaccgcgaatacccgaaaaaaaccgaaaccgaacgtaaaaacgtaaaaaccccgactacgcgacgctacgttaaatctcgaaacgccccgaccgcgaattctatcctaactccgcgaaaacgctaacgaatcgaacacttccccgaaaacgaaacgaccgaaacgaacgccgaaaatcgaattttaaaatactaaaacgaaaatacgatcttcgctctaaaaacgaaaacttctaacccgtaacgactccgaacgcacttattctttcga

SEQ ID NO: 4003 - DNA, 1095 bp, Artificial Sequence
  chemically treated genomic DNA (Homo sapiens) CpG-island No: 4003
ttgcgagtagatagtggttattaagaagttattattagattggtagggggagttttagggattcgggtttcgtcgttttttatattttttttcgcgttttttcggattttagggcgacgcggattcggtcgggggagttcgggggagggggtcgggtcggggtggggcgggcgcgcgtgcgcgagttgttagatcggtttcgttttttttttttcgtttttttttcgtttttcgggtgtagggcgggcgggcgttgcggcggtcgcggttgttgttttttcgggttattttgttgtggagcggcggggaggaggagtcgtcgaggagatttcgggcgaggagttgcgagtcggaggaggtcgcgcggatttcgggtttttcgtcgtcgcggggatttcggggggtaaagggatcgtcggggagggggattagagagtcgcgttcgtcgcgcggagcgttttttcgcgttttttgtattatgagttggggtatcgagttttgggtgagtgaggggttgggttcgcgggtagatgcggggcgcgcgttgcgttttttcgcggtttggggagggggcgcgggtcgcgttgttgggcggaggcgagggcgcgttggtcggggttttcgcggtttggggaggaggcggggttttaatgtttttcgttcgttttggttcgagtaggaggtgcgggtcggtttgtttttcggaggcgaggggagttggtgcgggttttcggcggtttgaggaacggcgcgggcgggtttttttgttttcggcgtttcggagcgggtcgtgtgtgtcgggtcgagttttaatttttcggggcgagtcgcggatgttcggggagggtcgggatcgggcgtgggggcgtggaggtttcggttgcgcggcgttgcgttgggtttcggggcgtttcggtcgcgagttttgttttggtttcgcggaggcgttggcggatcgggtattttttcgggagcggggcggtcggggcgagcgtcgggggtcgggttttggggtgttggggcgagagtgcggttttcgttttggaggcgaggatttttggttcgtggcggtttcgggcgtatttgttttttcgg

SEQ ID NO: 4004 - DNA, 1095 bp, Artificial Sequence
  chemically treated genomic DNA (Homo sapiens) CpG-island No: 4004
ccgaaaaaacaaatacgcccgaaaccgccacgaaccaaaaatcctcgcctccaaaacgaaaaccgcactctcgccccaacaccccaaaacccgacccccgacgctcgccccgaccgccccgctcccgaaaaaatacccgatccgccaacgcctccgcgaaaccaaaacaaaactcgcgaccgaaacgccccgaaacccaacgcaacgccgcgcaaccgaaacctccacgcccccacgcccgatcccgaccctccccgaacatccgcgactcgccccgaaaaattaaaactcgacccgacacacacgacccgctccgaaacgccgaaaacaaaaaaacccgcccgcgccgttcctcaaaccgccgaaaacccgcaccaactcccctcgcctccgaaaaacaaaccgacccgcacctcctactcgaaccaaaacgaacgaaaaacattaaaaccccgcctcctccccaaaccgcgaaaaccccgaccaacgcgccctcgcctccgcccaacaacgcgacccgcgccccctccccaaaccgcgaaaaaacgcaacgcgcgccccgcatctacccgcgaacccaacccctcactcacccaaaactcgataccccaactcataatacaaaaaacgcgaaaaaacgctccgcgcgacgaacgcgactctctaatccccctccccgacgatccctttaccccccgaaatccccgcgacgacgaaaaacccgaaatccgcgcgacctcctccgactcgcaactcctcgcccgaaatctcctcgacgactcctcctccccgccgctccacaacaaaataacccgaaaaaacaacaaccgcgaccgccgcaacgcccgcccgccctacacccgaaaaacgaaaaaaaaacgaaaaaaaaaaaacgaaaccgatctaacaactcgcgcacgcgcgcccgccccaccccgacccgaccccctcccccgaactcccccgaccgaatccgcgtcgccctaaaatccgaaaaaacgcgaaaaaaaatataaaaaacgacgaaacccgaatccctaaaactccccctaccaatctaataataacttcttaataaccactatctactcgcaa

SEQ ID NO: 4005 - DNA, 509 bp, Artificial Sequence
  chemically treated genomic DNA (Homo sapiens) CpG-island No: 4005
ggttcgatatcgtgcggttgatatagtttatttttcgattttgagattaggggttttcggagtttaaggtcgtttttaaagtttagcgaggcggaggtgcggttcgggttggtttggttcggttatcgttgttatggtaatcgttaataggttggttttatttttaattgaaagtttgtataggagcggtcgatcgaagggtttcgaggtgggtagtataggtttttcgacgattttttaggtcgtaatttttaggaaaacgattatagggttagcggagttagtcgtcgagtttcgtttttcgggttttttcggcggttgcgtttttttatttcggacgtgggcgggagaggaagcggttggtgatgttggaataaatatggtcgttttggcgttcgtcggttttttcgtttttcgcggttttaggttggtcgcgggttttcggttgtttttaatgttgggtttgttgtagttgttggtcgagtttggtttgggtcgcgtttattatt

SEQ ID NO: 4006 - DNA, 509 bp, Artificial Sequence
  chemically treated genomic DNA (Homo sapiens) CpG-island No: 4006
aataataaacgcgacccaaaccaaactcgaccaacaactacaacaaacccaacattaaaaacaaccgaaaacccgcgaccaacctaaaaccgcgaaaaacgaaaaaaccgacgaacgccaaaacgaccatatttattccaacatcaccaaccgcttcctctcccgcccacgtccgaaataaaaaaacgcaaccgccgaaaaaacccgaaaaacgaaactcgacgactaactccgctaaccctataatcgttttcctaaaaattacgacctaaaaaatcgtcgaaaaacctatactacccacctcgaaacccttcgatcgaccgctcctatacaaactttcaattaaaaataaaaccaacctattaacgattaccataacaacgataaccgaaccaaaccaacccgaaccgcacctccgcctcgctaaactttaaaaacgaccttaaactccgaaaacccctaatctcaaaatcgaaaaataaactatatcaaccgcacgatatcgaacc

SEQ ID NO: 4007 - DNA, 509 bp, Artificial Sequence
  chemically treated genomic DNA (Homo sapiens) CpG-island No: 4007
ggtgatggacgcggtttaggttaggttcggttagtaattgtagtaaatttagtattgggagtagtcggaggttcgcggttagtttaggatcgcgggaggcgggggagtcgacgggcgttagagcggttatgtttgttttagtattattagtcgttttttttttcgtttacgttcggggtgaaagggcgtagtcgtcggaagggttcggggagcggggttcggcggttagtttcgttgattttgtggtcgtttttttggagattgcgatttaggaagtcgtcgaggagtttgtgttgtttatttcggggtttttcgatcggtcgtttttgtgtagatttttagttagagatgaagttaatttattggcggttgttataataacggtggtcgaattagattagttcgggtcgtattttcgtttcgttgagttttggaagcgattttgggtttcggggatttttgattttagggtcgggggataagttgtgttagtcgtacggtgtcgggtt

SEQ ID NO: 4008 - DNA, 509 bp, Artificial Sequence
  chemically treated genomic DNA (Homo sapiens) CpG-island No: 4008
aacccgacaccgtacgactaacacaacttatcccccgaccctaaaatcaaaaatccccgaaacccaaaatcgcttccaaaactcaacgaaacgaaaatacgacccgaactaatctaattcgaccaccgttattataacaaccgccaataaattaacttcatctctaactaaaaatctacacaaaaacgaccgatcgaaaaaccccgaaataaacaacacaaactcctcgacgacttcctaaatcgcaatctccaaaaaaacgaccacaaaatcaacgaaactaaccgccgaaccccgctccccgaacccttccgacgactacgccctttcaccccgaacgtaaacgaaaaaaaaaacgactaataatactaaaacaaacataaccgctctaacgcccgtcgactcccccgcctcccgcgatcctaaactaaccgcgaacctccgactactcccaatactaaatttactacaattactaaccgaacctaacctaaaccgcgtccatcacc

SEQ ID NO: 4009 - DNA, 733 bp, Artificial Sequence
  chemically treated genomic DNA (Homo sapiens) CpG-island No: 4009
tcgtcgtgttttcggtattttatgaattcgtgtcgaatgaatgaatgttttcgggtcgggatttggttttatttatattcgatttttcgggtttttttcgtcgcggcgggggtcggagcgttagggttggattcggggagggggtggcgggggtggttgtttcgttttggggtcgcgttgagtcgaggggacgttttttcggttggttggcgaggtcggggtttagttggcggaggtcgcggttaggcgggtgcggggcgggaggtggcgtcgggcgttgagtggcggtttcgggtttatttttggcgcgcgggtgcgggcgggaggggggaggcgggaggcggggagcgtaggggcggcggtaggcgggaggtagtagcgagtatgtgtcgcggagtttagtaattagggacgatcgcggttatatcgcgtcggcgtcggcgtttagtttaggtagtttcgcgtcgcggcgttcggatcgttcgggtttgtttagcggtcgttttacgtttcgggcgtttcggcgtcgatagtcgcgtagcgtagcgcgggcgtcgtagataaaggcgcggtttcggttcggttcgttcggtttagtcgtttttgttgggcgttttaatcgggttcggttcgggggggcgggggtcgcggtcgtcgaggatggggaaatttaatagtaagttgaagttcgaagttgtggaggagttgattaggaagatttattgtgagtgtt

SEQ ID NO: 4010 - DNA, 733 bp, Artificial Sequence
  chemically treated genomic DNA (Homo sapiens) CpG-island No: 4010
aacactcacaataaatcttcctaatcaactcctccacaacttcgaacttcaacttactattaaatttccccatcctcgacgaccgcgacccccgcccccccgaaccgaacccgattaaaacgcccaacaaaaacgactaaaccgaacgaaccgaaccgaaaccgcgcctttatctacgacgcccgcgctacgctacgcgactatcgacgccgaaacgcccgaaacgtaaaacgaccgctaaacaaacccgaacgatccgaacgccgcgacgcgaaactacctaaactaaacgccgacgccgacgcgatataaccgcgatcgtccctaattactaaactccgcgacacatactcgctactacctcccgcctaccgccgcccctacgctccccgcctcccgcctcccccctcccgcccgcacccgcgcgccaaaaataaacccgaaaccgccactcaacgcccgacgccacctcccgccccgcacccgcctaaccgcgacctccgccaactaaaccccgacctcgccaaccaaccgaaaaaacgtcccctcgactcaacgcgaccccaaaacgaaacaaccacccccgccaccccctccccgaatccaaccctaacgctccgacccccgccgcgacgaaaaaaacccgaaaaatcgaatataaataaaaccaaatcccgacccgaaaacattcattcattcgacacgaattcataaaataccgaaaacacgacga

SEQ ID NO: 4011 - DNA, 733 bp, Artificial Sequence
  chemically treated genomic DNA (Homo sapiens) CpG-island No: 4011
agtatttatagtaggtttttttggttagtttttttataatttcgggttttaatttgttgttggatttttttattttcggcggtcgcggttttcgttttttcgggtcggattcggttggggcgtttagtaggagcggttgggtcgggcgggtcgggtcggggtcgcgtttttgtttgcggcgttcgcgttgcgttgcgcggttgtcggcgtcggggcgttcggggcgtggggcggtcgttgggtaggttcgggcggttcgggcgtcgcggcgcggggttgtttgggttgggcgtcggcgtcggcgcggtgtggtcgcggtcgtttttggttattgggtttcgcggtatatgttcgttgttgtttttcgtttgtcgtcgtttttgcgtttttcgtttttcgttttttttttttcgttcgtattcgcgcgttaggggtggattcggagtcgttatttagcgttcggcgttatttttcgtttcgtattcgtttggtcgcggttttcgttagttggatttcggtttcgttagttagtcggaggggcgttttttcggtttaacgcggttttagggcggggtagttattttcgttatttttttttcgaatttagttttggcgtttcggttttcgtcgcggcggggagggttcggaagatcggatgtgaatgaggttaggtttcggttcggagatatttatttattcgatacggatttatggggtgtcggggatacggcgg

SEQ ID NO: 4012 - DNA, 733 bp, Artificial Sequence
  chemically treated genomic DNA (Homo sapiens) CpG-island No: 4012
ccgccgtatccccgacaccccataaatccgtatcgaataaataaatatctccgaaccgaaacctaacctcattcacatccgatcttccgaaccctccccgccgcgacgaaaaccgaaacgccaaaactaaattcgaaaaaaaaataacgaaaataactaccccgccctaaaaccgcgttaaaccgaaaaaacgcccctccgactaactaacgaaaccgaaatccaactaacgaaaaccgcgaccaaacgaatacgaaacgaaaaataacgccgaacgctaaataacgactccgaatccacccctaacgcgcgaatacgaacgaaaaaaaaaaaacgaaaaacgaaaaacgcaaaaacgacgacaaacgaaaaacaacaacgaacatataccgcgaaacccaataaccaaaaacgaccgcgaccacaccgcgccgacgccgacgcccaacccaaacaaccccgcgccgcgacgcccgaaccgcccgaacctacccaacgaccgccccacgccccgaacgccccgacgccgacaaccgcgcaacgcaacgcgaacgccgcaaacaaaaacgcgaccccgacccgacccgcccgacccaaccgctcctactaaacgccccaaccgaatccgacccgaaaaaacgaaaaccgcgaccgccgaaaataaaaaaatccaacaacaaattaaaacccgaaattataaaaaaactaaccaaaaaaacctactataaatact

SEQ ID NO: 4013 - DNA, 1078 bp, Artificial Sequence
  chemically treated genomic DNA (Homo sapiens) CpG-island No: 4013
ttgtcggggcggtgttcggcgtattttaggttttttttcggcgatttttcgcgggttgtagtaaaatacggggcgtttcggcggggcgggggcgggcggttgtcgcggattcggtcggttatagtcgtagtttggtggttttcgattggttacgacgcgggcggggaggttcggcggaggagggaggcgggggcgagggcggcggcggcggcgggaggaataggagaggggagcgggtcgcgtagttaggtagcgcgtggggcgagcgcggggagagcggcggcggttcgtttaggtcgcgtagcggaggtcgagcggggtgcgcggtcggcgacggagggcggcgcgcgcgagtgagcggcgtagggcgaggatcggcgggcgggtgtcggtgcgcgggtagtaggggcggttgcggtagtagttgcgcgggacggagtcgcggcgggagagatcgcgtcggtttttcgttttatttttttgcggtcgaggtcggagaatagtttttaattcgtcgggggatcggaaagaggagtcgagaagcgtttttcggtttttacgtagcggaggcgcggagtggcgggattgttgttttttgtgggtgtagtacgtacgattcggagcgtttttttcgcggcgttgttttcggcgttttcgtcgcgtcgagcggttttggagcggggattcggaggaagtaaaattacgagttcgaaatttcgcgtggcggagtttttggggagcgttattcgttttatttttatttttatattttttatcggttaaggttttcgtcgttgtatttttcgcggttttcgttgcgtttcgggtcggagtcgagtcgtttgcgttgttatagtagtcgtttttatatattcgtagacgtttatacgttttttttttttgttttttcgttttttttttagttttttgatttttgggtttgttttattatttttggtgcgagtttcgcggatttcgcggttcgttatttgttattagttcgttttttattggcggggagcggagagtagcgaagaagggggtggggaggggaggggaagggaagggggtggaaatt

SEQ ID NO: 4014 - DNA, 1078 bp, Artificial Sequence
  chemically treated genomic DNA (Homo sapiens) CpG-island No: 4014
aatttccacccccttcccttcccctcccctccccacccccttcttcgctactctccgctccccgccaataaaaaacgaactaataacaaataacgaaccgcgaaatccgcgaaactcgcaccaaaaataataaaacaaacccaaaaatcaaaaaactaaaaaaaaaacgaaaaaacaaaaaaaaaaaacgtataaacgtctacgaatatataaaaacgactactataacaacgcaaacgactcgactccgacccgaaacgcaacgaaaaccgcgaaaaatacaacgacgaaaaccttaaccgataaaaaatataaaaataaaaataaaacgaataacgctccccaaaaactccgccacgcgaaatttcgaactcgtaattttacttcctccgaatccccgctccaaaaccgctcgacgcgacgaaaacgccgaaaacaacgccgcgaaaaaaacgctccgaatcgtacgtactacacccacaaaaaacaacaatcccgccactccgcgcctccgctacgtaaaaaccgaaaaacgcttctcgactcctctttccgatcccccgacgaattaaaaactattctccgacctcgaccgcaaaaaaataaaacgaaaaaccgacgcgatctctcccgccgcgactccgtcccgcgcaactactaccgcaaccgcccctactacccgcgcaccgacacccgcccgccgatcctcgccctacgccgctcactcgcgcgcgccgccctccgtcgccgaccgcgcaccccgctcgacctccgctacgcgacctaaacgaaccgccgccgctctccccgcgctcgccccacgcgctacctaactacgcgacccgctcccctctcctattcctcccgccgccgccgccgccctcgcccccgcctccctcctccgccgaacctccccgcccgcgtcgtaaccaatcgaaaaccaccaaactacgactataaccgaccgaatccgcgacaaccgcccgcccccgccccgccgaaacgccccgtattttactacaacccgcgaaaaatcgccgaaaaaaaacctaaaatacgccgaacaccgccccgacaa

SEQ ID NO: 4015 - DNA, 1078 bp, Artificial Sequence
  chemically treated genomic DNA (Homo sapiens) CpG-island No: 4015
agtttttattttttttttttttttttttttttttattttttttttcgttgtttttcgtttttcgttaatggagagcgagttgatgataaatagcgggtcgcggagttcgcgggattcgtattaggagtaataaaatagatttagagattaaggagttggggagggggcgggggaatagggagggagagcgtgtgagcgtttgcgagtgtgtggaggcggttgttgtggtagcgtaggcggttcggtttcggttcggagcgtagcggaagtcgcgagggatgtagcggcggggattttggtcggtggaggatgtggaggtggaagtggagcggatggcgttttttaagagtttcgttacgcgaggtttcgggttcgtggttttgtttttttcgggttttcgttttagggtcgttcggcgcgacgaagacgtcggggatagcgtcgcggggagggcgtttcgggtcgtgcgtgttgtatttataaagagtagtagtttcgttatttcgcgttttcgttgcgtgggggtcgaggggcgtttttcggttttttttttcggtttttcggcgagttggagattgtttttcggtttcggtcgtaagggggtgaggcgaggggtcggcgcggtttttttcgtcgcggtttcgtttcgcgtagttgttgtcgtagtcgtttttgttgttcgcgtatcggtattcgttcgtcggttttcgttttgcgtcgtttattcgcgcgcgtcgtttttcgtcgtcgatcgcgtatttcgttcggttttcgttgcgcgatttgggcgagtcgtcgtcgtttttttcgcgttcgttttacgcgttgtttggttgcgcggttcgttttttttttttatttttttcgtcgtcgtcgtcgttttcgttttcgtttttttttttcgtcgagttttttcgttcgcgtcgtggttaatcggaggttattaagttgcggttgtagtcggtcggattcgcggtagtcgttcgttttcgtttcgtcgaagcgtttcgtattttgttgtagttcgcggggggtcgtcggagggaagtttagagtgcgtcgagtatcgtttcggtag

SEQ ID NO: 4016 - DNA, 1078 bp, Artificial Sequence
  chemically treated genomic DNA (Homo sapiens) CpG-island No: 4016
ctaccgaaacgatactcgacgcactctaaacttccctccgacgaccccccgcgaactacaacaaaatacgaaacgcttcgacgaaacgaaaacgaacgactaccgcgaatccgaccgactacaaccgcaacttaataacctccgattaaccacgacgcgaacgaaaaaactcgacgaaaaaaaaaaacgaaaacgaaaacgacgacgacgacgaaaaaaataaaaaaaaaaaacgaaccgcgcaaccaaacaacgcgtaaaacgaacgcgaaaaaaacgacgacgactcgcccaaatcgcgcaacgaaaaccgaacgaaatacgcgatcgacgacgaaaaacgacgcgcgcgaataaacgacgcaaaacgaaaaccgacgaacgaataccgatacgcgaacaacaaaaacgactacgacaacaactacgcgaaacgaaaccgcgacgaaaaaaaccgcgccgacccctcgcctcacccccttacgaccgaaaccgaaaaacaatctccaactcgccgaaaaaccgaaaaaaaaaaccgaaaaacgcccctcgacccccacgcaacgaaaacgcgaaataacgaaactactactctttataaatacaacacgcacgacccgaaacgccctccccgcgacgctatccccgacgtcttcgtcgcgccgaacgaccctaaaacgaaaacccgaaaaaaacaaaaccacgaacccgaaacctcgcgtaacgaaactcttaaaaaacgccatccgctccacttccacctccacatcctccaccgaccaaaatccccgccgctacatccctcgcgacttccgctacgctccgaaccgaaaccgaaccgcctacgctaccacaacaaccgcctccacacactcgcaaacgctcacacgctctccctccctattcccccgccccctccccaactccttaatctctaaatctattttattactcctaatacgaatcccgcgaactccgcgacccgctatttatcatcaactcgctctccattaacgaaaaacgaaaaacaacgaaaaaaaaaataaaaaaaaaaaaaaaaaaaaaaaaaataaaaact

SEQ ID NO: 4017 - DNA, 558 bp, Artificial Sequence
  chemically treated genomic DNA (Homo sapiens) CpG-island No: 4017
ttcgagcgtgacgggaagttggggtaatttgttagttattcgtcgttattaagacgcggtacggcgtttggatcggaggggtttcgcgcgggcgcgaattttgggttcgggcgagtgggtggtgtttcgtttagttcgagacgggcgggcgcgcgggttaatgggtgtcgttttttggtcgcggggggtttcgattcgtgggtttcggttattagcgttttagtttcgaggtttagaagcggtaggcggaggcgcggttcgggcgttatggttatgttcggcgggttttacgcggttgtttttcgttcggcgcgttttcggtagggggcgttcggggtttagttggttcggttatgttgttggagatataggacgcgttgtacgtggcgttggagttggttatcgtcgcgttttcggtggcgggtaacgtgttggtgtgcgtcgcggtgggtacggcgaatattttgtagacgtttattaattattttttggtgtttttggttgcggtcgacgtggtcgtggggtttttcgttattttttttgttattattattagtt

SEQ ID NO: 4018 - DNA, 558 bp, Artificial Sequence
  chemically treated genomic DNA (Homo sapiens) CpG-island No: 4018
aactaataataataacaaaaaaaataacgaaaaaccccacgaccacgtcgaccgcaaccaaaaacaccaaaaaataattaataaacgtctacaaaatattcgccgtacccaccgcgacgcacaccaacacgttacccgccaccgaaaacgcgacgataaccaactccaacgccacgtacaacgcgtcctatatctccaacaacataaccgaaccaactaaaccccgaacgccccctaccgaaaacgcgccgaacgaaaaacaaccgcgtaaaacccgccgaacataaccataacgcccgaaccgcgcctccgcctaccgcttctaaacctcgaaactaaaacgctaataaccgaaacccacgaatcgaaaccccccgcgaccaaaaaacgacacccattaacccgcgcgcccgcccgtctcgaactaaacgaaacaccacccactcgcccgaacccaaaattcgcgcccgcgcgaaacccctccgatccaaacgccgtaccgcgtcttaataacgacgaataactaacaaattaccccaacttcccgtcacgctcgaa

SEQ ID NO: 4019 - DNA, 558 bp, Artificial Sequence
  chemically treated genomic DNA (Homo sapiens) CpG-island No: 4019
ggttgatggtgatggtaaaggggatggcgaagagttttacggttacgtcggtcgtagttagggatattaggaagtagttggtgggcgtttgtagagtgttcgtcgtgtttatcgcggcgtatattagtacgttgttcgttatcgaaagcgcggcgatgattagttttagcgttacgtatagcgcgttttgtgtttttagtagtatggtcgggttagttgggtttcgggcgttttttatcgaaggcgcgtcgggcgaggggtagtcgcgtgagattcgtcgggtatggttatagcgttcggatcgcgttttcgtttgtcgtttttgagtttcggggttggggcgttggtggtcgggatttacgggtcggggtttttcgcggttaagaggcggtatttattggttcgcgcgttcgttcgtttcgggttgggcggagtattatttattcgttcgagtttaaagttcgcgttcgcgcggggttttttcggtttaggcgtcgtgtcgcgttttggtggcggcggataattaataaattgttttaatttttcgttacgttcgag

SEQ ID NO: 4020 - DNA, 558 bp, Artificial Sequence
  chemically treated genomic DNA (Homo sapiens) CpG-island No: 4020
ctcgaacgtaacgaaaaattaaaacaatttattaattatccgccgccaccaaaacgcgacacgacgcctaaaccgaaaaaaccccgcgcgaacgcgaactttaaactcgaacgaataaataatactccgcccaacccgaaacgaacgaacgcgcgaaccaataaataccgcctcttaaccgcgaaaaaccccgacccgtaaatcccgaccaccaacgccccaaccccgaaactcaaaaacgacaaacgaaaacgcgatccgaacgctataaccatacccgacgaatctcacgcgactacccctcgcccgacgcgccttcgataaaaaacgcccgaaacccaactaacccgaccatactactaaaaacacaaaacgcgctatacgtaacgctaaaactaatcatcgccgcgctttcgataacgaacaacgtactaatatacgccgcgataaacacgacgaacactctacaaacgcccaccaactacttcctaatatccctaactacgaccgacgtaaccgtaaaactcttcgccatcccctttaccatcaccatcaacc

SEQ ID NO: 4021 - DNA, 1006 bp, Artificial Sequence
  chemically treated genomic DNA (Homo sapiens) CpG-island No: 4021
ttcggttcggcggtgttcggatgtttcgttcgcgtttatggcgtagttatatacgatttcggtttcgtatttcgcgcgtttttttgtatcgtcgtcgttatttcgtttaggagtttttttataatcgtcggtaatattacggttatcgcgtcgtaggatacgttttttacgatcggcggatcgtcgcgacgttttagttgattgcgtttatttgtggaggattttgatttttcgtcggggtagggcgagacggagtgacgtcggggcgcgttatcgcgcgtgcggacgtagggatgttttgtttagtcgttagggttcggttaattcggagggcgttcggcgcgtggtcgggggttaggagcgcgtttggtttgtagtgcgtagaggacgcggcgggagtatgtttcggtttttgagttggagtttgggtcgaggttttttgcgggtcgcggggcggcggtgtcggggttgtttcgcgcgtttgttttcggggttggtaggaggttcggggttcgaggtgtaggtgtcgttatttcgagtcgcgtcgtacggtcggggtttaggtttgttgtcgttgttggtaggtgaggggcgcgggtcgggcggggtcggtcgggcggggataggggcgcgggtcgggttcgatgattttagagttttttttcgtagcgttcgtttggttttcgaggttcgttgcggtagaggaggaggagtagtagggagtcgacggggtcgttgtcgaggacggggcggacgaggtcgaggtagagattatttagttgttgaagcgagttaaggtgaggcggtttcgggttttgcgttcggtcgagcgcggtagtttttgtgagcggggttttggcgttgttgcgtattatttttttcgtttcgtcgaagagtggatggaggtttcgcgggtaaaattgtcgagaatgaggtgggttattcgagaggggattggaatttatttaggttttttcgattttaaggtttgtagtaaaatttttgt

SEQ ID NO: 4022 - DNA, 1006 bp, Artificial Sequence
  chemically treated genomic DNA (Homo sapiens) CpG-island No: 4022
acaaaaattttactacaaaccttaaaatcgaaaaaacctaaataaattccaatcccctctcgaataacccacctcattctcgacaattttacccgcgaaacctccatccactcttcgacgaaacgaaaaaaataatacgcaacaacgccaaaaccccgctcacaaaaactaccgcgctcgaccgaacgcaaaacccgaaaccgcctcaccttaactcgcttcaacaactaaataatctctacctcgacctcgtccgccccgtcctcgacaacgaccccgtcgactccctactactcctcctcctctaccgcaacgaacctcgaaaaccaaacgaacgctacgaaaaaaaactctaaaatcatcgaacccgacccgcgcccctatccccgcccgaccgaccccgcccgacccgcgcccctcacctaccaacaacgacaacaaacctaaaccccgaccgtacgacgcgactcgaaataacgacacctacacctcgaaccccgaacctcctaccaaccccgaaaacaaacgcgcgaaacaaccccgacaccgccgccccgcgacccgcaaaaaacctcgacccaaactccaactcaaaaaccgaaacatactcccgccgcgtcctctacgcactacaaaccaaacgcgctcctaacccccgaccacgcgccgaacgccctccgaattaaccgaaccctaacgactaaacaaaacatccctacgtccgcacgcgcgataacgcgccccgacgtcactccgtctcgccctaccccgacgaaaaatcaaaatcctccacaaataaacgcaatcaactaaaacgtcgcgacgatccgccgatcgtaaaaaacgtatcctacgacgcgataaccgtaatattaccgacgattataaaaaaactcctaaacgaaataacgacgacgatacaaaaaaacgcgcgaaatacgaaaccgaaatcgtatataactacgccataaacgcgaacgaaacatccgaacaccgccgaaccgaa

SEQ ID NO: 4023 - DNA, 1006 bp, Artificial Sequence
  chemically treated genomic DNA (Homo sapiens) CpG-island No: 4023
gtagaggttttattgtaggttttagagtcggaaaagtttggatggattttaattttttttcggatgatttattttattttcggtaattttattcgcggagtttttatttatttttcggcgaggcggagagagtaatgcgtagtaacgttaagatttcgtttataaaggttatcgcgttcggtcgggcgtagggttcggagtcgttttattttggttcgttttagtagttggatgatttttgtttcggtttcgttcgtttcgttttcggtagcggtttcgtcggttttttgttgtttttttttttttgtcgtagcgggtttcgagaattaggcgagcgttgcgggaaggggttttgaggttatcgggttcggttcgcgtttttgttttcgttcggtcggtttcgttcggttcgcgttttttatttgttagtagcggtagtaggtttgggtttcggtcgtgcggcgcgattcgggatggcggtatttgtatttcgggtttcggattttttgttagtttcgggagtaggcgcgcggagtagtttcggtatcgtcgtttcgcggttcgtaggaagtttcggtttaggttttagtttaggagtcggaatatgttttcgtcgcgttttttgcgtattgtaggttagacgcgtttttggttttcgattacgcgtcgagcgtttttcggattggtcgggttttgacgattgagtaggatatttttgcgttcgtacgcgcgatgacgcgtttcgacgttatttcgtttcgttttgtttcggcggggggttaggattttttataggtaggcgtagttagttggagcgtcgcggcggttcgtcggtcgtggagggcgtgttttgcggcgcgatggtcgtagtgttgtcggcggttgtggaggagtttttgagcgagatggcggcggcggtgtaggagagcgcgcgaagtacgggatcgaggtcgtgtgtggttgcgttatgggcgcgggcggggtattcgggtatcgtcgggtcggg

SEQ ID NO: 4024 - DNA, 1006 bp, Artificial Sequence
  chemically treated genomic DNA (Homo sapiens) CpG-island No: 4024
cccgacccgacgatacccgaataccccgcccgcgcccataacgcaaccacacacgacctcgatcccgtacttcgcgcgctctcctacaccgccgccgccatctcgctcaaaaactcctccacaaccgccgacaacactacgaccatcgcgccgcaaaacacgccctccacgaccgacgaaccgccgcgacgctccaactaactacgcctacctataaaaaatcctaaccccccgccgaaacaaaacgaaacgaaataacgtcgaaacgcgtcatcgcgcgtacgaacgcaaaaatatcctactcaatcgtcaaaacccgaccaatccgaaaaacgctcgacgcgtaatcgaaaaccaaaaacgcgtctaacctacaatacgcaaaaaacgcgacgaaaacatattccgactcctaaactaaaacctaaaccgaaacttcctacgaaccgcgaaacgacgataccgaaactactccgcgcgcctactcccgaaactaacaaaaaatccgaaacccgaaatacaaataccgccatcccgaatcgcgccgcacgaccgaaacccaaacctactaccgctactaacaaataaaaaacgcgaaccgaacgaaaccgaccgaacgaaaacaaaaacgcgaaccgaacccgataacctcaaaaccccttcccgcaacgctcgcctaattctcgaaacccgctacgacaaaaaaaaaaaaacaacaaaaaaccgacgaaaccgctaccgaaaacgaaacgaacgaaaccgaaacaaaaatcatccaactactaaaacgaaccaaaataaaacgactccgaaccctacgcccgaccgaacgcgataacctttataaacgaaatcttaacgttactacgcattactctctccgcctcgccgaaaaataaataaaaactccgcgaataaaattaccgaaaataaaataaatcatccgaaaaaaaattaaaatccatccaaacttttccgactctaaaacctacaataaaacctctac

SEQ ID NO: 4025 - DNA, 525 bp, Artificial Sequence
  chemically treated genomic DNA (Homo sapiens) CpG-island No: 4025
agatcgggcgcgcgcgtacgattcgttttatttatagattatcgtgattagggcgtatagatatatacgcgcgtttttttacgtacgttcggttatacgtaggttttttttttttgttatagaggaacgcgttggcgtgcgtacggcggattaattattatttttagatttattcggatcgaggcgtaggttgcgcgtacgcgcggtttcgagttttcgtttttttgtcgcgtttgtcgggggcggggcgtcgttgggggcgggttttgcggtatcgttcgggaagttgcgcgagggtcgatagttttcgttatattttttattttttttggtttagcgagcgttgtcgggttagggttaagcggagggtttcgacggcgcggacggagcgaagcgtcgagttatggcgtattaaacgggtatttacggtgagggcggatggcgggcgggtagggggtttcggtttgggttttcggaagcgttttttttcggttttcggtttttttttttattttatattagtcg

SEQ ID NO: 4026 - DNA, 525 bp, Artificial Sequence
  chemically treated genomic DNA (Homo sapiens) CpG-island No: 4026
cgactaatataaaataaaaaaaaaaaccgaaaaccgaaaaaaaacgcttccgaaaacccaaaccgaaaccccctacccgcccgccatccgccctcaccgtaaatacccgtttaatacgccataactcgacgcttcgctccgtccgcgccgtcgaaaccctccgcttaaccctaacccgacaacgctcgctaaaccaaaaaaaataaaaaatataacgaaaactatcgaccctcgcgcaacttcccgaacgataccgcaaaacccgcccccaacgacgccccgcccccgacaaacgcgacaaaaaaacgaaaactcgaaaccgcgcgtacgcgcaacctacgcctcgatccgaataaatctaaaaataataattaatccgccgtacgcacgccaacgcgttcctctataacaaaaaaaaaaaacctacgtataaccgaacgtacgtaaaaaaacgcgcgtatatatctatacgccctaatcacgataatctataaataaaacgaatcgtacgcgcgcgcccgatct

SEQ ID NO: 4027 - DNA, 525 bp, Artificial Sequence
  chemically treated genomic DNA (Homo sapiens) CpG-island No: 4027
cggttggtgtggggtggagggaggggtcgagagtcgggggggggcgttttcgagagtttagatcgaggttttttgttcgttcgttattcgtttttatcgtggatgttcgtttggtgcgttatggttcggcgtttcgtttcgttcgcgtcgtcggagtttttcgtttgattttggttcggtaacgttcgttggattaagagaggtggaggatgtggcggaggttgtcgattttcgcgtagtttttcgggcggtgtcgtaggattcgtttttagcggcgtttcgttttcgataggcgcggtagggaggcggggattcggggtcgcgcgtgcgcgtagtttgcgtttcggttcgggtgggtttaaggatgatgattgattcgtcgtgcgtacgttagcgcgtttttttgtggtaggagaggggggtttgcgtgtgatcgagcgtgcgtgggaggacgcgcgtgtgtgtttgtgcgttttgattacggtggtttgtgggtggggcggatcgtgcgcgcgcgttcgattt

SEQ ID NO: 4028 - DNA, 525 bp, Artificial Sequence
  chemically treated genomic DNA (Homo sapiens) CpG-island No: 4028
aaatcgaacgcgcgcgcacgatccgccccacccacaaaccaccgtaatcaaaacgcacaaacacacacgcgcgtcctcccacgcacgctcgatcacacgcaaacccccctctcctaccacaaaaaaacgcgctaacgtacgcacgacgaatcaatcatcatccttaaacccacccgaaccgaaacgcaaactacgcgcacgcgcgaccccgaatccccgcctccctaccgcgcctatcgaaaacgaaacgccgctaaaaacgaatcctacgacaccgcccgaaaaactacgcgaaaatcgacaacctccgccacatcctccacctctcttaatccaacgaacgttaccgaaccaaaatcaaacgaaaaactccgacgacgcgaacgaaacgaaacgccgaaccataacgcaccaaacgaacatccacgataaaaacgaataacgaacgaacaaaaaacctcgatctaaactctcgaaaacgcccccccccgactctcgacccctccctccaccccacaccaaccg

SEQ ID NO: 4029 - DNA, 943 bp, Artificial Sequence
  chemically treated genomic DNA (Homo sapiens) CpG-island No: 4029
gcgcgcgcgggggacgtgtgcgggcgttttcgttattttgtgagtttataattcggagtcgttgggtcggtttttgttatttcggcgtttttatttcgtttttcgcgggtttgttttgtgtgttatggacgggtgagtcgtacgtcgtttcgcgttttatcgtttttttcgcgtcgtagttttgttttcgtcgtcgcgtcggttttttcggggtcgatttcgttttttttcgggcgggagggggcggcgggttttttttttttttttcgcgtggcgggcgcgggtgcggggcgggttaggggtttttcgggggtttggtcgcgtttttatttttcgttcggttcgttttcggttttcgcgcgtttcgtttttagcgtacgcggtttttcgcgttttttttttttcgcgcgcgttttcgtatttcgtttttgtttcgtttcggcggcgcgcggtttttttcgtttttcgttcggttttcgcgcgttcggatggtttttttcgtttttcgttcgtttttttcgtgcgtttgcgtagttcgtcgcgcgttttcgttggttttagcgcgcgtgcgcggtcgttatcgggggcgcgcgtttttttcgtcgttcggattttgttttcggcgtagtttcggaagcgtaggcggggttggggcggtcgtcgggagggaaagttggcgtcggggtttcgtcgcgggttcgagtttttgcgtttttcgttttatttttgtttttcgtgcgtttcgggtcgcggttaaggggtttcggtgatttcgggagagaagcggtcgtttcgagggtttgtttttcgtttcggggtcggaggggtttttttagggattttcgcgggcgtcgttatggggaggggttttttcggttttcgggtcggggtagttttttcgggcggttttgttgggcgggttttttttgggagaggtgggagt

SEQ ID NO: 4030 - DNA, 943 bp, Artificial Sequence
  chemically treated genomic DNA (Homo sapiens) CpG-island No: 4030
actcccacctctcccaaaaaaaacccgcccaacaaaaccgcccgaaaaaactaccccgacccgaaaaccgaaaaaacccctccccataacgacgcccgcgaaaatccctaaaaaaacccctccgaccccgaaacgaaaaacaaaccctcgaaacgaccgcttctctcccgaaatcaccgaaaccccttaaccgcgacccgaaacgcacgaaaaacaaaaataaaacgaaaaacgcaaaaactcgaacccgcgacgaaaccccgacgccaactttccctcccgacgaccgccccaaccccgcctacgcttccgaaactacgccgaaaacaaaatccgaacgacgaaaaaaacgcgcgcccccgataacgaccgcgcacgcgcgctaaaaccaacgaaaacgcgcgacgaactacgcaaacgcacgaaaaaaacgaacgaaaaacgaaaaaaaccatccgaacgcgcgaaaaccgaacgaaaaacgaaaaaaaccgcgcgccgccgaaacgaaacaaaaacgaaatacgaaaacgcgcgcgaaaaaaaaaaaacgcgaaaaaccgcgtacgctaaaaacgaaacgcgcgaaaaccgaaaacgaaccgaacgaaaaataaaaacgcgaccaaacccccgaaaaacccctaacccgccccgcacccgcgcccgccacgcgaaaaaaaaaaaaaaaacccgccgccccctcccgcccgaaaaaaaacgaaatcgaccccgaaaaaaccgacgcgacgacgaaaacaaaactacgacgcgaaaaaaacgataaaacgcgaaacgacgtacgactcacccgtccataacacacaaaacaaacccgcgaaaaacgaaataaaaacgccgaaataacaaaaaccgacccaacgactccgaattataaactcacaaaataacgaaaacgcccgcacacgtcccccgcgcgcgc

SEQ ID NO: 4031 - DNA, 943 bp, Artificial Sequence
  chemically treated genomic DNA (Homo sapiens) CpG-island No: 4031
gtttttattttttttaagggaagttcgtttagtaaagtcgttcggaaaggttgtttcggttcgagagtcgggaaggtttttttttatgacggcgttcgcgggggtttttggagaggttttttcggtttcggggcggaggatagattttcggggcggtcgtttttttttcgagattatcgaaattttttggtcgcggttcggggcgtacggggggtaggggtagggcggggagcgtagagattcgggttcgcggcgaggtttcggcgttagttttttttttcggcggtcgttttagtttcgtttgcgttttcggggttgcgtcgggggtagagttcgggcggcgggaaaggcgcgcgttttcgatggcggtcgcgtacgcgcgttggggttaacggggacgcgcgacgggttacgtaggcgtacgaggggagcggacgggaggcgggaagggttattcgggcgcgcgagggtcggacgggaagcgggaagggtcgcgcgtcgtcgaggcggggtaaaggcgaagtgcggggacgcgcgcggagggggaggggcgcgggaggtcgcgtgcgttagggacggggcgcgcgggggtcggaagcgggtcggacgggggatggggacgcggttagattttcgggaagtttttgattcgtttcgtattcgcgttcgttacgcggagaggaaggggagagttcgtcgttttttttcgttcgagagggggcgagatcggtttcggggaggtcggcgcggcggcgggggtagggttgcggcgcggggagggcggtggggcgcggggcgacgtgcgatttattcgtttatggtatatagagtagattcgcgggggacggagtggaggcgtcggaatagtaggaatcgatttaacggtttcgagttatagatttataaaatggcggagacgttcgtatacgtttttcgcgcgcgt

SEQ ID NO: 4032 - DNA, 943 bp, Artificial Sequence
  chemically treated genomic DNA (Homo sapiens) CpG-island No: 4032
acgcgcgcgaaaaacgtatacgaacgtctccgccattttataaatctataactcgaaaccgttaaatcgattcctactattccgacgcctccactccgtcccccgcgaatctactctatataccataaacgaataaatcgcacgtcgccccgcgccccaccgccctccccgcgccgcaaccctacccccgccgccgcgccgacctccccgaaaccgatctcgccccctctcgaacgaaaaaaaacgacgaactctccccttcctctccgcgtaacgaacgcgaatacgaaacgaatcaaaaacttcccgaaaatctaaccgcgtccccatcccccgtccgacccgcttccgacccccgcgcgccccgtccctaacgcacgcgacctcccgcgcccctccccctccgcgcgcgtccccgcacttcgcctttaccccgcctcgacgacgcgcgacccttcccgcttcccgtccgaccctcgcgcgcccgaataacccttcccgcctcccgtccgctcccctcgtacgcctacgtaacccgtcgcgcgtccccgttaaccccaacgcgcgtacgcgaccgccatcgaaaacgcgcgcctttcccgccgcccgaactctacccccgacgcaaccccgaaaacgcaaacgaaactaaaacgaccgccgaaaaaaaaaactaacgccgaaacctcgccgcgaacccgaatctctacgctccccgccctacccctaccccccgtacgccccgaaccgcgaccaaaaaatttcgataatctcgaaaaaaaaacgaccgccccgaaaatctatcctccgccccgaaaccgaaaaaacctctccaaaaacccccgcgaacgccgtcataaaaaaaaaccttcccgactctcgaaccgaaacaacctttccgaacgactttactaaacgaacttcccttaaaaaaaataaaaac

SEQ ID NO: 4033 - DNA, 1370 bp, Artificial Sequence
  chemically treated genomic DNA (Homo sapiens) CpG-island No: 4033
cgtttcgtttcgttttcgttgttggttttttttttttgtgtcgcgggcggtttcgattttcgttcgggtgttcgtcgaagcgttaggtggggttacgggcggggtgggttcggttttgagagtgggggtttttgcgtggggcgtgcgggttagagcgaatgattaagagtcggatttcggtttttgtcgttttattgagtattcgcgcggtcgttcgcgttttcggttcgtttttcgttcgttttcggtttcgtcgcgttagtcggggaagcggcgcgtttgtattttgcggaagtagttttcggttttcgttttcgtttcgcgtttcgttagttttaggtcgttcgcgtggcgtcgtagcgtggattttcggttgttcgggtttagcgttttatcggtcgcgtttagcgggggtagtttttcgttcgtggttaggttgacggtggttacggtttcgaatcgcggttttttttggtttacgtcgttgatcgacgagtcgggggatacgttcgggggtttggtttcgtcgcggaagtcgcgcgttaggttttttagttcgtagtcgtcgtcggttttcgttttggtttcgtcgttcgtcgttttttatttttagggcgcgtcgtcggtcgataggtgtattacggggtggtgcggcgcgtgcgcgtcgatggttacgatgttggcggagtcgcggttcgacggcgatcggtattgcgaggagtcggagttggcgttggacgacgacgtcgtttcggtcgttttggggttcggcgcgttcggagttttggatatggcgatgatttgtagtagtcgcggagggttggttattgtcgtttcgtttttttcggttattatgagttatttggcgcgtatttcggcgtcgtttttgggggataggtcggttttcgtttgcgcgttttttttcgggatgtgtattagcggcggcggtttcgcgcgcggtgggaggatgattcgaggttttagtttcggtcgcgtttgtacggtggggtagagcgagggcggggtcgggttttcgttttttttttttttttttttttttttttttttttcgtttttttttttttttttttttttcgttatgggttcggcgggcgcgcgtaggtgttcggggttggcgtcgtcgggtagttttaggtcgcggttttttaggtttttttgtttttattcgttgatgagttgtttggagcgcgaggcgtttagcggtacgtggatggttatgtggcggcgcgcggggtcgtttagcgagggcgcgttggttttgggtagcgtgtggttgaaggttattatgttttttttggttatggggttgcgcggggttagtaggtttacgtttacgttggcgcgtttta

SEQ ID NO: 4034 - DNA, 1370 bp, Artificial Sequence
  chemically treated genomic DNA (Homo sapiens) CpG-island No: 4034
taaaacgcgccaacgtaaacgtaaacctactaaccccgcgcaaccccataaccaaaaaaaacataataaccttcaaccacacgctacccaaaaccaacgcgccctcgctaaacgaccccgcgcgccgccacataaccatccacgtaccgctaaacgcctcgcgctccaaacaactcatcaacgaataaaaacaaaaaaacctaaaaaaccgcgacctaaaactacccgacgacgccaaccccgaacacctacgcgcgcccgccgaacccataacgaaaaaaaaaaaaaaaaaaaaaaacgaaaaaaaaaaaaaaaaaaaaaaaaaaaaaaaaaacgaaaacccgaccccgccctcgctctaccccaccgtacaaacgcgaccgaaactaaaacctcgaatcatcctcccaccgcgcgcgaaaccgccgccgctaatacacatcccgaaaaaaaacgcgcaaacgaaaaccgacctatcccccaaaaacgacgccgaaatacgcgccaaataactcataataaccgaaaaaaacgaaacgacaataaccaaccctccgcgactactacaaatcatcgccatatccaaaactccgaacgcgccgaaccccaaaacgaccgaaacgacgtcgtcgtccaacgccaactccgactcctcgcaataccgatcgccgtcgaaccgcgactccgccaacatcgtaaccatcgacgcgcacgcgccgcaccaccccgtaatacacctatcgaccgacgacgcgccctaaaaataaaaaacgacgaacgacgaaaccaaaacgaaaaccgacgacgactacgaactaaaaaacctaacgcgcgacttccgcgacgaaaccaaacccccgaacgtatcccccgactcgtcgatcaacgacgtaaaccaaaaaaaaccgcgattcgaaaccgtaaccaccgtcaacctaaccacgaacgaaaaactacccccgctaaacgcgaccgataaaacgctaaacccgaacaaccgaaaatccacgctacgacgccacgcgaacgacctaaaactaacgaaacgcgaaacgaaaacgaaaaccgaaaactacttccgcaaaatacaaacgcgccgcttccccgactaacgcgacgaaaccgaaaacgaacgaaaaacgaaccgaaaacgcgaacgaccgcgcgaatactcaataaaacgacaaaaaccgaaatccgactcttaatcattcgctctaacccgcacgccccacgcaaaaacccccactctcaaaaccgaacccaccccgcccgtaaccccacctaacgcttcgacgaacacccgaacgaaaatcgaaaccgcccgcgacacaaaaaaaaaaaaccaacaacgaaaacgaaacgaaacg

SEQ ID NO: 4035 - DNA, 1370 bp, Artificial Sequence
  chemically treated genomic DNA (Homo sapiens) CpG-island No: 4035
tgaagcgcgttagcgtggacgtggatttgttggtttcgcgtagttttatggttaaggagaatatggtgatttttagttatacgttgtttagggttagcgcgttttcgttggacgatttcgcgcgtcgttatatgattatttacgtgtcgttggacgtttcgcgttttaagtagtttattagcgagtggaagtagaagagtttggagggtcgcggtttggggttgttcgacgacgttagtttcgggtatttgcgcgcgttcgtcgaatttatggcggaggaggaggaagaggaggaggacgaagaggaagaggaggaggaggaagaggaggaggacgagggttcggtttcgttttcgttttattttatcgtgtaggcgcggtcggggttggggtttcgggttatttttttatcgcgcgcggggtcgtcgtcgttggtgtatatttcggaggagggcgcgtagacgggggtcggtttgttttttaaaagcggcgtcggggtgcgcgttaagtggtttatgatggtcgagaagagcggggcggtagtggttaatttttcgcggttgttgtaggttatcgttatgtttaaggtttcgggcgcgtcgggttttaaggcggtcgagacggcgtcgtcgtttagcgttagtttcgatttttcgtagtatcggtcgtcgtcggatcgcgatttcgttagtatcgtgattatcgacgcgtacgcgtcgtattatttcgtggtgtatttgtcggtcggcggcgcgttttgggagtggaaggcggcgggcggcggggttaaggcggaggtcgacggcggttacgagttgggggatttggcgcgcggttttcgcggcggggttaagttttcgggcgtgtttttcggttcgtcggttagcgacgtggattaggaggagtcgcggttcggggtcgtggttatcgttaatttggttacgggcgaggggttgttttcgttgggcgcggtcgatggggcgttgggttcgggtagtcgggagtttacgttgcggcgttacgcgggcggtttggggttggcggagcgcgaggcggaggcggaggtcgagggttattttcgtaagatgtaggcgcgtcgttttttcgattagcgcggcggggtcgggggcgggcggggggcgggtcgagggcgcgggcggtcgcgcggatgtttaataaagcggtagaaatcgaggttcggtttttggttattcgttttggttcgtacgttttacgtagggatttttatttttagggtcgggtttatttcgttcgtggttttatttggcgtttcggcggatattcgggcgggagtcggggtcgttcgcggtatagaaagaggaagttagtaacgaaggcggaacggagcg

SEQ ID NO: 4036 - DNA, 1370 bp, Artificial Sequence
  chemically treated genomic DNA (Homo sapiens) CpG-island No: 4036
cgctccgttccgccttcgttactaacttcctctttctataccgcgaacgaccccgactcccgcccgaatatccgccgaaacgccaaataaaaccacgaacgaaataaacccgaccctaaaaataaaaatccctacgtaaaacgtacgaaccaaaacgaataaccaaaaaccgaacctcgatttctaccgctttattaaacatccgcgcgaccgcccgcgccctcgacccgccccccgcccgcccccgaccccgccgcgctaatcgaaaaaacgacgcgcctacatcttacgaaaataaccctcgacctccgcctccgcctcgcgctccgccaaccccaaaccgcccgcgtaacgccgcaacgtaaactcccgactacccgaacccaacgccccatcgaccgcgcccaacgaaaacaacccctcgcccgtaaccaaattaacgataaccacgaccccgaaccgcgactcctcctaatccacgtcgctaaccgacgaaccgaaaaacacgcccgaaaacttaaccccgccgcgaaaaccgcgcgccaaatcccccaactcgtaaccgccgtcgacctccgccttaaccccgccgcccgccgccttccactcccaaaacgcgccgccgaccgacaaatacaccacgaaataatacgacgcgtacgcgtcgataatcacgatactaacgaaatcgcgatccgacgacgaccgatactacgaaaaatcgaaactaacgctaaacgacgacgccgtctcgaccgccttaaaacccgacgcgcccgaaaccttaaacataacgataacctacaacaaccgcgaaaaattaaccactaccgccccgctcttctcgaccatcataaaccacttaacgcgcaccccgacgccgcttttaaaaaacaaaccgacccccgtctacgcgccctcctccgaaatatacaccaacgacgacgaccccgcgcgcgataaaaaaataacccgaaaccccaaccccgaccgcgcctacacgataaaataaaacgaaaacgaaaccgaaccctcgtcctcctcctcttcctcctcctcctcttcctcttcgtcctcctcctcttcctcctcctccgccataaattcgacgaacgcgcgcaaatacccgaaactaacgtcgtcgaacaaccccaaaccgcgaccctccaaactcttctacttccactcgctaataaactacttaaaacgcgaaacgtccaacgacacgtaaataatcatataacgacgcgcgaaatcgtccaacgaaaacgcgctaaccctaaacaacgtataactaaaaatcaccatattctccttaaccataaaactacgcgaaaccaacaaatccacgtccacgctaacgcgcttca

SEQ ID NO: 4037 - DNA, 1832 bp, Artificial Sequence
  chemically treated genomic DNA (Homo sapiens) CpG-island No: 4037
ggagttggaagatttttggggcgttttaaggattttgagagatttggagaatgtttgaagttattttgtacggcgtcgaaggcggggggcgcgttggaacgtttttttttcggggggaggcggttcgggaagtcggattttttttttttcgtagtcggtgtaggcggtgcggttcgggagtttttgaagttcgtagcgcggtcgtcgtttcgtttcgtattaacgcggagtagatgttattcgcgcgttttttttcggttcgttcggtttcgattagcgtttgtagcgcgcggtatttttttcgcgtagataaaaggacgtttttttcgcgcgttttttattttaaatttcggcgttcgggtcgggtttttttttattcgagaaagggggcgtttcggggttttcgtgcgttcgggttgggggggacggttttcgcgtttaagttgtatagttcgttcggcgtttttcgcgttttcgttcggggttgtttaaagtttttcgaagtgttcggttcgacgggggcgacgcgggtttggcgagtttcgggtttttttacgtcgtcgttttttcggcgtcgcgcgaagttggagaataatgattttcgggtcgcggggcgtttttcgatatcgttttcgttttaatttttttcgcgtttttttttaataagcgcgcgcggggcgggtcggggttttttgggtataaagtacgggggtatcgggcgcgtttttcgtttttcgtcgggtttatttgttgggcgcggtcgggtacgcggcgcgtgggggggggcggcggtatgaagcgggggggttttttttcggataaaggtgcgtcgcggtcgggttttcgagggtcgcgcgtgggcggcggcggcggcgcgcgtggttcgggttttttttattttcgcgtggttcgtttcgcggggttcgtgcgcgcggtcggtcggggcgtttttggggtagcggcgtgcgcggtgttcgcggtgttcgtcgtcgcgtcggtttcggttcgttacgttcgtagtcgtcgtcgttgttttatttttttgcggcgggagatatgtttcgtttttcgttcgcgtcgtttcgtttcgtttcgtgtaggtttcgtttttgtttcgttttcgagtgtttcgttcggcggtttacgcggattttttcgttattttcgggcggttcgggttcgaacgttttagttcggtttttcgagtattttcgtgaggatttcgaatttcgtgaggtttagagtttgggagcggggacgcgtagaggaggcggtcgggttacggcgcggggagaaattacggattattttcgttcgcggaagtatatacgagttgtgcgtttagtttatgacgtaagcgagtaaggttcgtgagattgaaagttaaggtagagtagtttggttaatcggaagtcgcgaaagtttgatgggcggggattttagttattcgtggtgaggtttcgtttttttttttttcggtttcgttttttagtagaggcgggattttgcgagcgagaggtcgcgagaggcggtcggggtgggttttggagttttgtttttaggttggcgtggtcgttcgcgcggagttttttgtttggttatatttgcgtttttcgggtcggtttcgcgtgttgagtggtgcgagcgggtattacggtttcgagggggttacgttagatttattttttcggcgggaaaatcgattttggtttcggttttgggttagagagtttcgcggggagttttagcggtgtttttgtcgatttgagttttcgtttcggtatttgtgaatttggatttgattttggatagaatttaggttagatttggtt

SEQ ID NO: 4038 - DNA, 1832 bp, Artificial Sequence
  chemically treated genomic DNA (Homo sapiens) CpG-island No: 4038
aaccaaatctaacctaaattctatccaaaatcaaatccaaattcacaaataccgaaacgaaaactcaaatcgacaaaaacaccgctaaaactccccgcgaaactctctaacccaaaaccgaaaccaaaatcgattttcccgccgaaaaaataaatctaacgtaaccccctcgaaaccgtaatacccgctcgcaccactcaacacgcgaaaccgacccgaaaaacgcaaatataaccaaacaaaaaactccgcgcgaacgaccacgccaacctaaaaacaaaactccaaaacccaccccgaccgcctctcgcgacctctcgctcgcaaaatcccgcctctactaaaaaacgaaaccgaaaaaaaaaaaaacgaaacctcaccacgaataactaaaatccccgcccatcaaactttcgcgacttccgattaaccaaactactctaccttaactttcaatctcacgaaccttactcgcttacgtcataaactaaacgcacaactcgtatatacttccgcgaacgaaaataatccgtaatttctccccgcgccgtaacccgaccgcctcctctacgcgtccccgctcccaaactctaaacctcacgaaattcgaaatcctcacgaaaatactcgaaaaaccgaactaaaacgttcgaacccgaaccgcccgaaaataacgaaaaaatccgcgtaaaccgccgaacgaaacactcgaaaacgaaacaaaaacgaaacctacacgaaacgaaacgaaacgacgcgaacgaaaaacgaaacatatctcccgccgcaaaaaaataaaacaacgacgacgactacgaacgtaacgaaccgaaaccgacgcgacgacgaacaccgcgaacaccgcgcacgccgctaccccaaaaacgccccgaccgaccgcgcgcacgaaccccgcgaaacgaaccacgcgaaaataaaaaaaacccgaaccacgcgcgccgccgccgccgcccacgcgcgaccctcgaaaacccgaccgcgacgcacctttatccgaaaaaaaacccccccgcttcataccgccgcccccccccacgcgccgcgtacccgaccgcgcccaacaaataaacccgacgaaaaacgaaaaacgcgcccgatacccccgtactttatacccaaaaaaccccgacccgccccgcgcgcgcttattaaaaaaaaacgcgaaaaaaattaaaacgaaaacgatatcgaaaaacgccccgcgacccgaaaatcattattctccaacttcgcgcgacgccgaaaaaacgacgacgtaaaaaaacccgaaactcgccaaacccgcgtcgcccccgtcgaaccgaacacttcgaaaaactttaaacaaccccgaacgaaaacgcgaaaaacgccgaacgaactatacaacttaaacgcgaaaaccgtcccccccaacccgaacgcacgaaaaccccgaaacgccccctttctcgaataaaaaaaaacccgacccgaacgccgaaatttaaaataaaaaacgcgcgaaaaaaacgtccttttatctacgcgaaaaaaataccgcgcgctacaaacgctaatcgaaaccgaacgaaccgaaaaaaaacgcgcgaataacatctactccgcgttaatacgaaacgaaacgacgaccgcgctacgaacttcaaaaactcccgaaccgcaccgcctacaccgactacgaaaaaaaaaaaatccgacttcccgaaccgcctccccccgaaaaaaaaacgttccaacgcgccccccgccttcgacgccgtacaaaataacttcaaacattctccaaatctctcaaaatccttaaaacgccccaaaaatcttccaactcc

SEQ ID NO: 4039 - DNA, 1832 bp, Artificial Sequence
  chemically treated genomic DNA (Homo sapiens) CpG-island No: 4039
agttagatttggtttgagttttgtttaaagttaggtttaaatttatagatgtcgagacggagatttaagtcggtaaaggtatcgttgagatttttcgcggggttttttgatttagagtcggagttagagtcggttttttcgtcgggaaaatgggtttgacgtagttttttcggggtcgtgatattcgttcgtattatttagtacgcggggtcggttcgaggaacgtaaatataattaagtagaaggtttcgcgcgggcggttacgttaatttgagaataaaattttaggatttatttcggtcgtttttcgcggtttttcgttcgtagagtttcgtttttgttgaggggcggggtcgagaagaaaggaggcggggttttattacgaatggttaggattttcgtttattagattttcgcggttttcgattgattagattgttttgttttagtttttaattttacgggttttattcgtttgcgttatggattaagcgtatagttcgtgtgtgttttcgcggacggggatagttcgtgattttttttcgcgtcgtggttcgatcgttttttttgcgcgttttcgtttttaggttttggattttacgggattcggggtttttacgagggtgttcgagaggtcgagttagggcgttcgggttcgagtcgttcggaggtggcggagggattcgcgtgggtcgtcgggcggggtattcgggggcggggtaggggcggggtttgtacggggcggggcggggcggcgcgggcggggggcggaatatgtttttcgtcgtaggaagatgaggtagcggcggcggttgcgggcgtagcgggtcggagtcgacgcggcggcgggtatcgcgggtatcgcgtacgtcgttgttttaggggcgtttcggtcggtcgcgcgtacgggtttcgcgggacgggttacgcgggggtgggaggggttcgggttacgcgcgtcgtcgtcgtcgtttacgcgcgattttcgggggttcggtcgcgacgtatttttgttcgggggggggttttttcgttttatgtcgtcgtttttttttacgcgtcgcgtgttcggtcgcgtttagtaggtgagttcggcggggggcggggggcgcgttcggtattttcgtgttttgtgtttagggaatttcggttcgtttcgcgcgcgtttgttgggggggggcgcggaggaagttggggcgggggcggtgtcggggggcgtttcgcggttcgggagttattgttttttaatttcgcgcggcgtcgggggggcggcgacgtggaggagttcggagttcgttaggttcgcgtcgttttcgtcgggtcgggtatttcgggaaattttaagtagtttcgggcgggggcgcggggggcgtcggacgggttgtgtaatttaggcgcgaggatcgttttttttagttcgggcgtacggggatttcggggcgttttttttttcgggtagaggggggttcggttcgggcgtcggagtttggggtggggagcgcgcgggagggacgtttttttgtttgcgcggggaaggtgtcgcgcgttgtaggcgttggtcggggtcgggcgggtcgggggggggcgcgcgggtaatatttgtttcgcgttaatgcggggcgaggcggcggtcgcgttgcgagttttaaaggttttcgggtcgtatcgtttgtatcggttgcggggggaggggggttcggtttttcgggtcgttttttttcgggaaaaaggcgttttagcgcgtttttcgttttcggcgtcgtgtaaagtggttttaaatattttttaagttttttaaagtttttgggacgttttagaagttttttagtttt

SEQ ID NO: 4040 - DNA, 1832 bp, Artificial Sequence
  chemically treated genomic DNA (Homo sapiens) CpG-island No: 4040
aaaactaaaaaacttctaaaacgtcccaaaaactttaaaaaacttaaaaaatatttaaaaccactttacacgacgccgaaaacgaaaaacgcgctaaaacgcctttttcccgaaaaaaaacgacccgaaaaaccgaacccccctccccccgcaaccgatacaaacgatacgacccgaaaacctttaaaactcgcaacgcgaccgccgcctcgccccgcattaacgcgaaacaaatattacccgcgcgcccccccccgacccgcccgaccccgaccaacgcctacaacgcgcgacaccttccccgcgcaaacaaaaaaacgtccctcccgcgcgctccccaccccaaactccgacgcccgaaccgaacccccctctacccgaaaaaaaaaacgccccgaaatccccgtacgcccgaactaaaaaaaacgatcctcgcgcctaaattacacaacccgtccgacgccccccgcgcccccgcccgaaactacttaaaatttcccgaaatacccgacccgacgaaaacgacgcgaacctaacgaactccgaactcctccacgtcgccgcccccccgacgccgcgcgaaattaaaaaacaataactcccgaaccgcgaaacgccccccgacaccgcccccgccccaacttcctccgcgcccccccccaacaaacgcgcgcgaaacgaaccgaaattccctaaacacaaaacacgaaaataccgaacgcgccccccgccccccgccgaactcacctactaaacgcgaccgaacacgcgacgcgtaaaaaaaaacgacgacataaaacgaaaaaacccccccccgaacaaaaatacgtcgcgaccgaacccccgaaaatcgcgcgtaaacgacgacgacgacgcgcgtaacccgaacccctcccacccccgcgtaacccgtcccgcgaaacccgtacgcgcgaccgaccgaaacgcccctaaaacaacgacgtacgcgatacccgcgatacccgccgccgcgtcgactccgacccgctacgcccgcaaccgccgccgctacctcatcttcctacgacgaaaaacatattccgccccccgcccgcgccgccccgccccgccccgtacaaaccccgcccctaccccgcccccgaataccccgcccgacgacccacgcgaatccctccgccacctccgaacgactcgaacccgaacgccctaactcgacctctcgaacaccctcgtaaaaaccccgaatcccgtaaaatccaaaacctaaaaacgaaaacgcgcaaaaaaaacgatcgaaccacgacgcgaaaaaaaatcacgaactatccccgtccgcgaaaacacacacgaactatacgcttaatccataacgcaaacgaataaaacccgtaaaattaaaaactaaaacaaaacaatctaatcaatcgaaaaccgcgaaaatctaataaacgaaaatcctaaccattcgtaataaaaccccgcctcctttcttctcgaccccgcccctcaacaaaaacgaaactctacgaacgaaaaaccgcgaaaaacgaccgaaataaatcctaaaattttattctcaaattaacgtaaccgcccgcgcgaaaccttctacttaattatatttacgttcctcgaaccgaccccgcgtactaaataatacgaacgaatatcacgaccccgaaaaaactacgtcaaacccattttcccgacgaaaaaaccgactctaactccgactctaaatcaaaaaaccccgcgaaaaatctcaacgatacctttaccgacttaaatctccgtctcgacatctataaatttaaacctaactttaaacaaaactcaaaccaaatctaact

SEQ ID NO: 4041 - DNA, 516 bp, Artificial Sequence
  chemically treated genomic DNA (Homo sapiens) CpG-island No: 4041
ttttcgggggagagtaatgcgtattttcggaatgaggggggtggggaaggatgcgatgtgtaagtacggagggcggttcgggggtgcgatatcgtacgttcggggttaggattttttattttgtcgttgtaattttttaggattcgttcgatagtttttgtttcgtcggttcggacgatgtagagggcgcgttttttatttatggtcgtaggtgcgggggagtcgcggtcgttttgcgcgtttaagtcgttgtttttaggtaaacgtttcgcgttttcgttcgtttttttttagttttttttttttttttttttttttttttcgttttgtttttaattcgttagttttcgttcgggtcggttcgacgttatcgttttttaatttttatttcgcgacgttatcgtttttttagtaatcggcgttttacggtcgtttttgataaggtttaggattcggtcgaggtttggttagcggatcgaggcggagttaggtttaaggttttgtttgtttttttgt

SEQ ID NO: 4042 - DNA, 516 bp, Artificial Sequence
  chemically treated genomic DNA (Homo sapiens) CpG-island No: 4042
acaaaaaaacaaacaaaaccttaaacctaactccgcctcgatccgctaaccaaacctcgaccgaatcctaaaccttatcaaaaacgaccgtaaaacgccgattactaaaaaaacgataacgtcgcgaaataaaaattaaaaaacgataacgtcgaaccgacccgaacgaaaactaacgaattaaaaacaaaacgaaaaaaaaaaaaaaaaaaaaaaaaaaaactaaaaaaaaacgaacgaaaacgcgaaacgtttacctaaaaacaacgacttaaacgcgcaaaacgaccgcgactcccccgcacctacgaccataaataaaaaacgcgccctctacatcgtccgaaccgacgaaacaaaaactatcgaacgaatcctaaaaaattacaacgacaaaataaaaaatcctaaccccgaacgtacgatatcgcacccccgaaccgccctccgtacttacacatcgcatccttccccacccccctcattccgaaaatacgcattactctcccccgaaaa

SEQ ID NO: 4043 - DNA, 516 bp, Artificial Sequence
  chemically treated genomic DNA (Homo sapiens) CpG-island No: 4043
gtaggagagtaagtagggttttgggtttgatttcgtttcggttcgttagttaggtttcgatcgagttttgggttttgttaggggcggtcgtgaggcgtcggttgttgggggagcggtgacgtcgcggggtgaaagttgaggggcggtgacgtcgggtcggttcgggcggaggttggcgggttggaggtaggacggagggagggaaagagggaaggaaggaagttgggaaggagcgagcgggggcgcgaggcgtttatttggaggtagcggtttgggcgcgtagagcggtcgcggttttttcgtatttgcggttatggatgaggagcgcgttttttatatcgttcgggtcggcgaagtaggggttatcgagcgggttttgagggattatagcgataaggtaaagagttttggtttcgggcgtgcggtatcgtattttcgggtcgtttttcgtgtttgtatatcgtatttttttttattttttttatttcggggatgcgtattgttttttttcgaaaa

SEQ ID NO: 4044 - DNA, 516 bp, Artificial Sequence
  chemically treated genomic DNA (Homo sapiens) CpG-island No: 4044
ttttcgaaaaaaaacaatacgcatccccgaaataaaaaaaataaaaaaaaatacgatatacaaacacgaaaaacgacccgaaaatacgataccgcacgcccgaaaccaaaactctttaccttatcgctataatccctcaaaacccgctcgataacccctacttcgccgacccgaacgatataaaaaacgcgctcctcatccataaccgcaaatacgaaaaaaccgcgaccgctctacgcgcccaaaccgctacctccaaataaacgcctcgcgcccccgctcgctccttcccaacttccttccttccctctttccctccctccgtcctacctccaacccgccaacctccgcccgaaccgacccgacgtcaccgcccctcaactttcaccccgcgacgtcaccgctcccccaacaaccgacgcctcacgaccgcccctaacaaaacccaaaactcgatcgaaacctaactaacgaaccgaaacgaaatcaaacccaaaaccctacttactctcctac

SEQ ID NO: 4045 - DNA, 519 bp, Artificial Sequence
  chemically treated genomic DNA (Homo sapiens) CpG-island No: 4045
gttcgttcgcgtgtttttttgggtatgggtgcggttaggtcgggcgtcggatttttgttcgttcgcgtgtttttttgggtatgggtgcggttaggtcgggcgtcggattttgttcgttcgcgtttttttgggtatgggtgcgttaggtcgggcgtcggattttgttcgttttcgttttttttgggtatgggtgcgttaggtcgggcgtcggattttgttcgttttcgtgtttttttgggtatgggtgcggttaggcgggcgtcggattttgttcgttttcgtgtttttttggcgatgggtgcggttaggcgggcgtcggattttgttcgttttcgtgtttttttgggtatgggtgcggttaggcgggcgtcggattttgttcgttttcgtgtttttttgggtatgggtgcggttaggtcgggcgtcggattttgttcgttttcgtgtttttttgggtatgggtgcggttaggtcgggcgtcggattttgttcgtttttgtgtttttttgagtatgggtg

SEQ ID NO: 4046 - DNA, 519 bp, Artificial Sequence
  chemically treated genomic DNA (Homo sapiens) CpG-island No: 4046
cacccatactcaaaaaaacacaaaaacgaacaaaatccgacgcccgacctaaccgcacccatacccaaaaaaacacgaaaacgaacaaaatccgacgcccgacctaaccgcacccatacccaaaaaaacacgaaaacgaacaaaatccgacgcccgcctaaccgcacccatacccaaaaaaacacgaaaacgaacaaaatccgacgcccgcctaaccgcacccatcgccaaaaaaacacgaaaacgaacaaaatccgacgcccgcctaaccgcacccatacccaaaaaaacacgaaaacgaacaaaatccgacgcccgacctaacgcacccatacccaaaaaaaacgaaaacgaacaaaatccgacgcccgacctaacgcacccatacccaaaaaaacgcgaacgaacaaaatccgacgcccgacctaaccgcacccatacccaaaaaaacacgcgaacgaacaaaaatccgacgcccgacctaaccgcacccatacccaaaaaaacacgcgaacgaac

SEQ ID NO: 4047 - DNA, 519 bp, Artificial Sequence
  chemically treated genomic DNA (Homo sapiens) CpG-island No: 4047
tatttatgtttaggagggtataagagcgggtaggattcggcgttcggtttggtcgtatttatgtttaggagggtacgagagcgggtaggattcggcgttcggtttggtcgtatttatgtttaggagggtacgagagcgggtaggattcggcgttcgtttggtcgtatttatgtttaggagggtacgagagcgggtaggattcggcgttcgtttggtcgtatttatcgttaggagggtacgagagcgggtaggattcggcgttcgtttggtcgtatttatgtttaggagggtacgagagcgggtaggattcggcgttcggtttggcgtatttatgtttaggagggacgagagcgggtaggattcggcgttcggtttggcgtatttatgtttaggaggacgcgagcgggtaggattcggcgttcggtttggtcgtatttatgtttaggagggtacgcgagcgggtagggattcggcgttcggtttggtcgtatttatgtttaggagggtacgcgagcgggt

SEQ ID NO: 4048 - DNA, 519 bp, Artificial Sequence
  chemically treated genomic DNA (Homo sapiens) CpG-island No: 4048
acccgctcgcgtaccctcctaaacataaatacgaccaaaccgaacgccgaatccctacccgctcgcgtaccctcctaaacataaatacgaccaaaccgaacgccgaatcctacccgctcgcgtcctcctaaacataaatacgccaaaccgaacgccgaatcctacccgctctcgtccctcctaaacataaatacgccaaaccgaacgccgaatcctacccgctctcgtaccctcctaaacataaatacgaccaaacgaacgccgaatcctacccgctctcgtaccctcctaacgataaatacgaccaaacgaacgccgaatcctacccgctctcgtaccctcctaaacataaatacgaccaaacgaacgccgaatcctacccgctctcgtaccctcctaaacataaatacgaccaaaccgaacgccgaatcctacccgctctcgtaccctcctaaacataaatacgaccaaaccgaacgccgaatcctacccgctcttataccctcctaaacataaata

SEQ ID NO: 4049 - DNA, 1202 bp, Artificial Sequence
  chemically treated genomic DNA (Homo sapiens) CpG-island No: 4049
cgggaaggcggcgttcgatcgttacggttcgtattttgggagtagggcgagggcgtcgacgaggggtcggggtcggggtcggggttggcgggaggtttggttcgcgtcgttttcgtttttttttttatttttatttttcggtttttaagttcgggttcgtgaggtaatgttacgggtggcgacgcgggtttcgtttattgattatatattttttgtcgaggaaagtgaagagggattcgtttttttgcggggtgagtaatagggattttacgttggtgatttttcgcggcggcggcggttgttgttggacggagtttatggtttcgtcggcggggttgggagtttagggtcgttttttcggcgagtgggcgagagttcgttttttttttcggtgataggggcggggagaagtggagttagaggcgttatatttcgtagttttttcggagcggggaggaggacgaggtcgagggaagtaggcgttgacggcgagttattttcgcgtcgcgttgagaaagggaagttttcggtattcgtttcggttaggttagggtcggatggtcgttgttttcgtatttcggcgattgcgttaaatttttaattttttttttaattttttcgtagcggcggcggtcgtataatttaatatggtagcgggggcgggcgagattataggacggagggcgcgggggagtcggaaacgcgcgttttgcggttcgggagaaatttttttattcggcggcgggtttcgcgcgcgcgggttcgaagttacgttttttttcggtcgaggcgcggatcgcgcggagttaagtggaatttcggttggtttggggcgtaggtttttaatttcgtattttggtttttggcgtttcggttcgtcggttgggtattcgaatttagttattgttgtttgaagagaagatggatggggatttttcgtcgtcgttgcgtcgtcggttttttttgggcggacgtatatttttgcgaagcgttagtgaggatttagggtttttttttggaatagtttttattttttaagcgttgtagcgtgaagttcgttttgcgggttcgagaggtttgcgatttgaagattgaaaattgggaagagacgttttattttgtgtttttcgtcggtttcgataggagtcgtaggtgtttgggatttttttaaattttgttttaaattttagttgtgggagtgg

SEQ ID NO: 4050 - DNA, 1202 bp, Artificial Sequence
  chemically treated genomic DNA (Homo sapiens) CpG-island No: 4050
ccactcccacaactaaaatttaaaacaaaatttaaaaaaatcccaaacacctacgactcctatcgaaaccgacgaaaaacacaaaataaaacgtctcttcccaattttcaatcttcaaatcgcaaacctctcgaacccgcaaaacgaacttcacgctacaacgcttaaaaaataaaaactattccaaaaaaaaaccctaaatcctcactaacgcttcgcaaaaatatacgtccgcccaaaaaaaaccgacgacgcaacgacgacgaaaaatccccatccatcttctcttcaaacaacaataactaaattcgaatacccaaccgacgaaccgaaacgccaaaaaccaaaatacgaaattaaaaacctacgccccaaaccaaccgaaattccacttaactccgcgcgatccgcgcctcgaccgaaaaaaaacgtaacttcgaacccgcgcgcgcgaaacccgccgccgaataaaaaaatttctcccgaaccgcaaaacgcgcgtttccgactcccccgcgccctccgtcctataatctcgcccgcccccgctaccatattaaattatacgaccgccgccgctacgaaaaaattaaaaaaaaaattaaaaatttaacgcaatcgccgaaatacgaaaacaacgaccatccgaccctaacctaaccgaaacgaataccgaaaacttccctttctcaacgcgacgcgaaaataactcgccgtcaacgcctacttccctcgacctcgtcctcctccccgctccgaaaaaactacgaaatataacgcctctaactccacttctccccgcccctatcaccgaaaaaaaaaacgaactctcgcccactcgccgaaaaaacgaccctaaactcccaaccccgccgacgaaaccataaactccgtccaacaacaaccgccgccgccgcgaaaaatcaccaacgtaaaatccctattactcaccccgcaaaaaaacgaatccctcttcactttcctcgacaaaaaatatataatcaataaacgaaacccgcgtcgccacccgtaacattacctcacgaacccgaacttaaaaaccgaaaaataaaaataaaaaaaaaaacgaaaacgacgcgaaccaaacctcccgccaaccccgaccccgaccccgacccctcgtcgacgccctcgccctactcccaaaatacgaaccgtaacgatcgaacgccgccttcccg

SEQ ID NO: 4051 - DNA, 1202 bp, Artificial Sequence
  chemically treated genomic DNA (Homo sapiens) CpG-island No: 4051
ttatttttatagttgaagtttgggataaagtttgagaaaattttaggtatttgcggtttttatcgaagtcggcgaggagtatagggtagagcgtttttttttagtttttagtttttagatcgtaggtttttcggattcgtagagcgagttttacgttgtagcgtttgagaaataagagttattttaaggaggggttttgggtttttattgacgtttcgtaaaggtgtacgttcgtttagggaaggtcggcggcgtagcgacggcgaggagtttttatttattttttttttaagtagtagtagttgggttcgggtatttaatcgacgagtcgagacgttagaggttagagtacgaagttggaagtttgcgttttaagttaatcgggattttatttagtttcgcgcggttcgcgtttcggtcggaagggggcgtggtttcgggttcgcgcgcgcgaggttcgtcgtcgagtgggggggtttttttcgggtcgtaagacgcgcgttttcggttttttcgcgtttttcgttttgtggtttcgttcgttttcgttgttatgttggattgtgcggtcgtcgtcgttgcgggagggttgggggaggagttgggagtttagcgtagtcgtcggagtgcgaggataacgattattcggttttagtttggtcggggcgggtgtcgggagttttttttttttagcgcggcgcgaaggtggttcgtcgttagcgtttgtttttttcgatttcgttttttttttcgtttcggaggagttgcgagatgtggcgtttttgattttattttttttcgtttttgttatcgagagggggaacgagttttcgtttattcgtcggagagacggttttggatttttaatttcgtcggcgaaattatgagtttcgtttagtagtagtcgtcgtcgtcgcggagggttattaacgtggggtttttgttgtttatttcgtaggagaacgagtttttttttatttttttcggtaagaaatgtgtggttagtggacgagattcgcgtcgttattcgtgatattattttacgggttcgggtttgggggtcgggaagtgggagtggggaaggaggcgggagcggcgcgggttaggtttttcgttagtttcggtttcggtttcggtttttcgtcggcgttttcgttttgtttttagggtgcgggtcgtggcggtcgggcgtcgttttttcg

SEQ ID NO: 4052 - DNA, 1202 bp, Artificial Sequence
  chemically treated genomic DNA (Homo sapiens) CpG-island No: 4052
cgaaaaaacgacgcccgaccgccacgacccgcaccctaaaaacaaaacgaaaacgccgacgaaaaaccgaaaccgaaaccgaaactaacgaaaaacctaacccgcgccgctcccgcctccttccccactcccacttcccgacccccaaacccgaacccgtaaaataatatcacgaataacgacgcgaatctcgtccactaaccacacatttcttaccgaaaaaaataaaaaaaaactcgttctcctacgaaataaacaacaaaaaccccacgttaataaccctccgcgacgacgacgactactactaaacgaaactcataatttcgccgacgaaattaaaaatccaaaaccgtctctccgacgaataaacgaaaactcgttccccctctcgataacaaaaacgaaaaaaaataaaatcaaaaacgccacatctcgcaactcctccgaaacgaaaaaaaaaacgaaatcgaaaaaaacaaacgctaacgacgaaccaccttcgcgccgcgctaaaaaaaaaaaactcccgacacccgccccgaccaaactaaaaccgaataatcgttatcctcgcactccgacgactacgctaaactcccaactcctcccccaaccctcccgcaacgacgacgaccgcacaatccaacataacaacgaaaacgaacgaaaccacaaaacgaaaaacgcgaaaaaaccgaaaacgcgcgtcttacgacccgaaaaaaacccccccactcgacgacgaacctcgcgcgcgcgaacccgaaaccacgcccccttccgaccgaaacgcgaaccgcgcgaaactaaataaaatcccgattaacttaaaacgcaaacttccaacttcgtactctaacctctaacgtctcgactcgtcgattaaatacccgaacccaactactactacttaaaaaaaaaataaataaaaactcctcgccgtcgctacgccgccgaccttccctaaacgaacgtacacctttacgaaacgtcaataaaaacccaaaacccctccttaaaataactcttatttctcaaacgctacaacgtaaaactcgctctacgaatccgaaaaacctacgatctaaaaactaaaaactaaaaaaaaacgctctaccctatactcctcgccgacttcgataaaaaccgcaaatacctaaaattttctcaaactttatcccaaacttcaactataaaaataa

SEQ ID NO: 4053 - DNA, 520 bp, Artificial Sequence
  chemically treated genomic DNA (Homo sapiens) CpG-island No: 4053
agacgttttcgagtaaatagtattttcggattaaggtttttcggaatttttttttattcggtcgcgttcgaagttcgagaaacgggtcgttttttttggttttttatacggggttttttagttttaatcggtcgcgtttcgttttttattttttaggatatcggtttcgcggttcgggcggttataaagggtcgggttttgttcgcggtcgtttatgttcgcggtgtttttttggtttgttcggattttttattacgtatatacgttttttcgtcgtttcgttgtcgtcgcggttcgtagtttaggttttttttagattagtcgttgttttgttttcgatgtgaaatcgcggatttcggagttgtttgttttaggtttcgttcgagaatttttatcgttgtcgttattttcggttttggcgtcgttggcggtcggtttacggaggaggggaggagttaggaggaagggggcggggttttcggtttggagaaacgattgcggggagaatttagagttttat

SEQ ID NO: 4054 - DNA, 520 bp, Artificial Sequence
  chemically treated genomic DNA (Homo sapiens) CpG-island No: 4054
ataaaactctaaattctccccgcaatcgtttctccaaaccgaaaaccccgcccccttcctcctaactcctcccctcctccgtaaaccgaccgccaacgacgccaaaaccgaaaataacgacaacgataaaaattctcgaacgaaacctaaaacaaacaactccgaaatccgcgatttcacatcgaaaacaaaacaacgactaatctaaaaaaaacctaaactacgaaccgcgacgacaacgaaacgacgaaaaaacgtatatacgtaataaaaaatccgaacaaaccaaaaaaacaccgcgaacataaacgaccgcgaacaaaacccgaccctttataaccgcccgaaccgcgaaaccgatatcctaaaaaataaaaaacgaaacgcgaccgattaaaactaaaaaaccccgtataaaaaaccaaaaaaaacgacccgtttctcgaacttcgaacgcgaccgaataaaaaaaaattccgaaaaaccttaatccgaaaatactatttactcgaaaacgtct

SEQ ID NO: 4055 - DNA, 520 bp, Artificial Sequence
  chemically treated genomic DNA (Homo sapiens) CpG-island No: 4055
gtggagttttgggtttttttcgtaatcgtttttttaggtcggaggtttcgtttttttttttttggttttttttttttttcgtgggtcggtcgttaacgacgttagagtcggaaatgacgataacggtgagggttttcgggcggggtttgggataggtagtttcggggttcgcggttttatatcggaaataaaatagcggttggtttggaaggaatttgagttacgagtcgcggcggtagcggggcggcggggaagcgtatgtgcgtgatggggagttcgggtaagttaggaaggtatcgcggatatgggcggtcgcgggtagggttcggttttttgtggtcgttcgggtcgcgaagtcggtgttttaaaagatgaggggcggggcgcggtcggttggggttggggaatttcgtgtgggaaattaggaggggcggttcgtttttcgggtttcgggcgcggtcgggtggagagagatttcggggagttttggttcggaaatgttgtttgttcgaagacgttt

SEQ ID NO: 4056 - DNA, 520 bp, Artificial Sequence
  chemically treated genomic DNA (Homo sapiens) CpG-island No: 4056
aaacgtcttcgaacaaacaacatttccgaaccaaaactccccgaaatctctctccacccgaccgcgcccgaaacccgaaaaacgaaccgcccctcctaatttcccacacgaaattccccaaccccaaccgaccgcgccccgcccctcatcttttaaaacaccgacttcgcgacccgaacgaccacaaaaaaccgaaccctacccgcgaccgcccatatccgcgataccttcctaacttacccgaactccccatcacgcacatacgcttccccgccgccccgctaccgccgcgactcgtaactcaaattccttccaaaccaaccgctattttatttccgatataaaaccgcgaaccccgaaactacctatcccaaaccccgcccgaaaaccctcaccgttatcgtcatttccgactctaacgtcgttaacgaccgacccacgaaaaaaaaaaaaaaccaaaaaaaaaaaaacgaaacctccgacctaaaaaaacgattacgaaaaaaacccaaaactccac

SEQ ID NO: 4057 - DNA, 979 bp, Artificial Sequence
  chemically treated genomic DNA (Homo sapiens) CpG-island No: 4057
acggggttatttcgagggtcgtggaagttcgattttttttgtcgttcgagggtagggatcgggtggtttcgggtacgtagggtgggcgtttttaacgtgttgttttcggggaacgcgtttgttttgagttagggtcgaaggcggcgattttaggcgttagagggcgggaaggcgggtggtcgtcgattaagtttttttttatagggtttttagtcgatttcgggatcgtcgtagttcgtagacgttcgttttcgtggttttcgtttacggtttttttttgtatcggtttagttttgattaggtatttcgcgtttttattttaggaacgcgtcgcgtattttcgaggcggagaggcgcggtttttacgggaggttcggggtggtcgcgtaggtgtcggtagtcgttggggttttcggacgttttaggttcgcggtttagtggtatttttcgggaggggcgtacggtttttagggtttcgtttgtattacgcgtcgggagcggtattcgtttgaagggaaggttcgagcgggcggagggtgcgcgtcggggtcgtttcgtattagtttttcggttttttgtatttttttttttttaggtcggggggcgcgcggtgtcgagcgatgattttgcgtttattttcggagagcgagtcggggcggggttttttttgcggtttttatttttttcgatattttcgtcgtcgtgagttaggcgagtaaatttttgtagaagtttcggggtgcggggttttcgtcgttgggcgttcgggggtttttagttttttcgtttttttatttgttttcgttggcgtcgggaggttgtagttagggtcgtttcgtcggtgttcgtttaggtttaagttcgcgaggtcggtcgggtcgtaaggaacgttcgtaggggtgggatttttttttttcgtcgttgtttggttttattttttatttcgttttgttttatttatttatttttaattttcgtg

SEQ ID NO: 4058 - DNA, 979 bp, Artificial Sequence
  chemically treated genomic DNA (Homo sapiens) CpG-island No: 4058
cacgaaaattaaaaataaataaataaaacaaaacgaaataaaaaataaaaccaaacaacgacgaaaaaaaaaaatcccacccctacgaacgttccttacgacccgaccgacctcgcgaacttaaacctaaacgaacaccgacgaaacgaccctaactacaacctcccgacgccaacgaaaacaaataaaaaaacgaaaaaactaaaaacccccgaacgcccaacgacgaaaaccccgcaccccgaaacttctacaaaaatttactcgcctaactcacgacgacgaaaatatcgaaaaaaataaaaaccgcaaaaaaaaccccgccccgactcgctctccgaaaataaacgcaaaatcatcgctcgacaccgcgcgccccccgacctaaaaaaaaaaaaatacaaaaaaccgaaaaactaatacgaaacgaccccgacgcgcaccctccgcccgctcgaaccttcccttcaaacgaataccgctcccgacgcgtaatacaaacgaaaccctaaaaaccgtacgcccctcccgaaaaataccactaaaccgcgaacctaaaacgtccgaaaaccccaacgactaccgacacctacgcgaccaccccgaacctcccgtaaaaaccgcgcctctccgcctcgaaaatacgcgacgcgttcctaaaataaaaacgcgaaatacctaatcaaaactaaaccgatacaaaaaaaaaccgtaaacgaaaaccacgaaaacgaacgtctacgaactacgacgatcccgaaatcgactaaaaaccctataaaaaaaaacttaatcgacgaccacccgccttcccgccctctaacgcctaaaatcgccgccttcgaccctaactcaaaacaaacgcgttccccgaaaacaacacgttaaaaacgcccaccctacgtacccgaaaccacccgatccctaccctcgaacgacaaaaaaaatcgaacttccacgaccctcgaaataaccccgt

SEQ ID NO: 4059 - DNA, 979 bp, Artificial Sequence
  chemically treated genomic DNA (Homo sapiens) CpG-island No: 4059
tacggggattggaggtgggtaagtgagatagggcggggtggagggtgaggttaggtagcggcggagagagaaagttttatttttgcgggcgttttttgcggttcggtcgatttcgcgggtttgggtttgggcgggtatcgacggagcggttttggttgtagtttttcggcgttagcgaagataggtagggaggcggagggattggaagttttcgggcgtttagcggcggggatttcgtatttcggggtttttgtaggaatttgttcgtttggtttacggcgacgggggtgtcggagaaagtgggggtcgtagagaagatttcgtttcggttcgtttttcggaggtgggcgtagggttatcgttcggtatcgcgcgtttttcggtttggaggaaaggaaatgtagagagtcggggagttggtgcgggacggtttcggcgcgtatttttcgttcgttcggattttttttttaggcgaatgtcgttttcggcgcgtggtataagcgaggttttggagatcgtgcgtttttttcgggaggtgttattgggtcgcgggtttggagcgttcgggagttttagcggttgtcggtatttgcgcggttatttcgggtttttcgtgggaatcgcgttttttcgtttcgggggtgcgcggcgcgtttttggggtggggacgcggggtgtttggttagggttggatcgatgtagaggggggtcgtgggcgggggttacggggacgggcgtttgcggattgcggcggtttcggagtcggttggggattttgtagggggaggtttggtcggcggttattcgttttttcgttttttggcgtttagggtcgtcgttttcggttttagtttaaggtagacgcgtttttcgggaataatacgttgagggcgtttattttgcgtgttcggggttattcggtttttgttttcgggcggtaggagaggtcgagtttttacggttttcggagtagtttcgt

SEQ ID NO: 4060 - DNA, 979 bp, Artificial Sequence
  chemically treated genomic DNA (Homo sapiens) CpG-island No: 4060
acgaaactactccgaaaaccgtaaaaactcgacctctcctaccgcccgaaaacaaaaaccgaataaccccgaacacgcaaaataaacgccctcaacgtattattcccgaaaaacgcgtctaccttaaactaaaaccgaaaacgacgaccctaaacgccaaaaaacgaaaaaacgaataaccgccgaccaaacctccccctacaaaatccccaaccgactccgaaaccgccgcaatccgcaaacgcccgtccccgtaacccccgcccacgacccccctctacatcgatccaaccctaaccaaacaccccgcgtccccaccccaaaaacgcgccgcgcacccccgaaacgaaaaaacgcgattcccacgaaaaacccgaaataaccgcgcaaataccgacaaccgctaaaactcccgaacgctccaaacccgcgacccaataacacctcccgaaaaaaacgcacgatctccaaaacctcgcttataccacgcgccgaaaacgacattcgcctaaaaaaaaaatccgaacgaacgaaaaatacgcgccgaaaccgtcccgcaccaactccccgactctctacatttcctttcctccaaaccgaaaaacgcgcgataccgaacgataaccctacgcccacctccgaaaaacgaaccgaaacgaaatcttctctacgacccccactttctccgacacccccgtcgccgtaaaccaaacgaacaaattcctacaaaaaccccgaaatacgaaatccccgccgctaaacgcccgaaaacttccaatccctccgcctccctacctatcttcgctaacgccgaaaaactacaaccaaaaccgctccgtcgatacccgcccaaacccaaacccgcgaaatcgaccgaaccgcaaaaaacgcccgcaaaaataaaactttctctctccgccgctacctaacctcaccctccaccccgccctatctcacttacccacctccaatccccgta

SEQ ID NO: 4061 - DNA, 575 bp, Artificial Sequence
  chemically treated genomic DNA (Homo sapiens) CpG-island No: 4061
tttcgcggcgtttttatcggtgttggcgtggcgcggtggcgggggtagtatttcggcgcgtatggtttcgatgtcgtcggtcgacgaggcgcggcgtacgttggcgtagttttttcgggagcgcgttcgggttaggttgtagttggagttcgaggcgtcggggttgaggttgtgcgttcggggcgatgggagttggtcgggcgcgttgcggggcggagagtcgggatttattagcgtacgcgttttttcgcgggttcgagttttgttacgtggttgtttatggttgttatttcgtttagggttagcgattcgttgttgggtgtcgcgggcgttaggtttacgtttattattacggttttcgggcgttttcgtcgttcgcgtcgttcgatcgtatcgacgattttcgggtcgttatggttagtagcgcgggtagttttaggcggaaggttttggcgcggttgcgggagaggagaggtacgtggtcgtggggatcgcgagtagtttcggagcgggtaaggtttgggaaatggatttttagtcgttgggtaagggaaggaggggaacgggtaattttt

SEQ ID NO: 4062 - DNA, 575 bp, Artificial Sequence
  chemically treated genomic DNA (Homo sapiens) CpG-island No: 4062
aaaaattacccgttcccctccttcccttacccaacgactaaaaatccatttcccaaaccttacccgctccgaaactactcgcgatccccacgaccacgtacctctcctctcccgcaaccgcgccaaaaccttccgcctaaaactacccgcgctactaaccataacgacccgaaaatcgtcgatacgatcgaacgacgcgaacgacgaaaacgcccgaaaaccgtaataataaacgtaaacctaacgcccgcgacacccaacaacgaatcgctaaccctaaacgaaataacaaccataaacaaccacgtaacaaaactcgaacccgcgaaaaaacgcgtacgctaataaatcccgactctccgccccgcaacgcgcccgaccaactcccatcgccccgaacgcacaacctcaaccccgacgcctcgaactccaactacaacctaacccgaacgcgctcccgaaaaaactacgccaacgtacgccgcgcctcgtcgaccgacgacatcgaaaccatacgcgccgaaatactacccccgccaccgcgccacgccaacaccgataaaaacgccgcgaaa

SEQ ID NO: 4063 - DNA, 575 bp, Artificial Sequence
  chemically treated genomic DNA (Homo sapiens) CpG-island No: 4063
gggggttgttcgttttttttttttttttatttagcggttgggggtttattttttaggttttgttcgtttcggggttgttcgcgatttttacgattacgtgttttttttttttcgtagtcgcgttaagatttttcgtttgaagttgttcgcgttgttggttatgacggttcgggagtcgtcggtgcggtcgggcggcgcgggcggcgggggcgttcgggggtcgtggtggtggacgtggatttgacgttcgcggtatttagtagcgagtcgttggttttggacgaagtgatagttatggataattacgtggtagggttcgggttcgcggaggagcgcgtgcgttggtgggtttcggtttttcgtttcgtagcgcgttcggttagtttttatcgtttcgggcgtatagttttaatttcgacgtttcgggttttagttgtagtttggttcggacgcgttttcgagaaagttgcgttagcgtgcgtcgcgtttcgtcggtcgacgatatcgaggttatgcgcgtcggggtgttgttttcgttatcgcgttacgttagtatcggtgagggcgtcgcggga

SEQ ID NO: 4064 - DNA, 575 bp, Artificial Sequence
  chemically treated genomic DNA (Homo sapiens) CpG-island No: 4064
tcccgcgacgccctcaccgatactaacgtaacgcgataacgaaaacaacaccccgacgcgcataacctcgatatcgtcgaccgacgaaacgcgacgcacgctaacgcaactttctcgaaaacgcgtccgaaccaaactacaactaaaacccgaaacgtcgaaattaaaactatacgcccgaaacgataaaaactaaccgaacgcgctacgaaacgaaaaaccgaaacccaccaacgcacgcgctcctccgcgaacccgaaccctaccacgtaattatccataactatcacttcgtccaaaaccaacgactcgctactaaataccgcgaacgtcaaatccacgtccaccaccacgacccccgaacgcccccgccgcccgcgccgcccgaccgcaccgacgactcccgaaccgtcataaccaacaacgcgaacaacttcaaacgaaaaatcttaacgcgactacgaaaaaaaaaaaacacgtaatcgtaaaaatcgcgaacaaccccgaaacgaacaaaacctaaaaaataaacccccaaccgctaaataaaaaaaaaaaaaaaacgaacaaccccc

SEQ ID NO: 4065 - DNA, 504 bp, Artificial Sequence
  chemically treated genomic DNA (Homo sapiens) CpG-island No: 4065
gtgtgtgtcggtcgagggtggtcgggtagcgttattgttgttttagcggtggcgggattggtgtgacgggggttatcggtgggatcgtcgttagggtacggtattggagtcgtgaggcggggagtgtatcgacgagattttacggcgtaggttatcgtgagcgggtcgtggcgcgggtggttgtggcgggagggtgtataggttagagggacggtagagagtagggcggttataggcgtgtatatagtggagatatacgcgtatatatatcgacgatatagcgtatatatattcgatatagattttatatatattatatatatacgatatatatatacgatatatatatattatatagttatatatatattatatatattatatatatattatatatattatatatcgtatatatataatatatatttatatatatattatatattatatatatattatatatattatatattatatatatattatatatatatattatatata

SEQ ID NO: 4066 - DNA, 504 bp, Artificial Sequence
  chemically treated genomic DNA (Homo sapiens) CpG-island No: 4066
tatatataatatatatatataatatatatataatatataatatatataatatatatataatatataatatatatataaatatatattatatatatacgatatataatatatataatatatatataatatatataatatatatataactatataatatatatatatcgtatatatatatcgtatatatataatatatataaaatctatatcgaatatatatacgctatatcgtcgatatatatacgcgtatatctccactatatacacgcctataaccgccctactctctaccgtccctctaacctatacaccctcccgccacaaccacccgcgccacgacccgctcacgataacctacgccgtaaaatctcgtcgatacactccccgcctcacgactccaataccgtaccctaacgacgatcccaccgataacccccgtcacaccaatcccgccaccgctaaaacaacaataacgctacccgaccaccctcgaccgacacacac

SEQ ID NO: 4067 - DNA, 504 bp, Artificial Sequence
  chemically treated genomic DNA (Homo sapiens) CpG-island No: 4067
tgtgtgtggtgtgtgtgtgtggtgtgtgtgtggtgtgtggtgtgtgtggtgtgtgtgtggtgtgtggtgtgtgtgtgggtgtgtgttgtgtgtgtgcggtgtgtggtgtgtgtggtgtgtgtgtggtgtgtgtggtgtgtgtgtggttgtgtggtgtgtgtgtgtcgtgtgtgtgtgtcgtgtgtgtgtagtgtgtgtggggtttgtgtcgggtgtgtgtgcgttgtgtcgtcggtgtgtgtgcgcgtgtgtttttattgtgtgtacgtttgtgatcgttttgttttttatcgtttttttggtttgtgtattttttcgttataattattcgcgttacgattcgtttacgatggtttacgtcgtggagtttcgtcgatgtatttttcgttttacgattttaatgtcgtgttttgacgacggttttatcgatgattttcgttatattagtttcgttatcgttgaggtagtagtgacgttgttcgattattttcgatcggtatatat

SEQ ID NO: 4068 - DNA, 504 bp, Artificial Sequence
  chemically treated genomic DNA (Homo sapiens) CpG-island No: 4068
atatataccgatcgaaaataatcgaacaacgtcactactacctcaacgataacgaaactaatataacgaaaatcatcgataaaaccgtcgtcaaaacacgacattaaaatcgtaaaacgaaaaatacatcgacgaaactccacgacgtaaaccatcgtaaacgaatcgtaacgcgaataattataacgaaaaaatacacaaaccaaaaaaacgataaaaaacaaaacgatcacaaacgtacacacaataaaaacacacgcgcacacacaccgacgacacaacgcacacacacccgacacaaaccccacacacactacacacacacgacacacacacacgacacacacacaccacacaaccacacacacaccacacacaccacacacacaccacacacaccacacaccgcacacacacaacacacacccacacacacaccacacaccacacacacaccacacacaccacacaccacacacacaccacacacacacaccacacaca

SEQ ID NO: 4069 - DNA, 530 bp, Artificial Sequence
  chemically treated genomic DNA (Homo sapiens) CpG-island No: 4069
tcgggagacgtacgcgtgaatgcggagcgggttgagttagtcggcgtcggcgcgggcggtttaggcggaggaagtagcgtgcgcggcgggtgtggacgtttttggagcgaggcggggggcggcggcggtgaggtttagggagggcgcggtttagggtttcggtgtttggttgcggaatttagggtagagtttgttcggtagtttttaatcggagacgttacgtggtcgttttttaatgttgaaaaattattttggttgtagggagtggaggttgtcgtttagagagagcgtcgtcgggtgagaggagtagaaagtcggaagttaacgttggggtagtcgtggcgtttaggagagtgataggtagagtcgttcgcgaggtggttcgagacgtagatcggagggcggagggttgggggtgcgaggtagggagcgggtgcgaggtagggagtagttgtcgaagtcgagttagtggtgtgtagagatttcgtaagagtaggattggaaaagagttatggatgattttaggtttt

SEQ ID NO: 4070 - DNA, 530 bp, Artificial Sequence
  chemically treated genomic DNA (Homo sapiens) CpG-island No: 4070
aaaacctaaaatcatccataactcttttccaatcctactcttacgaaatctctacacaccactaactcgacttcgacaactactccctacctcgcacccgctccctacctcgcacccccaaccctccgccctccgatctacgtctcgaaccacctcgcgaacgactctacctatcactctcctaaacgccacgactaccccaacgttaacttccgactttctactcctctcacccgacgacgctctctctaaacgacaacctccactccctacaaccaaaataatttttcaacattaaaaaacgaccacgtaacgtctccgattaaaaactaccgaacaaactctaccctaaattccgcaaccaaacaccgaaaccctaaaccgcgccctccctaaacctcaccgccgccgccccccgcctcgctccaaaaacgtccacacccgccgcgcacgctacttcctccgcctaaaccgcccgcgccgacgccgactaactcaacccgctccgcattcacgcgtacgtctcccga

SEQ ID NO: 4071 - DNA, 530 bp, Artificial Sequence
  chemically treated genomic DNA (Homo sapiens) CpG-island No: 4071
gggatttggaattatttatgatttttttttagttttgtttttacggaatttttgtatattattaattcggtttcggtagttgttttttatttcgtattcgttttttatttcgtatttttagtttttcgtttttcggtttgcgtttcgggttatttcgcgggcggttttgtttgttatttttttaaacgttacggttgttttagcgttggttttcggttttttgttttttttattcgacggcgttttttttgggcgatagtttttattttttgtagttagagtgattttttagtattaaaaagcggttacgtgacgttttcgattaaaggttgtcgaatagattttattttaaatttcgtagttaggtatcgggattttggatcgcgttttttttaggttttatcgtcgtcgtttttcgtttcgttttaggagcgtttatattcgtcgcgtacgttgtttttttcgtttggatcgttcgcgtcggcgtcgattggtttagttcgtttcgtatttacgcgtgcgtttttcga

SEQ ID NO: 4072 - DNA, 530 bp, Artificial Sequence
  chemically treated genomic DNA (Homo sapiens) CpG-island No: 4072
tcgaaaaacgcacgcgtaaatacgaaacgaactaaaccaatcgacgccgacgcgaacgatccaaacgaaaaaaacaacgtacgcgacgaatataaacgctcctaaaacgaaacgaaaaacgacgacgataaaacctaaaaaaaacgcgatccaaaatcccgatacctaactacgaaatttaaaataaaatctattcgacaacctttaatcgaaaacgtcacgtaaccgctttttaatactaaaaaatcactctaactacaaaaaataaaaactatcgcccaaaaaaaacgccgtcgaataaaaaaaacaaaaaaccgaaaaccaacgctaaaacaaccgtaacgtttaaaaaaataacaaacaaaaccgcccgcgaaataacccgaaacgcaaaccgaaaaacgaaaaactaaaaatacgaaataaaaaacgaatacgaaataaaaaacaactaccgaaaccgaattaataatatacaaaaattccgtaaaaacaaaactaaaaaaaaatcataaataattccaaatccc

SEQ ID NO: 4073 - DNA, 544 bp, Artificial Sequence
  chemically treated genomic DNA (Homo sapiens) CpG-island No: 4073
ggacgcgtttcgttgtgttcgaaattcgcgagggttttatttcgggttgttttcgcgagcggcggggatttgttttgtttttttaggaagtttgcgggcgtttcggtggtcgttttatttttgagtttaggttgatttttttcgcgtcggggttcgaattcggaggttttgaatagatttcgttgtaagagaggtaaaggtttcggcgcgtttgggatcgggacgacggagagcgaggtagttttagggggtcgtagagattttcggtagcgttcgcgattttgttgcgttttgttttgcgcggttagttttaatgtttcgggtcggaaagttggtttcgaggagcgaggagcggagcggaggcgtggggagttgggtttcgggaagattgggggttgtcgagtatcgtttttttcgtaaggcggtataatgcgtttttattcgaggttcgagagtttgcgacgcgttggttttcgttgtttttttacgtaaaataaagtaaaacgtaacgaaaaatcgggggaattgttaagtttaaatagga

SEQ ID NO: 4074 - DNA, 544 bp, Artificial Sequence
  chemically treated genomic DNA (Homo sapiens) CpG-island No: 4074
tcctatttaaacttaacaattcccccgatttttcgttacgttttactttattttacgtaaaaaaacaacgaaaaccaacgcgtcgcaaactctcgaacctcgaataaaaacgcattataccgccttacgaaaaaaacgatactcgacaacccccaatcttcccgaaacccaactccccacgcctccgctccgctcctcgctcctcgaaaccaactttccgacccgaaacattaaaactaaccgcgcaaaacaaaacgcaacaaaatcgcgaacgctaccgaaaatctctacgaccccctaaaactacctcgctctccgtcgtcccgatcccaaacgcgccgaaacctttacctctcttacaacgaaatctattcaaaacctccgaattcgaaccccgacgcgaaaaaaatcaacctaaactcaaaaataaaacgaccaccgaaacgcccgcaaacttcctaaaaaaacaaaacaaatccccgccgctcgcgaaaacaacccgaaataaaaccctcgcgaatttcgaacacaacgaaacgcgtcc

SEQ ID NO: 4075 - DNA, 544 bp, Artificial Sequence
  chemically treated genomic DNA (Homo sapiens) CpG-island No: 4075
ttttgtttgagtttggtaattttttcgatttttcgttgcgttttattttgttttacgtggaaaggtaacgaaaattagcgcgtcgtaggttttcgggtttcgagtagggacgtattgtgtcgttttgcgaaaaggacggtgttcggtagtttttagttttttcggagtttagttttttacgttttcgtttcgtttttcgtttttcgaggttaatttttcggttcggggtattggggttggtcgcgtagggtagggcgtagtagggtcgcgagcgttgtcggggatttttgcggttttttaaggttgtttcgtttttcgtcgtttcggttttaagcgcgtcggggtttttgttttttttataacgaaatttgtttaaaattttcggattcgggtttcggcgcgggagaggttagtttgagtttagggatgggacggttatcggggcgttcgtaggttttttggggagatagagtaggttttcgtcgttcgcggaggtagttcggggtggggttttcgcgggtttcgggtatagcggagcgcgttt

SEQ ID NO: 4076 - DNA, 544 bp, Artificial Sequence
  chemically treated genomic DNA (Homo sapiens) CpG-island No: 4076
aaacgcgctccgctatacccgaaacccgcgaaaaccccaccccgaactacctccgcgaacgacgaaaacctactctatctccccaaaaaacctacgaacgccccgataaccgtcccatccctaaactcaaactaacctctcccgcgccgaaacccgaatccgaaaattttaaacaaatttcgttataaaaaaaacaaaaaccccgacgcgcttaaaaccgaaacgacgaaaaacgaaacaaccttaaaaaaccgcaaaaatccccgacaacgctcgcgaccctactacgccctaccctacgcgaccaaccccaataccccgaaccgaaaaattaacctcgaaaaacgaaaaacgaaacgaaaacgtaaaaaactaaactccgaaaaaactaaaaactaccgaacaccgtccttttcgcaaaacgacacaatacgtccctactcgaaacccgaaaacctacgacgcgctaattttcgttacctttccacgtaaaacaaaataaaacgcaacgaaaaatcgaaaaaattaccaaactcaaacaaaa

SEQ ID NO: 4077 - DNA, 691 bp, Artificial Sequence
  chemically treated genomic DNA (Homo sapiens) CpG-island No: 4077
cgatatatttttcggaaagtagcgcggggagaaggcggagaggttatttagggttttcgagttcgcgcgttttcgggttttagtatatagtggcgtttacgtgggagaggatggcggtcgttttagttgtcgcgatggtcgggttgtttgagttcgtgggggtgaaaaataaattttagttgattagcgcgggatttgggaattagataattttggatattagggatggggtcggagtcggaatagtatcgggttcgaggagtgcggattttatattaggtcggggtcgtagtggagtagcggtgttggggtttttcgatacggtcggcgattttgtattacgggtttcgatattttaaatttagtttttagtggggttttaatagagtgtcgtgtcgagttttgttcgacgcggggattggagaattgcgcggtcgttcgaaacgtttggggtcgaaattttgcggacgtcgaagtattttttcgggttttattattaggcgcgtcggtttaaggtttaggcggcgattttcggtttggtaggaattttttcgtttggaggtttggtttagtaagcgagagtcgacggcgcgggttttcggttgtcgttttttagttaggtagtagcgtaatttttttttatttattcgagttggtcgtttggttggtgtttagcggtttcgatgttttg

SEQ ID NO: 4078 - DNA, 691 bp, Artificial Sequence
  chemically treated genomic DNA (Homo sapiens) CpG-island No: 4078
caaaacatcgaaaccgctaaacaccaaccaaacgaccaactcgaataaataaaaaaaaattacgctactacctaactaaaaaacgacaaccgaaaacccgcgccgtcgactctcgcttactaaaccaaacctccaaacgaaaaaattcctaccaaaccgaaaatcgccgcctaaaccttaaaccgacgcgcctaataataaaacccgaaaaaatacttcgacgtccgcaaaatttcgaccccaaacgtttcgaacgaccgcgcaattctccaatccccgcgtcgaacaaaactcgacacgacactctattaaaaccccactaaaaactaaatttaaaatatcgaaacccgtaatacaaaatcgccgaccgtatcgaaaaaccccaacaccgctactccactacgaccccgacctaatataaaatccgcactcctcgaacccgatactattccgactccgaccccatccctaatatccaaaattatctaattcccaaatcccgcgctaatcaactaaaatttatttttcacccccacgaactcaaacaacccgaccatcgcgacaactaaaacgaccgccatcctctcccacgtaaacgccactatatactaaaacccgaaaacgcgcgaactcgaaaaccctaaataacctctccgccttctccccgcgctactttccgaaaaatatatcg

SEQ ID NO: 4079 - DNA, 691 bp, Artificial Sequence
  chemically treated genomic DNA (Homo sapiens) CpG-island No: 4079
tagagtatcggggtcgttggatattagttagacggttagttcgggtaggtgaggagaggttgcgttgttgtttgattggggggcgatagtcgggagttcgcgtcgtcggttttcgtttgttggattaggtttttaggcggaaaagtttttgttaggtcgggggtcgtcgtttgggttttgggtcgacgcgtttggtgatggggttcgggaggatgtttcggcgttcgtagggtttcggttttaagcgtttcgggcggtcgcgtagttttttagttttcgcgtcgggtagggttcggtacggtattttgttggagttttattgaaaattgggtttggggtgtcggagttcgtggtgtagagtcgtcggtcgtgtcggagggttttagtatcgttgttttattgcggtttcggtttggtgtaggattcgtatttttcgagttcgatgttgtttcggtttcggttttatttttggtgtttaaagttgtttgatttttaaatttcgcgttggttaattggggtttattttttatttttacgagtttagataattcggttatcgcggtagttaaagcggtcgttatttttttttacgtaagcgttattatatattggagttcggggacgcgcgggttcggggattttgggtgattttttcgtttttttttcgcgttgtttttcgggaggtgtgtcg

SEQ ID NO: 4080 - DNA, 691 bp, Artificial Sequence
  chemically treated genomic DNA (Homo sapiens) CpG-island No: 4080
cgacacacctcccgaaaaacaacgcgaaaaaaaaacgaaaaaatcacccaaaatccccgaacccgcgcgtccccgaactccaatatataataacgcttacgtaaaaaaaaataacgaccgctttaactaccgcgataaccgaattatctaaactcgtaaaaataaaaaataaaccccaattaaccaacgcgaaatttaaaaatcaaacaactttaaacaccaaaaataaaaccgaaaccgaaacaacatcgaactcgaaaaatacgaatcctacaccaaaccgaaaccgcaataaaacaacgatactaaaaccctccgacacgaccgacgactctacaccacgaactccgacaccccaaacccaattttcaataaaactccaacaaaataccgtaccgaaccctacccgacgcgaaaactaaaaaactacgcgaccgcccgaaacgcttaaaaccgaaaccctacgaacgccgaaacatcctcccgaaccccatcaccaaacgcgtcgacccaaaacccaaacgacgacccccgacctaacaaaaacttttccgcctaaaaacctaatccaacaaacgaaaaccgacgacgcgaactcccgactatcgccccccaatcaaacaacaacgcaacctctcctcacctacccgaactaaccgtctaactaatatccaacgaccccgatactcta

SEQ ID NO: 4081 - DNA, 1429 bp, Artificial Sequence
  chemically treated genomic DNA (Homo sapiens) CpG-island No: 4081
attcgcggcggtgggggtaaaaagttacggcggtgggggtaaaaatacgcgacggtagggtgaaaaagtcgtaggggtaaaaatttgtggcggcgggagtaaaaagtcgcgtcggtaaaaagtcgcggcggcgggggtaaaaagttataaaaagtcgcggcggcgggcgtaaaaagttataacggtggggtttaaaagtcggggcggtgggggaaaaagtcggggcgacgggggtaataagttatagcggcgggggtaataagttagggcggtcgaggtaaatagtcgcggcgataaaaagttgtggtgacgggggtaaaaagtcgtaaaaagttatagtatcggggttagaaagtcgcgacggtcgggataaaaatcgcggtggcggggtaagaagtcgcggcggtaaaaagatgcggcggcggtggaaaaaggcgcggcgggggtaaaacggtgtagcggtagtaaaaagtcgcggcgtcgggggtaaaaagttttaaaaagttacggcggagggggtaaaaagtcgtaaaaagtcgcgatagagggggtaaaaagtaggggcggtaaaaagttacgacggcggggatatgaaggcgtaaaaatttttcgcggtaggagtaaaaattcgtggcggcgggggtaaaaagcggttggggtgataaaaagtcgcggcggtgggggtaggaagtcgcgtagggggtaaggagtcgcggtagcggaggtaaaaagttgcggtggtaggggtaaatagtagtaaaaagtcgcggcggcggggggtaaaacgatataaaaagttttgatagtgggggtaagaagtcgcggttggaaaaatttgtggcggagggggaaaaaagtcgcggcggcgggggcggaaaggcgtaaaaagtcgcggtggtttcggttaaaagttatgacggtaaaatgtcggggcggtagggtaagaagttacggcgggaaaaatttgcggcggcgggggcgaaaagtagtaaaaagtatcggcgtcgggggttaaaagtcgtaaaaagtcgcggcggcggtgataaaaagtcgcggcggaaaaatttacggtggcgggggtaaaaagttgcggtagtagggggaaaaagtcgtaaaaagtcgtaaaggttagggtaaaaagtcgcggcggtggggggagaaagatttaaaaagttgcggcggtaaaaagttacggcggcgagggtaaagagttttaaaagtcgcggcggtaggggttaaatttcgcgaggtcgggggtagaaagtaatggcggcgggggtagaaagtcgtaaaaattcgtagcggcggggttaaaaatttacgatggtaaaaagtcgcgtcggcgggggtaaaatagtggaaatggggtagatagttagtatagtttggtatttttggagtgtgatgtggaaggaaaagtgtagaggaa

SEQ ID NO: 4082 - DNA, 1429 bp, Artificial Sequence
  chemically treated genomic DNA (Homo sapiens) CpG-island No: 4082
ttcctctacacttttccttccacatcacactccaaaaataccaaactatactaactatctaccccatttccactattttacccccgccgacgcgactttttaccatcgtaaatttttaaccccgccgctacgaatttttacgactttctacccccgccgccattactttctacccccgacctcgcgaaatttaacccctaccgccgcgacttttaaaactctttaccctcgccgccgtaactttttaccgccgcaactttttaaatctttctccccccaccgccgcgactttttaccctaacctttacgactttttacgactttttccccctactaccgcaactttttacccccgccaccgtaaatttttccgccgcgactttttatcaccgccgccgcgactttttacgacttttaacccccgacgccgatactttttactacttttcgcccccgccgccgcaaatttttcccgccgtaacttcttaccctaccgccccgacattttaccgtcataacttttaaccgaaaccaccgcgactttttacgcctttccgcccccgccgccgcgacttttttccccctccgccacaaatttttccaaccgcgacttcttacccccactatcaaaactttttatatcgttttaccccccgccgccgcgactttttactactatttacccctaccaccgcaactttttacctccgctaccgcgactccttaccccctacgcgacttcctacccccaccgccgcgactttttatcaccccaaccgctttttacccccgccgccacgaatttttactcctaccgcgaaaaatttttacgccttcatatccccgccgtcgtaactttttaccgcccctactttttaccccctctatcgcgactttttacgactttttaccccctccgccgtaactttttaaaactttttacccccgacgccgcgactttttactaccgctacaccgttttacccccgccgcgcctttttccaccgccgccgcatctttttaccgccgcgacttcttaccccgccaccgcgatttttatcccgaccgtcgcgactttctaaccccgatactataactttttacgactttttacccccgtcaccacaactttttatcgccgcgactatttacctcgaccgccctaacttattacccccgccgctataacttattacccccgtcgccccgactttttcccccaccgccccgacttttaaaccccaccgttataactttttacgcccgccgccgcgactttttataactttttacccccgccgccgcgactttttaccgacgcgactttttactcccgccgccacaaatttttacccctacgactttttcaccctaccgtcgcgtatttttacccccaccgccgtaactttttacccccaccgccgcgaat

SEQ ID NO: 4083 - DNA, 1429 bp, Artificial Sequence
  chemically treated genomic DNA (Homo sapiens) CpG-island No: 4083
tttttttgtatttttttttttatattatattttaggaatgttaagttgtgttggttgtttattttatttttattattttgttttcgtcgacgcggttttttgttatcgtggatttttgatttcgtcgttgcgggtttttgcggttttttgttttcgtcgttattgttttttgttttcggtttcgcggaatttagtttttgtcgtcgcggtttttggggttttttgttttcgtcgtcgtggttttttgtcgtcgtagttttttgggtttttttttttttatcgtcgcggttttttgttttagtttttgcggttttttgcggttttttttttttgttgtcgtagttttttgttttcgttatcgtgaattttttcgtcgcggttttttgttatcgtcgtcgcggttttttacggtttttggttttcggcgtcggtgttttttattgtttttcgttttcgtcgtcgtaggtttttttcgtcgtggttttttgttttgtcgtttcggtattttgtcgttatggtttttggtcgaggttatcgcggttttttacgttttttcgttttcgtcgtcgcggttttttttttttttcgttataggtttttttagtcgcggttttttgtttttattgttagggttttttgtgtcgttttgtttttcgtcgtcgcggttttttgttgttatttgtttttgttatcgtagttttttgttttcgttgtcgcggttttttgttttttacgcggttttttgtttttatcgtcgcggttttttattattttagtcgttttttgttttcgtcgttacgggtttttgtttttgtcgcggagggtttttgcgtttttatgttttcgtcgtcgtggttttttgtcgtttttgttttttgttttttttgtcgcggttttttgcggttttttatttttttcgtcgtggttttttgaggttttttgttttcgacgtcgcggttttttgttgtcgttgtatcgttttgttttcgtcgcgtttttttttatcgtcgtcgtatttttttgtcgtcgcggttttttatttcgttatcgcggtttttatttcggtcgtcgcggttttttgatttcgatgttgtggttttttacggttttttgttttcgttattatagttttttgtcgtcgcggttgtttgtttcggtcgttttggtttgttgttttcgtcgttgtggtttgttgttttcgtcgtttcggtttttttttttatcgtttcggtttttggattttatcgttgtggttttttgcgttcgtcgtcgcggttttttgtggttttttgttttcgtcgtcgcggttttttgtcgacgcggttttttattttcgtcgttataggtttttatttttgcggtttttttattttgtcgtcgcgtgtttttgtttttatcgtcgtgattttttatttttatcgtcgcgggt

SEQ ID NO: 4084 - DNA, 1429 bp, Artificial Sequence
  chemically treated genomic DNA (Homo sapiens) CpG-island No: 4084
acccgcgacgataaaaataaaaaatcacgacgataaaaacaaaaacacgcgacgacaaaataaaaaaaccgcaaaaataaaaacctataacgacgaaaataaaaaaccgcgtcgacaaaaaaccgcgacgacgaaaacaaaaaaccacaaaaaaccgcgacgacgaacgcaaaaaaccacaacgataaaatccaaaaaccgaaacgataaaaaaaaaaaccgaaacgacgaaaacaacaaaccacaacgacgaaaacaacaaaccaaaacgaccgaaacaaacaaccgcgacgacaaaaaactataataacgaaaacaaaaaaccgtaaaaaaccacaacatcgaaatcaaaaaaccgcgacgaccgaaataaaaaccgcgataacgaaataaaaaaccgcgacgacaaaaaaatacgacgacgataaaaaaaaacgcgacgaaaacaaaacgatacaacgacaacaaaaaaccgcgacgtcgaaaacaaaaaacctcaaaaaaccacgacgaaaaaaataaaaaaccgcaaaaaaccgcgacaaaaaaaacaaaaaacaaaaacgacaaaaaaccacgacgacgaaaacataaaaacgcaaaaaccctccgcgacaaaaacaaaaacccgtaacgacgaaaacaaaaaacgactaaaataataaaaaaccgcgacgataaaaacaaaaaaccgcgtaaaaaacaaaaaaccgcgacaacgaaaacaaaaaactacgataacaaaaacaaataacaacaaaaaaccgcgacgacgaaaaacaaaacgacacaaaaaaccctaacaataaaaacaaaaaaccgcgactaaaaaaacctataacgaaaaaaaaaaaaaaccgcgacgacgaaaacgaaaaaacgtaaaaaaccgcgataacctcgaccaaaaaccataacgacaaaataccgaaacgacaaaacaaaaaaccacgacgaaaaaaacctacgacgacgaaaacgaaaaacaataaaaaacaccgacgccgaaaaccaaaaaccgtaaaaaaccgcgacgacgataacaaaaaaccgcgacgaaaaaattcacgataacgaaaacaaaaaactacgacaacaaaaaaaaaaaaccgcaaaaaaccgcaaaaactaaaacaaaaaaccgcgacgataaaaaaaaaaaaacccaaaaaactacgacgacaaaaaaccacgacgacgaaaacaaaaaaccccaaaaaccgcgacgacaaaaactaaattccgcgaaaccgaaaacaaaaaacaataacgacgaaaacaaaaaaccgcaaaaacccgcaacgacgaaatcaaaaatccacgataacaaaaaaccgcgtcgacgaaaacaaaataataaaaataaaataaacaaccaacacaacttaacattcctaaaatataatataaaaaaaaaaatacaaaaaaa

SEQ ID NO: 4085 - DNA, 1039 bp, Artificial Sequence
  chemically treated genomic DNA (Homo sapiens) CpG-island No: 4085
gtcgtcgttgttttttgatttttcgtcgtcgcggttttttgttttttttgtcgtcgcggttttttttcgtttcgtcgtcgcggttttttttttttatcgcgttttcgttttttgttcgtcgcggttttttgttttttaagcgttaaggttttttgattatcgcggttttttgattttcgtttttgcgaattttgtcgtcgtggttttttgttcgtcgcggtttttttttttaattggtgtagcggttgtttgttttttgtcgttttttgtttttcgtcgttttttgtttttttcgtcgtcgcggttttttcgttgttatggtttttttttttttgttttcgcggttttttattcgtcgcggtttttcgttttttcgttatcgcggttttttattagtcgtagttttttgtttttcgtcgtcgcggttttttgttcgttgcggttttttggtttttttatcgtcgcggttttttgtttttcgtcgttttttgtatttcgtcgtcgtcgcggtttttttttttttgttttcgcggttttttattcgtcgcggttttttgttttaatttcgtttcggttttttatttttcgtcgtttcggttttttgtttttattttgtttcggttttttgattttcgcggttttttttttttcgtcgtcgcgatttttcgtttttcgtcgtcgcggttttttgtttttcgtcgttgtcgcggtttttttttcgattaggttttttgttttatcgtcgatatagttttttgtattttcgtcgttatggttttttgtcgtcgcggttttttgttcgtcgtggttttttgtttttacgtcgtcgcggttttttgttttcgtcgtcgcggttttttgttgtcgcgattttttgttttcgtcgtcgtcgttttttgttatcgcgattttttgttttcgtcgtcgaggatttttgttttcgtcgtcgcggttttgagggcgggagtagtagattcggttgtcggttttattggcgttttggtaagggtagcgattaggggtgtttttggtttagttt

SEQ ID NO: 4086 - DNA, 1039 bp, Artificial Sequence
  chemically treated genomic DNA (Homo sapiens) CpG-island No: 4086
aaactaaaccaaaaacacccctaatcgctacccttaccaaaacgccaataaaaccgacaaccgaatctactactcccgccctcaaaaccgcgacgacgaaaacaaaaatcctcgacgacgaaaacaaaaaatcgcgataacaaaaaacgacgacgacgaaaacaaaaaatcgcgacaacaaaaaaccgcgacgacgaaaacaaaaaaccgcgacgacgtaaaaacaaaaaaccacgacgaacaaaaaaccgcgacgacaaaaaaccataacgacgaaaatacaaaaaactatatcgacgataaaacaaaaaacctaatcgaaaaaaaaaccgcgacaacgacgaaaaacaaaaaaccgcgacgacgaaaaacgaaaaatcgcgacgacgaaaaaaaaaaaaccgcgaaaatcaaaaaaccgaaacaaaataaaaacaaaaaaccgaaacgacgaaaaataaaaaaccgaaacgaaattaaaacaaaaaaccgcgacgaataaaaaaccgcgaaaacaaaaaaaaaaaaaccgcgacgacgacgaaatacaaaaaacgacgaaaaacaaaaaaccgcgacgataaaaaaaccaaaaaaccgcaacgaacaaaaaaccgcgacgacgaaaaacaaaaaactacgactaataaaaaaccgcgataacgaaaaaacgaaaaaccgcgacgaataaaaaaccgcgaaaacaaaaaaaaaaaaaccataacaacgaaaaaaccgcgacgacgaaaaaaacaaaaaacgacgaaaaacaaaaaacgacaaaaaacaaacaaccgctacaccaattaaaaaaaaaaaccgcgacgaacaaaaaaccacgacgacaaaattcgcaaaaacgaaaatcaaaaaaccgcgataatcaaaaaaccttaacgcttaaaaaacaaaaaaccgcgacgaacaaaaaacgaaaacgcgataaaaaaaaaaaaccgcgacgacgaaacgaaaaaaaaccgcgacgacaaaaaaaacaaaaaaccgcgacgacgaaaaatcaaaaaacaacgacgac

SEQ ID NO: 4087 - DNA, 1039 bp, Artificial Sequence
  chemically treated genomic DNA (Homo sapiens) CpG-island No: 4087
gagttggattaggagtatttttggtcgttgtttttgttaggacgttagtagagtcggtagtcgagtttgttgttttcgtttttagagtcgcggcggcggggataaaaattttcggcggcgggggtaaaaagtcgcggtggtaaaaagcggcggcgacgggggtaaaaagtcgcggtagtaaaaagtcgcggcggcggggataaaaagtcgcggcggcgtgggggtagaaagttacggcgggtaaaaagtcgcggcggtaaaaagttatggcggcgagggtgtaaaaagttgtgtcggcggtggggtaaaaagtttggtcgggaaaaaagtcgcggtagcggcgaagggtaaaaagtcgcggcggcggagggcgaaaagtcgcggcggcgggaggaaaaaagtcgcggaggttaaaaagtcgaggtagggtgggggtaaaaagtcgaggcggcggggggtaaaaagtcgaggcggggttggggtaaaaagtcgcggcgggtaaaaagtcgcgggggtaggggggaaaaagtcgcggcggcggcggggtgtaaaaagcggcggggggtaaaaagtcgcggcggtgggggggttaaaaagtcgtagcgggtaaaaagtcgcggcggcgggggataaaaagttgcggttggtgaaaagtcgcggtggcgggggggcgaaaagtcgcggcgggtaaaaagtcgcgggggtaggggggaaaaagttatggtagcgaaaaagtcgcggcggcggggggggtaaaaagcggcggggggtaaaaagcggtagggggtaaatagtcgttgtattagttgggggaaaaagtcgcggcgggtaaaaagttacggcggtaaaattcgtagaggcgaaggttaaaaagtcgcggtggttaaaaagttttggcgtttggggggtaaaaagtcgcggcgggtaaaaagcggaggcgcggtggggggaaaaagtcgcggcggcggggcgggaaaaagtcgcggcggtagggggggtaaaaagtcgcggcggcggggggttaaaaagtagcggcggt

SEQ ID NO: 4088 - DNA, 1039 bp, Artificial Sequence
  chemically treated genomic DNA (Homo sapiens) CpG-island No: 4088
accgccgctactttttaaccccccgccgccgcgactttttaccccccctaccgccgcgactttttcccgccccgccgccgcgactttttccccccaccgcgcctccgctttttacccgccgcgactttttaccccccaaacgccaaaactttttaaccaccgcgactttttaaccttcgcctctacgaattttaccgccgtaactttttacccgccgcgactttttcccccaactaatacaacgactatttaccccctaccgctttttaccccccgccgctttttaccccccccgccgccgcgactttttcgctaccataactttttcccccctacccccgcgactttttacccgccgcgacttttcgcccccccgccaccgcgacttttcaccaaccgcaactttttatcccccgccgccgcgactttttacccgctacgactttttaacccccccaccgccgcgactttttaccccccgccgctttttacaccccgccgccgccgcgactttttcccccctacccccgcgactttttacccgccgcgactttttaccccaaccccgcctcgactttttaccccccgccgcctcgactttttacccccaccctacctcgactttttaacctccgcgacttttttcctcccgccgccgcgacttttcgccctccgccgccgcgactttttacccttcgccgctaccgcgacttttttcccgaccaaactttttaccccaccgccgacacaactttttacaccctcgccgccataactttttaccgccgcgactttttacccgccgtaactttctacccccacgccgccgcgactttttatccccgccgccgcgactttttactaccgcgactttttacccccgtcgccgccgctttttaccaccgcgactttttacccccgccgccgaaaatttttatccccgccgccgcgactctaaaaacgaaaacaacaaactcgactaccgactctactaacgtcctaacaaaaacaacgaccaaaaatactcctaatccaactc

SEQ ID NO: 4089 - DNA, 509 bp, Artificial Sequence
  chemically treated genomic DNA (Homo sapiens) CpG-island No: 4089
tagcgttttcgggatttttttttttagcgttcggtttggaatttcgcgtggacgttttttaggcgggaagggaggattggaagttattttatacgtgcgttttcgtacgcgcgtatttagggcgtacgtttttgatacgttcgtttacgcgttcgtcgtagttcggcgtgttcggttgtgagtttcgagggtcggcgcggtaagcgtttttttagtaagtttttagtttcgagtttagtgttaggagttgttttaatttcggagttcggtgcgagttcggggttttgttcgggtattcgtatattttaagtttgggtggtagcgtaggtggttaggtgcgttttaagcggtgcgcgggttgcgtttatttgtgtttgaaggcgacggtttttttgtttaggttttagttcgttcggtcgcggaggtttgggtgtttcgggatcgtttgtttttaggaaagtttttttttattttttcggttttcggtttagcgggtttgattttttttt

SEQ ID NO: 4090 - DNA, 509 bp, Artificial Sequence
  chemically treated genomic DNA (Homo sapiens) CpG-island No: 4090
aaaaaaaaatcaaacccgctaaaccgaaaaccgaaaaaataaaaaaaaactttcctaaaaacaaacgatcccgaaacacccaaacctccgcgaccgaacgaactaaaacctaaacaaaaaaaccgtcgccttcaaacacaaataaacgcaacccgcgcaccgcttaaaacgcacctaaccacctacgctaccacccaaacttaaaatatacgaatacccgaacaaaaccccgaactcgcaccgaactccgaaattaaaacaactcctaacactaaactcgaaactaaaaacttactaaaaaaacgcttaccgcgccgaccctcgaaactcacaaccgaacacgccgaactacgacgaacgcgtaaacgaacgtatcaaaaacgtacgccctaaatacgcgcgtacgaaaacgcacgtataaaataacttccaatcctcccttcccgcctaaaaaacgtccacgcgaaattccaaaccgaacgctaaaaaaaaaaatcccgaaaacgcta

SEQ ID NO: 4091 - DNA, 509 bp, Artificial Sequence
  chemically treated genomic DNA (Homo sapiens) CpG-island No: 4091
gagggaaggttaggttcgttgagtcgggagtcgggagggtagagaggggtttttttagggatagacggtttcggggtatttaggttttcgcggtcgagcgggttgaggtttaagtagggaggtcgtcgtttttaggtataggtaagcgtagttcgcgtatcgtttgggacgtatttggttatttgcgttgttatttaagtttggggtatgcgggtgttcgagtagaatttcgaattcgtatcgggtttcgaggttggagtaatttttaatattgggttcggagttaggggtttgttggaggggcgtttgtcgcgtcggttttcggggtttatagtcgggtacgtcggattgcggcgagcgcgtgggcgagcgtgttaggagcgtgcgttttgggtgcgcgcgtgcgagagcgtacgtgtagggtggtttttagtttttttttttcgtttgagaagcgtttacgcggagttttaggtcgggcgttggggaaggaggtttcggggacgttg

SEQ ID NO: 4092 - DNA, 509 bp, Artificial Sequence
  chemically treated genomic DNA (Homo sapiens) CpG-island No: 4092
caacgtccccgaaacctccttccccaacgcccgacctaaaactccgcgtaaacgcttctcaaacgaaaaaaaaaaactaaaaaccaccctacacgtacgctctcgcacgcgcgcacccaaaacgcacgctcctaacacgctcgcccacgcgctcgccgcaatccgacgtacccgactataaaccccgaaaaccgacgcgacaaacgcccctccaacaaacccctaactccgaacccaatattaaaaattactccaacctcgaaacccgatacgaattcgaaattctactcgaacacccgcataccccaaacttaaataacaacgcaaataaccaaatacgtcccaaacgatacgcgaactacgcttacctatacctaaaaacgacgacctccctacttaaacctcaacccgctcgaccgcgaaaacctaaataccccgaaaccgtctatccctaaaaaaacccctctctaccctcccgactcccgactcaacgaacctaaccttccctc

SEQ ID NO: 4093 - DNA, 636 bp, Artificial Sequence
  chemically treated genomic DNA (Homo sapiens) CpG-island No: 4093
acgcgttaggtgtgttttaagttggatacgataggaacgggcggcggtcgcgggtttgtttagcgcgggggtttcgggttcgcgtttttttcgtttcgttattcgcgtttcgtttcgttttcgggtttttttattcgcggttgtaggggattttcgggaggaggcgggttcggcgaggttttttgaggatttttcggtttcgggtcgtttttcggtttcgcgtcgattttatatttcgttcgcgtatttggcgttttttttcgagtatatacgtgcggataatgcgcgtttcgggtcggataaaggtgttttcgagacggcgagcgaggcggggcgcggtttatttagttgggggtaggaataaaggcgcggttttatcgttcgcgggtcggggcgggtcggggttaggtcgggggtcgcgggcggggtttttttagttcgggacggggtcgggggcgtcgtttaggtttgggttcggggtttgttgggtgggtttaggacgtagtgatttaggggttcggttcgaggcgttttattttcgatcgtcgttttgagggtgttcgggttcggaagaaattgttgaagtgggttttggaagcgaaagaatagggatttttggagattggaattgttgtt

SEQ ID NO: 4094 - DNA, 636 bp, Artificial Sequence
  chemically treated genomic DNA (Homo sapiens) CpG-island No: 4094
aacaacaattccaatctccaaaaatccctattctttcgcttccaaaacccacttcaacaatttcttccgaacccgaacaccctcaaaacgacgatcgaaaataaaacgcctcgaaccgaacccctaaatcactacgtcctaaacccacccaacaaaccccgaacccaaacctaaacgacgcccccgaccccgtcccgaactaaaaaaaccccgcccgcgacccccgacctaaccccgacccgccccgacccgcgaacgataaaaccgcgcctttattcctacccccaactaaataaaccgcgccccgcctcgctcgccgtctcgaaaacacctttatccgacccgaaacgcgcattatccgcacgtatatactcgaaaaaaaacgccaaatacgcgaacgaaatataaaatcgacgcgaaaccgaaaaacgacccgaaaccgaaaaatcctcaaaaaacctcgccgaacccgcctcctcccgaaaatcccctacaaccgcgaataaaaaaacccgaaaacgaaacgaaacgcgaataacgaaacgaaaaaaacgcgaacccgaaacccccgcgctaaacaaacccgcgaccgccgcccgttcctatcgtatccaacttaaaacacacctaacgcgt

SEQ ID NO: 4095 - DNA, 636 bp, Artificial Sequence
  chemically treated genomic DNA (Homo sapiens) CpG-island No: 4095
agtagtagttttagtttttaagagtttttgttttttcgtttttagggtttattttagtagtttttttcggattcggatatttttagggcggcgatcgggggtgaaacgtttcgggtcgagtttttgggttattgcgttttgagtttatttagtaaatttcgagtttaggtttgagcggcgttttcgatttcgtttcgggttggagaggtttcgttcgcggttttcggtttgatttcggttcgtttcggttcgcgggcgataaggtcgcgtttttgtttttgtttttagttgggtaaatcgcgtttcgtttcgttcgtcgtttcgggggtatttttgttcggttcggggcgcgtattgttcgtacgtgtgtattcggggaggggcgttaggtgcgcgggcggaatgtagggtcggcgcggggtcggggggcggttcggggtcggggggtttttaggaagtttcgtcgggttcgttttttttcgagggttttttgtagtcgcggatgggggagttcgggggcggagcggggcgcgggtggcggagcgggggaggcgcgaattcgggattttcgcgttggataaattcgcggtcgtcgttcgtttttgtcgtgtttagtttgagatatatttggcgcgt

SEQ ID NO: 4096 - DNA, 636 bp, Artificial Sequence
  chemically treated genomic DNA (Homo sapiens) CpG-island No: 4096
acgcgccaaatatatctcaaactaaacacgacaaaaacgaacgacgaccgcgaatttatccaacgcgaaaatcccgaattcgcgcctcccccgctccgccacccgcgccccgctccgcccccgaactcccccatccgcgactacaaaaaaccctcgaaaaaaaacgaacccgacgaaacttcctaaaaaccccccgaccccgaaccgccccccgaccccgcgccgaccctacattccgcccgcgcacctaacgcccctccccgaatacacacgtacgaacaatacgcgccccgaaccgaacaaaaatacccccgaaacgacgaacgaaacgaaacgcgatttacccaactaaaaacaaaaacaaaaacgcgaccttatcgcccgcgaaccgaaacgaaccgaaatcaaaccgaaaaccgcgaacgaaacctctccaacccgaaacgaaatcgaaaacgccgctcaaacctaaactcgaaatttactaaataaactcaaaacgcaataacccaaaaactcgacccgaaacgtttcacccccgatcgccgccctaaaaatatccgaatccgaaaaaaactactaaaataaaccctaaaaacgaaaaaacaaaaactcttaaaaactaaaactactact

SEQ ID NO: 4097 - DNA, 902 bp, Artificial Sequence
  chemically treated genomic DNA (Homo sapiens) CpG-island No: 4097
agatcgtcgcgtgtaaagtttagcggtacggagttgttgtcgtttttttttttgcgtttgtttaaatcgaggtaacgttttagttttcggatttttcggttttttttttcgttcgtcgttaaaagcgttcgttttcgggtagcggcggtggcggttgcggagggtttggtttttgcggtggcggtcgtggttttggttttgattcgggacggtcgcggttttttgggaggcgaggggtttcgattaggggttgggcgggcgcgttttttcgtgttttgtcggtgatcgttggttttttcggtttcgtttcggttttttaggcgggatttgttcggggtcgtcgttttttgtagtcggcgtgtttttcgtaggtgtcgtttttttttttttagttttttacggttttttttttttttcgggcgaaacgttatcgggcgtcgcgtttttcgtaattttcgggagtttcgtttttcgaagtcgcgtgtacgaatttttttatcgttagttttagtttttttagggttttttttttatcgttagtaggatcgcggcgttcgcgttcgttttttgcgttttatgcgattacgcgtttttgggagtcgttcgggtcggtttttttcgcgtttttggacgtcgttatttttcgaaacgcgtggacgtacgattttcggtcgaggcgggattttcggggaagaggcggttgcgcggggcgggcggcggcgttttttgttggtcggagggcgatagcgtgtagagttgcgcggagtcgggtgcgggggtagtcgggtaggtggcgttcggggtaggcgttcgcgggtgggcgtcgcgtggacgttaggttcgcgatgagtatggaggtgtttttatatttaaaagggaaattcggtcgggcgcggtggttt

SEQ ID NO: 4098 - DNA, 902 bp, Artificial Sequence
  chemically treated genomic DNA (Homo sapiens) CpG-island No: 4098
aaaccaccgcgcccgaccgaatttcccttttaaatataaaaacacctccatactcatcgcgaacctaacgtccacgcgacgcccacccgcgaacgcctaccccgaacgccacctacccgactacccccgcacccgactccgcgcaactctacacgctatcgccctccgaccaacaaaaaacgccgccgcccgccccgcgcaaccgcctcttccccgaaaatcccgcctcgaccgaaaatcgtacgtccacgcgtttcgaaaaataacgacgtccaaaaacgcgaaaaaaaccgacccgaacgactcccaaaaacgcgtaatcgcataaaacgcaaaaaacgaacgcgaacgccgcgatcctactaacgataaaaaaaaaaccctaaaaaaactaaaactaacgataaaaaaattcgtacacgcgacttcgaaaaacgaaactcccgaaaattacgaaaaacgcgacgcccgataacgtttcgcccgaaaaaaaaaaaaaaccgtaaaaaactaaaaaaaaaaaaacgacacctacgaaaaacacgccgactacaaaaaacgacgaccccgaacaaatcccgcctaaaaaaccgaaacgaaaccgaaaaaaccaacgatcaccgacaaaacacgaaaaaacgcgcccgcccaacccctaatcgaaacccctcgcctcccaaaaaaccgcgaccgtcccgaatcaaaaccaaaaccacgaccgccaccgcaaaaaccaaaccctccgcaaccgccaccgccgctacccgaaaacgaacgcttttaacgacgaacgaaaaaaaaaaccgaaaaatccgaaaactaaaacgttacctcgatttaaacaaacgcaaaaaaaaaaacgacaacaactccgtaccgctaaactttacacgcgacgatct

SEQ ID NO: 4099 - DNA, 902 bp, Artificial Sequence
  chemically treated genomic DNA (Homo sapiens) CpG-island No: 4099
gagttatcgcgttcggtcggattttttttttaaatgtgaaggtatttttatgtttatcgcgagtttgacgtttacgcggcgtttattcgcgggcgtttgtttcgggcgttatttgttcggttgttttcgtattcggtttcgcgtagttttgtacgttgtcgtttttcggttagtagggggcgtcgtcgttcgtttcgcgtagtcgtttttttttcggaagtttcgtttcggtcggaagtcgtgcgtttacgcgtttcgaaagatggcggcgtttaggagcgcgggagaggtcggttcgggcggtttttagggacgcgtggtcgtatgaagcgtagaaggcgggcgcgggcgtcgcggttttgttggcggtggggagaaggttttgaagaggttgaagttagcggtggaggagttcgtgtacgcgatttcggaaggcgaggttttcgggggttgcgaggggcgcggcgttcggtgacgtttcgttcgggagggagaaaaagtcgtaaggaattgaggaaggagaagcggtatttgcggaaagtacgtcggttgtagaggacggcggtttcgaataggtttcgtttgggaggtcgaagcggagtcgaagaagttagcggttatcggtaggatacggaggagcgcgttcgtttagtttttagtcgggatttttcgttttttaggaagtcgcggtcgtttcgggttaaggttaaggttacggtcgttatcgtaaagattagatttttcgtagtcgttatcgtcgttgttcggaaacgggcgtttttagcggcgaacgaggaggaggatcgagagattcgaaagttggagcgttgtttcggtttgaataagcgtaaaaagaaggacggtagtagtttcgtgtcgttgagttttgtacgcgacggttt

SEQ ID NO: 4100 - DNA, 902 bp, Artificial Sequence
  chemically treated genomic DNA (Homo sapiens) CpG-island No: 4100
aaaccgtcgcgtacaaaactcaacgacacgaaactactaccgtccttctttttacgcttattcaaaccgaaacaacgctccaactttcgaatctctcgatcctcctcctcgttcgccgctaaaaacgcccgtttccgaacaacgacgataacgactacgaaaaatctaatctttacgataacgaccgtaaccttaaccttaacccgaaacgaccgcgacttcctaaaaaacgaaaaatcccgactaaaaactaaacgaacgcgctcctccgtatcctaccgataaccgctaacttcttcgactccgcttcgacctcccaaacgaaacctattcgaaaccgccgtcctctacaaccgacgtactttccgcaaataccgcttctccttcctcaattccttacgactttttctccctcccgaacgaaacgtcaccgaacgccgcgcccctcgcaacccccgaaaacctcgccttccgaaatcgcgtacacgaactcctccaccgctaacttcaacctcttcaaaaccttctccccaccgccaacaaaaccgcgacgcccgcgcccgccttctacgcttcatacgaccacgcgtccctaaaaaccgcccgaaccgacctctcccgcgctcctaaacgccgccatctttcgaaacgcgtaaacgcacgacttccgaccgaaacgaaacttccgaaaaaaaaacgactacgcgaaacgaacgacgacgccccctactaaccgaaaaacgacaacgtacaaaactacgcgaaaccgaatacgaaaacaaccgaacaaataacgcccgaaacaaacgcccgcgaataaacgccgcgtaaacgtcaaactcgcgataaacataaaaataccttcacatttaaaaaaaaaatccgaccgaacgcgataactc

SEQ ID NO: 4101 - DNA, 1256 bp, Artificial Sequence
  chemically treated genomic DNA (Homo sapiens) CpG-island No: 4101
cgtttcgttatttaatcgcgtttcgttatttattcgcgtttcgttatttaatcgcgtttcgttatttagtcgcgtttcgttatttattcgcgtttcgttatttaatcgcgtttcgttatttaatcgcgtttcgttatttagttgcgtttcgttatttattcgcgtttcgttattcggtcgcgtttcgttatttaattgcgtttcgttatttattcgcgttttatttagtcgcgtttcgttatttaacgatatttcgttatttagcgtatatttttttatttagcgtgcgtttcgttatttattcgcgttttattatttagttgcgtttcgttattcgatatttcgttatttagtacgcgtttcgttatttagtatgtatttcgttatttaatcgcgtttcgttatttatttgcgtttcgttatttggttacgtttcgttatttattcgttatttagtcgcgtttcgttatttaacgatatttcgttatttagtcgtgttttattatttagtacgcgtttcgttatttagtatgcgtttcgttatttagtcgcgtttcgttatttagtcgtatttcgttatttattcgcgttttattatttagtcgcgttttattatttagtcgcgtttcgttatttaacgatatttcgttatttagcgtatatttttttatttagcgtatatttttttatttagcgtgtttttcgttatttaatcgcgtttcgttatttatttgcgtttcgttatttagtcgcgtttcgttatttagtacgtgtttcgttatttagtatgcgttttgttatttaatcgcgtttcgttatttattcgcgtttcgttatttaatgatatttcgttatttagcgtatatttttttatttagcgtgtttttcgttatttaatcgcgtttcgttatttagtcgcgttttgttatttagtcgcgtttcgttatttaatcgcgtttcgttatttattcgtatttcgttatttagtcgcgtttcgttatttaatcgcgtttcgttatttattcgcgtttcgttatttaacgatatttcgttatttagcgtatatttttttatttagcgtgtgtttcgttatttaatcgcgtttcgttatttattcgcgtttcgttattcggtcgcgtttcgttattcggtcgcgtttcgttattcggtcgcgttttattatttagtcgtatgggaaagagttttatttttatagttttgggtaaaggggttcggagtggggaaatgggaggttt

SEQ ID NO: 4102 - DNA, 1256 bp, Artificial Sequence
  chemically treated genomic DNA (Homo sapiens) CpG-island No: 4102
aaacctcccatttccccactccgaacccctttacccaaaactataaaaataaaactctttcccatacgactaaataataaaacgcgaccgaataacgaaacgcgaccgaataacgaaacgcgaccgaataacgaaacgcgaataaataacgaaacgcgattaaataacgaaacacacgctaaataaaaaaatatacgctaaataacgaaatatcgttaaataacgaaacgcgaataaataacgaaacgcgattaaataacgaaacgcgactaaataacgaaatacgaataaataacgaaacgcgattaaataacgaaacgcgactaaataacaaaacgcgactaaataacgaaacgcgattaaataacgaaaaacacgctaaataaaaaaatatacgctaaataacgaaatatcattaaataacgaaacgcgaataaataacgaaacgcgattaaataacaaaacgcatactaaataacgaaacacgtactaaataacgaaacgcgactaaataacgaaacgcaaataaataacgaaacgcgattaaataacgaaaaacacgctaaataaaaaaatatacgctaaataaaaaaatatacgctaaataacgaaatatcgttaaataacgaaacgcgactaaataataaaacgcgactaaataataaaacgcgaataaataacgaaatacgactaaataacgaaacgcgactaaataacgaaacgcatactaaataacgaaacgcgtactaaataataaaacacgactaaataacgaaatatcgttaaataacgaaacgcgactaaataacgaataaataacgaaacgtaaccaaataacgaaacgcaaataaataacgaaacgcgattaaataacgaaatacatactaaataacgaaacgcgtactaaataacgaaatatcgaataacgaaacgcaactaaataataaaacgcgaataaataacgaaacgcacgctaaataaaaaaatatacgctaaataacgaaatatcgttaaataacgaaacgcgactaaataaaacgcgaataaataacgaaacgcaattaaataacgaaacgcgaccgaataacgaaacgcgaataaataacgaaacgcaactaaataacgaaacgcgattaaataacgaaacgcgattaaataacgaaacgcgaataaataacgaaacgcgactaaataacgaaacgcgattaaataacgaaacgcgaataaataacgaaacgcgattaaataacgaaacg

SEQ ID NO: 4103 - DNA, 1256 bp, Artificial Sequence
  chemically treated genomic DNA (Homo sapiens) CpG-island No: 4103
gagttttttatttttttatttcgagtttttttatttaggattgtggaaataggatttttttttatgcgattgggtgatgaggcgcgatcgggtgacgaggcgcgatcgggtgacgaggcgcgatcgggtgacgaggcgcgaatgggtgacgaggcgcgattgggtgacgaggtatacgttgggtgaagaggtgtgcgttgggtgacgaggtgtcgttgggtgacgaggcgcgaatgggtgacgaggcgcgattgggtgacgaggcgcgattgggtgacgaggtgcgaatgggtgacgaggcgcgattgggtgacgaggcgcgattgggtgataaggcgcgattgggtgacgaggcgcgattgggtgacgaggagtacgttgggtgaagaggtgtgcgttgggtgacgaggtgttattgggtgacgaggcgcgaatgggtgacgaggcgcgattgggtgatagggcgtatgttgggtgacgaggtacgtgttgggtgacgaggcgcgattgggtgacgaggcgtaaatgggtgacgaggcgcgattgggtgacgaggagtacgttgggtgaagaggtgtgcgttgggtgaagaggtgtgcgttgggtgacgaggtgtcgttgggtgacgaggcgcgattgggtgatgaggcgcgattgggtgatgaggcgcgaatgggtgacgaggtgcgattgggtgacgaggcgcgattgggtgacgaggcgtatgttgggtgacgaggcgcgtgttgggtgatgaggtacgattgggtgacgaggtgtcgttgggtgacgaggcgcgattgggtgacgaatgggtgacgaggcgtgattaggtgacgaggcgtaaatgggtgacgaggcgcgattgggtgacgaggtgtatgttgggtgacgaggcgcgtgttgggtgacgaggtgtcgggtgacgaggcgtaattgggtgatgaggcgcgaatgggtgacgaggcgtacgttgggtgaagaggtgtgcgttgggtgacgaggtgtcgttgggtgacgaggcgcgattgggtgaggcgcgaatgggtgacgaggcgtaattgggtgacgaggcgcgatcgggtgacgaggcgcgaatgggtgacgaggcgtaattgggtgacgaggcgcgattgggtgacgaggcgcgattgggtgacgaggcgcgaatgggtgacgaggcgcgattgggtgacgaggcgcgattgggtgacgaggcgcgaatgggtgacgaggcgcgattgggtgacgaggcg

SEQ ID NO: 4104 - DNA, 1256 bp, Artificial Sequence
  chemically treated genomic DNA (Homo sapiens) CpG-island No: 4104
cgcctcgtcacccaatcgcgcctcgtcacccattcgcgcctcgtcacccaatcgcgcctcgtcacccaatcgcgcctcgtcacccattcgcgcctcgtcacccaatcgcgcctcgtcacccaatcgcgcctcgtcacccaattacgcctcgtcacccattcgcgcctcgtcacccgatcgcgcctcgtcacccaattacgcctcgtcacccattcgcgcctcacccaatcgcgcctcgtcacccaacgacacctcgtcacccaacgcacacctcttcacccaacgtacgcctcgtcacccattcgcgcctcatcacccaattacgcctcgtcacccgacacctcgtcacccaacacgcgcctcgtcacccaacatacacctcgtcacccaatcgcgcctcgtcacccatttacgcctcgtcacctaatcacgcctcgtcacccattcgtcacccaatcgcgcctcgtcacccaacgacacctcgtcacccaatcgtacctcatcacccaacacgcgcctcgtcacccaacatacgcctcgtcacccaatcgcgcctcgtcacccaatcgcacctcgtcacccattcgcgcctcatcacccaatcgcgcctcatcacccaatcgcgcctcgtcacccaacgacacctcgtcacccaacgcacacctcttcacccaacgcacacctcttcacccaacgtactcctcgtcacccaatcgcgcctcgtcacccatttacgcctcgtcacccaatcgcgcctcgtcacccaacacgtacctcgtcacccaacatacgccctatcacccaatcgcgcctcgtcacccattcgcgcctcgtcacccaataacacctcgtcacccaacgcacacctcttcacccaacgtactcctcgtcacccaatcgcgcctcgtcacccaatcgcgccttatcacccaatcgcgcctcgtcacccaatcgcgcctcgtcacccattcgcacctcgtcacccaatcgcgcctcgtcacccaatcgcgcctcgtcacccattcgcgcctcgtcacccaacgacacctcgtcacccaacgcacacctcttcacccaacgtatacctcgtcacccaatcgcgcctcgtcacccattcgcgcctcgtcacccgatcgcgcctcgtcacccgatcgcgcctcgtcacccgatcgcgcctcatcacccaatcgcataaaaaaaaatcctatttccacaatcctaaataaaaaaactcgaaataaaaaaataaaaaactc

SEQ ID NO: 4105 - DNA, 947 bp, Artificial Sequence
  chemically treated genomic DNA (Homo sapiens) CpG-island No: 4105
tcgcgtcgcggagtttatatttgcgtaggtggagtttgtcgagcgcggtcgtcggtgttgggaaggtgagcggcgtcggggggcggagtgggggcgggtcgcgggttttttttaatggcggtacggcggggaggacgcgggttacggtcggaggggggcgtttcgggtttaggcgttgtcgttttcgagttttcgggtttttttttacgttttttttcgggcgggtcgtattaaggcgcgggggggagcggcgcgttttattcgcggaggggtacgcgggtcgcgcggtatttgcggcggcggcggcggtttcgggcgggtgggggtagcgttttcgtttcgttttcggttttcgttgttcgcgttttttgttaggttttttttttcggcggcgcggtagagttaggttttagcgttcggtcggtcgcgagttcgtcggtcggggacgagcgtcgtagtttatgttgatcgttgtttttttttttttttttaggcggcgttggcggcggttttgggattcgcggaagtcggtatgttggagaagttggagttcgaggacgaaggtgagtgcgtttcgttcgttgtcggttcggcgtttttacggttcggtcgttcgaggatcgggattcgcggggatttcgcgttttattttcggcgttgttttacggcgagttgcgttttgcggaagtttaggggtcggggcgggaatcggggcggggatgcgggcgtcggcgagttcgggttgcggggtatcgggcgttcgcggaggggacgcgagttaggtttttagagcgtagttttgagttcggtatttatacggacgggcggtttttttgtttttattcgtcgaattcgaattatagtaaggtgttagggagcgttaattgtttgtgtttgttattatgtattcggaggtaatttcgaattatatttatagtttagatttt

SEQ ID NO: 4106 - DNA, 947 bp, Artificial Sequence
  chemically treated genomic DNA (Homo sapiens) CpG-island No: 4106
aaaatctaaactataaatataattcgaaattacctccgaatacataataacaaacacaaacaattaacgctccctaacaccttactataattcgaattcgacgaataaaaacaaaaaaaccgcccgtccgtataaataccgaactcaaaactacgctctaaaaacctaactcgcgtcccctccgcgaacgcccgataccccgcaacccgaactcgccgacgcccgcatccccgccccgattcccgccccgacccctaaacttccgcaaaacgcaactcgccgtaaaacaacgccgaaaataaaacgcgaaatccccgcgaatcccgatcctcgaacgaccgaaccgtaaaaacgccgaaccgacaacgaacgaaacgcactcaccttcgtcctcgaactccaacttctccaacataccgacttccgcgaatcccaaaaccgccgccaacgccgcctaaaaaaaaaaaaaaaaacaacgatcaacataaactacgacgctcgtccccgaccgacgaactcgcgaccgaccgaacgctaaaacctaactctaccgcgccgccgaaaaaaaaaacctaacaaaaaacgcgaacaacgaaaaccgaaaacgaaacgaaaacgctacccccacccgcccgaaaccgccgccgccgccgcaaataccgcgcgacccgcgtacccctccgcgaataaaacgcgccgctcccccccgcgccttaatacgacccgcccgaaaaaaaacgtaaaaaaaaacccgaaaactcgaaaacgacaacgcctaaacccgaaacgcccccctccgaccgtaacccgcgtcctccccgccgtaccgccattaaaaaaaacccgcgacccgcccccactccgccccccgacgccgctcaccttcccaacaccgacgaccgcgctcgacaaactccacctacgcaaatataaactccgcgacgcga

SEQ ID NO: 4107 - DNA, 947 bp, Artificial Sequence
  chemically treated genomic DNA (Homo sapiens) CpG-island No: 4107
agggtttggattgtgggtatgattcggggttgttttcgagtgtatggtgataagtataaataattagcgttttttgatattttgttgtaattcgagttcggcgagtaaggataaaagggtcgttcgttcgtgtggatgtcgggtttagggttgcgttttgggagtttggttcgcgtttttttcgcggacgttcggtatttcgtagttcgagttcgtcggcgttcgtattttcgtttcggttttcgtttcggtttttgggttttcgtaggacgtagttcgtcgtggggtagcgtcggagatggggcgcggggttttcgcgggtttcggttttcgggcggtcgggtcgtgggagcgtcgggtcggtagcgggcggggcgtatttattttcgttttcgaattttagtttttttagtatgtcggttttcgcgggttttagggtcgtcgttagcgtcgtttgagggggaggaggaggatagcgattagtatgagttgcgacgttcgttttcggtcggcgggttcgcggtcggtcgagcgttggggtttggttttgtcgcgtcgtcgggaggaggggtttggtaggggacgcgggtagcgggggtcgggggcggagcgggagcgttgtttttattcgttcgaggtcgtcgtcgtcgtcgtaggtgtcgcgcggttcgcgtgttttttcgcgagtgggacgcgtcgttttttttcgcgttttggtacggttcgttcgggaggaagcgtgggaagggattcgggagttcgagggcggtagcgtttgggttcggggcgttttttttcggtcgtggttcgcgtttttttcgtcgtgtcgttattgggagaggttcgcggttcgtttttatttcgtttttcggcgtcgtttatttttttagtatcggcggtcgcgttcggtaggttttatttgcgtaggtgtgggtttcgcggcgcgg

SEQ ID NO: 4108 - DNA, 947 bp, Artificial Sequence
  chemically treated genomic DNA (Homo sapiens) CpG-island No: 4108
ccgcgccgcgaaacccacacctacgcaaataaaacctaccgaacgcgaccgccgatactaaaaaaataaacgacgccgaaaaacgaaataaaaacgaaccgcgaacctctcccaataacgacacgacgaaaaaaacgcgaaccacgaccgaaaaaaaacgccccgaacccaaacgctaccgccctcgaactcccgaatcccttcccacgcttcctcccgaacgaaccgtaccaaaacgcgaaaaaaaacgacgcgtcccactcgcgaaaaaacacgcgaaccgcgcgacacctacgacgacgacgacgacctcgaacgaataaaaacaacgctcccgctccgcccccgacccccgctacccgcgtcccctaccaaacccctcctcccgacgacgcgacaaaaccaaaccccaacgctcgaccgaccgcgaacccgccgaccgaaaacgaacgtcgcaactcatactaatcgctatcctcctcctccccctcaaacgacgctaacgacgaccctaaaacccgcgaaaaccgacatactaaaaaaactaaaattcgaaaacgaaaataaatacgccccgcccgctaccgacccgacgctcccacgacccgaccgcccgaaaaccgaaacccgcgaaaaccccgcgccccatctccgacgctaccccacgacgaactacgtcctacgaaaacccaaaaaccgaaacgaaaaccgaaacgaaaatacgaacgccgacgaactcgaactacgaaataccgaacgtccgcgaaaaaaacgcgaaccaaactcccaaaacgcaaccctaaacccgacatccacacgaacgaacgacccttttatccttactcgccgaactcgaattacaacaaaatatcaaaaaacgctaattatttatacttatcaccatacactcgaaaacaaccccgaatcatacccacaatccaaaccct

SEQ ID NO: 4109 - DNA, 601 bp, Artificial Sequence
  chemically treated genomic DNA (Homo sapiens) CpG-island No: 4109
tttgggcggtaggttttcggggttttcgggtgttagatgaagtgaggcggaggcgtcgcgggagagtcgggttcggaggcggtcgggtggatattttaggtagaagacggcgttgggaagagttgcgtgacgttcgggggttggcggttgggtcggtagcgcgtcgtggcggcgtgatttgtttatggtgttgaaggcgcggtgggtcgagtttttagcgtcgcgcgtagtgagcgttgtttggtgtatttttcgtcgcgtagttcgtttttcgcgttcgttagtagtcgtttagttttcgtagattttaggtcgggtttcgttcggtaacgtcgttcgggtgaatacgttgtcggttcgaggggtcgtttgaatggcgatgttagaggtagggtatcggggagttcgcggggaaaggtcggtcgagagcgtgcgttcgcggggagtgcgtttttgagcgtagtacgcgggttagaaggagtaatcgatttgttggtgattagagaacggagattttaagaggattcgatttaaagaggaagaatatttttgggtgcgcgttttaggtttttgtttgtagacggggagggggagaggtttt

SEQ ID NO: 4110 - DNA, 601 bp, Artificial Sequence
  chemically treated genomic DNA (Homo sapiens) CpG-island No: 4110
aaaacctctccccctccccgtctacaaacaaaaacctaaaacgcgcacccaaaaatattcttcctctttaaatcgaatcctcttaaaatctccgttctctaatcaccaacaaatcgattactccttctaacccgcgtactacgctcaaaaacgcactccccgcgaacgcacgctctcgaccgacctttccccgcgaactccccgataccctacctctaacatcgccattcaaacgacccctcgaaccgacaacgtattcacccgaacgacgttaccgaacgaaacccgacctaaaatctacgaaaactaaacgactactaacgaacgcgaaaaacgaactacgcgacgaaaaatacaccaaacaacgctcactacgcgcgacgctaaaaactcgacccaccgcgccttcaacaccataaacaaatcacgccgccacgacgcgctaccgacccaaccgccaacccccgaacgtcacgcaactcttcccaacgccgtcttctacctaaaatatccacccgaccgcctccgaacccgactctcccgcgacgcctccgcctcacttcatctaacacccgaaaaccccgaaaacctaccgcccaaa

SEQ ID NO: 4111 - DNA, 601 bp, Artificial Sequence
  chemically treated genomic DNA (Homo sapiens) CpG-island No: 4111
agagttttttttttttttcgtttgtaagtaaagatttggggcgcgtatttagaaatgttttttttttttgggtcgggtttttttaaaattttcgttttttggttattagtaggtcggttgttttttttgattcgcgtgttgcgtttagaggcgtatttttcgcggacgtacgttttcggtcgattttttttcgcgagtttttcggtgttttgtttttggtatcgttatttaggcggtttttcgggtcgatagcgtgtttattcgggcggcgttatcggacgagattcggtttgggatttgcggagattgggcggttgttggcggacgcgaggggcgggttgcgcggcggagggtgtattaggtagcgtttattgcgcgcggcgttaggggttcggtttatcgcgtttttaatattatggataggttacgtcgttacggcgcgttgtcggtttagtcgttagttttcgagcgttacgtagttttttttagcgtcgttttttgtttggagtgtttattcgatcgttttcggattcggttttttcgcgacgttttcgttttattttatttggtattcgggagtttcgggagtttgtcgtttagg

SEQ ID NO: 4112 - DNA, 601 bp, Artificial Sequence
  chemically treated genomic DNA (Homo sapiens) CpG-island No: 4112
cctaaacgacaaactcccgaaactcccgaataccaaataaaataaaacgaaaacgtcgcgaaaaaaccgaatccgaaaacgatcgaataaacactccaaacaaaaaacgacgctaaaaaaaactacgtaacgctcgaaaactaacgactaaaccgacaacgcgccgtaacgacgtaacctatccataatattaaaaacgcgataaaccgaacccctaacgccgcgcgcaataaacgctacctaatacaccctccgccgcgcaacccgcccctcgcgtccgccaacaaccgcccaatctccgcaaatcccaaaccgaatctcgtccgataacgccgcccgaataaacacgctatcgacccgaaaaaccgcctaaataacgataccaaaaacaaaacaccgaaaaactcgcgaaaaaaaatcgaccgaaaacgtacgtccgcgaaaaatacgcctctaaacgcaacacgcgaatcaaaaaaaacaaccgacctactaataaccaaaaaacgaaaattttaaaaaaacccgacccaaaaaaaaaaaacatttctaaatacgcgccccaaatctttacttacaaacgaaaaaaaaaaaaaactct

SEQ ID NO: 4113 - DNA, 895 bp, Artificial Sequence
  chemically treated genomic DNA (Homo sapiens) CpG-island No: 4113
tagttttcggttcgagggtagcggcgttcgaagtcgggttgggagtcgaggcggttgtttcggggtagtcgttttttgcggggcggggagggggcgggaggcggtcgcgttgggttcgtcgtcgtcggaggttgtatttgttttagaggatgtttaggagttcgcgggagttttttcggattagaattttttaggtcgttcgtttttattttcgtagttttcgggtcgtgtttcggtaggcgggggtcgagggggcgtcgcggcgcgagttttttttttgtttttttttttagttcggtcgttcgtcgttttgtttcgggtgcggcgagggaaggcgaggttgcggcggattatgtttatggtgtagtcgttaagcggaggtatggttgtcggaaggttattgttttatattggtttttcgttagcgttttgcgttttcggtatgttggtcgtggttatttgttcggattattggtacgagacggacgttaggaagtatagggataggtgtaaggtttttaatattcgtcgggtcgatttcggttttatttataataataataataatttgtcgtttcgggcgagtcgttcgcgtttggatcgttgggagggtaaattttttcgggttcggaatcgtcggtagttgttcgttatgagtttcgcggacgagtgtagtcggtagtataattttattaatatgggtttttggaggaagtgttatcggtagggtttcgatttcgagatcgtcgtttttattcggaaaggtaagcgtcgggcgtaaggcgtggcgttgcggagagttcggcgtttttaggtttcgtagtttttcgcgttttttttttaggttataggttattaggtttttgggttttaggcggttcggttatttaggttt

SEQ ID NO: 4114 - DNA, 895 bp, Artificial Sequence
  chemically treated genomic DNA (Homo sapiens) CpG-island No: 4114
aaacctaaataaccgaaccgcctaaaacccaaaaacctaataacctataacctaaaaaaaaaacgcgaaaaactacgaaacctaaaaacgccgaactctccgcaacgccacgccttacgcccgacgcttacctttccgaataaaaacgacgatctcgaaatcgaaaccctaccgataacacttcctccaaaaacccatattaataaaattatactaccgactacactcgtccgcgaaactcataacgaacaactaccgacgattccgaacccgaaaaaatttaccctcccaacgatccaaacgcgaacgactcgcccgaaacgacaaattattattattattataaataaaaccgaaatcgacccgacgaatattaaaaaccttacacctatccctatacttcctaacgtccgtctcgtaccaataatccgaacaaataaccacgaccaacataccgaaaacgcaaaacgctaacgaaaaaccaatataaaacaataaccttccgacaaccatacctccgcttaacgactacaccataaacataatccgccgcaacctcgccttccctcgccgcacccgaaacaaaacgacgaacgaccgaactaaaaaaaaaaacaaaaaaaaaactcgcgccgcgacgccccctcgacccccgcctaccgaaacacgacccgaaaactacgaaaataaaaacgaacgacctaaaaaattctaatccgaaaaaactcccgcgaactcctaaacatcctctaaaacaaatacaacctccgacgacgacgaacccaacgcgaccgcctcccgccccctccccgccccgcaaaaaacgactaccccgaaacaaccgcctcgactcccaacccgacttcgaacgccgctaccctcgaaccgaaaacta

SEQ ID NO: 4115 - DNA, 895 bp, Artificial Sequence
  chemically treated genomic DNA (Homo sapiens) CpG-island No: 4115
aggtttggataatcggatcgtttggaatttagagatttgatagtttgtggtttgggaaggagacgcgaggggttgcggggtttaaaggcgtcgggtttttcgtagcgttacgttttgcgttcggcgtttattttttcgaatgagggcggcgatttcggggtcgaagttttgtcggtggtattttttttagaggtttatgttggtggagttgtattgtcggttgtattcgttcgcggggtttatggcgaatagttgtcggcgatttcgggttcggaggagtttgtttttttagcggtttaggcgcgagcggttcgttcggagcggtaagttgttgttattgttgtaaatgaagtcggggtcgattcggcgggtgttgaaggttttgtatttgtttttgtgttttttggcgttcgtttcgtattagtggttcgagtagatggttacggttagtatgtcgagggcgtagagcgttagcgagaggttagtgtagagtagtaatttttcggtagttatgttttcgtttggcggttatattatgggtatgattcgtcgtagtttcgttttttttcgtcgtattcggaataaagcggcgggcggtcgagttgggggagggggtaggagagggattcgcgtcgcggcgttttttcggttttcgtttatcggagtacggttcggggattgcggggatgggggcgggcggtttaaaaagttttgattcggagaggttttcgcgggtttttgggtattttttgaggtaggtgtagttttcggcggcggcgaatttagcgcggtcgtttttcgtttttttttcgtttcgtaggaagcgattgtttcgaagtagtcgtttcggtttttagttcggtttcgggcgtcgttgttttcgggtcggaaatta

SEQ ID NO: 4116 - DNA, 895 bp, Artificial Sequence
  chemically treated genomic DNA (Homo sapiens) CpG-island No: 4116
taatttccgacccgaaaacaacgacgcccgaaaccgaactaaaaaccgaaacgactacttcgaaacaatcgcttcctacgaaacgaaaaaaaaacgaaaaacgaccgcgctaaattcgccgccgccgaaaactacacctacctcaaaaaatacccaaaaacccgcgaaaacctctccgaatcaaaactttttaaaccgcccgcccccatccccgcaatccccgaaccgtactccgataaacgaaaaccgaaaaaacgccgcgacgcgaatccctctcctaccccctcccccaactcgaccgcccgccgctttattccgaatacgacgaaaaaaaacgaaactacgacgaatcatacccataatataaccgccaaacgaaaacataactaccgaaaaattactactctacactaacctctcgctaacgctctacgccctcgacatactaaccgtaaccatctactcgaaccactaatacgaaacgaacgccaaaaaacacaaaaacaaatacaaaaccttcaacacccgccgaatcgaccccgacttcatttacaacaataacaacaacttaccgctccgaacgaaccgctcgcgcctaaaccgctaaaaaaacaaactcctccgaacccgaaatcgccgacaactattcgccataaaccccgcgaacgaatacaaccgacaatacaactccaccaacataaacctctaaaaaaaataccaccgacaaaacttcgaccccgaaatcgccgccctcattcgaaaaaataaacgccgaacgcaaaacgtaacgctacgaaaaacccgacgcctttaaaccccgcaacccctcgcgtctccttcccaaaccacaaactatcaaatctctaaattccaaacgatccgattatccaaacct

SEQ ID NO: 4117 - DNA, 756 bp, Artificial Sequence
  chemically treated genomic DNA (Homo sapiens) CpG-island No: 4117
tttcgcgtcgcgtgagtgtcggagcgttcggtggtcgtcgcgtcgcgcgtttggagggatgttaacgtggagtcggcgtcgagttcgttcggcgtgcgtgcgtgtgtgggagcgcgcgagttttttgacgcggggattagttatgaatcgggggtgtgtgtttgtttttagagatttggtaaggtgcggagttttttagaagtgcggttaagcggtagcggagacggcgagttaggaattttttttcgcgtttttagttttttagcgtggcggcggaattttcggagaaagtttgtaaatttttagcgggcgcggcgaggacgtcgggttatttagggggcgggtgggcgcgcgcgtagggggttcgtttttttcggtgcggagttgtagttgttatttttttcgtcgggttgtcggttgtagcgggtgggcgcgcgttcggggaggggaggtcgttttcggagggcgtttggttttcgttttaggcgtttcgggttggagagcggcgaggtttcgttcgttttagtttattttttcggtcgttttttgttttcgttgtttttttgttggtatcgttattttttttcggtcgttgttttaaatgatagtttcggttcgagttttggcggcgtttaggtaatttttaagatttggcggcggagtttttttttgcggtagattttcggtagaattatttgaattttttacgaagtttttagaggggtaagatgcgaaggaaggaattaaggagatgtt

SEQ ID NO: 4118 - DNA, 756 bp, Artificial Sequence
  chemically treated genomic DNA (Homo sapiens) CpG-island No: 4118
aacatctccttaattccttccttcgcatcttacccctctaaaaacttcgtaaaaaattcaaataattctaccgaaaatctaccgcaaaaaaaaactccgccgccaaatcttaaaaattacctaaacgccgccaaaactcgaaccgaaactatcatttaaaacaacgaccgaaaaaaaataacgataccaacaaaaaaacaacgaaaacaaaaaacgaccgaaaaaataaactaaaacgaacgaaacctcgccgctctccaacccgaaacgcctaaaacgaaaaccaaacgccctccgaaaacgacctcccctccccgaacgcgcgcccacccgctacaaccgacaacccgacgaaaaaaataacaactacaactccgcaccgaaaaaaacgaaccccctacgcgcgcgcccacccgccccctaaataacccgacgtcctcgccgcgcccgctaaaaatttacaaactttctccgaaaattccgccgccacgctaaaaaactaaaaacgcgaaaaaaaattcctaactcgccgtctccgctaccgcttaaccgcacttctaaaaaactccgcaccttaccaaatctctaaaaacaaacacacacccccgattcataactaatccccgcgtcaaaaaactcgcgcgctcccacacacgcacgcacgccgaacgaactcgacgccgactccacgttaacatccctccaaacgcgcgacgcgacgaccaccgaacgctccgacactcacgcgacgcgaaa

SEQ ID NO: 4119 - DNA, 756 bp, Artificial Sequence
  chemically treated genomic DNA (Homo sapiens) CpG-island No: 4119
aatatttttttggttttttttttcgtattttgtttttttaagaatttcgtgaaaagtttaagtgattttgtcgagaatttgtcgtagggggagatttcgtcgttaggttttgggaattgtttgggcgtcgttaaagttcgagtcggagttgttatttggggtagcggtcgggaagaggtaacgatgttagtaagaaagtagcggaggtaggaggcggtcggaggagtggattggagcggacggagtttcgtcgttttttagttcggagcgtttggagcgaaagttaagcgtttttcgagggcgatttttttttttcgggcgcgcgtttattcgttgtagtcggtagttcggcgggagaggtggtagttgtagtttcgtatcggggagagcgagttttttgcgcgcgcgtttattcgttttttaggtgattcggcgttttcgtcgcgttcgttggaagtttgtaaatttttttcgggggtttcgtcgttacgttgggaagttggggacgcggggggaggtttttggttcgtcgttttcgttgtcgtttgatcgtatttttggagggtttcgtattttgttaggtttttggaggtaaatatatattttcgatttataattggttttcgcgttaggggattcgcgcgtttttatatacgtacgtacgtcgggcggattcggcgtcggttttacgttagtatttttttaggcgcgcggcgcggcggttatcgagcgtttcggtatttacgcggcgcgggg

SEQ ID NO: 4120 - DNA, 756 bp, Artificial Sequence
  chemically treated genomic DNA (Homo sapiens) CpG-island No: 4120
ccccgcgccgcgtaaataccgaaacgctcgataaccgccgcgccgcgcgcctaaaaaaatactaacgtaaaaccgacgccgaatccgcccgacgtacgtacgtatataaaaacgcgcgaatcccctaacgcgaaaaccaattataaatcgaaaatatatatttacctccaaaaacctaacaaaatacgaaaccctccaaaaatacgatcaaacgacaacgaaaacgacgaaccaaaaacctccccccgcgtccccaacttcccaacgtaacgacgaaacccccgaaaaaaatttacaaacttccaacgaacgcgacgaaaacgccgaatcacctaaaaaacgaataaacgcgcgcgcaaaaaactcgctctccccgatacgaaactacaactaccacctctcccgccgaactaccgactacaacgaataaacgcgcgcccgaaaaaaaaaaatcgccctcgaaaaacgcttaactttcgctccaaacgctccgaactaaaaaacgacgaaactccgtccgctccaatccactcctccgaccgcctcctacctccgctactttcttactaacatcgttacctcttcccgaccgctaccccaaataacaactccgactcgaactttaacgacgcccaaacaattcccaaaacctaacgacgaaatctccccctacgacaaattctcgacaaaatcacttaaacttttcacgaaattcttaaaaaaacaaaatacgaaaaaaaaaaccaaaaaaatatt

SEQ ID NO: 4121 - DNA, 1079 bp, Artificial Sequence
  chemically treated genomic DNA (Homo sapiens) CpG-island No: 4121
cgtcgcgtgtttagttgtttagtcgggagtttcggtatttttagggcgtttattttatttttcgggttttggttgtagttttgaggggagcgagttagaaattgatagaacgcgatttttttttttcgcgtttatcggagttcgggttgagagggatttggggagttgcggtttggtcggggcggcgtatttaggtggtttcgtttttttgcgggttatcgttcgttattcgtatagttaggtcggtttgttgggatcgggagaggtgggcgtacgagttttagtgcgggagttcggggtgcgggcggagttttattgttttcgtgtattcgggcggtagtattttcgggtttttttttaaatcgagcgttcggcgatttttttttgtgtttagggagtcgaaagcggtatttttttcgagagaagtcgtttattggggggtggcgttggggaggtaataatgggcgtttattgtttttcgagggtttaacggtgattttttttcgcgcgcgcgttcggttatcggttggtttcgggttagggtataggtatcgcggttgggagggtcggtttcgttgttcgcgtttttcgtttcgttttagtgagttttcgcgtcgtcggtttcgtttcgcgtcgtttcgtttttcgtaggtttagttttcgcgttcggtcgtttcgcgtttagtcgcgcgtattttttttcgcggtcgggggatcgtagcgcggggttagttcggagattcggttatcggtttggggcgtttttacgtcgtttcggagcggataatgcggtgagtaggtattacgtcggtagattcggttggatttgcgtatagcggtagggattgcgtgcgttcgcgggaggttcggggtagcggttgggatttttagcggcggtcggtgagtcggggtagtttagggtttttttttttttatttgtttgtgagtttgtttcgttcgcggtcgtggtcgttttcggcgtgcgttggtgttaggttgggaaattagtagggagtcgggatatttagggtatcgtttttttatttagtgtttaacggaacgaaggggatataaagtaa

SEQ ID NO: 4122 - DNA, 1079 bp, Artificial Sequence
  chemically treated genomic DNA (Homo sapiens) CpG-island No: 4122
ttactttatatccccttcgttccgttaaacactaaataaaaaaacgataccctaaatatcccgactccctactaatttcccaacctaacaccaacgcacgccgaaaacgaccacgaccgcgaacgaaacaaactcacaaacaaataaaaaaaaaaaaaccctaaactaccccgactcaccgaccgccgctaaaaatcccaaccgctaccccgaacctcccgcgaacgcacgcaatccctaccgctatacgcaaatccaaccgaatctaccgacgtaatacctactcaccgcattatccgctccgaaacgacgtaaaaacgccccaaaccgataaccgaatctccgaactaaccccgcgctacgatcccccgaccgcgaaaaaaaatacgcgcgactaaacgcgaaacgaccgaacgcgaaaactaaacctacgaaaaacgaaacgacgcgaaacgaaaccgacgacgcgaaaactcactaaaacgaaacgaaaaacgcgaacaacgaaaccgaccctcccaaccgcgatacctataccctaacccgaaaccaaccgataaccgaacgcgcgcgcgaaaaaaaatcaccgttaaaccctcgaaaaacaataaacgcccattattacctccccaacgccaccccccaataaacgacttctctcgaaaaaaataccgctttcgactccctaaacacaaaaaaaaatcgccgaacgctcgatttaaaaaaaaacccgaaaatactaccgcccgaatacacgaaaacaataaaactccgcccgcaccccgaactcccgcactaaaactcgtacgcccacctctcccgatcccaacaaaccgacctaactatacgaataacgaacgataacccgcaaaaaaacgaaaccacctaaatacgccgccccgaccaaaccgcaactccccaaatccctctcaacccgaactccgataaacgcgaaaaaaaaaaatcgcgttctatcaatttctaactcgctcccctcaaaactacaaccaaaacccgaaaaataaaataaacgccctaaaaataccgaaactcccgactaaacaactaaacacgcgacg

SEQ ID NO: 4123 - DNA, 1079 bp, Artificial Sequence
  chemically treated genomic DNA (Homo sapiens) CpG-island No: 4123
ttgttttatgtttttttcgtttcgttggatattagatgggaaagcgatgttttgggtatttcgattttttgttggttttttagtttaatattagcgtacgtcggaagcggttacggtcgcgggcgggatagatttatagataggtagagaggaaggagttttgggttgtttcgatttatcggtcgtcgttgaggattttagtcgttgtttcgggtttttcgcgggcgtacgtaatttttgtcgttgtgcgtagatttagtcgagtttgtcggcgtggtgtttgtttatcgtattattcgtttcgagacggcgtgaaggcgttttaggtcggtggtcgggttttcgggttagtttcgcgttgcggtttttcggtcgcgagagaaggtgcgcgcgattgagcgcggggcggtcggacgcgaggattgaatttgcggagggcggggcggcgcggggcggggtcggcggcgcggggatttattggggcggggcggagggcgcgggtagcggggtcgatttttttagtcgcggtatttgtgttttggttcggggttaatcggtggtcgggcgcgcgcgcgggggggggttatcgttggattttcggaggataatgggcgtttattgttatttttttagcgttattttttagtaggcgatttttttcggagaagatgtcgttttcgattttttaagtataaagaaaggtcgtcggacgttcggtttaaagagggattcggaggtgttgtcgttcgggtgtacggggataataggatttcgttcgtatttcggattttcgtattaaaattcgtgcgtttatttttttcgattttaataggtcgatttagttgtgcgagtggcgggcggtgattcgtagggaagcgaggttatttgagtgcgtcgtttcggttaggtcgtagttttttaggttttttttagttcgggtttcggtgggcgcggagggggagggtcgcgttttgttagtttttagttcgttttttttagagttgtagttaaaattcggagagtggaataagcgttttgaagatgtcggagttttcggttgagtaattggatacgcgacg

SEQ ID NO: 4124 - DNA, 1079 bp, Artificial Sequence
  chemically treated genomic DNA (Homo sapiens) CpG-island No: 4124
cgtcgcgtatccaattactcaaccgaaaactccgacatcttcaaaacgcttattccactctccgaattttaactacaactctaaaaaaaacgaactaaaaactaacaaaacgcgaccctccccctccgcgcccaccgaaacccgaactaaaaaaaacctaaaaaactacgacctaaccgaaacgacgcactcaaataacctcgcttccctacgaatcaccgcccgccactcgcacaactaaatcgacctattaaaatcgaaaaaaataaacgcacgaattttaatacgaaaatccgaaatacgaacgaaatcctattatccccgtacacccgaacgacaacacctccgaatccctctttaaaccgaacgtccgacgacctttctttatacttaaaaaatcgaaaacgacatcttctccgaaaaaaatcgcctactaaaaaataacgctaaaaaaataacaataaacgcccattatcctccgaaaatccaacgataacccccccccgcgcgcgcgcccgaccaccgattaaccccgaaccaaaacacaaataccgcgactaaaaaaatcgaccccgctacccgcgccctccgccccgccccaataaatccccgcgccgccgaccccgccccgcgccgccccgccctccgcaaattcaatcctcgcgtccgaccgccccgcgctcaatcgcgcgcaccttctctcgcgaccgaaaaaccgcaacgcgaaactaacccgaaaacccgaccaccgacctaaaacgccttcacgccgtctcgaaacgaataatacgataaacaaacaccacgccgacaaactcgactaaatctacgcacaacgacaaaaattacgtacgcccgcgaaaaacccgaaacaacgactaaaatcctcaacgacgaccgataaatcgaaacaacccaaaactccttcctctctacctatctataaatctatcccgcccgcgaccgtaaccgcttccgacgtacgctaatattaaactaaaaaaccaacaaaaaatcgaaatacccaaaacatcgctttcccatctaatatccaacgaaacgaaaaaaacataaaacaa

SEQ ID NO: 4125 - DNA, 1127 bp, Artificial Sequence
  chemically treated genomic DNA (Homo sapiens) CpG-island No: 4125
ttttcgggcggcgtttgacgtagcgtttgtggtgggttgttttacgcgggcgtttgacgtagcgtttgtggtgggttgttttacgcgggcgtttgacgtagcgtttgtggtgggttttttcgggcggcgtttggcgtagcgtttgtggtgggttttttcgggcggcgtttgacgtagcgtttgtggtgggttttttcgggcggcgtttggcgtagcgtttgtggtgggttttttcgggcggcgtttgacgtagcgtttgtggtgggttttttcggtcggcgtttggcgtagcgtttgtggtgggttttttcgggcggcgtttggcgtagcgtttgtggtgggttgtttcgggcggcgtttggcgtagcgtttgtggtgggttgtttcgggcggcgtttgacgtagcgtttgtggtgggttgttttacgcgggcgtttgacgtagcgtttgtggtgggttgttttacgcgggcgtttgacgtagcgtttgtggtgggttgttttacgcgggcgtttgacgtagcgtttgtggtgggttgttcggggcgggcgtttgatgtagcgtttgtggtgggttttttcgggcggcgtttggcgtagcgtttggggtgggttgttttacgcgggcgtttgacgtagcgtttgtggtgggtttttttgggcggcgtttggtatagcgtttggggtgggttttttcgggcggcgtttggcgtagcgtttggggtgggttgttttacgcgggcgtttgacgtagtatttgtggtgggttattttacgcgggcgtttggtttatagtttgtggtgggttgttcggggcggcgtttggcgtagcgtttgtggtgggttttttcgggcggcgtttggtatagcgtttgtggtgggttttttcggtcggcgtttgacgtagcgtttgtggtgggttttttcgggcggcgtttggcgtagcgtttgtggtgggttttttcggtcggcgtttgacgtagcgtttgtggtgggttttttcgggcggcgtttggcgtagcgtttgtggtgggtttttttggtcggcgtttgacgtagcgtttgtcgtgggttgttcggggcgggtgtttgatgtagcgtttgtggtggatttttcgggtggtgatt

SEQ ID NO: 4126 - DNA, 1127 bp, Artificial Sequence
  chemically treated genomic DNA (Homo sapiens) CpG-island No: 4126
aatcaccacccgaaaaatccaccacaaacgctacatcaaacacccgccccgaacaacccacgacaaacgctacgtcaaacgccgaccaaaaaaacccaccacaaacgctacgccaaacgccgcccgaaaaaacccaccacaaacgctacgtcaaacgccgaccgaaaaaacccaccacaaacgctacgccaaacgccgcccgaaaaaacccaccacaaacgctacgtcaaacgccgaccgaaaaaacccaccacaaacgctataccaaacgccgcccgaaaaaacccaccacaaacgctacgccaaacgccgccccgaacaacccaccacaaactataaaccaaacgcccgcgtaaaataacccaccacaaatactacgtcaaacgcccgcgtaaaacaacccaccccaaacgctacgccaaacgccgcccgaaaaaacccaccccaaacgctataccaaacgccgcccaaaaaaacccaccacaaacgctacgtcaaacgcccgcgtaaaacaacccaccccaaacgctacgccaaacgccgcccgaaaaaacccaccacaaacgctacatcaaacgcccgccccgaacaacccaccacaaacgctacgtcaaacgcccgcgtaaaacaacccaccacaaacgctacgtcaaacgcccgcgtaaaacaacccaccacaaacgctacgtcaaacgcccgcgtaaaacaacccaccacaaacgctacgtcaaacgccgcccgaaacaacccaccacaaacgctacgccaaacgccgcccgaaacaacccaccacaaacgctacgccaaacgccgcccgaaaaaacccaccacaaacgctacgccaaacgccgaccgaaaaaacccaccacaaacgctacgtcaaacgccgcccgaaaaaacccaccacaaacgctacgccaaacgccgcccgaaaaaacccaccacaaacgctacgtcaaacgccgcccgaaaaaacccaccacaaacgctacgccaaacgccgcccgaaaaaacccaccacaaacgctacgtcaaacgcccgcgtaaaacaacccaccacaaacgctacgtcaaacgcccgcgtaaaacaacccaccacaaacgctacgtcaaacgccgcccgaaaa

SEQ ID NO: 4127 - DNA, 1127 bp, Artificial Sequence
  chemically treated genomic DNA (Homo sapiens) CpG-island No: 4127
agttattattcggaaagtttattatagacgttatattaggtattcgtttcgaatagtttacgatagacgttacgttaggcgtcgattagaagagtttattatagacgttacgttaggcgtcgttcgaaagagtttattatagacgttacgttaggcgtcgatcggaagagtttattatagacgttacgttaggcgtcgttcggaagagtttattatagacgttacgttaggcgtcgatcggaagagtttattatagacgttatgttaggcgtcgttcggaagagtttattatagacgttacgttaggcgtcgtttcgaatagtttattatagattgtaagttaggcgttcgcgtggaatagtttattatagatgttacgttagacgttcgcgtggaatagtttattttagacgttacgttaggcgtcgttcggaagagtttattttagacgttatgttaggcgtcgtttagaagagtttattatagacgttacgttaggcgttcgcgtggaatagtttattttagacgttacgttaggcgtcgttcggaagagtttattatagacgttatattaggcgttcgtttcgaatagtttattatagacgttacgttaggcgttcgcgtggaatagtttattatagacgttacgttaggcgttcgcgtggaatagtttattatagacgttacgttaggcgttcgcgtggaatagtttattatagacgttacgttaggcgtcgttcggaatagtttattatagacgttacgttaggcgtcgttcggaatagtttattatagacgttacgttaggcgtcgttcggaagagtttattatagacgttacgttaggcgtcgatcggaagagtttattatagacgttacgttaggcgtcgttcggaagagtttattatagacgttacgttaggcgtcgttcggaagagtttattatagacgttacgttaggcgtcgttcggaagagtttattatagacgttacgttaggcgtcgttcggaagagtttattatagacgttacgttaggcgttcgcgtggaatagtttattatagacgttacgttaagcgttcgcgtggaatagtttattataggcgttacgttaggcgtcgttcggaag

SEQ ID NO: 4128 - DNA, 1127 bp, Artificial Sequence
  chemically treated genomic DNA (Homo sapiens) CpG-island No: 4128
cttccgaacgacgcctaacgtaacgcctataataaactattccacgcgaacgcttaacgtaacgtctataataaactattccacgcgaacgcctaacgtaacgtctataataaactcttccgaacgacgcctaacgtaacgtctataataaactcttccgaacgacgcctaacgtaacgtctataataaactcttccgaacgacgcctaacgtaacgtctataataaactcttccgaacgacgcctaacgtaacgtctataataaactcttccgatcgacgcctaacgtaacgtctataataaactcttccgaacgacgcctaacgtaacgtctataataaactattccgaacgacgcctaacgtaacgtctataataaactattccgaacgacgcctaacgtaacgtctataataaactattccacgcgaacgcctaacgtaacgtctataataaactattccacgcgaacgcctaacgtaacgtctataataaactattccacgcgaacgcctaacgtaacgtctataataaactattcgaaacgaacgcctaatataacgtctataataaactcttccgaacgacgcctaacgtaacgtctaaaataaactattccacgcgaacgcctaacgtaacgtctataataaactcttctaaacgacgcctaacataacgtctaaaataaactcttccgaacgacgcctaacgtaacgtctaaaataaactattccacgcgaacgtctaacgtaacatctataataaactattccacgcgaacgcctaacttacaatctataataaactattcgaaacgacgcctaacgtaacgtctataataaactcttccgaacgacgcctaacataacgtctataataaactcttccgatcgacgcctaacgtaacgtctataataaactcttccgaacgacgcctaacgtaacgtctataataaactcttccgatcgacgcctaacgtaacgtctataataaactctttcgaacgacgcctaacgtaacgtctataataaactcttctaatcgacgcctaacgtaacgtctatcgtaaactattcgaaacgaatacctaatataacgtctataataaactttccgaataataact

SEQ ID NO: 4129 - DNA, 808 bp, Artificial Sequence
  chemically treated genomic DNA (Homo sapiens) CpG-island No: 4129
aattattcggtgtagatgggagtttatcgtaggtggtcggtcggggtatttagggtttcgaggaggtagggtcgttttttttagaggtagtagcgggagttttagcgcggcggtggggtcggttcgagggcggttagtgacgtcggtagcgtttttttttagtcgttaggttttcggtaggggacgtcgttcgtttcgagagtacgttcgaggcggcggttaggtcggttttgggaaggtttcgtagcgggcgggtaggttgcgggagcggtcggcgttgatagttgcgtaggcggttattcgcgcggcgacggtacggggttgcgggtcgcggcgtaggttagggtcgttttaagaatttagttcgttttttatcgtcgttcgtatcgtttataggggaaggtttagagtttcgttattttgtcgtagtagagttttattagttgttttattcggtagcgtggggcggggaagacgtttatttttttaggaaagggcgttatcgttattgttttagttttcgttttagtagtcgacgttcgacgtttgtttatagattatttttattgcggggtagaggttgcgggtttttttgtttatgtgttcgtttcgtttcggcgcgcggtttgtttggtttgttttatcgtggacgttatttagtatgatgttttttttttattttcggttggtgcggcgtgtatttgttttacggtgatagagttgtggtatgcggtaacgcgtttcgggtacgagtgagttagtttcgagcggcgtttcgtaataacgtgatggagtcggacgtggattg

SEQ ID NO: 4130 - DNA, 808 bp, Artificial Sequence
  chemically treated genomic DNA (Homo sapiens) CpG-island No: 4130
caatccacgtccgactccatcacgttattacgaaacgccgctcgaaactaactcactcgtacccgaaacgcgttaccgcataccacaactctatcaccgtaaaacaaatacacgccgcaccaaccgaaaataaaaaaaaaacatcatactaaataacgtccacgataaaacaaaccaaacaaaccgcgcgccgaaacgaaacgaacacataaacaaaaaaacccgcaacctctaccccgcaataaaaataatctataaacaaacgtcgaacgtcgactactaaaacgaaaactaaaacaataacgataacgccctttcctaaaaaaataaacgtcttccccgccccacgctaccgaataaaacaactaataaaactctactacgacaaaataacgaaactctaaaccttcccctataaacgatacgaacgacgataaaaaacgaactaaattcttaaaacgaccctaacctacgccgcgacccgcaaccccgtaccgtcgccgcgcgaataaccgcctacgcaactatcaacgccgaccgctcccgcaacctacccgcccgctacgaaaccttcccaaaaccgacctaaccgccgcctcgaacgtactctcgaaacgaacgacgtcccctaccgaaaacctaacgactaaaaaaaaacgctaccgacgtcactaaccgccctcgaaccgaccccaccgccgcgctaaaactcccgctactacctctaaaaaaaacgaccctacctcctcgaaaccctaaataccccgaccgaccacctacgataaactcccatctacaccgaataatt

SEQ ID NO: 4131 - DNA, 808 bp, Artificial Sequence
  chemically treated genomic DNA (Homo sapiens) CpG-island No: 4131
taatttacgttcgattttattacgttattacggagcgtcgttcggaattgatttattcgtattcgaggcgcgttgtcgtatattataattttattatcgtgaagtaagtgtacgtcgtattaatcgaggatggaagaaagatattatattaaatggcgtttacgatagagtaaattagatagatcgcgcgtcgagacggggcgggtatatgagtaagagggttcgtagtttttgtttcgtagtgaaggtagtttatggatagacgtcggacgtcggttattgaggcggagattgagatagtggcgatggcgtttttttttgaagaagtgaacgtttttttcgttttacgttgtcggataaagtagttggtggggttttattgcgataaggtaacggagttttgagtttttttttgtgggcggtgcgggcggcgatggggagcgggttgggtttttggggcggttttggtttgcgtcgcggttcgtagtttcgtgtcgtcgtcgcgcgagtagtcgtttgcgtagttgttagcgtcggtcgttttcgtagtttgttcgttcgttgcgaggtttttttagagtcggtttggtcgtcgtttcggacgtgttttcggggcgggcggcgttttttgtcgagggtttggcggttgaggaggggcgttatcggcgttattggtcgttttcgggtcggttttatcgtcgcgttgggattttcgttgttgtttttaaggagagcggttttattttttcgaagttttgggtgtttcggtcggttatttgcggtggatttttatttgtatcgagtagtt

SEQ ID NO: 4132 - DNA, 808 bp, Artificial Sequence
  chemically treated genomic DNA (Homo sapiens) CpG-island No: 4132
aactactcgatacaaataaaaatccaccgcaaataaccgaccgaaacacccaaaacttcgaaaaaataaaaccgctctccttaaaaacaacaacgaaaatcccaacgcgacgataaaaccgacccgaaaacgaccaataacgccgataacgcccctcctcaaccgccaaaccctcgacaaaaaacgccgcccgccccgaaaacacgtccgaaacgacgaccaaaccgactctaaaaaaacctcgcaacgaacgaacaaactacgaaaacgaccgacgctaacaactacgcaaacgactactcgcgcgacgacgacacgaaactacgaaccgcgacgcaaaccaaaaccgccccaaaaacccaacccgctccccatcgccgcccgcaccgcccacaaaaaaaaactcaaaactccgttaccttatcgcaataaaaccccaccaactactttatccgacaacgtaaaacgaaaaaaacgttcacttcttcaaaaaaaaacgccatcgccactatctcaatctccgcctcaataaccgacgtccgacgtctatccataaactaccttcactacgaaacaaaaactacgaaccctcttactcatatacccgccccgtctcgacgcgcgatctatctaatttactctatcgtaaacgccatttaatataatatctttcttccatcctcgattaatacgacgtacacttacttcacgataataaaattataatatacgacaacgcgcctcgaatacgaataaatcaattccgaacgacgctccgtaataacgtaataaaatcgaacgtaaatta

SEQ ID NO: 4133 - DNA, 528 bp, Artificial Sequence
  chemically treated genomic DNA (Homo sapiens) CpG-island No: 4133
  misc_feature (422)..(422): n is either a, c, g or t
  misc_feature (521)..(521): n is either a, c, g or t
gcgtatttttttttaaatcgttttttcgggtttcgagtaatttttttttcggatttgcggggtttagattttttttttagatttttcgttttagtttttttttcgtaatcgtagatttttttattcgtttttcggggttgtagatttcggatttttttttaagttttcgagtcggattttcggttttagttattattttcgtttcgggtgttcgcgtttttaatatatcgtataagtgtttataagtttcgagtttacgacgcgcgtttttttggtcggttcggtttttcgttcgggttcgaacgtgcgcgcggttgttatgttcgggttttcgtcgttaacgtcgttcggcgtagattagtagtagtacggggcgggggtaacgtttatcgttttcggttttcggcgtacgttcgattcgncgtgcgttgtcgcggtaatttgggttcgttttatttttgtgtttaggtcggtttcggggttaatttataaggtaatttaggtttttttttaagtggttntttggga

SEQ ID NO: 4134 - DNA, 528 bp, Artificial Sequence
  chemically treated genomic DNA (Homo sapiens) CpG-island No: 4134
  misc_feature (8)..(8): n is either a, c, g or t
  misc_feature (107)..(107): n is either a, c, g or t
tcccaaanaaccacttaaaaaaaaacctaaattaccttataaattaaccccgaaaccgacctaaacacaaaaataaaacgaacccaaattaccgcgacaacgcacgncgaatcgaacgtacgccgaaaaccgaaaacgataaacgttacccccgccccgtactactactaatctacgccgaacgacgttaacgacgaaaacccgaacataacaaccgcgcgcacgttcgaacccgaacgaaaaaccgaaccgaccaaaaaaacgcgcgtcgtaaactcgaaacttataaacacttatacgatatattaaaaacgcgaacacccgaaacgaaaataataactaaaaccgaaaatccgactcgaaaacttaaaaaaaaatccgaaatctacaaccccgaaaaacgaataaaaaaatctacgattacgaaaaaaaaactaaaacgaaaaatctaaaaaaaaaatctaaaccccgcaaatccgaaaaaaaaattactcgaaacccgaaaaaacgatttaaaaaaaaatacgc

SEQ ID NO: 4135 - DNA, 528 bp, Artificial Sequence
  chemically treated genomic DNA (Homo sapiens) CpG-island No: 4135
  misc_feature (8)..(8): n is either a, c, g or t
  misc_feature (107)..(107): n is either a, c, g or t
ttttaagngattatttggaaaggggtttaaattgttttataaattaatttcggggtcggtttaggtatagaaatgaggcgggtttaaattgtcgcgatagcgtacgncgagtcgaacgtacgtcgggggtcgaggacggtggacgttattttcgtttcgtgttgttgttagtttgcgtcgggcggcgttggcggcgaagattcgaatatggtaatcgcgcgtacgttcgggttcgagcgggaagtcgagtcggttaaggaagcgcgcgtcgtgggttcggagtttgtggatatttatacggtgtgttgggggcgcgggtattcgaagcgggggtggtggttggaatcgggagttcgattcgggggtttggggaggggttcgggatttgtagtttcgaggagcgggtagaagggtttgcgattgcgaggagggggttgggacgggggatttaggaaagggatttgggtttcgtaggttcgggagaagggttgttcggggttcggggaggcggtttggaaaagggtacgt

SEQ ID NO: 4136 - DNA, 528 bp, Artificial Sequence
  chemically treated genomic DNA (Homo sapiens) CpG-island No: 4136
  misc_feature (422)..(422): n is either a, c, g or t
  misc_feature (521)..(521): n is either a, c, g or t
acgtacccttttccaaaccgcctccccgaaccccgaacaacccttctcccgaacctacgaaacccaaatccctttcctaaatcccccgtcccaaccccctcctcgcaatcgcaaacccttctacccgctcctcgaaactacaaatcccgaacccctccccaaacccccgaatcgaactcccgattccaaccaccacccccgcttcgaatacccgcgcccccaacacaccgtataaatatccacaaactccgaacccacgacgcgcgcttccttaaccgactcgacttcccgctcgaacccgaacgtacgcgcgattaccatattcgaatcttcgccgccaacgccgcccgacgcaaactaacaacaacacgaaacgaaaataacgtccaccgtcctcgacccccgacgtacgttcgactcgncgtacgctatcgcgacaatttaaacccgcctcatttctatacctaaaccgaccccgaaattaatttataaaacaatttaaacccctttccaaataatcncttaaaa

SEQ ID NO: 4137 - DNA, 624 bp, Artificial Sequence
  chemically treated genomic DNA (Homo sapiens) CpG-island No: 4137
aatcggcggggattaattttatatttcgtagttggcggaaagtagcgggaggaggtatttagttttggggttgagatttaagtttttgcgcgcgtaaattacgtttttgtggattttggttgttgcgtgttcgcgcgcgtttcggagtgcgtatgcgtagcggcgggggttgtttcggtagttttttattgaggggattcgttagttttaaatttagtggcgtttgttttgattttcggggtttggtttttagcgtagtaattttgtcggcgaagaaggtgagcgtagtgttgtgtggtagtagaggtttttaggacgaggagtagcgggacgaggaagggtagattggtgaaatcgtaaattgggcgtttgtttcggcgtcggatttttgtttgtaaaggtgggtggttcgttcggagcgggaaaatatttcggaggtggagggttgggttagcgtgattgataagcgggaatttttgtgtggggacggggtaggtttaggaaggttgtgtttgcggtggaacggcgcggtgcgtaggagtgggtattaatagtagtcgcgtgtttgggttttagatttggtttagttgtgttgagttttttatggattatgttacgtagata

SEQ ID NO: 4138 - DNA, 624 bp, Artificial Sequence
  chemically treated genomic DNA (Homo sapiens) CpG-island No: 4138
tatctacgtaacataatccataaaaaactcaacacaactaaaccaaatctaaaacccaaacacgcgactactattaatacccactcctacgcaccgcgccgttccaccgcaaacacaaccttcctaaacctaccccgtccccacacaaaaattcccgcttatcaatcacgctaacccaaccctccacctccgaaatattttcccgctccgaacgaaccacccacctttacaaacaaaaatccgacgccgaaacaaacgcccaatttacgatttcaccaatctacccttcctcgtcccgctactcctcgtcctaaaaacctctactaccacacaacactacgctcaccttcttcgccgacaaaattactacgctaaaaaccaaaccccgaaaatcaaaacaaacgccactaaatttaaaactaacgaatcccctcaataaaaaactaccgaaacaacccccgccgctacgcatacgcactccgaaacgcgcgcgaacacgcaacaaccaaaatccacaaaaacgtaatttacgcgcgcaaaaacttaaatctcaaccccaaaactaaatacctcctcccgctactttccgccaactacgaaatataaaattaatccccgccgatt

SEQ ID NO: 4139 - DNA, 624 bp, Artificial Sequence
  chemically treated genomic DNA (Homo sapiens) CpG-island No: 4139
tatttacgtaatataatttatgaaaagtttaatatagttaggttaaatttaagatttagatacgcggttgttgttaatgtttatttttgcgtatcgcgtcgttttatcgtaggtataatttttttaggtttgtttcgtttttatataggggttttcgtttgttaattacgttggtttagttttttattttcggaatgttttttcgtttcggacgggttatttatttttgtaaataggggttcggcgtcggaatagacgtttagtttgcgattttattagtttgttttttttcgtttcgttgtttttcgttttaaggatttttgttgttatatagtattgcgtttatttttttcgtcggtagaattgttacgttgaaagttaggtttcgggaattagggtaaacgttattgaatttgaaattggcgggtttttttagtgaaaggttgtcggaataattttcgtcgttgcgtatgcgtatttcgggacgcgcgcgaatacgtagtagttagaatttataggggcgtggtttgcgcgcgtaggaatttggattttaattttagggttaggtgttttttttcgttgtttttcgttagttgcggggtgtgagattaattttcgtcgatt

SEQ ID NO: 4140 - DNA, 624 bp, Artificial Sequence
  chemically treated genomic DNA (Homo sapiens) CpG-island No: 4140
aatcgacgaaaattaatctcacaccccgcaactaacgaaaaacaacgaaaaaaaacacctaaccctaaaattaaaatccaaattcctacgcgcgcaaaccacgcccctataaattctaactactacgtattcgcgcgcgtcccgaaatacgcatacgcaacgacgaaaattattccgacaacctttcactaaaaaaacccgccaatttcaaattcaataacgtttaccctaattcccgaaacctaactttcaacgtaacaattctaccgacgaaaaaaataaacgcaatactatataacaacaaaaatccttaaaacgaaaaacaacgaaacgaaaaaaaacaaactaataaaatcgcaaactaaacgtctattccgacgccgaacccctatttacaaaaataaataacccgtccgaaacgaaaaaacattccgaaaataaaaaactaaaccaacgtaattaacaaacgaaaacccctatataaaaacgaaacaaacctaaaaaaattatacctacgataaaacgacgcgatacgcaaaaataaacattaacaacaaccgcgtatctaaatcttaaatttaacctaactatattaaacttttcataaattatattacgtaaata

SEQ ID NO: 4141 - DNA, 682 bp, Artificial Sequence
  chemically treated genomic DNA (Homo sapiens) CpG-island No: 4141
gattttgatgagtggcgtgaatttttcggttgataaatcgtttggatgcggtttttgtcgttttgtatcgtggttagtcggtcgtcgttttagtcgtattaggttatttgcggttttcgtgatagcgatatttagttcgttaggtttcgtttacgtcgttatattcgttttgttattttgcggtttagcgggtcgtaaagatagcggttttcgattagtggttcgttatgttgtattcgcgtgtagaatattaggcggtgttggttgtcgtagtggtagtggtgggttcgttcgtcgttcgttcgtattatattcgtcgggatgcggttcgtttttttcgttagtttgtcgtatttatcgtggcggtagatatagtgcgtatttttcgcgatgcggttattcggttatattgtgagtgtattgttcgggtgtagtttcgggttcggtagtcggttgttcgtcgggttcgtggtatacgggatgcggatgtttaggtttggtgcgagggtgcgtatattttttagtttgttcgtggcgttgtagtcgtattttcgcgtttgtcgcgggtcgttgatgcgtattaggtcgtcgttgttattttattcgtagttacggttatatatatggttgtttaggtgttggttttgtaattggttgcgggggtgtattgatgaattattgt

SEQ ID NO: 4142 - DNA, 682 bp, Artificial Sequence
  chemically treated genomic DNA (Homo sapiens) CpG-island No: 4142
acaataattcatcaatacacccccgcaaccaattacaaaaccaacacctaaacaaccatatatataaccgtaactacgaataaaataacaacgacgacctaatacgcatcaacgacccgcgacaaacgcgaaaatacgactacaacgccacgaacaaactaaaaaatatacgcaccctcgcaccaaacctaaacatccgcatcccgtataccacgaacccgacgaacaaccgactaccgaacccgaaactacacccgaacaatacactcacaatataaccgaataaccgcatcgcgaaaaatacgcactatatctaccgccacgataaatacgacaaactaacgaaaaaaacgaaccgcatcccgacgaatataatacgaacgaacgacgaacgaacccaccactaccactacgacaaccaacaccgcctaatattctacacgcgaatacaacataacgaaccactaatcgaaaaccgctatctttacgacccgctaaaccgcaaaataacaaaacgaatataacgacgtaaacgaaacctaacgaactaaatatcgctatcacgaaaaccgcaaataacctaatacgactaaaacgacgaccgactaaccacgatacaaaacgacaaaaaccgcatccaaacgatttatcaaccgaaaaattcacgccactcatcaaaatc

SEQ ID NO: 4143 - DNA, 682 bp, Artificial Sequence
  chemically treated genomic DNA (Homo sapiens) CpG-island No: 4143
gtagtagtttattaatatattttcgtagttagttatagagttagtatttgaatagttatgtatatgatcgtgattacgggtggagtgataacggcgatttggtgcgtattagcggttcgcgatagacgcgggaatacggttatagcgttacgggtaggttggagagtgtgcgtattttcgtattagatttggatattcgtatttcgtatgttacggattcggcgggtaatcggttgtcggattcggagttgtattcggatagtatatttatagtgtggtcggataatcgtatcgcggaggatgcgtattatgtttatcgttacgatgaatacggtaggttgacggagaagacggatcgtatttcggcgggtgtgatacggacggacgacgagcggatttattattattattacgatagttagtatcgtttggtgttttatacgcggatatagtatggcgagttattggtcgagagtcgttatttttacgattcgttgggtcgtagggtggtaaaacgggtgtggcggcgtgaacgggatttgacgggttggatgtcgttgttacggaaatcgtaagtgatttggtacggttgggacggcgatcggttgattacgatatagaacgataggagtcgtatttagacgatttattagtcggggagtttacgttatttattagggtt

SEQ ID NO: 4144 - DNA, 682 bp, Artificial Sequence
  chemically treated genomic DNA (Homo sapiens) CpG-island No: 4144
aaccctaataaataacgtaaactccccgactaataaatcgtctaaatacgactcctatcgttctatatcgtaatcaaccgatcgccgtcccaaccgtaccaaatcacttacgatttccgtaacaacgacatccaacccgtcaaatcccgttcacgccgccacacccgttttaccaccctacgacccaacgaatcgtaaaaataacgactctcgaccaataactcgccatactatatccgcgtataaaacaccaaacgatactaactatcgtaataataataataaatccgctcgtcgtccgtccgtatcacacccgccgaaatacgatccgtcttctccgtcaacctaccgtattcatcgtaacgataaacataatacgcatcctccgcgatacgattatccgaccacactataaatatactatccgaatacaactccgaatccgacaaccgattacccgccgaatccgtaacatacgaaatacgaatatccaaatctaatacgaaaatacgcacactctccaacctacccgtaacgctataaccgtattcccgcgtctatcgcgaaccgctaatacgcaccaaatcgccgttatcactccacccgtaatcacgatcatatacataactattcaaatactaactctataactaactacgaaaatatattaataaactactac

SEQ ID NO: 4145 - DNA, 1498 bp, Artificial Sequence
  chemically treated genomic DNA (Homo sapiens) CpG-island No: 4145
  misc_feature (499)..(500): n is either a, c, g or t
  misc_feature (764)..(764): n is either a, c, g or t
  misc_feature (1011)..(1011): n is either a, c, g or t
  misc_feature (1114)..(1114): n is either a, c, g or t
  misc_feature (1136)..(1136): n is either a, c, g or t
ggtacgttgttttttcgtttgtaacggtatgttttttattattttgagtaattttttttttttttcgattttttagcgaggtttgggaatcgcgtggaagatattttttttattttgttcggtttcgtattagtttaagttcgtttttgttattttaatttgcgtttcgttttttacggagcggtcgggaaggattttgtgggacgtggcgattcggtaagggggattggtcgcgatttttcggtcgtcgggttcgggcggttgcgtttttattaatttttttagaaatttgataattgtacggcgacggtcggacggggatttagaggggttacggggttaggttgtatcggtttcgtcgtgggtaggttcggatcgtaggggattttatgttcgagtttcggtttttttcgtttcgtcgggagagggagtaggtagaagttaggggagttttagcgggatcgaggttcgtttttagtcgcggggtcgcgggttttanngggttagcgtttataatgcggtttcgcgttttttatgcgggagcgggtgcgttgttatgatagcgattttcgtggcgcgcgttcgggtttgtcgtttttaggcgcgtacggttttttttcgtttcgatttttcgtcgttgtgcgtaattttttttcggttgtgggaaggggtcgggtttgtcgtttgacgtttgtgcggggttcggaagatggttgcggagtcgagtatcgggtagtggttgcggcggcggcggcggcggcggngtcgggagcgcggcgggcgggggtttcgttttgcgcgtggggcgttgagtcgagaggcgcggaggcggcgagggcgcgggggttttgaggatcgttcggcgtcgttttttgttatattatgggtagcgtagaggacgtagttaaagagaaattgttgtggaacgtgaagaaggaggtaaagtcgagttaagaatttcggggggttcgcgttttggttcgcgcggtttagggggtagaaaggtttttncgtttatttttcggcgcgggtattcgggtcgaatttgggtcgggcggggcgggttttggacgggttgcgttttttttttttttttcggatgggggagggtagnagtttttttttcgggggatttngtcggcgttttcggtttgtttgtttcgtagtttcgtagtttttcgtttagtgacggtagcggcgttgggagtttaaggtcgggggaggggtggcggcgatggcggggatggttggattcggagttgtttatttagtgttcgcgtcgttaggggagggggcggggtttcgcgcgagttttcgcggcgtaggtgggtgtcgtgcgggtcgagtttttttacgttttaagtgggtgtcgtgcgggttgagtttttttttgttcgacgttcgttgtgtttttagttacggagtgatcgttgtcggaggggtgcgtcgtatattttagtttttttttttacgtttatttttttagttagggattagg

SEQ ID NO: 4146 - DNA, 1498 bp, Artificial Sequence
  chemically treated genomic DNA (Homo sapiens) CpG-island No: 4146
  misc_feature (363)..(363): n is either a, c, g or t
  misc_feature (385)..(385): n is either a, c, g or t
  misc_feature (488)..(488): n is either a, c, g or t
  misc_feature (735)..(735): n is either a, c, g or t
  misc_feature (999)..(1000): n is either a, c, g or t
cctaatccctaactaaaaaaataaacgtaaaaaaaaaaactaaaatatacgacgcacccctccgacaacgatcactccgtaactaaaaacacaacgaacgtcgaacaaaaaaaaactcaacccgcacgacacccacttaaaacgtaaaaaaactcgacccgcacgacacccacctacgccgcgaaaactcgcgcgaaaccccgccccctcccctaacgacgcgaacactaaataaacaactccgaatccaaccatccccgccatcgccgccacccctcccccgaccttaaactcccaacgccgctaccgtcactaaacgaaaaactacgaaactacgaaacaaacaaaccgaaaacgccgacnaaatcccccgaaaaaaaaactnctaccctcccccatccgaaaaaaaaaaaaaaaacgcaacccgtccaaaacccgccccgcccgacccaaattcgacccgaatacccgcgccgaaaaataaacgnaaaaacctttctaccccctaaaccgcgcgaaccaaaacgcgaaccccccgaaattcttaactcgactttacctccttcttcacgttccacaacaatttctctttaactacgtcctctacgctacccataatataacaaaaaacgacgccgaacgatcctcaaaacccccgcgccctcgccgcctccgcgcctctcgactcaacgccccacgcgcaaaacgaaacccccgcccgccgcgctcccgacnccgccgccgccgccgccgccgcaaccactacccgatactcgactccgcaaccatcttccgaaccccgcacaaacgtcaaacgacaaacccgaccccttcccacaaccgaaaaaaaattacgcacaacgacgaaaaatcgaaacgaaaaaaaaccgtacgcgcctaaaaacgacaaacccgaacgcgcgccacgaaaatcgctatcataacaacgcacccgctcccgcataaaaaacgcgaaaccgcattataaacgctaacccnntaaaacccgcgaccccgcgactaaaaacgaacctcgatcccgctaaaactcccctaacttctacctactccctctcccgacgaaacgaaaaaaaccgaaactcgaacataaaatcccctacgatccgaacctacccacgacgaaaccgatacaacctaaccccgtaacccctctaaatccccgtccgaccgtcgccgtacaattatcaaatttctaaaaaaattaataaaaacgcaaccgcccgaacccgacgaccgaaaaatcgcgaccaatcccccttaccgaatcgccacgtcccacaaaatccttcccgaccgctccgtaaaaaacgaaacgcaaattaaaataacaaaaacgaacttaaactaatacgaaaccgaacaaaataaaaaaaatatcttccacgcgattcccaaacctcgctaaaaaatcgaaaaaaaaaaaaaattactcaaaataataaaaaacataccgttacaaacgaaaaaacaacgtacc

SEQ ID NO: 4147 - DNA, 1498 bp, Artificial Sequence
  chemically treated genomic DNA (Homo sapiens) CpG-island No: 4147
  misc_feature (363)..(363): n is either a, c, g or t
  misc_feature (385)..(385): n is either a, c, g or t
  misc_feature (488)..(488): n is either a, c, g or t
  misc_feature (735)..(735): n is either a, c, g or t
  misc_feature (999)..(1000): n is either a, c, g or t
tttggtttttggttaaggaggtgggcgtggagggagaaattgaggtgtgcggcgtattttttcggtagcgattatttcgtagttggaggtatagcggacgtcggataagggggagtttagttcgtacgatatttatttaggacgtggggaagttcggttcgtacgatatttatttgcgtcgcgggagttcgcgcggggtttcgtttttttttttggcggcgcgggtattgaatgggtagtttcggatttagttattttcgttatcgtcgttatttttttttcggttttgggtttttagcgtcgttgtcgttattgggcggggagttgcggggttgcgaagtaaataagtcgggagcgtcggtngggtttttcggggaaagggttnttgtttttttttattcgagaaaggggaaggaggcgtagttcgtttaggattcgtttcgttcggtttaggttcggttcgggtgttcgcgtcggggggtgggcgnggggatttttttgttttttgggtcgcgcgggttagggcgcgagtttttcggggtttttgattcgattttatttttttttttacgttttatagtagtttttttttgattgcgttttttgcgttgtttatggtgtggtaggaggcggcgtcgagcggtttttagagttttcgcgttttcgtcgttttcgcgtttttcggtttagcgttttacgcgtaaggcggagttttcgttcgtcgcgttttcggtntcgtcgtcgtcgtcgtcgtcgtagttattgttcggtgttcggtttcgtagttatttttcgagtttcgtatagacgttaggcggtaggttcggtttttttttatagtcggaggggggttgcgtatagcgacgggggatcggggcggggagaggtcgtgcgcgtttaggggcggtagattcgggcgcgcgttacgggggtcgttgttatggtaacgtattcgttttcgtatggagggcgcgaagtcgtattgtgagcgttggtttnntggagttcgcggtttcgcggttgagagcgagtttcggtttcgttgaagtttttttgatttttgtttgttttttttttcgacgggacggaaagggtcggggttcgggtatggggttttttgcggttcgagtttgtttacggcgaagtcggtgtagtttggtttcgtgatttttttgaattttcgttcggtcgtcgtcgtgtagttgttaagtttttgggaagattagtgggagcgtagtcgttcgagttcgacggtcggagggtcgcggttagttttttttgtcgggtcgttacgttttataaggtttttttcggtcgtttcgtgggaggcggggcgtaggttggagtaatagggacgggtttgagttggtacggaatcgggtaaggtgagagaagtgttttttacgcgatttttaagtttcgttagggaatcgagggagaagaaaggttgtttagagtgataaagaatatgtcgttgtaaacggaagagtaacgtgtt

SEQ ID NO: 4148 - DNA, 1498 bp, Artificial Sequence
  chemically treated genomic DNA (Homo sapiens) CpG-island No: 4148
  misc_feature (499)..(500): n is either a, c, g or t
  misc_feature (764)..(764): n is either a, c, g or t
  misc_feature (1011)..(1011): n is either a, c, g or t
  misc_feature (1114)..(1114): n is either a, c, g or t
  misc_feature (1136)..(1136): n is either a, c, g or t
aacacgttactcttccgtttacaacgacatattctttatcactctaaacaacctttcttctccctcgattccctaacgaaacttaaaaatcgcgtaaaaaacacttctctcaccttacccgattccgtaccaactcaaacccgtccctattactccaacctacgccccgcctcccacgaaacgaccgaaaaaaaccttataaaacgtaacgacccgacaaaaaaaactaaccgcgaccctccgaccgtcgaactcgaacgactacgctcccactaatcttcccaaaaacttaacaactacacgacgacgaccgaacgaaaattcaaaaaaatcacgaaaccaaactacaccgacttcgccgtaaacaaactcgaaccgcaaaaaaccccatacccgaaccccgaccctttccgtcccgtcgaaaaaaaaaacaaacaaaaatcaaaaaaacttcaacgaaaccgaaactcgctctcaaccgcgaaaccgcgaactccannaaaccaacgctcacaatacgacttcgcgccctccatacgaaaacgaatacgttaccataacaacgacccccgtaacgcgcgcccgaatctaccgcccctaaacgcgcacgacctctccccgccccgatcccccgtcgctatacgcaacccccctccgactataaaaaaaaaccgaacctaccgcctaacgtctatacgaaactcgaaaaataactacgaaaccgaacaccgaacaataactacgacgacgacgacgacgacganaccgaaaacgcgacgaacgaaaactccgccttacgcgtaaaacgctaaaccgaaaaacgcgaaaacgacgaaaacgcgaaaactctaaaaaccgctcgacgccgcctcctaccacaccataaacaacgcaaaaaacgcaatcaaaaaaaaactactataaaacgtaaaaaaaaaaataaaatcgaatcaaaaaccccgaaaaactcgcgccctaacccgcgcgacccaaaaaacaaaaaaatccccncgcccaccccccgacgcgaacacccgaaccgaacctaaaccgaacgaaacgaatcctaaacgaactacgcctccttcccctttctcgaataaaaaaaaacaanaaccctttccccgaaaaacccnaccgacgctcccgacttatttacttcgcaaccccgcaactccccgcccaataacgacaacgacgctaaaaacccaaaaccgaaaaaaaaataacgacgataacgaaaataactaaatccgaaactacccattcaatacccgcgccgccaaaaaaaaaaacgaaaccccgcgcgaactcccgcgacgcaaataaatatcgtacgaaccgaacttccccacgtcctaaataaatatcgtacgaactaaactcccccttatccgacgtccgctatacctccaactacgaaataatcgctaccgaaaaaatacgccgcacacctcaatttctccctccacgcccacctccttaaccaaaaaccaaa

SEQ ID NO: 4149 - DNA, 1215 bp, Artificial Sequence
  chemically treated genomic DNA (Homo sapiens) CpG-island No: 4149
gaggtcgggggaggggcggcgtttagcggttggtttttcgcgcgttggatttttttcgttattttttttacggggttcgtgacgtcgcgtcgttttcggagtttttttagaggatggatagggagagtttcggttcgtcgtttattttttttttaacgcgggttgggagttttacgtttttttattttttacggtttcgcgttttcgcggttgtcggtttattttttatagttttcggttcggcgcgcggaagtttcgtcggtttttagggaaatcgaagtttaggtcgttatggtaatcgtttgacgtggcggcgttttcggttcgagtattgtagagggagcgacgtttaaagggaggggacgcgtagtcgggagggtttcgaaaaaagagatattttttttttttagtttaggaggaaggaaagcgtgacgtgttttaggttcggcggtttcggggttgtttgtcgtttagttaaatcggagtttttttcgttttaggcgtaattttatattcgggtcgtggcgtttttacgcgcgtttcgaaaagattttttttttttggggtaaacggggttcggttcgcgtcgtagcgtggacggggattacgtttaatttttttcgtagatagttatagatattcgggcggaatttgggttttcgtttaggttttgcggtcggggaggaggcgtcgggtcgttttatgtttttttttttcgcggttgtattaatacgcgcgaacgggagtcgttatcgggattcgtattaggcgttacggcgcgcgttttacggtttcggggacgtcgaggttgtaggggttcgggagcggcgcgggaggggagtcgcgtttttttttgcgtacgcgcgttttttcgggtagggagtttcgttgacgttagtcgggttatgtgtttagcgttcgcgtggaggtgggagggaggcgcgggggagtcgtcggggcgtgagggcggggcggggcgcggtcgggggaggggcggcggagggagggcgggggaagttgcgcgacgtcggttttcgggttttatatttggatgtatcgtagcgtcgttcgtagtacgtttagattggacgtttttttgttatttacgttggggatgtttcgttttagggttttaaagtatttttttagatgggtttttttgaagagaggggcgagcgtcggttagcggtgtttggggcggggttgggacggggg

SEQ ID NO: 4150 - DNA, 1215 bp, Artificial Sequence
  chemically treated genomic DNA (Homo sapiens) CpG-island No: 4150
cccccgtcccaaccccgccccaaacaccgctaaccgacgctcgcccctctcttcaaaaaaacccatctaaaaaaatactttaaaaccctaaaacgaaacatccccaacgtaaataacaaaaaaacgtccaatctaaacgtactacgaacgacgctacgatacatccaaatataaaacccgaaaaccgacgtcgcgcaacttcccccgccctccctccgccgcccctcccccgaccgcgccccgccccgccctcacgccccgacgactcccccgcgcctccctcccacctccacgcgaacgctaaacacataacccgactaacgtcaacgaaactccctacccgaaaaaacgcgcgtacgcaaaaaaaaacgcgactcccctcccgcgccgctcccgaacccctacaacctcgacgtccccgaaaccgtaaaacgcgcgccgtaacgcctaatacgaatcccgataacgactcccgttcgcgcgtattaatacaaccgcgaaaaaaaaaaacataaaacgacccgacgcctcctccccgaccgcaaaacctaaacgaaaacccaaattccgcccgaatatctataactatctacgaaaaaaattaaacgtaatccccgtccacgctacgacgcgaaccgaaccccgtttaccccaaaaaaaaaaaatcttttcgaaacgcgcgtaaaaacgccacgacccgaatataaaattacgcctaaaacgaaaaaaactccgatttaactaaacgacaaacaaccccgaaaccgccgaacctaaaacacgtcacgctttccttcctcctaaactaaaaaaaaaaaatatctcttttttcgaaaccctcccgactacgcgtcccctccctttaaacgtcgctccctctacaatactcgaaccgaaaacgccgccacgtcaaacgattaccataacgacctaaacttcgatttccctaaaaaccgacgaaacttccgcgcgccgaaccgaaaactataaaaaataaaccgacaaccgcgaaaacgcgaaaccgtaaaaaataaaaaaacgtaaaactcccaacccgcgttaaaaaaaaaataaacgacgaaccgaaactctccctatccatcctctaaaaaaactccgaaaacgacgcgacgtcacgaaccccgtaaaaaaaataacgaaaaaaatccaacgcgcgaaaaaccaaccgctaaacgccgcccctcccccgacctc

SEQ ID NO: 4151 - DNA, 1215 bp, Artificial Sequence
  chemically treated genomic DNA (Homo sapiens) CpG-island No: 4151
ttttcgttttagtttcgttttaggtatcgttgatcggcgttcgtttttttttttaggagggtttatttgaaagagtgttttgagattttgaagcggaatatttttaacgtggatgataagaagacgtttaatttgagcgtgttgcggacggcgttgcggtatatttaggtatggggttcggaggtcggcgtcgcgtagtttttttcgtttttttttcgtcgtttttttttcggtcgcgtttcgtttcgtttttacgtttcggcggttttttcgcgttttttttttatttttacgcgggcgttgagtatatggttcggttgacgttagcggggttttttgttcgggagggcgcgcgtgcgtagaggagggcgcggtttttttttcgcgtcgttttcgagtttttgtagtttcggcgttttcggggtcgtgaggcgcgcgtcgtgacgtttggtgcgagtttcgatggcggttttcgttcgcgcgtgttggtgtagtcgcgggagggaagggtatggggcggttcggcgtttttttttcggtcgtagagtttgggcgggagtttagatttcgttcgaatgtttgtagttatttgcggggagggttgggcgtggttttcgtttacgttgcggcgcgggtcgagtttcgtttattttaaaggaggaaggttttttcggagcgcgcgtggaggcgttacggttcgagtgtggggttacgtttggggcggggaaaatttcgatttgattgggcggtaaatagtttcggggtcgtcgagtttgaaatacgttacgttttttttttttttgggttaggaagagggggtgttttttttttcggggttttttcggttgcgcgttttttttttttgggcgtcgttttttttgtagtgttcgggtcgggggcgtcgttacgttaggcggttgttatggcggtttgagtttcggtttttttggaaatcggcggggttttcgcgcgtcgggtcggaggttgtgggggatgggtcggtagtcgcggagacgcggagtcgtaggggatggagggacgtggggtttttagttcgcgttggggggggggtgggcggcgagtcgggattttttttgtttattttttgaggaagtttcgggggcggcgcggcgttacgggtttcgtgggaggggtggcgaggagggtttagcgcgcgaggagttagtcgttgggcgtcgtttttttttcggtttt

SEQ ID NO: 4152 - DNA, 1215 bp, Artificial Sequence
  chemically treated genomic DNA (Homo sapiens) CpG-island No: 4152
aaaaccgaaaaaaaaacgacgcccaacgactaactcctcgcgcgctaaaccctcctcgccacccctcccacgaaacccgtaacgccgcgccgcccccgaaacttcctcaaaaaataaacaaaaaaaatcccgactcgccgcccaccccccccccaacgcgaactaaaaaccccacgtccctccatcccctacgactccgcgtctccgcgactaccgacccatcccccacaacctccgacccgacgcgcgaaaaccccgccgatttccaaaaaaaccgaaactcaaaccgccataacaaccgcctaacgtaacgacgcccccgacccgaacactacaaaaaaaacgacgcccaaaaaaaaaaaacgcgcaaccgaaaaaaccccgaaaaaaaaaacaccccctcttcctaacccaaaaaaaaaaaaaacgtaacgtatttcaaactcgacgaccccgaaactatttaccgcccaatcaaatcgaaattttccccgccccaaacgtaaccccacactcgaaccgtaacgcctccacgcgcgctccgaaaaaaccttcctcctttaaaataaacgaaactcgacccgcgccgcaacgtaaacgaaaaccacgcccaaccctccccgcaaataactacaaacattcgaacgaaatctaaactcccgcccaaactctacgaccgaaaaaaaaacgccgaaccgccccatacccttccctcccgcgactacaccaacacgcgcgaacgaaaaccgccatcgaaactcgcaccaaacgtcacgacgcgcgcctcacgaccccgaaaacgccgaaactacaaaaactcgaaaacgacgcgaaaaaaaaaccgcgccctcctctacgcacgcgcgccctcccgaacaaaaaaccccgctaacgtcaaccgaaccatatactcaacgcccgcgtaaaaataaaaaaaaaacgcgaaaaaaccgccgaaacgtaaaaacgaaacgaaacgcgaccgaaaaaaaaacgacgaaaaaaaaacgaaaaaaactacgcgacgccgacctccgaaccccatacctaaatataccgcaacgccgtccgcaacacgctcaaattaaacgtcttcttatcatccacgttaaaaatattccgcttcaaaatctcaaaacactctttcaaataaaccctcctaaaaaaaaaaacgaacgccgatcaacgatacctaaaacgaaactaaaacgaaaa

SEQ ID NO: 4153 - DNA, 685 bp, Artificial Sequence
  chemically treated genomic DNA (Homo sapiens) CpG-island No: 4153
aggggtcgggtcgcgtcgtttttagtaggagtgttttcggtgtacgtggtcgggggcggagttcgtttacgttattattcggtgtaattaacgggttcggaacgtaggtatacgtaatattttaggcgagagcgggtttggaacgcgtagatacgttatattttatattggttaaagcggggcgtagcgaggggggttcgggggttgatttttagcgattcgcgggttatttcgtaaacgtttaattagttcggtttttatttaaatttcggacgcgtagtttagtttagttttgggaggcggggttaggcggggttggttaggattataagatacgcgatgttattttattttgtaaaggtcgttttcgttttaagcggcgcgtagatttgtcgggagcgtttttcgtattttttttacggggttagggaagtcgaagagttgtttcgcgtagagtagtttttatttttatttcgttatatatacgtttattcgtgtgttatatatacgttcgtgtatacgttcgtttatttgtttttttcgaggtttatattatatatttttcgtgtatatacgtacgtatacgcgagtttgttatttttacgtaatattattttttattttatttttcggtttatatatttttagtgttatcgagggtttcgttggtttacgtaaaagtagt

SEQ ID NO: 4154 - DNA, 685 bp, Artificial Sequence
  chemically treated genomic DNA (Homo sapiens) CpG-island No: 4154
actacttttacgtaaaccaacgaaaccctcgataacactaaaaatatataaaccgaaaaataaaataaaaaataatattacgtaaaaataacaaactcgcgtatacgtacgtatatacacgaaaaatatataatataaacctcgaaaaaaacaaataaacgaacgtatacacgaacgtatatataacacacgaataaacgtatatataacgaaataaaaataaaaactactctacgcgaaacaactcttcgacttccctaaccccgtaaaaaaaatacgaaaaacgctcccgacaaatctacgcgccgcttaaaacgaaaacgacctttacaaaataaaataacatcgcgtatcttataatcctaaccaaccccgcctaaccccgcctcccaaaactaaactaaactacgcgtccgaaatttaaataaaaaccgaactaattaaacgtttacgaaataacccgcgaatcgctaaaaatcaacccccgaacccccctcgctacgccccgctttaaccaatataaaatataacgtatctacgcgttccaaacccgctctcgcctaaaatattacgtatacctacgttccgaacccgttaattacaccgaataataacgtaaacgaactccgcccccgaccacgtacaccgaaaacactcctactaaaaacgacgcgacccgacccct

SEQ ID NO: 4155 - DNA, 685 bp, Artificial Sequence
  chemically treated genomic DNA (Homo sapiens) CpG-island No: 4155
gttgtttttgcgtgggttagcggagttttcggtggtattgaggatgtgtgagtcggggggtggggtgaggaatggtgttgcgtgggggtggtaggttcgcgtgtgcgtgcgtgtgtgtacgggggatgtgtgatgtgagtttcgggaagagtagatgaacggacgtgtatacgggcgtgtgtatagtatacgagtgggcgtgtgtgtaacggagtgggggtggggattattttacgcggagtagtttttcggtttttttggtttcgtggggagggtgcggggggcgttttcggtagatttacgcgtcgtttggggcggaggcggtttttgtagaatgaaatgatatcgcgtgttttatgattttggttagtttcgtttgatttcgttttttagagttgggttgggttgcgcgttcggggtttgggtgaaagtcgggttaattgggcgtttgcgaaatggttcgcgggtcgttgggggttagttttcgggtttttttcgttgcgtttcgttttagttagtgtggaatgtggcgtgtttgcgcgttttaaattcgttttcgtttggaatgttgcgtgtgtttgcgtttcgagttcgttggttatatcgggtggtgacgtggacgggtttcgttttcgattacgtgtatcggggatatttttgttggggacggcgcggttcggttttt

SEQ ID NO: 4156 - DNA, 685 bp, Artificial Sequence
  chemically treated genomic DNA (Homo sapiens) CpG-island No: 4156
aaaaaccgaaccgcgccgtccccaacaaaaatatccccgatacacgtaatcgaaaacgaaacccgtccacgtcaccacccgatataaccaacgaactcgaaacgcaaacacacgcaacattccaaacgaaaacgaatttaaaacgcgcaaacacgccacattccacactaactaaaacgaaacgcaacgaaaaaaacccgaaaactaacccccaacgacccgcgaaccatttcgcaaacgcccaattaacccgactttcacccaaaccccgaacgcgcaacccaacccaactctaaaaaacgaaatcaaacgaaactaaccaaaatcataaaacacgcgatatcatttcattctacaaaaaccgcctccgccccaaacgacgcgtaaatctaccgaaaacgccccccgcaccctccccacgaaaccaaaaaaaccgaaaaactactccgcgtaaaataatccccacccccactccgttacacacacgcccactcgtatactatacacacgcccgtatacacgtccgttcatctactcttcccgaaactcacatcacacatcccccgtacacacacgcacgcacacgcgaacctaccacccccacgcaacaccattcctcaccccaccccccgactcacacatcctcaataccaccgaaaactccgctaacccacgcaaaaacaac

SEQ ID NO: 4157 - DNA, 776 bp, Artificial Sequence
  chemically treated genomic DNA (Homo sapiens) CpG-island No: 4157
tcgtttttcgtcgttaggtcgagttcgggtatcggtagtcgcggcgcgttcggggttttgtaaaggtcgttcgggtttgttttcgtcgcgggtcgggtacggagttcgtaggtttcggcgcggttcggtttttttcgttcgttcgtttttcggtcgggggttcgcgttcgttcgttcgttttttcggttgtagggtcggtttcgtcgagttttcgcggcgttcgggttttatttaattgtttttcgttggggcggcggcggcggtggttgcggcggcggcgggtttcggtttcgttttacgtagaagtagttttttatcgttcgggcggcgcgggaggggtcgggttcggggtttaggcggtaggagtcggcgtcgtagttcgagcgcgagttttatcgagagcggcggcggcggcggcggcggcggaggggcggggcgcggtttggcggcggcggcgataacggtagtggcggcggcggtttttttcgcgggtcgcggcggcgggtcgggtttcgggtttttcggcgttggcgttggtttaggatcgggggaggcgttcggcgttcgaggttggttcgggcgggaggagggagagggagttttggcgtttcgagttcgcgtcgtcgtttcggtcggtatttcgtttttttagtttttttttcgatttagttcgttagtcgtaggtagggtttcggtgcgtttattcgggttttttcgagttcgtcggcgattttagtttagttttaggttttcgggagtttacggtttttagagt

SEQ ID NO: 4158 - DNA, 776 bp, Artificial Sequence
  chemically treated genomic DNA (Homo sapiens) CpG-island No: 4158
actctaaaaaccgtaaactcccgaaaacctaaaactaaactaaaatcgccgacgaactcgaaaaaacccgaataaacgcaccgaaaccctacctacgactaacgaactaaatcgaaaaaaaaactaaaaaaacgaaataccgaccgaaacgacgacgcgaactcgaaacgccaaaactccctctccctcctcccgcccgaaccaacctcgaacgccgaacgcctcccccgatcctaaaccaacgccaacgccgaaaaacccgaaacccgacccgccgccgcgacccgcgaaaaaaaccgccgccgccactaccgttatcgccgccgccgccaaaccgcgccccgcccctccgccgccgccgccgccgccgccgctctcgataaaactcgcgctcgaactacgacgccgactcctaccgcctaaaccccgaacccgacccctcccgcgccgcccgaacgataaaaaactacttctacgtaaaacgaaaccgaaacccgccgccgccgcaaccaccgccgccgccgccccaacgaaaaacaattaaataaaacccgaacgccgcgaaaactcgacgaaaccgaccctacaaccgaaaaaacgaacgaacgaacgcgaacccccgaccgaaaaacgaacgaacgaaaaaaaccgaaccgcgccgaaacctacgaactccgtacccgacccgcgacgaaaacaaacccgaacgacctttacaaaaccccgaacgcgccgcgactaccgatacccgaactcgacctaacgacgaaaaacga

SEQ ID NO: 4159 - DNA, 776 bp, Artificial Sequence
  chemically treated genomic DNA (Homo sapiens) CpG-island No: 4159
gttttagaggtcgtgggttttcgggggtttgaggttggattggggtcgtcggcgggttcggggaggttcgggtgggcgtatcggggttttgtttgcggttgacgggttgggtcgagggggaggttggggaggcggggtgtcggtcggggcggcggcgcgggttcgggacgttagggtttttttttttttttttcgttcgagttagtttcgggcgtcgggcgtttttttcgattttgaattagcgttagcgtcgggaggttcggagttcggttcgtcgtcgcggttcgcggagggagtcgtcgtcgttattgtcgttgtcgtcgtcgtcgttaggtcgcgtttcgttttttcgtcgtcgtcgtcgtcgtcgtcgttttcggtgaggttcgcgttcgagttgcggcgtcggtttttgtcgtttgggtttcgggttcggtttttttcgcgtcgttcgggcgatgagaagttgtttttgcgtgagacggagtcgggattcgtcgtcgtcgtagttatcgtcgtcgtcgttttagcggggaatagttaagtgaggttcgggcgtcgcggaggttcggcggagtcggttttgtagtcgggagggcgggcgggcgggcgcgggttttcggtcgaggggcgggcggacgggaggagtcgggtcgcgtcgaggtttgcgggtttcgtgttcggttcgcggcggggataggttcgggcggtttttgtagagtttcgagcgcgtcgcggttgtcggtgttcgggttcggtttggcggcgagaggcgg

SEQ ID NO: 4160 - DNA, 776 bp, Artificial Sequence
  chemically treated genomic DNA (Homo sapiens) CpG-island No: 4160
ccgcctctcgccgccaaaccgaacccgaacaccgacaaccgcgacgcgctcgaaactctacaaaaaccgcccgaacctatccccgccgcgaaccgaacacgaaacccgcaaacctcgacgcgacccgactcctcccgtccgcccgcccctcgaccgaaaacccgcgcccgcccgcccgccctcccgactacaaaaccgactccgccgaacctccgcgacgcccgaacctcacttaactattccccgctaaaacgacgacgacgataactacgacgacgacgaatcccgactccgtctcacgcaaaaacaacttctcatcgcccgaacgacgcgaaaaaaaccgaacccgaaacccaaacgacaaaaaccgacgccgcaactcgaacgcgaacctcaccgaaaacgacgacgacgacgacgacgacgaaaaaacgaaacgcgacctaacgacgacgacgacaacgacaataacgacgacgactccctccgcgaaccgcgacgacgaaccgaactccgaacctcccgacgctaacgctaattcaaaatcgaaaaaaacgcccgacgcccgaaactaactcgaacgaaaaaaaaaaaaaaaaaccctaacgtcccgaacccgcgccgccgccccgaccgacaccccgcctccccaacctccccctcgacccaacccgtcaaccgcaaacaaaaccccgatacgcccacccgaacctccccgaacccgccgacgaccccaatccaacctcaaacccccgaaaacccacgacctctaaaac

SEQ ID NO: 4161 - DNA, 793 bp, Artificial Sequence
  chemically treated genomic DNA (Homo sapiens) CpG-island No: 4161
tcgtcgcggatgaagcggggttagaaacgtattgttttcgtttagatttagggttttaggtgtcgcgcgggtcgaagttttaatttttagggattttagatttttgtcggtgatttaaattttataattcgcgattagtatagttttgtcgttttcgtcgttatagtcgtcgttattttcggcgtagttcggtttcgcgagggcgtttgcgttcggcgacggtcgaaattggtttttcgcggttttcgtcgtcggattttcgttaatgttgttatcgtttttttttttttttttttagtttttttttattttcggggttgttttggattcgttggtttcgtaataatatttcgttggttttttttaggcggcgggattagtgtagtcgtcgttttttaggatcgttcgtcggttagggtttttgtttttttcggtataggttattatggttattaatttatagtcgtagtcgtttttttcggcgtcgtcgtttttttcgtcgtagtcgtagtcgtagttatcgtcgtcgtcgtcgggtttcggggttggtttcggcgcgggcggggcgggcggcgcgggtgcgggcgtcggggattcgtagttcgtggttatgatcgtgaattattttaagagttaggggtttttcgattagtttcgtagagattgtttggtcgacgtggatattaaggttaggagcgcgtcgggtttgggggtttgcgagggaaggggaggatttaagggcgcgttttttttgtagtggtttttttttggagttgtagttgtgtgttacgga

SEQ ID NO: 4162 - DNA, 793 bp, Artificial Sequence
  chemically treated genomic DNA (Homo sapiens) CpG-island No: 4162
tccgtaacacacaactacaactccaaaaaaaaaccactacaaaaaaaacgcgcccttaaatcctccccttccctcgcaaacccccaaacccgacgcgctcctaaccttaatatccacgtcgaccaaacaatctctacgaaactaatcgaaaaacccctaactcttaaaataattcacgatcataaccacgaactacgaatccccgacgcccgcacccgcgccgcccgccccgcccgcgccgaaaccaaccccgaaacccgacgacgacgacgataactacgactacgactacgacgaaaaaaacgacgacgccgaaaaaaacgactacgactataaattaataaccataataacctataccgaaaaaaacaaaaaccctaaccgacgaacgatcctaaaaaacgacgactacactaatcccgccgcctaaaaaaaaccaacgaaatattattacgaaaccaacgaatccaaaacaaccccgaaaataaaaaaaaactaaaaaaaaaaaaaaaaaaacgataacaacattaacgaaaatccgacgacgaaaaccgcgaaaaaccaatttcgaccgtcgccgaacgcaaacgccctcgcgaaaccgaactacgccgaaaataacgacgactataacgacgaaaacgacaaaactatactaatcgcgaattataaaatttaaatcaccgacaaaaatctaaaatccctaaaaattaaaacttcgacccgcgcgacacctaaaaccctaaatctaaacgaaaacaatacgtttctaaccccgcttcatccgcgacga

SEQ ID NO: 4163 - DNA, 793 bp, Artificial Sequence
  chemically treated genomic DNA (Homo sapiens) CpG-island No: 4163
ttcgtggtatatagttgtagttttaagaggaagttattgtaaaagaagcgcgtttttgggttttttttttttttcgtagatttttaaattcggcgcgtttttaattttggtgtttacgtcggttaggtagtttttgcggaattggtcgaagagtttttggtttttgaggtggtttacgattatggttacgagttgcgggttttcggcgttcgtattcgcgtcgttcgtttcgttcgcgtcggggttagtttcggggttcggcggcggcggcggtggttgcggttgcggttgcggcgggggaggcggcggcgtcggaggaggcggttgcggttgtgggttggtggttatggtggtttgtgtcggggagggtaagggttttgatcggcggacgattttgggaggcggcggttgtattggtttcgtcgtttgagggaagttaacgggatgttgttacggaattagcggatttagagtaatttcggaagtgaaagggaattgggggaaaggaggaaaagacggtgataatattgacgaaagttcggcgacggaggtcgcgaagagttagtttcgatcgtcgtcgggcgtaagcgttttcgcgaggtcgagttgcgtcggaagtggcggcgattgtggcgacggagacgataagattgtgttggtcgcgggttgtggggtttaggttatcggtaggggtttggagtttttggaggttagggtttcgattcgcgcgatatttggggttttaggtttgagcgggggtagtgcgtttttggtttcgttttattcgcgacgg

SEQ ID NO: 4164 - DNA, 793 bp, Artificial Sequence
  chemically treated genomic DNA (Homo sapiens) CpG-island No: 4164
ccgtcgcgaataaaacgaaaccaaaaacgcactacccccgctcaaacctaaaaccccaaatatcgcgcgaatcgaaaccctaacctccaaaaactccaaacccctaccgataacctaaaccccacaacccgcgaccaacacaatcttatcgtctccgtcgccacaatcgccgccacttccgacgcaactcgacctcgcgaaaacgcttacgcccgacgacgatcgaaactaactcttcgcgacctccgtcgccgaactttcgtcaatattatcaccgtcttttcctcctttcccccaattccctttcacttccgaaattactctaaatccgctaattccgtaacaacatcccgttaacttccctcaaacgacgaaaccaatacaaccgccgcctcccaaaatcgtccgccgatcaaaacccttaccctccccgacacaaaccaccataaccaccaacccacaaccgcaaccgcctcctccgacgccgccgcctcccccgccgcaaccgcaaccgcaaccaccgccgccgccgccgaaccccgaaactaaccccgacgcgaacgaaacgaacgacgcgaatacgaacgccgaaaacccgcaactcgtaaccataatcgtaaaccacctcaaaaaccaaaaactcttcgaccaattccgcaaaaactacctaaccgacgtaaacaccaaaattaaaaacgcgccgaatttaaaaatctacgaaaaaaaaaaaaaacccaaaaacgcgcttcttttacaataacttcctcttaaaactacaactatataccacgaa

SEQ ID NO: 4165 - DNA, 974 bp, Artificial Sequence
  chemically treated genomic DNA (Homo sapiens) CpG-island No: 4165
atttagttgagttgcgaaaggagagcgtttggttttggattcggggggagggggttttcgggcggggtgggtttttaaggtgggggcgagggtcggcgttgattttgggacggagtggggcgggagttgttgggtcgcgtagtagtgggcggcggcggtttcgtatatttagtttattcgcgttgcggtcgtcggcgttttttgtttcgttcggagttgttcggcgttttagttgttcgtttcgtcggtcgtttttgttcgcggcgtagatggttgtgcgcggcgttaatattttgacgtttttttttatttaggcgatttttaataagaaagaggagcgcggcgggttggtcgcgttagaggggcgttcggcgttcgggggtatagcggtatcggtggtcgcggttttcgttgtttgttgttggcggttttttggggagagggacgcgggcgcgttggggggcgtcgaggattttttgttggcgttttttgtcggtattagaatagttgcggggcggattgcggagagttcggaaggttgggattcggatttcgcgtttagcgaggagaacgagagtaggcggcgttgcgcggacgcgcggggggttagcggggtcggttttgcggggggatttttgagtttcggttagtcggtttgtgagttggtcgtttttaaagatttagaggaggaagtcgcgggtcggagcgatagcgagatgttcgttagcgttttaggtttgttgcggtttcgcggggatgggggtcgggttgaggggatggacgcggagggtaattacgtcgagtggggtggtcggtttgagtattttgcgttttggggttcggaggttggttaaatttcgaagttttgcgttttggcgcgagttgttttattatttcgggaattgagttcgcgagagatcggagtagttttttagagttttacgttttggggtgaggtttgagatattttgggt

SEQ ID NO: 4166 - DNA, 974 bp, Artificial Sequence
  chemically treated genomic DNA (Homo sapiens) CpG-island No: 4166
acccaaaatatctcaaacctcaccccaaaacgtaaaactctaaaaaactactccgatctctcgcgaactcaattcccgaaataataaaacaactcgcgccaaaacgcaaaacttcgaaatttaaccaacctccgaaccccaaaacgcaaaatactcaaaccgaccaccccactcgacgtaattaccctccgcgtccatcccctcaacccgacccccatccccgcgaaaccgcaacaaacctaaaacgctaacgaacatctcgctatcgctccgacccgcgacttcctcctctaaatctttaaaaacgaccaactcacaaaccgactaaccgaaactcaaaaatccccccgcaaaaccgaccccgctaaccccccgcgcgtccgcgcaacgccgcctactctcgttctcctcgctaaacgcgaaatccgaatcccaaccttccgaactctccgcaatccgccccgcaactattctaataccgacaaaaaacgccaacaaaaaatcctcgacgccccccaacgcgcccgcgtccctctccccaaaaaaccgccaacaacaaacaacgaaaaccgcgaccaccgataccgctatacccccgaacgccgaacgcccctctaacgcgaccaacccgccgcgctcctctttcttattaaaaatcgcctaaataaaaaaaaacgtcaaaatattaacgccgcgcacaaccatctacgccgcgaacaaaaacgaccgacgaaacgaacaactaaaacgccgaacaactccgaacgaaacaaaaaacgccgacgaccgcaacgcgaataaactaaatatacgaaaccgccgccgcccactactacgcgacccaacaactcccgccccactccgtcccaaaatcaacgccgaccctcgcccccaccttaaaaacccaccccgcccgaaaaccccctccccccgaatccaaaaccaaacgctctcctttcgcaactcaactaaat

SEQ ID NO: 4167 - DNA, 974 bp, Artificial Sequence
  chemically treated genomic DNA (Homo sapiens) CpG-island No: 4167
gtttaggatgttttaggttttattttaggacgtagggttttgaggagttatttcggtttttcgcgggtttagttttcgaagtgatagagtagttcgcgttagagcgtagaatttcgggatttggttagttttcgagttttagggcgtagggtgtttaagtcgattattttattcggcgtggttgtttttcgcgtttatttttttagttcggtttttattttcgcgaagtcgtagtagatttgagacgttggcggatatttcgttgtcgtttcggttcgcggtttttttttttaggtttttggaagcggttagtttatagatcggttggtcgaggtttaaggattttttcgtaaggtcggtttcgttggtttttcgcgcgttcgcgtagcgtcgtttgttttcgtttttttcgttgagcgcggagttcgagttttagtttttcgggtttttcgtagttcgtttcgtagttgttttggtatcggtaggagacgttagtagagagttttcggcgttttttaacgcgttcgcgtttttttttttaaagagtcgttaatagtagatagcgggagtcgcggttatcgatgtcgttgtgttttcgggcgtcgggcgtttttttggcgcggttagttcgtcgcgttttttttttttgttgaggatcgtttggatggagaaggacgttaaggtgttggcgtcgcgtatagttatttgcgtcgcgggtaggagcggtcggcggggcgggtagttggggcgtcgagtagtttcgagcgggatagagagcgtcggcggtcgtagcgcgagtgagttgggtgtgcgaggtcgtcgtcgtttattgttgcgcggtttagtagttttcgttttatttcgttttaggattagcgtcgattttcgtttttattttagaggtttatttcgttcggagatttttttttttcgaatttagagttagacgtttttttttcgtagtttagttggat

SEQ ID NO: 4168 - DNA, 974 bp, Artificial Sequence
  chemically treated genomic DNA (Homo sapiens) CpG-island No: 4168
atccaactaaactacgaaaaaaaaacgtctaactctaaattcgaaaaaaaaaaatctccgaacgaaataaacctctaaaataaaaacgaaaatcgacgctaatcctaaaacgaaataaaacgaaaactactaaaccgcgcaacaataaacgacgacgacctcgcacacccaactcactcgcgctacgaccgccgacgctctctatcccgctcgaaactactcgacgccccaactacccgccccgccgaccgctcctacccgcgacgcaaataactatacgcgacgccaacaccttaacgtccttctccatccaaacgatcctcaacaaaaaaaaaaaacgcgacgaactaaccgcgccaaaaaaacgcccgacgcccgaaaacacaacgacatcgataaccgcgactcccgctatctactattaacgactctttaaaaaaaaaaacgcgaacgcgttaaaaaacgccgaaaactctctactaacgtctcctaccgataccaaaacaactacgaaacgaactacgaaaaacccgaaaaactaaaactcgaactccgcgctcaacgaaaaaaacgaaaacaaacgacgctacgcgaacgcgcgaaaaaccaacgaaaccgaccttacgaaaaaatccttaaacctcgaccaaccgatctataaactaaccgcttccaaaaacctaaaaaaaaaaaccgcgaaccgaaacgacaacgaaatatccgccaacgtctcaaatctactacgacttcgcgaaaataaaaaccgaactaaaaaaataaacgcgaaaaacaaccacgccgaataaaataatcgacttaaacaccctacgccctaaaactcgaaaactaaccaaatcccgaaattctacgctctaacgcgaactactctatcacttcgaaaactaaacccgcgaaaaaccgaaataactcctcaaaaccctacgtcctaaaataaaacctaaaacatcctaaac

SEQ ID NO: 4169 - DNA, 542 bp, Artificial Sequence
  chemically treated genomic DNA (Homo sapiens) CpG-island No: 4169
tttttatcggggttcgtaggcgatcgtagtttaaggatcgaggacgacggtgttggttttagaggtgtatacgtgttcgcgttgtgtagcggggtcggcggcgggggcggtagcgggtcggtaggcgtcgcggaggaggaggaggagtcggcggcgtttaagttacgtaagaagcgttcgcgggtcgtttttttttacgcgtaggttttcgagttggagcgtcgttttaattattagcgttatttgttcgggttcgagcgcgtagatttggtcgcgtcgttgaagtttatcgagacgtaggtgaaaatttggttttagaatcgtcgttataagataaagcgtcggtagatggtagtcgatttgttggtttcggcgttcgtcgttaagaaggtggtcgtaaaggtgttggtgcgcgacgattagagataatatttgttcggcgaagtgttgcggttattttcgtttttgttattgtagtttttttattattattcgtattattgttttttaggttgggcgttttttatttgcgtagttgtcgt

SEQ ID NO: 4170 - DNA, 542 bp, Artificial Sequence
  chemically treated genomic DNA (Homo sapiens) CpG-island No: 4170
acgacaactacgcaaataaaaaacgcccaacctaaaaaacaataatacgaataataataaaaaaactacaataacaaaaacgaaaataaccgcaacacttcgccgaacaaatattatctctaatcgtcgcgcaccaacacctttacgaccaccttcttaacgacgaacgccgaaaccaacaaatcgactaccatctaccgacgctttatcttataacgacgattctaaaaccaaattttcacctacgtctcgataaacttcaacgacgcgaccaaatctacgcgctcgaacccgaacaaataacgctaataattaaaacgacgctccaactcgaaaacctacgcgtaaaaaaaaacgacccgcgaacgcttcttacgtaacttaaacgccgccgactcctcctcctcctccgcgacgcctaccgacccgctaccgcccccgccgccgaccccgctacacaacgcgaacacgtatacacctctaaaaccaacaccgtcgtcctcgatccttaaactacgatcgcctacgaaccccgataaaaa

SEQ ID NO: 4171 - DNA, 542 bp, Artificial Sequence
  chemically treated genomic DNA (Homo sapiens) CpG-island No: 4171
gcggtagttgcgtaggtggagagcgtttagtttgggaggtagtagtacgggtaatagtaggagggttgtagtggtagaagcgagggtggtcgtagtatttcgtcgggtaggtattgtttttggtcgtcgcgtattagtatttttacggttatttttttggcggcgggcgtcgaggttagtaggtcggttgttatttgtcggcgttttgttttgtagcgacggttttggaattagatttttatttgcgtttcggtgagttttagcgacgcggttaggtttgcgcgttcgggttcggataggtagcgttggtggttaaagcggcgttttagttcgaagatttgcgcgtgggagaaagcggttcgcgagcgttttttgcgtggtttgggcgtcgtcggtttttttttttttttcgcgacgtttgtcggttcgttgtcgttttcgtcgtcggtttcgttgtatagcgcggatacgtgtgtatttttggggttaatatcgtcgttttcggtttttgggttgcggtcgtttgcggatttcggtgggaa

SEQ ID NO: 4172 - DNA, 542 bp, Artificial Sequence
  chemically treated genomic DNA (Homo sapiens) CpG-island No: 4172
ttcccaccgaaatccgcaaacgaccgcaacccaaaaaccgaaaacgacgatattaaccccaaaaatacacacgtatccgcgctatacaacgaaaccgacgacgaaaacgacaacgaaccgacaaacgtcgcgaaaaaaaaaaaaaaaccgacgacgcccaaaccacgcaaaaaacgctcgcgaaccgctttctcccacgcgcaaatcttcgaactaaaacgccgctttaaccaccaacgctacctatccgaacccgaacgcgcaaacctaaccgcgtcgctaaaactcaccgaaacgcaaataaaaatctaattccaaaaccgtcgctacaaaacaaaacgccgacaaataacaaccgacctactaacctcgacgcccgccgccaaaaaaataaccgtaaaaatactaatacgcgacgaccaaaaacaatacctacccgacgaaatactacgaccaccctcgcttctaccactacaaccctcctactattacccgtactactacctcccaaactaaacgctctccacctacgcaactaccgc

SEQ ID NO: 4173 - DNA, 738 bp, Artificial Sequence
  chemically treated genomic DNA (Homo sapiens) CpG-island No: 4173
ttcgtcgttcgttcgttcggtatagagttcgtttcgttttttttagttcgtttttttagtacgtttttttttttcgatttcgttaagtttcgcggttttttttttttttttatcgttttagcggcggttagcggcggtatcggttgggttttcgatattataatttttaggagtagtcgtcgtttttttatagtattaggcgagtcgttgcgttagcgttaattttaatttttagtttgttttatttttttttttcgtttttttttttcgtcggaattcgtcgtcgtcgtcgtcgtcgtcgtcgttttaggaatatagttagtttttcgttcgttttgttttttttttttcggtttttttttttttttatttttcgttagtagtcgtagtcgtagtcgtagtcgtttttttttacgggcgcgttttcgtcgttatttagatgcgcggtttcgcgttgcggtttcgttttaagcgttgcgttcgtagatgtattttcgttcgtttttcggttacgtttttaagttcgtttcgtcggttttagtttcgtttggagtggttggaaggtattttagcgggcggtttggagatttgattttattttcggggcgtggtttcgttcggggtgtttagaggtcggagtatcgttgggaggagagttggtttatttggaggagggaatgcgattttgagcgggttaagttttagtgggttagagtaggattttgatggaatttgcgg

SEQ ID NO: 4174 - DNA, 738 bp, Artificial Sequence
  chemically treated genomic DNA (Homo sapiens) CpG-island No: 4174
ccgcaaattccatcaaaatcctactctaacccactaaaacttaacccgctcaaaatcgcattccctcctccaaataaaccaactctcctcccaacgatactccgacctctaaacaccccgaacgaaaccacgccccgaaaataaaatcaaatctccaaaccgcccgctaaaataccttccaaccactccaaacgaaactaaaaccgacgaaacgaacttaaaaacgtaaccgaaaaacgaacgaaaatacatctacgaacgcaacgcttaaaacgaaaccgcaacgcgaaaccgcgcatctaaataacgacgaaaacgcgcccgtaaaaaaaaacgactacgactacgactacgactactaacgaaaaataaaaaaaaaaaaaaaccgaaaaaaaaaaaacaaaacgaacgaaaaactaactatattcctaaaacgacgacgacgacgacgacgacgacgaattccgacgaaaaaaaaaaacgaaaaaaaaaaataaaacaaactaaaaattaaaattaacgctaacgcaacgactcgcctaatactataaaaaaacgacgactactcctaaaaattataatatcgaaaacccaaccgataccgccgctaaccgccgctaaaacgataaaaaaaaaaaaaaaaccgcgaaacttaacgaaatcgaaaaaaaaaaacgtactaaaaaaacgaactaaaaaaaacgaaacgaactctataccgaacgaacgaacgacgaa

SEQ ID NO: 4175 - DNA, 738 bp, Artificial Sequence
  chemically treated genomic DNA (Homo sapiens) CpG-island No: 4175
tcgtaaattttattagaattttattttgatttattagggtttggttcgtttagagtcgtatttttttttttaaatgaattaattttttttttagcgatatttcgatttttgagtatttcgggcggggttacgtttcggaaatggagttaggtttttaggtcgttcgttgaagtgttttttagttattttaagcggggttggggtcggcggggcgggtttgggggcgtggtcgggaggcgggcggggatgtatttgcgggcgtagcgtttggggcggagtcgtagcgcgaggtcgcgtatttgggtggcggcggggacgcgttcgtggggagaggcggttgcggttgcggttgcggttgttggcggggggtgggggggaggaggaatcgggaaggggggggtagggcgagcggagagttagttgtgtttttgaggcggcggcggcggcggcggcggcggcgggtttcgacggaggaggagggcggggaaggaggatggagtaagttgggggttggggttggcgttagcgtagcggttcgtttggtattgtgggagagcggcggttgtttttggaagttgtggtgtcgggagtttagtcggtgtcgtcgttagtcgtcgttagggcggtggggaggaggagggagtcgcggggtttggcggggtcgggagggagggacgtgttgggggaacgagttggggaagacggagcgggttttgtgtcgggcgggcgggcggcggg

SEQ ID NO: 4176 - DNA, 738 bp, Artificial Sequence
  chemically treated genomic DNA (Homo sapiens) CpG-island No: 4176
cccgccgcccgcccgcccgacacaaaacccgctccgtcttccccaactcgttcccccaacacgtccctccctcccgaccccgccaaaccccgcgactccctcctcctccccaccgccctaacgacgactaacgacgacaccgactaaactcccgacaccacaacttccaaaaacaaccgccgctctcccacaataccaaacgaaccgctacgctaacgccaaccccaacccccaacttactccatcctccttccccgccctcctcctccgtcgaaacccgccgccgccgccgccgccgccgccgcctcaaaaacacaactaactctccgctcgccctaccccccccttcccgattcctcctcccccccaccccccgccaacaaccgcaaccgcaaccgcaaccgcctctccccacgaacgcgtccccgccgccacccaaatacgcgacctcgcgctacgactccgccccaaacgctacgcccgcaaatacatccccgcccgcctcccgaccacgcccccaaacccgccccgccgaccccaaccccgcttaaaataactaaaaaacacttcaacgaacgacctaaaaacctaactccatttccgaaacgtaaccccgcccgaaatactcaaaaatcgaaatatcgctaaaaaaaaaattaattcatttaaaaaaaaaaatacgactctaaacgaaccaaaccctaataaatcaaaataaaattctaataaaatttacga

SEQ ID NO: 4177 - DNA, 1142 bp, Artificial Sequence
  chemically treated genomic DNA (Homo sapiens) CpG-island No: 4177
tgtttcgcgtttgtacgcgtacgtatatatttatatatattcgtatagatatatttatatatagatatataagcgcgtatatatatatacgcgcgcgcgcggatatatatatatttatattcgcgtttcgagggatttagtacggcgtagggcgggggtttatcggttttttgtaggttttcgaggcgcgagacggcggcgttcgggtttagttttgggagttagttcgagttcgggaggaacgtttggatcgcgttttgtatagtttcgggattaggcgggaatttagattttcgtttgtagagtcgtttttttcgttaggtttaggtcgcgcgagtcgttttttttttttttcgcgcgttttttttttcgttttttttttttttttagttcgattttgtattttttggttcggttcggttttattttttcgcgggcggcgttacgcgggttttggggcgtattttgggggtttcggggcgggtcgggacggttggcggcgcggttcgggggcgggcggcggcgggtgtcggggacgttatggtttttcgtttttcgtttttttgttcgtcgagtttttttcggtcgttcgtaagtttttgggggtttttcgttcgcgcgcgtttttcgtggggttttcgtcgttttcggttttagcggcgcgtttttttcggtcggtttagcgtaggttcgttcgcggtttttgtttttttttgtcgtggtttcgcgacgatttgcgcgacgcgtttttttttttcgatttatttcgttcggtttagtgagttaattcgtagttggcggtcgttcggtcgggttgttacggtaattttttttttagggttcggttcgcgcggagttgcggtaaataggattttttgtcggattcgttttttcgtttttcggggtgggggagaggtggtttaattttttttgggaggacgttcgtcgcgcgcgggttttattttatttaggttcgggcggattcgcgaggtgttttcggtttgaggtttagatttggacgtttaagtttggggaacggcgtcgcgtgttcggtttcgtttattttaggtagttaatatattttcggtatcgggtcggggtcgggggtatttcgggtagtgagttaggtattatttttgttt

SEQ ID NO: 4178 - DNA, 1142 bp, Artificial Sequence
  chemically treated genomic DNA (Homo sapiens) CpG-island No: 4178
aaacaaaaataatacctaactcactacccgaaatacccccgaccccgacccgataccgaaaatatattaactacctaaaataaacgaaaccgaacacgcgacgccgttccccaaacttaaacgtccaaatctaaacctcaaaccgaaaacacctcgcgaatccgcccgaacctaaataaaataaaacccgcgcgcgacgaacgtcctcccaaaaaaaattaaaccacctctcccccaccccgaaaaacgaaaaaacgaatccgacaaaaaatcctatttaccgcaactccgcgcgaaccgaaccctaaaaaaaaaattaccgtaacaacccgaccgaacgaccgccaactacgaattaactcactaaaccgaacgaaataaatcgaaaaaaaaaaacgcgtcgcgcaaatcgtcgcgaaaccacgacaaaaaaaaacaaaaaccgcgaacgaacctacgctaaaccgaccgaaaaaaacgcgccgctaaaaccgaaaacgacgaaaaccccacgaaaaacgcgcgcgaacgaaaaacccccaaaaacttacgaacgaccgaaaaaaactcgacgaacaaaaaaacgaaaaacgaaaaaccataacgtccccgacacccgccgccgcccgcccccgaaccgcgccgccaaccgtcccgacccgccccgaaacccccaaaatacgccccaaaacccgcgtaacgccgcccgcgaaaaaataaaaccgaaccgaaccaaaaaatacaaaatcgaactaaaaaaaaaaaaaaaacgaaaaaaaaaacgcgcgaaaaaaaaaaaaaacgactcgcgcgacctaaacctaacgaaaaaaacgactctacaaacgaaaatctaaattcccgcctaatcccgaaactatacaaaacgcgatccaaacgttcctcccgaactcgaactaactcccaaaactaaacccgaacgccgccgtctcgcgcctcgaaaacctacaaaaaaccgataaacccccgccctacgccgtactaaatccctcgaaacgcgaatataaatatatatatatccgcgcgcgcgcgtatatatatatacgcgcttatatatctatatataaatatatctatacgaatatatataaatatatacgtacgcgtacaaacgcgaaaca

SEQ ID NO: 4179 - DNA, 1142 bp, Artificial Sequence
  chemically treated genomic DNA (Homo sapiens) CpG-island No: 4179
gggtaagggtggtgtttgatttattgttcgaggtgttttcggtttcggttcggtgtcgagagtgtgttaattgtttagagtaagcggggtcgggtacgcggcgtcgttttttaggtttggacgtttaggtttaagttttaggtcggaagtatttcgcgaattcgttcgggtttgggtggaatggagttcgcgcgcggcgggcgtttttttaggaagggttaagttattttttttttatttcgagaggcgagggggcgagttcggtagaaggttttgtttatcgtagtttcgcgcgggtcgggttttgggagaggagttgtcgtggtaattcggtcgggcgatcgttagttgcggattagtttattgggtcgggcgggatgggtcgggaggagggggcgcgtcgcgtagatcgtcgcggagttacggtaggaggaggtaggggtcgcgggcgagtttgcgttgggtcggtcgagggaagcgcgtcgttggggtcgggggcggcggggattttacgggagacgcgcgcggacggggaatttttaggggtttgcgggcggtcgggggaggttcggcggataaaggggcggagggcggagggttatggcgttttcggtattcgtcgtcgttcgttttcgagtcgcgtcgttagtcgtttcggttcgtttcggagtttttaagatgcgttttagagttcgcgtagcgtcgttcgcggggaggtagggtcgggtcgggttagggggtgtagggtcgagttggggagggaaaggggacggaggaggggacgcgcgggggagggaggaaacggttcgcgcggtttgagtttgacgggggaagcggttttgtagacgggagtttgagttttcgtttggtttcgggattgtgtagagcgcgatttaggcgtttttttcgggttcgggttgatttttaggattgagttcggacgtcgtcgtttcgcgtttcggggatttgtagaaagtcggtagattttcgttttgcgtcgtgttgggtttttcggggcgcgagtgtgagtgtgtgtgtgttcgcgcgcgcgcgtgtgtgtgtgtgcgcgtttgtgtgtttgtgtgtgagtgtgtttgtgcgagtgtgtgtgagtgtgtgcgtgcgcgtgtaagcgcggggta

SEQ ID NO: 4180 - DNA, 1142 bp, Artificial Sequence
  chemically treated genomic DNA (Homo sapiens) CpG-island No: 4180
taccccgcgcttacacgcgcacgcacacactcacacacactcgcacaaacacactcacacacaaacacacaaacgcgcacacacacacacgcgcgcgcgcgaacacacacacactcacactcgcgccccgaaaaacccaacacgacgcaaaacgaaaatctaccgactttctacaaatccccgaaacgcgaaacgacgacgtccgaactcaatcctaaaaatcaacccgaacccgaaaaaaacgcctaaatcgcgctctacacaatcccgaaaccaaacgaaaactcaaactcccgtctacaaaaccgcttcccccgtcaaactcaaaccgcgcgaaccgtttcctccctcccccgcgcgtcccctcctccgtcccctttccctccccaactcgaccctacaccccctaacccgacccgaccctacctccccgcgaacgacgctacgcgaactctaaaacgcatcttaaaaactccgaaacgaaccgaaacgactaacgacgcgactcgaaaacgaacgacgacgaataccgaaaacgccataaccctccgccctccgcccctttatccgccgaacctcccccgaccgcccgcaaacccctaaaaattccccgtccgcgcgcgtctcccgtaaaatccccgccgcccccgaccccaacgacgcgcttccctcgaccgacccaacgcaaactcgcccgcgacccctacctcctcctaccgtaactccgcgacgatctacgcgacgcgccccctcctcccgacccatcccgcccgacccaataaactaatccgcaactaacgatcgcccgaccgaattaccacgacaactcctctcccaaaacccgacccgcgcgaaactacgataaacaaaaccttctaccgaactcgccccctcgcctctcgaaataaaaaaaaaataacttaacccttcctaaaaaaacgcccgccgcgcgcgaactccattccacccaaacccgaacgaattcgcgaaatacttccgacctaaaacttaaacctaaacgtccaaacctaaaaaacgacgccgcgtacccgaccccgcttactctaaacaattaacacactctcgacaccgaaccgaaaccgaaaacacctcgaacaataaatcaaacaccacccttaccc

SEQ ID NO: 4181 - DNA, 620 bp, Artificial Sequence
  chemically treated genomic DNA (Homo sapiens) CpG-island No: 4181
ggagacgcgttagggcgttattattttttcgaggttcgcgtttaggcggttcgttttttattttagaggcgttcgtttaggcgaggttgcggtgaagcgaagttcggttttgattcgcggacggagttcgtatttggtcggaatatcgtttcgttttttttagtatttcgtttgtttttaggtcggaggattcgcgtttcgttcgatattcgtcgcgtcgcgtcgcgtcgcgcggaaggggttgttagacggtattaattgcggaacgggaggagttaggatttacgcgaagttaggtttcgggcgttcgcgatttgagcgagggggtcgcgcgggcggaggtaggggtcgggtagtcgtagggttatcgtgcgtttaggggttagtatgagatcgttggggtggcgggtattagtttagggcgcgggcgtaggcgggggtcgggagggcggggcggagcgtggagggcgggcggagcgtcgggggcggagcgtcgggggcgggcgggagtgtaggtgtagggaatcgaggtatcgagggttgtggtggagcggaggggcgcgggagatggatgggacgggttcggttattaggttgaaatcgttattgtaaaattataa

SEQ ID NO: 4182 - DNA, 620 bp, Artificial Sequence
  chemically treated genomic DNA (Homo sapiens) CpG-island No: 4182
ttataattttacaataacgatttcaacctaataaccgaacccgtcccatccatctcccgcgcccctccgctccaccacaaccctcgatacctcgattccctacacctacactcccgcccgcccccgacgctccgcccccgacgctccgcccgccctccacgctccgccccgccctcccgacccccgcctacgcccgcgccctaaactaatacccgccaccccaacgatctcatactaacccctaaacgcacgataaccctacgactacccgacccctacctccgcccgcgcgaccccctcgctcaaatcgcgaacgcccgaaacctaacttcgcgtaaatcctaactcctcccgttccgcaattaataccgtctaacaaccccttccgcgcgacgcgacgcgacgcgacgaatatcgaacgaaacgcgaatcctccgacctaaaaacaaacgaaatactaaaaaaaacgaaacgatattccgaccaaatacgaactccgtccgcgaatcaaaaccgaacttcgcttcaccgcaacctcgcctaaacgaacgcctctaaaataaaaaacgaaccgcctaaacgcgaacctcgaaaaaataataacgccctaacgcgtctcc

SEQ ID NO: 4183 - DNA, 620 bp, Artificial Sequence
  chemically treated genomic DNA (Homo sapiens) CpG-island No: 4183
ttataattttgtaatggcggttttaatttagtggtcgaattcgttttatttatttttcgcgttttttcgttttattatagttttcggtgtttcggttttttgtatttgtattttcgttcgttttcgacgtttcgttttcgacgtttcgttcgttttttacgtttcgtttcgttttttcggttttcgtttgcgttcgcgttttgggttggtgttcgttattttagcgattttatattggtttttgggcgtacggtgattttgcggttgttcggtttttgttttcgttcgcgcggttttttcgtttaggtcgcgggcgttcggggtttggtttcgcgtgggttttggtttttttcgtttcgtagttggtgtcgtttgatagtttttttcgcgcggcgcggcgcggcgcggcgggtgtcgggcggggcgcgggtttttcggtttgaggataggcgaggtgttggagggagcggggcggtatttcggttagatgcgagtttcgttcgcgggttagggtcgggtttcgttttatcgtagtttcgtttgagcgggcgtttttgaagtggagggcgggtcgtttgggcgcgggtttcgggaggatggtggcgttttggcgcgttttt

SEQ ID NO: 4184 - DNA, 620 bp, Artificial Sequence
  chemically treated genomic DNA (Homo sapiens) CpG-island No: 4184
aaaaacgcgccaaaacgccaccatcctcccgaaacccgcgcccaaacgacccgccctccacttcaaaaacgcccgctcaaacgaaactacgataaaacgaaacccgaccctaacccgcgaacgaaactcgcatctaaccgaaataccgccccgctccctccaacacctcgcctatcctcaaaccgaaaaacccgcgccccgcccgacacccgccgcgccgcgccgcgccgcgcgaaaaaaactatcaaacgacaccaactacgaaacgaaaaaaaccaaaacccacgcgaaaccaaaccccgaacgcccgcgacctaaacgaaaaaaccgcgcgaacgaaaacaaaaaccgaacaaccgcaaaatcaccgtacgcccaaaaaccaatataaaatcgctaaaataacgaacaccaacccaaaacgcgaacgcaaacgaaaaccgaaaaaacgaaacgaaacgtaaaaaacgaacgaaacgtcgaaaacgaaacgtcgaaaacgaacgaaaatacaaatacaaaaaaccgaaacaccgaaaactataataaaacgaaaaaacgcgaaaaataaataaaacgaattcgaccactaaattaaaaccgccattacaaaattataa

SEQ ID NO: 4185 - DNA, 508 bp, Artificial Sequence
  chemically treated genomic DNA (Homo sapiens) CpG-island No: 4185
tttatatcgtatatttttagagcgtcgtgtgacgtttttagtttcgttagtaaaacggattcggtattttaatttttttcggagggaaaatgtacgagttagggtcgcgtttttcgtcgttttggtatatagaatgttttcgggaatcgtttatacgagttcggggtcgtttttttttttcggcggcggtcgcgcggagttcgtttttttcggatatcgtttttaaagtgttcgcgtggtttcgcgatttagtcgttttaagttcgttcgtggtcgtttagtcgcgaaagtgtttcgtatttggcggatcgggagtggcgatcgttcgtttcggtacgtatttagttagcggttgtagcggttttggcgcgtttttttcgaggattgtttagttttaatttcgaagcgacggttttcggtttttttttttttggcggttgtaggagtcgggacgttttcgttttatcgagggggaagggaaggtggtgggcgcgtttttttttttttt

SEQ ID NO: 4186 - DNA, 508 bp, Artificial Sequence
  chemically treated genomic DNA (Homo sapiens) CpG-island No: 4186
aaaaaaaaaaaaaacgcgcccaccaccttcccttccccctcgataaaacgaaaacgtcccgactcctacaaccgccaaaaaaaaaaaaaccgaaaaccgtcgcttcgaaattaaaactaaacaatcctcgaaaaaaacgcgccaaaaccgctacaaccgctaactaaatacgtaccgaaacgaacgatcgccactcccgatccgccaaatacgaaacactttcgcgactaaacgaccacgaacgaacttaaaacgactaaatcgcgaaaccacgcgaacactttaaaaacgatatccgaaaaaaacgaactccgcgcgaccgccgccgaaaaaaaaaaacgaccccgaactcgtataaacgattcccgaaaacattctatataccaaaacgacgaaaaacgcgaccctaactcgtacattttccctccgaaaaaaattaaaataccgaatccgttttactaacgaaactaaaaacgtcacacgacgctctaaaaatatacgatataaa

SEQ ID NO: 4187 - DNA, 508 bp, Artificial Sequence
  chemically treated genomic DNA (Homo sapiens) CpG-island No: 4187
ggagggagagagagcgcgtttattatttttttttttttttcgatggagcgggggcgtttcggtttttgtagtcgttagaggagggagagtcgggggtcgtcgtttcggagttggggttgagtagttttcggggagagcgcgttaagatcgttgtagtcgttggttgagtacgtatcggagcggacggtcgttattttcggttcgttaagtgcgggatattttcgcggttgagcggttacgggcgaatttggggcggttgagtcgcggggttacgcgggtattttgggggcggtgttcgggggaagcgggtttcgcgcggtcgtcgtcggaaggagagggcggtttcgggttcgtgtgggcgattttcggagatattttgtgtgttagggcggcggggagcgcggttttgattcgtgtatttttttttcgagaaaggttggggtgtcgagttcgttttgttaacggggttgggggcgttatacggcgttttgggggtgtgcgatgtggg

SEQ ID NO: 4188 - DNA, 508 bp, Artificial Sequence
  chemically treated genomic DNA (Homo sapiens) CpG-island No: 4188
cccacatcgcacacccccaaaacgccgtataacgcccccaaccccgttaacaaaacgaactcgacaccccaacctttctcgaaaaaaaaatacacgaatcaaaaccgcgctccccgccgccctaacacacaaaatatctccgaaaatcgcccacacgaacccgaaaccgccctctccttccgacgacgaccgcgcgaaacccgcttcccccgaacaccgcccccaaaatacccgcgtaaccccgcgactcaaccgccccaaattcgcccgtaaccgctcaaccgcgaaaatatcccgcacttaacgaaccgaaaataacgaccgtccgctccgatacgtactcaaccaacgactacaacgatcttaacgcgctctccccgaaaactactcaaccccaactccgaaacgacgacccccgactctccctcctctaacgactacaaaaaccgaaacgcccccgctccatcgaaaaaaaaaaaaaaataataaacgcgctctctctccctcc

SEQ ID NO: 4189 - DNA, 578 bp, Artificial Sequence
  chemically treated genomic DNA (Homo sapiens) CpG-island No: 4189
tcgggttcgcgtttttttcgtttatcgttcgacgtagttcgttttgcgcgggggcgtaggcggtttttttagcgttgcggcgtttcgcgcgtcggtcgggtaggttttttttcgtcgtgtttgttatttttttttttgtttttttcgagcgagttatatttttatttttttttttcgttcgatttcgtcgtttttatttttatattcggggttgttatattgggagattttttttttgttatattcgtcgtttcgttttcgtttacgcgcggtcgagtgacgtagatttcgacgtgggtcgcgtcgggcgggggcgggggcgtcgttgggttacggttcggttttttttcgtcgtttttttcgcggaattcggaggacggtttatttatacggtagttgggaggaattaagtgggcgtcgggagtgggcggttttcgcgagtttcgtttcgggcgcggggaggggacgataaagagggagacgggtggggaacgtcgttttcggtttgttttttagttgcggagtgaattgggaaggtttgtaattaaaaaaaaaaaattatgtgtgaggttttcgat

SEQ ID NO: 4190 - DNA, 578 bp, Artificial Sequence
  chemically treated genomic DNA (Homo sapiens) CpG-island No: 4190
atcgaaaacctcacacataattttttttttttaattacaaaccttcccaattcactccgcaactaaaaaacaaaccgaaaacgacgttccccacccgtctccctctttatcgtcccctccccgcgcccgaaacgaaactcgcgaaaaccgcccactcccgacgcccacttaattcctcccaactaccgtataaataaaccgtcctccgaattccgcgaaaaaaacgacgaaaaaaaaccgaaccgtaacccaacgacgcccccgcccccgcccgacgcgacccacgtcgaaatctacgtcactcgaccgcgcgtaaacgaaaacgaaacgacgaatataacaaaaaaaaaatctcccaatataacaaccccgaatataaaaataaaaacgacgaaatcgaacgaaaaaaaaaaataaaaatataactcgctcgaaaaaaacaaaaaaaaaaataacaaacacgacgaaaaaaaacctacccgaccgacgcgcgaaacgccgcaacgctaaaaaaaccgcctacgcccccgcgcaaaacgaactacgtcgaacgataaacgaaaaaaacgcgaacccga

SEQ ID NO: 4191 - DNA, 578 bp, Artificial Sequence
  chemically treated genomic DNA (Homo sapiens) CpG-island No: 4191
atcgggaattttatatataattttttttttttaattgtaaatttttttagtttatttcgtagttggagagtaggtcggaggcggcgttttttattcgtttttttttttgtcgtttttttttcgcgttcggagcgggattcgcgggagtcgtttattttcggcgtttatttggttttttttagttgtcgtgtgaatgggtcgtttttcggatttcgcggagggggcggcgggaaggggtcgagtcgtagtttagcggcgttttcgttttcgttcggcgcgatttacgtcgggatttgcgttattcggtcgcgcgtgggcggaagcggagcggcgaatgtagtaagaggggaattttttaatgtgataatttcggatgtgggagtggaggcggcggagtcgggcgggggagggggatgaaggtgtagttcgttcggggaaggtaggggaagggatggtaagtacggcgggggaggatttgttcggtcggcgcgcggagcgtcgtagcgttggaggagtcgtttgcgttttcgcgtagagcgagttgcgtcgggcggtgggcggaagaagcgcgggttcga

SEQ ID NO: 4192 - DNA, 578 bp, Artificial Sequence
  chemically treated genomic DNA (Homo sapiens) CpG-island No: 4192
tcgaacccgcgcttcttccgcccaccgcccgacgcaactcgctctacgcgaaaacgcaaacgactcctccaacgctacgacgctccgcgcgccgaccgaacaaatcctcccccgccgtacttaccatcccttcccctaccttccccgaacgaactacaccttcatccccctcccccgcccgactccgccgcctccactcccacatccgaaattatcacattaaaaaattcccctcttactacattcgccgctccgcttccgcccacgcgcgaccgaataacgcaaatcccgacgtaaatcgcgccgaacgaaaacgaaaacgccgctaaactacgactcgaccccttcccgccgccccctccgcgaaatccgaaaaacgacccattcacacgacaactaaaaaaaaccaaataaacgccgaaaataaacgactcccgcgaatcccgctccgaacgcgaaaaaaaaacgacaaaaaaaaaaacgaataaaaaacgccgcctccgacctactctccaactacgaaataaactaaaaaaatttacaattaaaaaaaaaaaattatatataaaattcccgat

SEQ ID NO: 4193 - DNA, 693 bp, Artificial Sequence
  chemically treated genomic DNA (Homo sapiens) CpG-island No: 4193
tttttcgtagacggagttaagttggattgtcgcgtcgcgcggggcgggtaaagggggcgttgcgttcggtttcgggtagggagtgacggcggcggcggcggtttcgggcgagcgtggttttcgcgtgcgtatacgtatacgtcgtcgcgtagggatatacggatttcggtcgttagtcggttatataggcgcggagattcggttcggcgcgcgtttttcggcgatacgttttttattttcgcgtcgcgcgggtcgcggatttgtaggttgcgcgttttttgcggagtttgtttcggttttacggataggtttcgtagtgagtaggtaagggtcgtttcgtcgcggttgtttttttacgtttcggtcgttttttttttttttagaattttcgtttagtcgggatttcggatttttttttttggtttggcggttttcgttagtcgcgatttttatcgacggagagcgggcgagggtcggcgttaggtaagttttttagatttgaaatgaagttttttttcgtcgttgcgttttttttgcgcgttaggttgatattttttaatttaagtgtttggcgttgcgttcggggcggtcgatcgtcgtagattgtcggggtgggggtcgatttagttattttacgttttttttgatgcggagaagggagattaggggggtaggtaagttatgcggtcggag

SEQ ID NO: 4194 - DNA, 693 bp, Artificial Sequence
  chemically treated genomic DNA (Homo sapiens) CpG-island No: 4194
ctccgaccgcataacttacctacccccctaatctcccttctccgcatcaaaaaaaacgtaaaataactaaatcgacccccaccccgacaatctacgacgatcgaccgccccgaacgcaacgccaaacacttaaattaaaaaatatcaacctaacgcgcaaaaaaaacgcaacgacgaaaaaaaacttcatttcaaatctaaaaaacttacctaacgccgaccctcgcccgctctccgtcgataaaaatcgcgactaacgaaaaccgccaaaccaaaaaaaaaaatccgaaatcccgactaaacgaaaattctaaaaaaaaaaaaaacgaccgaaacgtaaaaaaacaaccgcgacgaaacgacccttacctactcactacgaaacctatccgtaaaaccgaaacaaactccgcaaaaaacgcgcaacctacaaatccgcgacccgcgcgacgcgaaaataaaaaacgtatcgccgaaaaacgcgcgccgaaccgaatctccgcgcctatataaccgactaacgaccgaaatccgtatatccctacgcgacgacgtatacgtatacgcacgcgaaaaccacgctcgcccgaaaccgccgccgccgccgtcactccctacccgaaaccgaacgcaacgccccctttacccgccccgcgcgacgcgacaatccaacttaactccgtctacgaaaaa

SEQ ID NO: 4195 - DNA, 693 bp, Artificial Sequence
  chemically treated genomic DNA (Homo sapiens) CpG-island No: 4195
tttcggtcgtatggtttgtttgtttttttggtttttttttttcgtattaggaggggcgtgagatagttaggtcgatttttatttcggtagtttgcggcgatcggtcgtttcgagcgtagcgttagatatttgggttggggggtgttagtttgacgcgtaggaagggcgtagcggcgggagggggttttattttagatttgggaggtttgtttggcgtcggttttcgttcgtttttcgtcggtggaggtcgcggttggcggagatcgttaagttagaggaggggattcgaggtttcggttgggcgaaggttttggagggggagaagacggtcgaggcgtggaggggtagtcgcggcggggcgatttttatttgtttattgcggggtttgttcgtggggtcggggtagatttcgtaaaggacgcgtagtttgtaagttcgcggttcgcgcggcgcggggatggggagcgtgtcgtcgaggagcgcgcgtcgagtcgggttttcgcgtttgtgtggtcggttggcggtcggggttcgtgtgtttttgcgcggcggcgtgtgcgtgtgcgtacgcggggattacgttcgttcggagtcgtcgtcgtcgtcgttattttttgttcggggtcgagcgtagcgttttttttgttcgtttcgcgcggcgcggtagtttagtttggtttcgtttgcgggaag

SEQ ID NO: 4196 - DNA, 693 bp, Artificial Sequence
  chemically treated genomic DNA (Homo sapiens) CpG-island No: 4196
cttcccgcaaacgaaaccaaactaaactaccgcgccgcgcgaaacgaacaaaaaaaacgctacgctcgaccccgaacaaaaaataacgacgacgacgacgactccgaacgaacgtaatccccgcgtacgcacacgcacacgccgccgcgcaaaaacacacgaaccccgaccgccaaccgaccacacaaacgcgaaaacccgactcgacgcgcgctcctcgacgacacgctccccatccccgcgccgcgcgaaccgcgaacttacaaactacgcgtcctttacgaaatctaccccgaccccacgaacaaaccccgcaataaacaaataaaaatcgccccgccgcgactacccctccacgcctcgaccgtcttctccccctccaaaaccttcgcccaaccgaaacctcgaatcccctcctctaacttaacgatctccgccaaccgcgacctccaccgacgaaaaacgaacgaaaaccgacgccaaacaaacctcccaaatctaaaataaaaccccctcccgccgctacgcccttcctacgcgtcaaactaacaccccccaacccaaatatctaacgctacgctcgaaacgaccgatcgccgcaaactaccgaaataaaaatcgacctaactatctcacgcccctcctaatacgaaaaaaaaaaaccaaaaaaacaaacaaaccatacgaccgaaa

SEQ ID NO: 4197 - DNA, 602 bp, Artificial Sequence
  chemically treated genomic DNA (Homo sapiens) CpG-island No: 4197
gcgcgcggcgtttcgggttttgtagttttggatagattttcgaggtttatggtgtcgtgcggcgggtcgttgcgtttgcgcggtgcgagcggcgggtagcgtagattgcgaggtttttttgttcggttgaggggagggtcgttggtcggggtttgcggtacgtcgttttagtgagggacgttattgcggttattcggtttgttgtttttttgggcgttatttttttaggcgattcgacgcgacgcgttagtagcgtagtatcgatttttttcgggtttttgggcgttgttttgaggtgaggagttcgttggaggcgggagagttgggggagggggcgcggcggcggcggcggcgggagttttgcgtgagggaacgcgttttcgaggcggaggttaggagcggggagcgcgttcgggtttagcgttttgttttttcgtttttcgcgttgagtttttcgtttgtcgttgaggcgtcggtgttagttgcgtgaaggatggagagggcggggcgcgaattttgagttagagattgagtgtttgggggtgggtcgagtatttgggggtcgtttttcggggttcgggtggtttggaataatgttgttt

SEQ ID NO: 4198 - DNA, 602 bp, Artificial Sequence
  chemically treated genomic DNA (Homo sapiens) CpG-island No: 4198
aaacaacattattccaaaccacccgaaccccgaaaaacgacccccaaatactcgacccacccccaaacactcaatctctaactcaaaattcgcgccccgccctctccatccttcacgcaactaacaccgacgcctcaacgacaaacgaaaaactcaacgcgaaaaacgaaaaaacaaaacgctaaacccgaacgcgctccccgctcctaacctccgcctcgaaaacgcgttccctcacgcaaaactcccgccgccgccgccgccgcgccccctcccccaactctcccgcctccaacgaactcctcacctcaaaacaacgcccaaaaacccgaaaaaaatcgatactacgctactaacgcgtcgcgtcgaatcgcctaaaaaaataacgcccaaaaaaacaacaaaccgaataaccgcaataacgtccctcactaaaacgacgtaccgcaaaccccgaccaacgaccctcccctcaaccgaacaaaaaaacctcgcaatctacgctacccgccgctcgcaccgcgcaaacgcaacgacccgccgcacgacaccataaacctcgaaaatctatccaaaactacaaaacccgaaacgccgcgcgc

SEQ ID NO: 4199 - DNA, 602 bp, Artificial Sequence
  chemically treated genomic DNA (Homo sapiens) CpG-island No: 4199
aagtaatattgttttagattattcgggtttcgaagagcggtttttaagtgttcggtttatttttaagtatttagtttttggtttaggattcgcgtttcgttttttttattttttacgtagttggtatcgacgttttagcgataggcgaagagtttagcgcgggaagcggagaagtaggacgttggattcgggcgcgtttttcgtttttaattttcgtttcgaaagcgcgtttttttacgtagggttttcgtcgtcgtcgtcgtcgcgtttttttttttagttttttcgtttttagcgggttttttattttagagtagcgtttaagagttcgagaggaatcggtgttgcgttgttggcgcgtcgcgtcgggtcgtttgggggagtggcgtttaggaaggtagtaagtcgggtggtcgtagtggcgttttttattgaagcggcgtatcgtaggtttcggttaacggttttttttttagtcgaataaaagagtttcgtagtttgcgttgttcgtcgttcgtatcgcgtaggcgtaacgattcgtcgtacggtattatgggtttcgggggtttgtttaagattataaggttcgaagcgtcgcgcgt

SEQ ID NO: 4200 - DNA, 602 bp, Artificial Sequence
  chemically treated genomic DNA (Homo sapiens) CpG-island No: 4200
acgcgcgacgcttcgaaccttataatcttaaacaaacccccgaaacccataataccgtacgacgaatcgttacgcctacgcgatacgaacgacgaacaacgcaaactacgaaactcttttattcgactaaaaaaaaaaccgttaaccgaaacctacgatacgccgcttcaataaaaaacgccactacgaccacccgacttactaccttcctaaacgccactcccccaaacgacccgacgcgacgcgccaacaacgcaacaccgattcctctcgaactcttaaacgctactctaaaataaaaaacccgctaaaaacgaaaaaactaaaaaaaaaaacgcgacgacgacgacgacgaaaaccctacgtaaaaaaacgcgctttcgaaacgaaaattaaaaacgaaaaacgcgcccgaatccaacgtcctacttctccgcttcccgcgctaaactcttcgcctatcgctaaaacgtcgataccaactacgtaaaaaataaaaaaaacgaaacgcgaatcctaaaccaaaaactaaatacttaaaaataaaccgaacacttaaaaaccgctcttcgaaacccgaataatctaaaacaatattactt

SEQ ID NO: 4201 - DNA, 699 bp, Artificial Sequence
  chemically treated genomic DNA (Homo sapiens) CpG-island No: 4201
gggcggcgggaagttagtgtttgcgtcggggttttcgttgtttttttcgtcgttgtcgtcgggtttattttcggagttcgaggtttcgacgtttttatttatggtttcgatagatgttttttcgtcgtcggtgtcgtttgggtcggaggtcgagttttcggggtcgtcgtcgtttttttcgttttcgtcgtcgggtttcgcgaacgagttagttcgcgttttgttcgagtttttagggtcgtttttcgaaggttcgtcgtcgtttatggcgtcgagtataggtttaggttgcggggttcgggttgttcgggttgttttagtcgtcgtcgttgtcgtcgtttttttcgggttttggttttttttaggtcgcgtcgttttggtttgggtttcggtttcggtttagcgttcgtcgcggggtacgtcgggagatgtagttcggttgtcgttcgcgtcgtcgttatcgttttcggttcgtatagagagtcgcgtggtacgtcgggaaatgaagtttataaaagttttagagtagatcgcgggaatgatgggcgggaatgacgggttacgttgtacgtcgggaaatggagtttagggtaatttgttagtcgattgtacgacggggagttttgaagtattttaggaagtagagagtttgatgtacgttgggaaacggagtttatttatttagtttattagttgtgt

SEQ ID NO: 4202 - DNA, 699 bp, Artificial Sequence
  chemically treated genomic DNA (Homo sapiens) CpG-island No: 4202
acacaactaataaactaaataaataaactccgtttcccaacgtacatcaaactctctacttcctaaaatacttcaaaactccccgtcgtacaatcgactaacaaattaccctaaactccatttcccgacgtacaacgtaacccgtcattcccgcccatcattcccgcgatctactctaaaacttttataaacttcatttcccgacgtaccacgcgactctctatacgaaccgaaaacgataacgacgacgcgaacgacaaccgaactacatctcccgacgtaccccgcgacgaacgctaaaccgaaaccgaaacccaaaccaaaacgacgcgacctaaaaaaaaccaaaacccgaaaaaaacgacgacaacgacgacgactaaaacaacccgaacaacccgaaccccgcaacctaaacctatactcgacgccataaacgacgacgaaccttcgaaaaacgaccctaaaaactcgaacaaaacgcgaactaactcgttcgcgaaacccgacgacgaaaacgaaaaaaacgacgacgaccccgaaaactcgacctccgacccaaacgacaccgacgacgaaaaaacatctatcgaaaccataaataaaaacgtcgaaacctcgaactccgaaaataaacccgacgacaacgacgaaaaaaacaacgaaaaccccgacgcaaacactaacttcccgccgccc

SEQ ID NO: 4203 - DNA, 699 bp, Artificial Sequence
  chemically treated genomic DNA (Homo sapiens) CpG-island No: 4203
atatagttaatagattgagtgagtggatttcgttttttagcgtgtattaggttttttgttttttaaagtgttttagggtttttcgtcgtatagtcggttgatagattattttggattttatttttcgacgtatagcgtgattcgttattttcgtttattattttcgcggtttattttgaggtttttgtggattttatttttcggcgtgttacgcggttttttgtgcgggtcgagggcggtgacggcggcgcggacgatagtcggattgtatttttcggcgtgtttcgcggcgggcgttgggtcggagtcggagtttaagttagagcggcgcggtttggaagaggttagggttcgggggaggcggcggtagcggcggcggttggggtagttcgggtagttcgagtttcgtagtttgggtttgtgttcggcgttatgagcggcggcgggttttcgggaggcggttttgggggttcgggtagggcgcggattagttcgttcgcggagttcggcggcggaggcggaggaggcggcggcggtttcggaggttcggttttcggtttaggcggtatcggcggcggaaaggtatttgtcggggttatgggtgggggcgtcggggtttcgagtttcgggggtggattcggcggtagcggcggaggaggtagcggaggtttcggcgtaggtattagtttttcgtcgttt

SEQ ID NO: 4204 - DNA, 699 bp, Artificial Sequence
  chemically treated genomic DNA (Homo sapiens) CpG-island No: 4204
aaacgacgaaaaactaatacctacgccgaaacctccgctacctcctccgccgctaccgccgaatccacccccgaaactcgaaaccccgacgcccccacccataaccccgacaaatacctttccgccgccgataccgcctaaaccgaaaaccgaacctccgaaaccgccgccgcctcctccgcctccgccgccgaactccgcgaacgaactaatccgcgccctacccgaacccccaaaaccgcctcccgaaaacccgccgccgctcataacgccgaacacaaacccaaactacgaaactcgaactacccgaactaccccaaccgccgccgctaccgccgcctcccccgaaccctaacctcttccaaaccgcgccgctctaacttaaactccgactccgacccaacgcccgccgcgaaacacgccgaaaaatacaatccgactatcgtccgcgccgccgtcaccgccctcgacccgcacaaaaaaccgcgtaacacgccgaaaaataaaatccacaaaaacctcaaaataaaccgcgaaaataataaacgaaaataacgaatcacgctatacgtcgaaaaataaaatccaaaataatctatcaaccgactatacgacgaaaaaccctaaaacactttaaaaaacaaaaaacctaatacacgctaaaaaacgaaatccactcactcaatctattaactatat

SEQ ID NO: 4205 - DNA, 516 bp, Artificial Sequence
  chemically treated genomic DNA (Homo sapiens) CpG-island No: 4205
tttgtgtcgggttttcgttttttttattggttgtcgtttcgttcgttgatcgttgattggtcgagatttgttttttcgtttttgagcgattaatttttgcgttgtcgcgttttcgggttgggtggggtatttttttttttatcgtagatagttcgggtgttagttggtcggcgtttcgtcgcggttcgcgtgggtgttaggtcggtcgggtattcgttcgttttttttgtataaagcggttttgtggagtttgtcgggggttggttgggggttaggcggcgagtggaaaatttcgtgagcgcggggaggggaggggaacgtagggcggcgtttttttttttgttcgggttttggcgttttttttagttcgcgtcgattaatttttttagtttaagcgtttgtatatttttttttcgttttcgtatttttttttttttaaatttacgttttttaatttttttattttcgtattttatttattttttaatttttggggattattttttatatattttt

SEQ ID NO: 4206 - DNA, 516 bp, Artificial Sequence
  chemically treated genomic DNA (Homo sapiens) CpG-island No: 4206
aaaaatatataaaaaataatccccaaaaattaaaaaataaataaaatacgaaaataaaaaaattaaaaaacgtaaatttaaaaaaaaaaaaatacgaaaacgaaaaaaaaatatacaaacgcttaaactaaaaaaattaatcgacgcgaactaaaaaaaacgccaaaacccgaacaaaaaaaaaaacgccgccctacgttcccctcccctccccgcgctcacgaaattttccactcgccgcctaacccccaaccaacccccgacaaactccacaaaaccgctttatacaaaaaaaacgaacgaatacccgaccgacctaacacccacgcgaaccgcgacgaaacgccgaccaactaacacccgaactatctacgataaaaaaaaaaataccccacccaacccgaaaacgcgacaacgcaaaaattaatcgctcaaaaacgaaaaaacaaatctcgaccaatcaacgatcaacgaacgaaacgacaaccaataaaaaaaacgaaaacccgacacaaa

SEQ ID NO: 4207 - DNA, 516 bp, Artificial Sequence
  chemically treated genomic DNA (Homo sapiens) CpG-island No: 4207
gagagtgtgtgggggatggtttttagggattgggagatgggtgggatgcgggggtgggggggttgagagacgtgggtttggggaagggaaggtgcgggggcgggaaaggggtgtataggcgtttgggttgggagggttggtcggcgcgggttgagggaggcgttaaggttcgagtagaggagggggcgtcgttttgcgtttttttttttttttcgcgtttacgagattttttattcgtcgtttggtttttagttaattttcggtaggttttataaagtcgttttgtgtagggagggcggacgggtgttcggtcggtttgatatttacgcgggtcgcggcggggcgtcggttagttggtattcgagttgtttgcggtgggagggagggtattttatttagttcgaggacgcggtagcgtaggggttaatcgtttaggggcggagaagtaggtttcggttaattagcggttagcgggcgagacggtagttaatgagaaggacggaggttcgatatagg

SEQ ID NO: 4208 - DNA, 516 bp, Artificial Sequence
  chemically treated genomic DNA (Homo sapiens) CpG-island No: 4208
cctatatcgaacctccgtccttctcattaactaccgtctcgcccgctaaccgctaattaaccgaaacctacttctccgcccctaaacgattaacccctacgctaccgcgtcctcgaactaaataaaataccctccctcccaccgcaaacaactcgaataccaactaaccgacgccccgccgcgacccgcgtaaatatcaaaccgaccgaacacccgtccgccctccctacacaaaacgactttataaaacctaccgaaaattaactaaaaaccaaacgacgaataaaaaatctcgtaaacgcgaaaaaaaaaaaaaaacgcaaaacgacgccccctcctctactcgaaccttaacgcctccctcaacccgcgccgaccaaccctcccaacccaaacgcctatacacccctttcccgcccccgcaccttcccttccccaaacccacgtctctcaacccccccacccccgcatcccacccatctcccaatccctaaaaaccatcccccacacactctc

SEQ ID NO: 4209 - DNA, 1226 bp, Artificial Sequence
  chemically treated genomic DNA (Homo sapiens) CpG-island No: 4209
gtttaggcgggtgtgcgggaggcgggtcgagtcgcgcgtgagcgtgtttttcgcgcggattggatatataatagtattacgtataatttagagattttcgtagcgcggcgtttcgaatcgtttttttggttcggtgtttttattgtagtgcgttttttttgttatttttttatcgcggtttcgttttcggtcggttcggggttaatcggagttcgtttcgttttgtttttatttgtatatgattgacgttttttcggggcggttaatgggggcgggcgcggcggggtttgattcgcgcgcggcggcggtagttaatgggtttacgcgcggggggtcgggtttgcgcggaaggtcgcgggggaagcggggaaggggcggggggaggcgcggcggggggaggggagcgcgtagtagtggcggggcggggaggcggtggtggttcggcgcggggttcgttcggagcgtacggacgtacgtacgttggttcgtttgttcgttcggggtcggaggtcgattcggcgttgagtttcgggttcggggttcggaaaggcggggcggcggcgtcggtagtcgggacgcgcggggttagagtcgttattcgtcggagttgcgagggagggagggaacgagcgagttagcgagcggggaagggagggggtcgttttcgcgtacgcgcgtcgcgtttcgtttcgtttgtttcgtttgtttcgttcgtcggatttcgcgagggaggagggagagggagggggcggtgtcgatggttttcgtgtcgcgcgtttcgtgacggttttcgcgcgcgtcggggggcggggcggggtcggtgcgcgttgatttttttcgtttttcgggcggcgggaggtaggcggcgttgtgcgtaggcgcgttcggtagagattttcgcgtggggcggtcggaggggggcggcgggggggggggtatgcggcgacggtttttcgtttttttcgggtttaagcggcgacggtcgaggagcgggttgcgggcggagcggcgtcggtcgttgaggaggtgcgagtttttgtcgggttttttttgcgtcggattatgtattcggtttataggtttttgatgttcgcgtttagcgcggtttttcgtggtttcggtatgttcggttagtagcgtttgggttttgggattgtaggggttaaggtgtcggggtgttaagtgcggagtaacggtggtgggggtatagtaggggagagaatagt

SEQ ID NO: 4210 - DNA, 1226 bp, Artificial Sequence
  chemically treated genomic DNA (Homo sapiens) CpG-island No: 4210
actattctctcccctactatacccccaccaccgttactccgcacttaacaccccgacaccttaacccctacaatcccaaaacccaaacgctactaaccgaacataccgaaaccacgaaaaaccgcgctaaacgcgaacatcaaaaacctataaaccgaatacataatccgacgcaaaaaaaacccgacaaaaactcgcacctcctcaacgaccgacgccgctccgcccgcaacccgctcctcgaccgtcgccgcttaaacccgaaaaaaacgaaaaaccgtcgccgcatacccccccccccgccgcccccctccgaccgccccacgcgaaaatctctaccgaacgcgcctacgcacaacgccgcctacctcccgccgcccgaaaaacgaaaaaaatcaacgcgcaccgaccccgccccgccccccgacgcgcgcgaaaaccgtcacgaaacgcgcgacacgaaaaccatcgacaccgccccctccctctccctcctccctcgcgaaatccgacgaacgaaacaaacgaaacaaacgaaacgaaacgcgacgcgcgtacgcgaaaacgaccccctcccttccccgctcgctaactcgctcgttccctccctccctcgcaactccgacgaataacgactctaaccccgcgcgtcccgactaccgacgccgccgccccgcctttccgaaccccgaacccgaaactcaacgccgaatcgacctccgaccccgaacgaacaaacgaaccaacgtacgtacgtccgtacgctccgaacgaaccccgcgccgaaccaccaccgcctccccgccccgccactactacgcgctcccctccccccgccgcgcctccccccgccccttccccgcttcccccgcgaccttccgcgcaaacccgaccccccgcgcgtaaacccattaactaccgccgccgcgcgcgaatcaaaccccgccgcgcccgcccccattaaccgccccgaaaaaacgtcaatcatatacaaataaaaacaaaacgaaacgaactccgattaaccccgaaccgaccgaaaacgaaaccgcgataaaaaaataacaaaaaaaacgcactacaataaaaacaccgaaccaaaaaaacgattcgaaacgccgcgctacgaaaatctctaaattatacgtaatactattatatatccaatccgcgcgaaaaacacgctcacgcgcgactcgacccgcctcccgcacacccgcctaaac

SEQ ID NO: 4211 - DNA, 1226 bp, Artificial Sequence
  chemically treated genomic DNA (Homo sapiens) CpG-island No: 4211
attgtttttttttttattatatttttattatcgttatttcgtatttagtatttcgatattttgatttttgtagttttagggtttaggcgttattgatcgaatatgtcgaggttacgggaggtcgcgttggacgcgggtattaggggtttgtgggtcgaatatatggttcggcgtaggggggattcggtaggggttcgtatttttttagcggtcgacgtcgtttcgttcgtagttcgtttttcggtcgtcgtcgtttgggttcggggggagcgggaggtcgtcgtcgtatgttttttttttcgtcgttttttttcggtcgttttacgcgggggtttttgtcgggcgcgtttgcgtatagcgtcgtttgtttttcgtcgttcggggggcgggggaggttagcgcgtatcggtttcgtttcgtttttcggcgcgcgcgggggtcgttacggggcgcgcggtacgggggttatcggtatcgtttttttttttttttttttttttcgcggagttcggcgggcggggtaggcggggtaggcggggcggggcgcgacgcgcgtgcgcgggggcggttttttttttttttcgttcgttggttcgttcgttttttttttttttcgtagtttcggcgggtaacggttttggtttcgcgcgtttcggttgtcggcgtcgtcgtttcgttttttcgggtttcgggttcgaggtttagcgtcgggtcgattttcggtttcgggcgggtagacggattagcgtgcgtgcgttcgtgcgtttcgagcgagtttcgcgtcgaattattatcgttttttcgtttcgttattattacgcgttttttttttttcgtcgcgttttttttcgtttttttttcgtttttttcgcggtttttcgcgtaagttcggtttttcgcgcgtgagtttattggttgtcgtcgtcgcgcgcgggttaggtttcgtcgcgttcgtttttattggtcgtttcgggggaacgttagttatatgtaaataagggtagggcggggcgggtttcggttggtttcgagtcggtcgggggcggggtcgcggtaggagggtggtagggagggcgtattgtagtaaaggtatcgagttaggggggcggttcggggcgtcgcgttgcggaggtttttgggttgtgcgtggtgttgttgtgtgtttagttcgcgcgaggaatacgtttacgcgcggttcggttcgtttttcgtatattcgtttgggt

SEQ ID NO: 4212 - DNA, 1226 bp, Artificial Sequence
  chemically treated genomic DNA (Homo sapiens) CpG-island No: 4212
acccaaacgaatatacgaaaaacgaaccgaaccgcgcgtaaacgtattcctcgcgcgaactaaacacacaacaacaccacgcacaacccaaaaacctccgcaacgcgacgccccgaaccgcccccctaactcgatacctttactacaatacgccctccctaccaccctcctaccgcgaccccgcccccgaccgactcgaaaccaaccgaaacccgccccgccctacccttatttacatataactaacgttcccccgaaacgaccaataaaaacgaacgcgacgaaacctaacccgcgcgcgacgacgacaaccaataaactcacgcgcgaaaaaccgaacttacgcgaaaaaccgcgaaaaaaacgaaaaaaaaacgaaaaaaaacgcgacgaaaaaaaaaaaacgcgtaataataacgaaacgaaaaaacgataataattcgacgcgaaactcgctcgaaacgcacgaacgcacgcacgctaatccgtctacccgcccgaaaccgaaaatcgacccgacgctaaacctcgaacccgaaacccgaaaaaacgaaacgacgacgccgacaaccgaaacgcgcgaaaccaaaaccgttacccgccgaaactacgaaaaaaaaaaaaaacgaacgaaccaacgaacgaaaaaaaaaaaaaaccgcccccgcgcacgcgcgtcgcgccccgccccgcctaccccgcctaccccgcccgccgaactccgcgaaaaaaaaaaaaaaaaaaaaaaacgataccgataacccccgtaccgcgcgccccgtaacgacccccgcgcgcgccgaaaaacgaaacgaaaccgatacgcgctaacctcccccgccccccgaacgacgaaaaacaaacgacgctatacgcaaacgcgcccgacaaaaacccccgcgtaaaacgaccgaaaaaaaacgacgaaaaaaaaaacatacgacgacgacctcccgctccccccgaacccaaacgacgacgaccgaaaaacgaactacgaacgaaacgacgtcgaccgctaaaaaaatacgaacccctaccgaatcccccctacgccgaaccatatattcgacccacaaacccctaatacccgcgtccaacgcgacctcccgtaacctcgacatattcgatcaataacgcctaaaccctaaaactacaaaaatcaaaatatcgaaatactaaatacgaaataacgataataaaaatataataaaaaaaaaaacaat

SEQ ID NO: 4213 - DNA, 554 bp, Artificial Sequence
  chemically treated genomic DNA (Homo sapiens) CpG-island No: 4213
gaacgtttattagggatatttagcgttcgtcgttttgtacgttttgtatcggcgtgggtttgttggttgggtttttttttttatttattttggcgtcgtagtttttgtaggatgagcgagtcgggtcggttcgggagtgtttcgaacggagttggtttcgttacgtttatttttatttttcgcggtaataaaggatcgttttaacgttagtatattcgcggaggacgaaggtcgatatagggcgtcgttttttttttagggacggaagtttttatttaggaggtaggtggaattaggaattttcgttttttttacgacggtcgtatagtgggttcgttcggcgtttttcgttcgggtcgttgatttttaggtcgcgtattcggtacggggtggggggagggagaggcgagattatttagttttcgaggcggggaggagggagaaattatttatcggttacggggaggggcgaattatttgaagagtcgagagtgggcggggaaaatttagttttttgtttagtaaatgggaagaaattatttgttgtatagagt

SEQ ID NO: 4214 - DNA, 554 bp, Artificial Sequence
  chemically treated genomic DNA (Homo sapiens) CpG-island No: 4214
actctatacaacaaataatttcttcccatttactaaacaaaaaactaaattttccccgcccactctcgactcttcaaataattcgcccctccccgtaaccgataaataatttctccctcctccccgcctcgaaaactaaataatctcgcctctccctccccccaccccgtaccgaatacgcgacctaaaaatcaacgacccgaacgaaaaacgccgaacgaacccactatacgaccgtcgtaaaaaaaacgaaaattcctaattccacctacctcctaaataaaaacttccgtccctaaaaaaaaaacgacgccctatatcgaccttcgtcctccgcgaatatactaacgttaaaacgatcctttattaccgcgaaaaataaaaataaacgtaacgaaaccaactccgttcgaaacactcccgaaccgacccgactcgctcatcctacaaaaactacgacgccaaaataaataaaaaaaaaaacccaaccaacaaacccacgccgatacaaaacgtacaaaacgacgaacgctaaatatccctaataaacgttc

SEQ ID NO: 4215 - DNA, 554 bp, Artificial Sequence
  chemically treated genomic DNA (Homo sapiens) CpG-island No: 4215
attttgtatagtaaatggtttttttttatttgttagatagagggttagatttttttcgtttattttcgattttttaggtagttcgttttttttcgtgatcggtgggtggtttttttttttttttcgtttcgggagttggatggtttcgtttttttttttttttatttcgtgtcgggtgcgcggtttgggagttagcggttcgagcgggaagcgtcgggcgagtttattgtgcggtcgtcgtgggggaagcgaaggtttttgattttatttattttttaagtgaaggttttcgtttttggagaggaggcggcgttttgtatcggttttcgtttttcgcgggtgtgttagcgttgggacggttttttgttgtcgcgaggggtaggagtgggcgtggcggagttagtttcgttcggaatattttcgggtcgattcgattcgtttattttgtaggagttgcggcgttaagatgagtggagaggagaatttagttagtaagtttacgtcggtgtaggacgtatagggcgacgggcgttggatgtttttggtgagcgttt

SEQ ID NO: 4216 - DNA, 554 bp, Artificial Sequence
  chemically treated genomic DNA (Homo sapiens) CpG-island No: 4216
aaacgctcaccaaaaacatccaacgcccgtcgccctatacgtcctacaccgacgtaaacttactaactaaattctcctctccactcatcttaacgccgcaactcctacaaaataaacgaatcgaatcgacccgaaaatattccgaacgaaactaactccgccacgcccactcctacccctcgcgacaacaaaaaaccgtcccaacgctaacacacccgcgaaaaacgaaaaccgatacaaaacgccgcctcctctccaaaaacgaaaaccttcacttaaaaaataaataaaatcaaaaaccttcgcttcccccacgacgaccgcacaataaactcgcccgacgcttcccgctcgaaccgctaactcccaaaccgcgcacccgacacgaaataaaaaaaaaaaaaaacgaaaccatccaactcccgaaacgaaaaaaaaaaaaaaaccacccaccgatcacgaaaaaaaacgaactacctaaaaaatcgaaaataaacgaaaaaaatctaaccctctatctaacaaataaaaaaaaaccatttactatacaaaat

SEQ ID NO: 4217 - DNA, 1025 bp, Artificial Sequence
  chemically treated genomic DNA (Homo sapiens) CpG-island No: 4217
gagttgggttggggcggggagttcgggacgacgggatggaataatggaggaggtcggagggattggaggtagaggggattcggtaaggataatggggatcggttagataatgggggggaggggcgtcggagggagaggttggggagcgggagagaggttgagaagtgggttagggagggtagaagaggggcgacggcgagggcggtagagagatggaagtagaaggaaaggagatagagcggggcgcggattttgaagtggtcggggtttcgtttgttcgttgagggatagtgagacgagaagagagagtagaggtttggatatttttagcgtttgttttcgcgtttttgttcgcggttttttttagtttcggaattggggttgcggatttaaggttgggaggggagtgtttatttcgtcggggcgaattcgttttcggggtttttttacggtcggcgggttttttcgacgcgcgtgtttttacggtttgaagtagcgtagcggatcgcgagggacggagcgggtgtgtttttattcgggttggcggtggttacgtttcggggtgtagagcgtcggggcgtattaggcggggattttttttggtcgcgcgtagttttggttacgtaggcgggaggcggtaggtagggggcgttgcggggcgaggtaagtgtagttcgtcgttgtttgtttgcgagtttggggttgcgcgtcgttttttatttagttgcgcgattcgagcgtagcgtttatcgcgtttcgtgggttttcgcgtttcgaagggtcgggattcggtttgagttttttttggttttcggtgtaagtcgttgggtatttaacgagacgggggcgttcggacgtttcggattttgtagcgcggtatttcgggttatcgattcggtaaaggtcggcgggtttttcgggtggttcgacgagattgttagatgtggtttgttttatggttatgaatcgaatgttttggaaggtttggtaacggaggaggcgtttttatttttttcgttagtatt

SEQ ID NO: 4218 - DNA, 1025 bp, Artificial Sequence
  chemically treated genomic DNA (Homo sapiens) CpG-island No: 4218
aatactaacgaaaaaaataaaaacgcctcctccgttaccaaaccttccaaaacattcgattcataaccataaaacaaaccacatctaacaatctcgtcgaaccacccgaaaaacccgccgacctttaccgaatcgataacccgaaataccgcgctacaaaatccgaaacgtccgaacgcccccgtctcgttaaatacccaacgacttacaccgaaaaccaaaaaaaactcaaaccgaatcccgacccttcgaaacgcgaaaacccacgaaacgcgataaacgctacgctcgaatcgcgcaactaaataaaaaacgacgcgcaaccccaaactcgcaaacaaacaacgacgaactacacttacctcgccccgcaacgccccctacctaccgcctcccgcctacgtaaccaaaactacgcgcgaccaaaaaaaatccccgcctaatacgccccgacgctctacaccccgaaacgtaaccaccgccaacccgaataaaaacacacccgctccgtccctcgcgatccgctacgctacttcaaaccgtaaaaacacgcgcgtcgaaaaaacccgccgaccgtaaaaaaaccccgaaaacgaattcgccccgacgaaataaacactcccctcccaaccttaaatccgcaaccccaattccgaaactaaaaaaaaccgcgaacaaaaacgcgaaaacaaacgctaaaaatatccaaacctctactctctcttctcgtctcactatccctcaacgaacaaacgaaaccccgaccacttcaaaatccgcgccccgctctatctcctttccttctacttccatctctctaccgccctcgccgtcgcccctcttctaccctccctaacccacttctcaacctctctcccgctccccaacctctccctccgacgcccctcccccccattatctaaccgatccccattatccttaccgaatcccctctacctccaatccctccgacctcctccattattccatcccgtcgtcccgaactccccgccccaacccaactc

SEQ ID NO: 4219 - DNA, 1025 bp, Artificial Sequence
  chemically treated genomic DNA (Homo sapiens) CpG-island No: 4219
gatgttggcggggagagtgaagacgtttttttcgttgttagattttttagggtattcggtttatggttataaagtaggttatatttgataatttcgtcggattattcggaggattcgtcgatttttgtcgagtcggtggttcgggatatcgcgttatagaattcgaggcgttcgggcgttttcgtttcgttaggtgtttagcggtttgtatcgagagttaggagaggtttagatcggatttcgatttttcgaggcgcgggagtttacggagcgcggtgggcgttgcgttcgggtcgcgtagttaggtggggagcggcgcgtagttttagattcgtaggtaggtagcggcggattgtatttgtttcgtttcgtagcgttttttgtttgtcgtttttcgtttgcgtagttagagttgcgcgcggttaggaagggttttcgtttagtgcgtttcggcgttttgtatttcgagacgtagttatcgttagttcgggtaggggtatattcgtttcgtttttcgcgattcgttgcgttgttttaagtcgtgagaatacgcgcgtcggaggagttcgtcggtcgtgggggaatttcgggagcgggttcgtttcggcgaagtgggtattttttttttagttttagattcgtagttttaatttcgggattgggagaggtcgcgagtaggagcgcggggataggcgttggaaatgtttaagtttttgtttttttttttcgttttattgttttttagcgggtaggcgggatttcgattattttagggttcgcgtttcgttttgttttttttttttttgtttttatttttttgtcgttttcgtcgtcgttttttttttgttttttttaatttattttttaatttttttttcgttttttaattttttttttcgacgttttttttttttattgtttggtcggtttttattgtttttgtcgggttttttttgtttttagttttttcgattttttttattgttttatttcgtcgtttcgggtttttcgttttagtttagttt

SEQ ID NO: 4220 - DNA, 1025 bp, Artificial Sequence
  chemically treated genomic DNA (Homo sapiens) CpG-island No: 4220
aaactaaactaaaacgaaaaacccgaaacgacgaaataaaacaataaaaaaaatcgaaaaaactaaaaacaaaaaaaacccgacaaaaacaataaaaaccgaccaaacaataaaaaaaaaaaacgtcgaaaaaaaaaattaaaaaacgaaaaaaaaattaaaaaataaattaaaaaaaacaaaaaaaaaacgacgacgaaaacgacaaaaaaataaaaacaaaaaaaaaaaaaacaaaacgaaacgcgaaccctaaaataatcgaaatcccgcctacccgctaaaaaacaataaaacgaaaaaaaaaaacaaaaacttaaacatttccaacgcctatccccgcgctcctactcgcgacctctcccaatcccgaaattaaaactacgaatctaaaactaaaaaaaaaatacccacttcgccgaaacgaacccgctcccgaaattcccccacgaccgacgaactcctccgacgcgcgtattctcacgacttaaaacaacgcaacgaatcgcgaaaaacgaaacgaatatacccctacccgaactaacgataactacgtctcgaaatacaaaacgccgaaacgcactaaacgaaaacccttcctaaccgcgcgcaactctaactacgcaaacgaaaaacgacaaacaaaaaacgctacgaaacgaaacaaatacaatccgccgctacctacctacgaatctaaaactacgcgccgctccccacctaactacgcgacccgaacgcaacgcccaccgcgctccgtaaactcccgcgcctcgaaaaatcgaaatccgatctaaacctctcctaactctcgatacaaaccgctaaacacctaacgaaacgaaaacgcccgaacgcctcgaattctataacgcgatatcccgaaccaccgactcgacaaaaatcgacgaatcctccgaataatccgacgaaattatcaaatataacctactttataaccataaaccgaataccctaaaaaatctaacaacgaaaaaaacgtcttcactctccccgccaacatc

SEQ ID NO: 4221 - DNA, 772 bp, Artificial Sequence
  chemically treated genomic DNA (Homo sapiens) CpG-island No: 4221
gttatttcgttttcgcgtgtcgtttttttttggttggagagtcggcgttttaggttttcgggttgcgggtcggtaggggaggagttaatttcggaggtatcggttgggtttattgtatttgtcgtcgtcgtcgtcgtcgtcggtgggagggacgaggaagcgggagtcgtttgggcgttaggagcgttttagtttggcggggcgtagcgtagcgcggggagcgggcggtcggggtttcgcgcggttgggggcgttcgttagggggcgcgtcgcgacggggcgggtggagtagtttggtttggggaattagtattaaggacgggcgcgcgcgtaggtttttagtatatttgggcgagagcggcgtcgttggagtcgaggggggcgtcgagcgtagatttggagtagtagagttacggcgtagttggggtttttcgaggcgttcggggcgtatatttgggatttcgagcgggggtcgtgtcgcgcgtagttggattaggggaggggggcggcggttgtatagttggatcgaagggggcggggtcggttttgggcgattcgttgaggggagggtcgcgggtcgtcggggattggagtatgggacggcgcgtttgaaggagtaggaaggggaaggaggtttgggatttcgaaaagagaaggggagagcgaggggacgagagcggaggaggaagatgtaattgattcgttgttgtttcgtgtttttggtgtagggtagtttttatttggtgagtggttcgaggggagttgcgtagag

SEQ ID NO: 4222 - DNA, 772 bp, Artificial Sequence
  chemically treated genomic DNA (Homo sapiens) CpG-island No: 4222
ctctacgcaactcccctcgaaccactcaccaaataaaaactaccctacaccaaaaacacgaaacaacaacgaatcaattacatcttcctcctccgctctcgtcccctcgctctccccttctcttttcgaaatcccaaacctccttccccttcctactccttcaaacgcgccgtcccatactccaatccccgacgacccgcgaccctcccctcaacgaatcgcccaaaaccgaccccgcccccttcgatccaactatacaaccgccgcccccctcccctaatccaactacgcgcgacacgacccccgctcgaaatcccaaatatacgccccgaacgcctcgaaaaaccccaactacgccgtaactctactactccaaatctacgctcgacgcccccctcgactccaacgacgccgctctcgcccaaatatactaaaaacctacgcgcgcgcccgtccttaatactaattccccaaaccaaactactccacccgccccgtcgcgacgcgccccctaacgaacgcccccaaccgcgcgaaaccccgaccgcccgctccccgcgctacgctacgccccgccaaactaaaacgctcctaacgcccaaacgactcccgcttcctcgtccctcccaccgacgacgacgacgacgacgacaaatacaataaacccaaccgatacctccgaaattaactcctcccctaccgacccgcaacccgaaaacctaaaacgccgactctccaaccaaaaaaaaacgacacgcgaaaacgaaataac

SEQ ID NO: 4223 - DNA, 772 bp, Artificial Sequence
  chemically treated genomic DNA (Homo sapiens) CpG-island No: 4223
ttttgcgtagtttttttcggattatttattagatagaggttattttgtattaggaatacgaagtagtagcgagttagttgtatttttttttttcgttttcgttttttcgtttttttttttttttttcggggttttaggttttttttttttttttgtttttttaggcgcgtcgttttatgttttagttttcggcggttcgcggttttttttttagcgggtcgtttagggtcgatttcgtttttttcggtttagttgtgtagtcgtcgttttttttttttggtttagttgcgcgcggtacggttttcgttcgaggttttagatgtgcgtttcgagcgtttcgaagggttttagttgcgtcgtggttttgttgttttagatttgcgttcggcgtttttttcggttttagcggcgtcgttttcgtttagatgtgttggggatttgcgcgcgcgttcgtttttggtgttaattttttaaattaggttgttttattcgtttcgtcgcggcgcgttttttggcggacgtttttagtcgcgcggagtttcggtcgttcgtttttcgcgttgcgttgcgtttcgttagattagagcgtttttggcgtttaggcggttttcgttttttcgttttttttatcggcggcggcggcggcggcggtaggtatagtgagtttagtcggtattttcggagttaattttttttttgtcggttcgtagttcggggatttaggacgtcggttttttagttaggagaggacggtacgcgggggcggagtagt

SEQ ID NO: 4224 - DNA, 772 bp, Artificial Sequence
  chemically treated genomic DNA (Homo sapiens) CpG-island No: 4224
actactccgcccccgcgtaccgtcctctcctaactaaaaaaccgacgtcctaaatccccgaactacgaaccgacaaaaaaaaaattaactccgaaaataccgactaaactcactatacctaccgccgccgccgccgccgccgataaaaaaaacgaaaaaacgaaaaccgcctaaacgccaaaaacgctctaatctaacgaaacgcaacgcaacgcgaaaaacgaacgaccgaaactccgcgcgactaaaaacgtccgccaaaaaacgcgccgcgacgaaacgaataaaacaacctaatttaaaaaattaacaccaaaaacgaacgcgcgcgcaaatccccaacacatctaaacgaaaacgacgccgctaaaaccgaaaaaaacgccgaacgcaaatctaaaacaacaaaaccacgacgcaactaaaacccttcgaaacgctcgaaacgcacatctaaaacctcgaacgaaaaccgtaccgcgcgcaactaaaccaaaaaaaaaaaacgacgactacacaactaaaccgaaaaaaacgaaatcgaccctaaacgacccgctaaaaaaaaaaccgcgaaccgccgaaaactaaaacataaaacgacgcgcctaaaaaaacaaaaaaaaaaaaaaaacctaaaaccccgaaaaaaaaaaaaaaaaacgaaaaaacgaaaacgaaaaaaaaaaatacaactaactcgctactacttcgtattcctaatacaaaataacctctatctaataaataatccgaaaaaaactacgcaaaa

SEQ ID NO: 4225 - DNA, 604 bp, Artificial Sequence
  chemically treated genomic DNA (Homo sapiens) CpG-island No: 4225
cgaattacgtttcgtcgtatttaaggtttcggttgggttttgttgcgcggttagaatcgggaaatggagggtttagacgtttcgcgcgagtaggtttagtcgcgtttttttatttgtcgttatcgtcgttgagtcggttcgtgggcgcggtcgtttttatttgtaggagcgggggcgcgcgggattcgtttttaaggtgtttacgggcggtgcgggttacgtgtcgcgtaggtgaggttggcggggcgggcgtcggcggagatttagagtagagggaataggtttcgttttcgaacgttcgcggggatttagagcggagggaataggtttcgtttttcgaacgttcgttgtgatttagagcggagggagtaggtttcgtttcgcgaaagtttgtggagatttagggcggagggaataggtttcgttttcgggatcggtttttgaggcggcgtatgcgcgttttttcgttcggattgcgagtttttttttagtttttggtttttagggttaaggcgattttaggtttggaaagggattttcgtcgtaaatttttttgtttttgttaaagttgcggtcgtaaggtttagtgatcgtttgaaacgtt

SEQ ID NO: 4226 - DNA, 604 bp, Artificial Sequence
  chemically treated genomic DNA (Homo sapiens) CpG-island No: 4226
aacgtttcaaacgatcactaaaccttacgaccgcaactttaacaaaaacaaaaaaatttacgacgaaaatccctttccaaacctaaaatcgccttaaccctaaaaaccaaaaactaaaaaaaaactcgcaatccgaacgaaaaaacgcgcatacgccgcctcaaaaaccgatcccgaaaacgaaacctattccctccgccctaaatctccacaaactttcgcgaaacgaaacctactccctccgctctaaatcacaacgaacgttcgaaaaacgaaacctattccctccgctctaaatccccgcgaacgttcgaaaacgaaacctattccctctactctaaatctccgccgacgcccgccccgccaacctcacctacgcgacacgtaacccgcaccgcccgtaaacaccttaaaaacgaatcccgcgcgcccccgctcctacaaataaaaacgaccgcgcccacgaaccgactcaacgacgataacgacaaataaaaaaacgcgactaaacctactcgcgcgaaacgtctaaaccctccatttcccgattctaaccgcgcaacaaaacccaaccgaaaccttaaatacgacgaaacgtaattcg

SEQ ID NO: 4227 - DNA, 604 bp, Artificial Sequence
  chemically treated genomic DNA (Homo sapiens) CpG-island No: 4227
gacgttttaggcgattattaggttttgcgatcgtagttttagtaaaaatagaaagatttgcgacggaagtttttttttaagtttgaaatcgttttgattttaggagttagaagttggggaggaattcgtagttcgggcggaagagcgcgtatgcgtcgttttaggggtcggtttcgggggcggggtttgtttttttcgttttgggtttttataggttttcgcggggcggggtttatttttttcgttttgggttatagcgggcgttcggggggcggggtttgtttttttcgttttgggttttcgcgggcgttcgggggcggggtttgttttttttgttttgggttttcgtcggcgttcgtttcgttagttttatttgcgcggtacgtgattcgtatcgttcgtgggtattttgaaggcggatttcgcgcgttttcgtttttgtaggtgagagcggtcgcgtttacgggtcggtttagcggcggtggcggtaggtggggaagcgcggttgggtttgttcgcgcggggcgtttgagttttttatttttcggttttaatcgcgtagtagggtttaatcgggattttgagtgcggcgaggcgtggttcg

SEQ ID NO: 4228 - DNA, 604 bp, Artificial Sequence
  chemically treated genomic DNA (Homo sapiens) CpG-island No: 4228
cgaaccacgcctcgccgcactcaaaatcccgattaaaccctactacgcgattaaaaccgaaaaataaaaaactcaaacgccccgcgcgaacaaacccaaccgcgcttccccacctaccgccaccgccgctaaaccgacccgtaaacgcgaccgctctcacctacaaaaacgaaaacgcgcgaaatccgccttcaaaatacccacgaacgatacgaatcacgtaccgcgcaaataaaactaacgaaacgaacgccgacgaaaacccaaaacaaaaaaaacaaaccccgcccccgaacgcccgcgaaaacccaaaacgaaaaaaacaaaccccgccccccgaacgcccgctataacccaaaacgaaaaaaataaaccccgccccgcgaaaacctataaaaacccaaaacgaaaaaaacaaaccccgcccccgaaaccgacccctaaaacgacgcatacgcgctcttccgcccgaactacgaattcctccccaacttctaactcctaaaatcaaaacgatttcaaacttaaaaaaaaacttccgtcgcaaatctttctatttttactaaaactacgatcgcaaaacctaataatcgcctaaaacgtc

SEQ ID NO: 4229 - DNA, 936 bp, Artificial Sequence
  chemically treated genomic DNA (Homo sapiens) CpG-island No: 4229
cgagcgttggacgcgttttttttcgcgagttttttttcgaggtttttcgggttttttcggttaatttcgttcgggcggtgcgcgttttcgttgtttacgttttcgttttagagaggtagggtttttagagtttgttagtttcgcggtcgtaattaatttcgggtcggagtgtttcggttcggttagtttcgcggcgtgagggaaggggagtttagtagtttttcgcgcggggtttaggcgtcggcggtagggcgggttttttatcgttagcgtgttagtttcgtttttatttattagtgtgttagtttcgtttttttttacgtcgtcgcgcgttcgggggcggggtttggcgcgtatcgttcgcgtacggcgaggcgtttgttgattggttattggggttcgggtttttatcggcggagcgcgtttttttttagatttttcgttagtaggagtcgcgcggtagatgcggtgtttttaggagtttcgttcgatagaacggttgggttttgtcggttgtcggtatgtcgcgatagagtattttgtatagttttttttttaagttttcggcgttgagtgatgttaataaggtttcggttagggttttacgcgaaggcggtcgtgtcgtcgttgttttcggggtttttttttttttaggcggggatgcggtttggagcgaggttgggtttgggtttaggtttttggcgcgtttcgcgttatcgtttaaggcgaagaattttaacggagggttgcggagatcggtagcgtttgttgtttttattaggtagcggggtgggggtggggtcgaaggcgggggtatagcggcggggcgtttggaattcggcgaggggaggttcgtatagggggttgggggggtgtacggtttggttttgggttcggaggaggcggggtcgtagagttggtttgaatgagtgtagg

SEQ ID NO: 4230 - DNA, 936 bp, Artificial Sequence
  chemically treated genomic DNA (Homo sapiens) CpG-island No: 4230
cctacactcattcaaaccaactctacgaccccgcctcctccgaacccaaaaccaaaccgtacacccccccaaccccctatacgaacctcccctcgccgaattccaaacgccccgccgctatacccccgccttcgaccccacccccaccccgctacctaataaaaacaacaaacgctaccgatctccgcaaccctccgttaaaattcttcgccttaaacgataacgcgaaacgcgccaaaaacctaaacccaaacccaacctcgctccaaaccgcatccccgcctaaaaaaaaaaaaaccccgaaaacaacgacgacacgaccgccttcgcgtaaaaccctaaccgaaaccttattaacatcactcaacgccgaaaacttaaaaaaaaaactatacaaaatactctatcgcgacataccgacaaccgacaaaacccaaccgttctatcgaacgaaactcctaaaaacaccgcatctaccgcgcgactcctactaacgaaaaatctaaaaaaaaacgcgctccgccgataaaaacccgaaccccaataaccaatcaacaaacgcctcgccgtacgcgaacgatacgcgccaaaccccgcccccgaacgcgcgacgacgtaaaaaaaaacgaaactaacacactaataaataaaaacgaaactaacacgctaacgataaaaaacccgccctaccgccgacgcctaaaccccgcgcgaaaaactactaaactccccttccctcacgccgcgaaactaaccgaaccgaaacactccgacccgaaattaattacgaccgcgaaactaacaaactctaaaaaccctacctctctaaaacgaaaacgtaaacaacgaaaacgcgcaccgcccgaacgaaattaaccgaaaaaacccgaaaaacctcgaaaaaaaactcgcgaaaaaaaacgcgtccaacgctcg

SEQ ID NO: 4231 - DNA, 936 bp, Artificial Sequence
  chemically treated genomic DNA (Homo sapiens) CpG-island No: 4231
tttgtatttatttaagttaattttgcggtttcgtttttttcgagtttagggttaggtcgtgtatttttttaattttttgtgcgagttttttttcgtcgggttttaagcgtttcgtcgttatgttttcgttttcgattttatttttatttcgttatttggtgggggtagtaggcgttatcgattttcgtagtttttcgttgaggtttttcgttttgggcggtgacgcggagcgcgttaagggtttgggtttaggtttagtttcgttttaggtcgtattttcgtttggggaaggagaggtttcgggggtagcggcggtacggtcgttttcgcgtgaggttttggtcgaggttttgttggtattatttagcgtcggagatttggggaagaagttgtatagggtgttttgtcgcgatatatcgatagtcggtaaggtttaatcgttttgtcggacggagtttttaaaagtatcgtatttatcgcgcggtttttgttggcgggaaatttggggggaggcgcgtttcgtcggtaggaattcgggttttagtggttaattaataggcgtttcgtcgtgcgcgggcggtgcgcgttaggtttcgttttcgggcgcgcggcgacgtggggaagggcggggttggtatattggtgggtaggggcggggttggtacgttggcggtgaggggttcgttttgtcgtcgacgtttgggtttcgcgcggggaattgttgagtttttttttttttacgtcgcggggttggtcgggtcggaatatttcgattcggggttagttgcggtcgcggggttagtaggttttgaaagttttgtttttttggagcggaagcgtgaatagcgggggcgcgtatcgttcgggcgggattaatcggggggattcgaaaggtttcggaaaggggttcgcggggagaaacgcgtttagcgttcg

SEQ ID NO: 4232 - DNA, 936 bp, Artificial Sequence
  chemically treated genomic DNA (Homo sapiens) CpG-island No: 4232
cgaacgctaaacgcgtttctccccgcgaacccctttccgaaacctttcgaatccccccgattaatcccgcccgaacgatacgcgcccccgctattcacgcttccgctccaaaaaaacaaaactttcaaaacctactaaccccgcgaccgcaactaaccccgaatcgaaatattccgacccgaccaaccccgcgacgtaaaaaaaaaaaaactcaacaattccccgcgcgaaacccaaacgtcgacgacaaaacgaacccctcaccgccaacgtaccaaccccgcccctacccaccaatataccaaccccgcccttccccacgtcgccgcgcgcccgaaaacgaaacctaacgcgcaccgcccgcgcacgacgaaacgcctattaattaaccactaaaacccgaattcctaccgacgaaacgcgcctccccccaaatttcccgccaacaaaaaccgcgcgataaatacgatacttttaaaaactccgtccgacaaaacgattaaaccttaccgactatcgatatatcgcgacaaaacaccctatacaacttcttccccaaatctccgacgctaaataataccaacaaaacctcgaccaaaacctcacgcgaaaacgaccgtaccgccgctacccccgaaacctctccttccccaaacgaaaatacgacctaaaacgaaactaaacctaaacccaaacccttaacgcgctccgcgtcaccgcccaaaacgaaaaacctcaacgaaaaactacgaaaatcgataacgcctactacccccaccaaataacgaaataaaaataaaatcgaaaacgaaaacataacgacgaaacgcttaaaacccgacgaaaaaaaactcgcacaaaaaattaaaaaaatacacgacctaaccctaaactcgaaaaaaacgaaaccgcaaaattaacttaaataaatacaaa

SEQ ID NO: 4233 - DNA, 624 bp, Artificial Sequence
  chemically treated genomic DNA (Homo sapiens) CpG-island No: 4233
ggtagtacggttcgggaggtcgcggttcgagatttcggtttttgttattgtggcggtagtattttttttagggtcgttttgtcgggttcgtttttttcggcgcgtggggtttttcgcgttgttatcgttcgggtttcgattagtttgggttttcggggagttagaaggcgggtagatagtgttagggttcggcgcgggttcgggttcggttcggtttcgttgtaggtttcggttttttttcggttttcgcgtcgcgtttcgcgtttttttttttttttcgttcgtcggtcgttgtcgttatcgtttttcggcgcgggttaaggaggagtcgggagacgtcgagtcgcgggtagcgtcgagtcgcgagtttcgttattcggtgtgcgtttcgtttggagagttacggtcgtttttacgtcggcgagggatttcgtcgttttcgtttatttgcggtcgcgtggtttcgggagttcgtcgtttattcgggatgataatttattgtttttcgtcgggagagtttttagtgcgtatcgtatatcgttaattttagttgatattttaatttcggcgttttattttgttaaatttcgtatatagatgaatagttttagtttttttaggatt

SEQ ID NO: 4234 - DNA, 624 bp, Artificial Sequence
  chemically treated genomic DNA (Homo sapiens) CpG-island No: 4234
aatcctaaaaaaactaaaactattcatctatatacgaaatttaacaaaataaaacgccgaaattaaaatatcaactaaaattaacgatatacgatacgcactaaaaactctcccgacgaaaaacaataaattatcatcccgaataaacgacgaactcccgaaaccacgcgaccgcaaataaacgaaaacgacgaaatccctcgccgacgtaaaaacgaccgtaactctccaaacgaaacgcacaccgaataacgaaactcgcgactcgacgctacccgcgactcgacgtctcccgactcctccttaacccgcgccgaaaaacgataacgacaacgaccgacgaacgaaaaaaaaaaaaaaacgcgaaacgcgacgcgaaaaccgaaaaaaaaccgaaacctacaacgaaaccgaaccgaacccgaacccgcgccgaaccctaacactatctacccgccttctaactccccgaaaacccaaactaatcgaaacccgaacgataacaacgcgaaaaaccccacgcgccgaaaaaaacgaacccgacaaaacgaccctaaaaaaaatactaccgccacaataacaaaaaccgaaatctcgaaccgcgacctcccgaaccgtactacc

SEQ ID NO: 4235 - DNA, 624 bp, Artificial Sequence
  chemically treated genomic DNA (Homo sapiens) CpG-island No: 4235
agttttgagaaagttggggttgtttatttgtatacggagtttaatagaatgaaacgtcggagttggggtgttagttggaattgacggtatacggtgcgtattagggattttttcgacggggagtagtgagttgttatttcgggtagacggcgaattttcggagttacgcggtcgtaggtgggcgagggcggcgagatttttcgtcggcgtgagagcggtcgtggttttttaggcggagcgtatatcgggtagcgaggttcgcggttcggcgttgttcgcggttcggcgtttttcggtttttttttaattcgcgtcgggaggcggtggcggtagcggtcggcgggcgggggagggggaggggcgcggagcgcggcgcggaggtcggggaggagtcggggtttgtagcggagtcgagtcgagttcgagttcgcgtcgagttttgatattgtttgttcgttttttggtttttcgggagtttagattggtcggagttcgagcggtggtagcgcggggagttttacgcgtcgaagggagcggattcgataggacggttttagaggaggtgttgtcgttatagtagtagggatcggagtttcgagtcgcggtttttcggatcgtgttgtt

SEQ ID NO: 4236 - DNA, 624 bp, Artificial Sequence
  chemically treated genomic DNA (Homo sapiens) CpG-island No: 4236
aacaacacgatccgaaaaaccgcgactcgaaactccgatccctactactataacgacaacacctcctctaaaaccgtcctatcgaatccgctcccttcgacgcgtaaaactccccgcgctaccaccgctcgaactccgaccaatctaaactcccgaaaaaccaaaaaacgaacaaacaatatcaaaactcgacgcgaactcgaactcgactcgactccgctacaaaccccgactcctccccgacctccgcgccgcgctccgcgcccctccccctcccccgcccgccgaccgctaccgccaccgcctcccgacgcgaattaaaaaaaaaccgaaaaacgccgaaccgcgaacaacgccgaaccgcgaacctcgctacccgatatacgctccgcctaaaaaaccacgaccgctctcacgccgacgaaaaatctcgccgccctcgcccacctacgaccgcgtaactccgaaaattcgccgtctacccgaaataacaactcactactccccgtcgaaaaaatccctaatacgcaccgtataccgtcaattccaactaacaccccaactccgacgtttcattctattaaactccgtatacaaataaacaaccccaactttctcaaaact

SEQ ID NO: 4237 - DNA, 1181 bp, Artificial Sequence
  chemically treated genomic DNA (Homo sapiens) CpG-island No: 4237
tagcggttcgggcggttcggtcgcggggtaggttggtagcgcggtgggcgtttcggcggtggcggcggcggcgttgggggcggcggcgggtcggaggcggttagtgcggcgatcgcgtatttagtcgtagtttacgtagaggcgtaggttttgttgcgcgtcgttcgtcgttagttttaggtgttcgatgagtagcggcggttcgacgcggtggaaggcggcggcgaagaaagcgcggtcgtgcgcgttggtggagaagagtagtaggtcgtattggaagtttcgcgggcggttttagcgtacgagtagcgagtttagtatttgtcgttgtacgttgatgttgtacggcgtcgttgtcgtcgtcgtttttttcgggttcgggcgttcggggggttcgggggtcgtcgaggttagtagtcgcggggcgatgggttcgttcgcggaggacgcgttgattgaagtattggagggtatttcgaggaggtcgggcgcgttcgcggtttcgtcgcggacgggcggtagcgggtaggcggcggttaggagcgcggcgagtaggggtagtatggtttgcggcgggcgtttacgcgcgcgaggtcggcggcggttgtatggcgagcgggcgacgggtcggcgagtttacggtgggatcgcgggagtcggcggtcgggcgtagtgcgggcgcgtcgggcgtttgttaagttcgtaggggcggcgcggaggcggtgacggcggttggttcggcgcggggatttttttagattcggttgcgtttggggtttttcgtcgttttcggcgtcggggtttttgggttgtcgcgttgttttgcggggtcgggtgttattttagagtaggatttttcggttcggtttcgtttttcgcgtgtttcgtttcgtttcgtttttcgttcgttaggttcggggatttaggggagggcggggttttacgcgtcggggttgggagaggaatcgtcggggcggggttgggtgcgggggcgcggcggagagcggatcgttcggggtgcgtgcgggcgggcggggaagtttgcggacgcgttcgggcgttttcgcgtttcgggtgaatcgcgtttttagagggaggttttagggttcggagattatttttttgttaggtttgaggggagtttcgttgtttcgttttagcgttatcgaattttttttgtt

SEQ ID NO: 4238 - DNA, 1181 bp, Artificial Sequence
  chemically treated genomic DNA (Homo sapiens) CpG-island No: 4238
aacaaaaaaaattcgataacgctaaaacgaaacaacgaaactcccctcaaacctaacaaaaaaataatctccgaaccctaaaacctccctctaaaaacgcgattcacccgaaacgcgaaaacgcccgaacgcgtccgcaaacttccccgcccgcccgcacgcaccccgaacgatccgctctccgccgcgcccccgcacccaaccccgccccgacgattcctctcccaaccccgacgcgtaaaaccccgccctcccctaaatccccgaacctaacgaacgaaaaacgaaacgaaacgaaacacgcgaaaaacgaaaccgaaccgaaaaatcctactctaaaataacacccgaccccgcaaaacaacgcgacaacccaaaaaccccgacgccgaaaacgacgaaaaaccccaaacgcaaccgaatctaaaaaaatccccgcgccgaaccaaccgccgtcaccgcctccgcgccgcccctacgaacttaacaaacgcccgacgcgcccgcactacgcccgaccgccgactcccgcgatcccaccgtaaactcgccgacccgtcgcccgctcgccatacaaccgccgccgacctcgcgcgcgtaaacgcccgccgcaaaccatactacccctactcgccgcgctcctaaccgccgcctacccgctaccgcccgtccgcgacgaaaccgcgaacgcgcccgacctcctcgaaataccctccaatacttcaatcaacgcgtcctccgcgaacgaacccatcgccccgcgactactaacctcgacgacccccgaaccccccgaacgcccgaacccgaaaaaaacgacgacgacaacgacgccgtacaacatcaacgtacaacgacaaatactaaactcgctactcgtacgctaaaaccgcccgcgaaacttccaatacgacctactactcttctccaccaacgcgcacgaccgcgctttcttcgccgccgccttccaccgcgtcgaaccgccgctactcatcgaacacctaaaactaacgacgaacgacgcgcaacaaaacctacgcctctacgtaaactacgactaaatacgcgatcgccgcactaaccgcctccgacccgccgccgcccccaacgccgccgccgccaccgccgaaacgcccaccgcgctaccaacctaccccgcgaccgaaccgcccgaaccgcta

SEQ ID NO: 4239 - DNA, 1181 bp, Artificial Sequence
  chemically treated genomic DNA (Homo sapiens) CpG-island No: 4239
aataaaggaggttcggtagcgttaaggcgagatagcgaagttttttttaggtttgataaaaggatggttttcgggttttggagtttttttttgagaacgcgatttattcggagcgcgggggcgttcgggcgcgttcgtaggttttttcgttcgttcgtacgtatttcgggcgattcgtttttcgtcgcgttttcgtatttagtttcgtttcggcgattttttttttagtttcggcgcgtggaatttcgtttttttttgagttttcgagtttggcgagcggagggcggggcggggcggggtacgcgggaggcggagtcgagtcggggaattttgttttgggatagtattcggtttcgtagagtagcgcggtagtttaagggtttcggcgtcgggggcggcggggaattttaaacgtaatcgggtttggagggattttcgcgtcgagttagtcgtcgttatcgttttcgcgtcgtttttgcgggtttggtaggcgttcggcgcgttcgtattgcgttcggtcgtcggttttcgcggttttatcgtgagttcgtcggttcgtcgttcgttcgttatgtaatcgtcgtcggtttcgcgcgcgtaggcgttcgtcgtaggttatgttgtttttgttcgtcgcgtttttggtcgtcgtttgttcgttgtcgttcgttcgcggcggggtcgcggacgcgttcggttttttcggggtgttttttaatgttttagttaacgcgtttttcgcggacgagtttatcgtttcgcggttgttggtttcggcggttttcgggtttttcgagcgttcgggttcggaggagacggcggcggtagcggcgtcgtgtaatattagcgtgtagcggtagatgttgagttcgttgttcgtgcgttggggtcgttcgcggggtttttagtgcgatttattgtttttttttattaacgcgtacggtcgcgtttttttcgtcgtcgttttttatcgcgtcgggtcgtcgttgtttatcgagtatttggggttggcggcgggcggcgcgtagtaggatttgcgtttttgcgtgggttgcggttgggtgcgcggtcgtcgtattggtcgttttcggttcgtcgtcgtttttagcgtcgtcgtcgttatcgtcggggcgtttatcgcgttgttagtttatttcgcggtcgagtcgttcgggtcgttg

SEQ ID NO: 4240 - DNA, 1181 bp, Artificial Sequence
  chemically treated genomic DNA (Homo sapiens) CpG-island No: 4240
caacgacccgaacgactcgaccgcgaaataaactaacaacgcgataaacgccccgacgataacgacgacgacgctaaaaacgacgacgaaccgaaaacgaccaatacgacgaccgcgcacccaaccgcaacccacgcaaaaacgcaaatcctactacgcgccgcccgccgccaaccccaaatactcgataaacaacgacgacccgacgcgataaaaaacgacgacgaaaaaaacgcgaccgtacgcgttaataaaaaaaaacaataaatcgcactaaaaaccccgcgaacgaccccaacgcacgaacaacgaactcaacatctaccgctacacgctaatattacacgacgccgctaccgccgccgtctcctccgaacccgaacgctcgaaaaacccgaaaaccgccgaaaccaacaaccgcgaaacgataaactcgtccgcgaaaaacgcgttaactaaaacattaaaaaacaccccgaaaaaaccgaacgcgtccgcgaccccgccgcgaacgaacgacaacgaacaaacgacgaccaaaaacgcgacgaacaaaaacaacataacctacgacgaacgcctacgcgcgcgaaaccgacgacgattacataacgaacgaacgacgaaccgacgaactcacgataaaaccgcgaaaaccgacgaccgaacgcaatacgaacgcgccgaacgcctaccaaacccgcaaaaacgacgcgaaaacgataacgacgactaactcgacgcgaaaatccctccaaacccgattacgtttaaaattccccgccgcccccgacgccgaaacccttaaactaccgcgctactctacgaaaccgaatactatcccaaaacaaaattccccgactcgactccgcctcccgcgtaccccgccccgccccgccctccgctcgccaaactcgaaaactcaaaaaaaaacgaaattccacgcgccgaaactaaaaaaaaaatcgccgaaacgaaactaaatacgaaaacgcgacgaaaaacgaatcgcccgaaatacgtacgaacgaacgaaaaaacctacgaacgcgcccgaacgcccccgcgctccgaataaatcgcgttctcaaaaaaaaactccaaaacccgaaaaccatccttttatcaaacctaaaaaaaacttcgctatctcgccttaacgctaccgaacctcctttatt

SEQ ID NO: 4241 - DNA, 760 bp, Artificial Sequence
  chemically treated genomic DNA (Homo sapiens) CpG-island No: 4241
  misc_feature (559)..(559): n is either a, c, g or t
agcgtttatttaggagtaatatttttttgcgatcgaagtgatggatgttgtcgacgttgcgtaggtcgcgtaagtgtgttagcgattgttagttgaaacggagcgattggacgcgttggttaatgcggcgggaattttacgtatgggcgcgatcgattagtttagtaaagaggattggtagtagatttttgcggttaacgtcggcggtgcgtttaatttgttttagtaaattatgaattagtttcgtcgttagcggggcggggcgattgttattgtggcgttcgacgtcgcgtatacgtcgcgtattggtatgagtgtttatggcgtatcgaaagcggcgttgaaaagtttggcgttgagcgtcgggttggaattggcgggtagcggcgtgcgttgtaatgtggtttcgtttggttttatcgatatcgatatgtaacgtacgttgtgggtgagcgatgacgtcgaagaatacgtattcgcggttttggcgagtagtttaaattcggtatttcgttggggaaaatcgttcgtttataagagatcgttaatacgattttgnttttcgtttttgatttcgttagttatattattttatagggaaattggggtcgattggcggtttaacgttggggggtataaagtatgatttggaaaacggtatttaaacgtttcgattaaattgaattttaattcgcggattattatttatggtggggcgtatttttgggggaaatggggttttaattttttttgggtttta

SEQ ID NO: 4242 - DNA, 760 bp, Artificial Sequence
  chemically treated genomic DNA (Homo sapiens) CpG-island No: 4242
  misc_feature (202)..(202): n is either a, c, g or t
taaaacccaaaaaaaattaaaaccccatttcccccaaaaatacgccccaccataaataataatccgcgaattaaaattcaatttaatcgaaacgtttaaataccgttttccaaatcatactttataccccccaacgttaaaccgccaatcgaccccaatttccctataaaataatataactaacgaaatcaaaaacgaaaancaaaatcgtattaacgatctcttataaacgaacgattttccccaacgaaataccgaatttaaactactcgccaaaaccgcgaatacgtattcttcgacgtcatcgctcacccacaacgtacgttacatatcgatatcgataaaaccaaacgaaaccacattacaacgcacgccgctacccgccaattccaacccgacgctcaacgccaaacttttcaacgccgctttcgatacgccataaacactcataccaatacgcgacgtatacgcgacgtcgaacgccacaataacaatcgccccgccccgctaacgacgaaactaattcataatttactaaaacaaattaaacgcaccgccgacgttaaccgcaaaaatctactaccaatcctctttactaaactaatcgatcgcgcccatacgtaaaattcccgccgcattaaccaacgcgtccaatcgctccgtttcaactaacaatcgctaacacacttacgcgacctacgcaacgtcgacaacatccatcacttcgatcgcaaaaaaatattactcctaaataaacgct

SEQ ID NO: 4243 - DNA, 760 bp, Artificial Sequence
  chemically treated genomic DNA (Homo sapiens) CpG-island No: 4243
  misc_feature (202)..(202): n is either a, c, g or t
tggggtttagaaggggttaaaattttattttttttaagaatgcgttttattatgggtggtaattcgcgggttggggtttagtttggtcgaagcgtttaaatgtcgttttttagattatgttttatgttttttagcgttgagtcgttaatcgattttaatttttttgtagggtaatatggttggcgaggttagaggcgaggantaaaatcgtgttggcgattttttgtggacgggcgattttttttagcggaatgtcgagtttaaattgttcgttaaagtcgcgaatacgtgtttttcggcgttatcgtttatttatagcgtgcgttgtatatcggtgtcggtggagttaggcgaaattatattatagcgtacgtcgttattcgttagttttagttcgacgtttaacgttaggttttttagcgtcgttttcgatgcgttataagtatttatgttaatacgcggcgtgtgcgcggcgtcggacgttatagtgataatcgtttcgtttcgttgacggcgaaattggtttatggtttgttggaataggttaaacgtatcgtcgacgttaatcgtaaaagtttgttgttagttttttttattgagttgatcggtcgcgtttatgcgtaaaattttcgtcgtattgattagcgcgtttagtcgtttcgttttagttaatagtcgttgatatatttgcgcgatttgcgtagcgtcggtaatatttattatttcggtcgtaaagggatattgtttttgagtgaacgtt

SEQ ID NO: 4244 - DNA, 760 bp, Artificial Sequence
  chemically treated genomic DNA (Homo sapiens) CpG-island No: 4244
  misc_feature (559)..(559): n is either a, c, g or t
aacgttcactcaaaaacaatatccctttacgaccgaaataataaatattaccgacgctacgcaaatcgcgcaaatatatcaacgactattaactaaaacgaaacgactaaacgcgctaatcaatacgacgaaaattttacgcataaacgcgaccgatcaactcaataaaaaaaactaacaacaaacttttacgattaacgtcgacgatacgtttaacctattccaacaaaccataaaccaatttcgccgtcaacgaaacgaaacgattatcactataacgtccgacgccgcgcacacgccgcgtattaacataaatacttataacgcatcgaaaacgacgctaaaaaacctaacgttaaacgtcgaactaaaactaacgaataacgacgtacgctataatataatttcgcctaactccaccgacaccgatatacaacgcacgctataaataaacgataacgccgaaaaacacgtattcgcgactttaacgaacaatttaaactcgacattccgctaaaaaaaatcgcccgtccacaaaaaatcgccaacacgattttantcctcgcctctaacctcgccaaccatattaccctacaaaaaaattaaaatcgattaacgactcaacgctaaaaaacataaaacataatctaaaaaacgacatttaaacgcttcgaccaaactaaaccccaacccgcgaattaccacccataataaaacgcattcttaaaaaaaataaaattttaaccccttctaaacccca

SEQ ID NO: 4245 - DNA, 637 bp, Artificial Sequence
  chemically treated genomic DNA (Homo sapiens) CpG-island No: 4245
tcgtcgtgcgtttattttttgttagtggttcgtttcgaatatttttcgtcgggcggcgggtattgcggttcgttttattttcggttgttgttcggttttatattcggtgttcgttcgttttcggttttttcgtcgtgatgttgtttcgatttcgttgtgtgtttcgggcgtttagtcgttcgtttttcgttttttagaaggtacggtttggtcgagtcggggtttcgacgggtgaggagtttgttggcgggtagagaggcggtttggaaggtaggggcgcggcgcgtcggtcgggtcgggtattaagggtattgggacgcggaggtcgcgcgggttgggcggttcggggtcgtggttgttttcgggatcgttttgcggagtttagcggttttttgttttttttaggtagtttgcggggaacgttttttgttgtattttatttttcgcgcgggagttggggagtcgcgttcgtttagatatttgatttagagttagggaggaggcgcggcggagtttttcggcgggattcggcgttcgtttcgttttgttttgttaaaattagtgggtattaatgagtttcgttgggaagttgagatagtttggtaggtttagcgtgttgattgggtttgttagtacg

SEQ ID NO: 4246 - DNA, 637 bp, Artificial Sequence
  chemically treated genomic DNA (Homo sapiens) CpG-island No: 4246
cgtactaacaaacccaatcaacacgctaaacctaccaaactatctcaacttcccaacgaaactcattaatacccactaattttaacaaaacaaaacgaaacgaacgccgaatcccgccgaaaaactccgccgcgcctcctccctaactctaaatcaaatatctaaacgaacgcgactccccaactcccgcgcgaaaaataaaatacaacaaaaaacgttccccgcaaactacctaaaaaaaacaaaaaaccgctaaactccgcaaaacgatcccgaaaacaaccacgaccccgaaccgcccaacccgcgcgacctccgcgtcccaatacccttaatacccgacccgaccgacgcgccgcgcccctaccttccaaaccgcctctctacccgccaacaaactcctcacccgtcgaaaccccgactcgaccaaaccgtaccttctaaaaaacgaaaaacgaacgactaaacgcccgaaacacacaacgaaatcgaaacaacatcacgacgaaaaaaccgaaaacgaacgaacaccgaatataaaaccgaacaacaaccgaaaataaaacgaaccgcaatacccgccgcccgacgaaaaatattcgaaacgaaccactaacaaaaaataaacgcacgacga

SEQ ID NO: 4247 - DNA, 637 bp, Artificial Sequence
  chemically treated genomic DNA (Homo sapiens) CpG-island No: 4247
cgtgttggtagatttaattaatacgttgggtttgttaaattattttaattttttaacgggatttattaatatttattgattttaatagagtaagacgagacgggcgtcgaatttcgtcggaggatttcgtcgcgttttttttttaattttgagttaagtatttggacgggcgcggttttttagttttcgcgcggagggtggggtatagtaggaaacgtttttcgtaggttgtttggagaaggtagggggtcgttgggtttcgtaaaacggtttcgagggtaattacggtttcgggtcgtttagttcgcgcggttttcgcgttttagtgtttttggtgttcggttcggtcggcgcgtcgcgtttttgttttttaggtcgtttttttgttcgttaatagattttttattcgtcggggtttcggttcggttagatcgtattttttggaaggcggagagcgagcggttgaacgttcgagatatatagcgggatcgggatagtattacggcggaggagtcgagggcgggcggatatcggatatagggtcggataataatcggaagtggggcgggtcgtagtattcgtcgttcgacgaggggtgttcggagcgaattattggtagggggtgggcgtacggcgg

SEQ ID NO: 4248 - DNA, 637 bp, Artificial Sequence
  chemically treated genomic DNA (Homo sapiens) CpG-island No: 4248
ccgccgtacgcccaccccctaccaataattcgctccgaacacccctcgtcgaacgacgaatactacgacccgccccacttccgattattatccgaccctatatccgatatccgcccgccctcgactcctccgccgtaatactatcccgatcccgctatatatctcgaacgttcaaccgctcgctctccgccttccaaaaaatacgatctaaccgaaccgaaaccccgacgaataaaaaatctattaacgaacaaaaaaacgacctaaaaaacaaaaacgcgacgcgccgaccgaaccgaacaccaaaaacactaaaacgcgaaaaccgcgcgaactaaacgacccgaaaccgtaattaccctcgaaaccgttttacgaaacccaacgaccccctaccttctccaaacaacctacgaaaaacgtttcctactataccccaccctccgcgcgaaaactaaaaaaccgcgcccgtccaaatacttaactcaaaattaaaaaaaaaacgcgacgaaatcctccgacgaaattcgacgcccgtctcgtcttactctattaaaatcaataaatattaataaatcccgttaaaaaattaaaataatttaacaaacccaacgtattaattaaatctaccaacacg

SEQ ID NO: 4249 - DNA, 647 bp, Artificial Sequence
  chemically treated genomic DNA (Homo sapiens) CpG-island No: 4249
  misc_feature (2)..(2): n is either a, c, g or t
  misc_feature (11)..(11): n is either a, c, g or t
  misc_feature (138)..(138): n is either a, c, g or t
  misc_feature (303)..(303): n is either a, c, g or t
gncggcggcgngcggtattttttcggttattgttgttttttttgggcgagattagtcgcgttttgggcgttattttagtttggtcggcggtttattttgtttcggttgttgtagcggtgtcgcgagcggagttttttngatgggttcggacgtgggcggcggcggcggtggcggcggggtcggggcgtagcgtattcgtagcgggagtcgcgagttgatttgggcggtttgatatagtacggttttttatgtcgaagtcgaggcggggggagaaggaaaataaagggggaggggtcggtatangagggggcggtgggaattattatattcgggaggaaagtacgcgggcgggataaggaattagtttcgaatagggaaagcgaagcgagggaaaaaaattaattcgatttgtcggggtttaatttcggatcgtttttaagcgttaatttgttttttttttttcgttcggtgattgggggaacgaatagcggtcgataggaaacgcggttacgttaatttgtttttcgaataaatttggacgaaataattcgtcgacggtttaaagggggaattcggaatttttaaatcgggggcgaggaatttaggttttttgtggaagaaatttatttaggtggtattaattttga

SEQ ID NO: 4250 - DNA, 647 bp, Artificial Sequence
  chemically treated genomic DNA (Homo sapiens) CpG-island No: 4250
  misc_feature (345)..(345): n is either a, c, g or t
  misc_feature (510)..(510): n is either a, c, g or t
  misc_feature (637)..(637): n is either a, c, g or t
  misc_feature (646)..(646): n is either a, c, g or t
tcaaaattaataccacctaaataaatttcttccacaaaaaacctaaattcctcgcccccgatttaaaaattccgaattccccctttaaaccgtcgacgaattatttcgtccaaatttattcgaaaaacaaattaacgtaaccgcgtttcctatcgaccgctattcgttcccccaatcaccgaacgaaaaaaaaaaaacaaattaacgcttaaaaacgatccgaaattaaaccccgacaaatcgaattaatttttttccctcgcttcgctttccctattcgaaactaattccttatcccgcccgcgtactttcctcccgaatataataattcccaccgccccctcntataccgacccctccccctttattttccttctccccccgcctcgacttcgacataaaaaaccgtactatatcaaaccgcccaaatcaactcgcgactcccgctacgaatacgctacgccccgaccccgccgccaccgccgccgccgcccacgtccgaacccatcnaaaaaactccgctcgcgacaccgctacaacaaccgaaacaaaataaaccgccgaccaaactaaaataacgcccaaaacgcgactaatctcgcccaaaaaaaacaacaataaccgaaaaaataccgcncgccgccgnc

SEQ ID NO: 4251 - DNA, 647 bp, Artificial Sequence
  chemically treated genomic DNA (Homo sapiens) CpG-island No: 4251
  misc_feature (345)..(345): n is either a, c, g or t
  misc_feature (510)..(510): n is either a, c, g or t
  misc_feature (637)..(637): n is either a, c, g or t
  misc_feature (646)..(646): n is either a, c, g or t
ttaagattggtgttatttaagtgggttttttttataaggggtttaagtttttcgttttcgatttagagatttcgggttttttttttgggtcgtcggcgggttgtttcgtttaagtttgttcggggggtaagttaacgtgatcgcgttttttgtcggtcgttgttcgtttttttagttatcgagcgagagggaagaaatagattggcgtttgaaggcgattcggagttgggtttcgataaatcggattgatttttttttttcgtttcgttttttttgttcggggttggttttttgtttcgttcgcgtgtttttttttcgggtgtgatggtttttatcgtttttttntgtgtcggtttttttttttttgtttttttttttttttcgtttcggtttcgatatgaggggtcgtgttgtgttaggtcgtttaagttagttcgcggttttcgttgcggatgcgttgcgtttcggtttcgtcgttatcgtcgtcgtcgtttacgttcggatttattnggggggtttcgttcgcggtatcgttgtagtagtcggggtagagtgggtcgtcgattaggttgaggtggcgtttaagacgcggttgatttcgtttagggggggtagtagtagtcggaggaatgtcgtncgtcgtcgnt

SEQ ID NO: 4252 - DNA, 647 bp, Artificial Sequence
  chemically treated genomic DNA (Homo sapiens) CpG-island No: 4252
  misc_feature (2)..(2): n is either a, c, g or t
  misc_feature (11)..(11): n is either a, c, g or t
  misc_feature (138)..(138): n is either a, c, g or t
  misc_feature (303)..(303): n is either a, c, g or t
ancgacgacgnacgacattcctccgactactactaccccccctaaacgaaatcaaccgcgtcttaaacgccacctcaacctaatcgacgacccactctaccccgactactacaacgataccgcgaacgaaaccccccnaataaatccgaacgtaaacgacgacgacgataacgacgaaaccgaaacgcaacgcatccgcaacgaaaaccgcgaactaacttaaacgacctaacacaacacgacccctcatatcgaaaccgaaacgaaaaaaaaaaaaaaacaaaaaaaaaaaaaccgacacanaaaaaaacgataaaaaccatcacacccgaaaaaaaaacacgcgaacgaaacaaaaaaccaaccccgaacaaaaaaaacgaaacgaaaaaaaaaaatcaatccgatttatcgaaacccaactccgaatcgccttcaaacgccaatctatttcttccctctcgctcgataactaaaaaaacgaacaacgaccgacaaaaaacgcgatcacgttaacttaccccccgaacaaacttaaacgaaacaacccgccgacgacccaaaaaaaaaacccgaaatctctaaatcgaaaacgaaaaacttaaaccccttataaaaaaaacccacttaaataacaccaatcttaa

SEQ ID NO: 4253 - DNA, 806 bp, Artificial Sequence
  chemically treated genomic DNA (Homo sapiens) CpG-island No: 4253
cgattcgtcgtagaggaaaaggaaattttaaataaaattcgggcgtagagtttatttttattggttaaagagcgtcgttaagatttttttcgttcggggttgttcgcgttgttattagtaaagatggcggttataggcggagtcgtttatttcgaaggtcgtaggttattttgtcggttacgattatttacgcggagttttttacgtttttcgcggtttgacgtattgtaggtgtagcgcgattaattagacggcgcggtttttttcggttaattattgtagggtcgcgtcggtttattagagcgtttttgttaaattgaacgaggaaagaagttttagtagcgttaattaagtaatcggttatagatcgcgtttcggtgcgtgtgtgacgatatcgtcgtgtgttttttcgttgggagatatagtgttttcgtttttgtttcgtttcgttcgcgagcgttttaaaggtttgggcgtgcggtttgtttttttttttcgtttgacgggcggtggttttttcgagatagaaatttgattgaaaaataatattaaatattcgtgttgcggttcgtggttttttatagggttatttgaattagtttcgtttgtttttttgttttttgtcgttcgtttttcgcgttttgtgaaaatagttggcgtcgtagaaatgagataaacgtttttgagttcgaaattcgtattcgaattgttatcgagtcgattttttttgttttggaatttagggttcggttattcgagaagtatttttatgggtattttgtttttataagggttcgtttttattt

SEQ ID NO: 4254 - DNA, 806 bp, Artificial Sequence
  chemically treated genomic DNA (Homo sapiens) CpG-island No: 4254
aaataaaaacgaacccttataaaaacaaaatacccataaaaatacttctcgaataaccgaaccctaaattccaaaacaaaaaaaatcgactcgataacaattcgaatacgaatttcgaactcaaaaacgtttatctcatttctacgacgccaactattttcacaaaacgcgaaaaacgaacgacaaaaaacaaaaaaacaaacgaaactaattcaaataaccctataaaaaaccacgaaccgcaacacgaatatttaatattatttttcaatcaaatttctatctcgaaaaaaccaccgcccgtcaaacgaaaaaaaaaaacaaaccgcacgcccaaacctttaaaacgctcgcgaacgaaacgaaacaaaaacgaaaacactatatctcccaacgaaaaaacacacgacgatatcgtcacacacgcaccgaaacgcgatctataaccgattacttaattaacgctactaaaacttctttcctcgttcaatttaacaaaaacgctctaataaaccgacgcgaccctacaataattaaccgaaaaaaaccgcgccgtctaattaatcgcgctacacctacaatacgtcaaaccgcgaaaaacgtaaaaaactccgcgtaaataatcgtaaccgacaaaataacctacgaccttcgaaataaacgactccgcctataaccgccatctttactaataacaacgcgaacaaccccgaacgaaaaaaatcttaacgacgctctttaaccaataaaaataaactctacgcccgaattttatttaaaatttccttttcctctacgacgaatcg

SEQ ID NO: 4255 - DNA, 806 bp, Artificial Sequence
  chemically treated genomic DNA (Homo sapiens) CpG-island No: 4255
aaatggaaacgggtttttgtagaaataaagtgtttatgagggtgtttttcgggtggtcgggttttgagttttaaaataggaagggtcggttcggtggtagttcgagtgcgggtttcgagtttaggggcgtttattttatttttgcggcgttaattgtttttataaaacgcgaaggacgaacggtaaagagtaaggggataggcgaggttagtttaggtggttttatggagggttacgggtcgtagtacgggtatttggtattattttttagttaagtttttgtttcgggggaattatcgttcgttaagcggagaggaagagtaagtcgtacgtttaagtttttggagcgttcgcgggcggggcgaggtaagggcgagggtattatattttttagcggaggagtatacggcggtgtcgttatatacgtatcggaacgcggtttgtagtcggttgtttagttggcgttgttgaggttttttttttcgtttagtttgataaggacgttttgataggtcggcgcgattttgtagtggttggtcgaaaagagtcgcgtcgtttgattggtcgcgttgtatttgtaatgcgttaagtcgcgaagggcgtggagggtttcgcgtgaatggtcgtggtcggtagggtagtttgcggttttcggagtgagcggtttcgtttatggtcgttatttttattagtggtagcgcggatagtttcggacggaaggggttttggcggcgttttttggttagtagaaataggttttgcgttcgagttttgtttggggttttttttttttttacggcgggtcg

SEQ ID NO: 4256 - DNA, 806 bp, Artificial Sequence
  chemically treated genomic DNA (Homo sapiens) CpG-island No: 4256
cgacccgccgtaaaaaaaaaaaaaaccccaaacaaaactcgaacgcaaaacctatttctactaaccaaaaaacgccgccaaaaccccttccgtccgaaactatccgcgctaccactaataaaaataacgaccataaacgaaaccgctcactccgaaaaccgcaaactaccctaccgaccacgaccattcacgcgaaaccctccacgcccttcgcgacttaacgcattacaaatacaacgcgaccaatcaaacgacgcgactcttttcgaccaaccactacaaaatcgcgccgacctatcaaaacgtccttatcaaactaaacgaaaaaaaaaacctcaacaacgccaactaaacaaccgactacaaaccgcgttccgatacgtatataacgacaccgccgtatactcctccgctaaaaaatataataccctcgcccttacctcgccccgcccgcgaacgctccaaaaacttaaacgtacgacttactcttcctctccgcttaacgaacgataattcccccgaaacaaaaacttaactaaaaaataataccaaatacccgtactacgacccgtaaccctccataaaaccacctaaactaacctcgcctatccccttactctttaccgttcgtccttcgcgttttataaaaacaattaacgccgcaaaaataaaataaacgcccctaaactcgaaacccgcactcgaactaccaccgaaccgacccttcctattttaaaactcaaaacccgaccacccgaaaaacaccctcataaacactttatttctacaaaaacccgtttccattt

SEQ ID NO: 4257 - DNA, 770 bp, Artificial Sequence
  chemically treated genomic DNA (Homo sapiens) CpG-island No: 4257
ttcgtatttattgtatttattagcgtcgtattcgggttgtttgtagcgtagcgtttcggtttgggagtcgggcggggtcgggtattagattttttttttcggttcgtttttttttatttcgttttttcgtcggcgcgaaggtggtaggtcgggcgggtagtggagaatgaatgggttggagttggtcggtggcgtatattgtttcggtcgggtgttgaggggcgtagttagcgttcgttatttttttattttggtcggttttgttgggcgttttttttcggtcgttttttttttttttttttcggggggcgcggcgcgggcgtgggttgggaaggaaggagtcggggaagggtggggttgggggtaggaaggcgaggggttgggggcggagagggcggaagcggcggtcgggtcgttttgcgttcgggcggggttttgcggtgtggtcgtggtttgtttttgtcgttttcgtattttgcggttttttatttagtgtagtagtgcgggcgggcgtgagtttcggtgtattaggaggtatttttcgcgggaggcgttgggttcgcgttaattggggcggggggggggggcggcgggggaggagggaattggcgcgcggtttggtttttattagagacgtaaagtttttgtttcgggaggaggcggcggcgtcgcgggttcgtcgtttgggggagtagaagcgggtgggaggtgcgggtggttttggttttagttttggtgcgcgggggtcgggggtggtgatttttttggtt

SEQ ID NO: 4258 - DNA, 770 bp, Artificial Sequence
  chemically treated genomic DNA (Homo sapiens) CpG-island No: 4258
aaccaaaaaaatcaccacccccgacccccgcgcaccaaaactaaaaccaaaaccacccgcacctcccacccgcttctactcccccaaacgacgaacccgcgacgccgccgcctcctcccgaaacaaaaactttacgtctctaataaaaaccaaaccgcgcgccaattccctcctcccccgccgccccccccccccgccccaattaacgcgaacccaacgcctcccgcgaaaaatacctcctaatacaccgaaactcacgcccgcccgcactactacactaaataaaaaaccgcaaaatacgaaaacgacaaaaacaaaccacgaccacaccgcaaaaccccgcccgaacgcaaaacgacccgaccgccgcttccgccctctccgcccccaacccctcgccttcctacccccaaccccacccttccccgactccttccttcccaacccacgcccgcgccgcgccccccgaaaaaaaaaaaaaaaaaacgaccgaaaaaaaacgcccaacaaaaccgaccaaaataaaaaaataacgaacgctaactacgcccctcaacacccgaccgaaacaatatacgccaccgaccaactccaacccattcattctccactacccgcccgacctaccaccttcgcgccgacgaaaaaacgaaataaaaaaaaacgaaccgaaaaaaaaaatctaatacccgaccccgcccgactcccaaaccgaaacgctacgctacaaacaacccgaatacgacgctaataaatacaataaatacgaa

SEQ ID NO: 4259 - DNA, 770 bp, Artificial Sequence
  chemically treated genomic DNA (Homo sapiens) CpG-island No: 4259
ggttaggagggttattattttcggttttcgcgtattagggttgaggttaaggttattcgtattttttattcgtttttgtttttttaggcgacgagttcgcggcgtcgtcgttttttttcggagtagaaattttgcgtttttaatggaaattaagtcgcgcgttagtttttttttttttcgtcgtttttttttttcgttttaattagcgcgagtttagcgtttttcgcgggaagtgttttttggtgtatcgaggtttacgttcgttcgtattgttgtattgggtggggggtcgtagggtgcgaaagcggtaggaataagttacggttatatcgtagggtttcgttcgggcgtagggcggttcggtcgtcgttttcgtttttttcgtttttaatttttcgtttttttgtttttaattttattttttttcggtttttttttttttagtttacgttcgcgtcgcgtttttcgggaagaaggaggggagagcgatcgagggagggcgtttagtagggtcggttaaagtggggaggtggcgggcgttgattgcgttttttaatattcggtcggaataatgtgcgttatcggttagttttagtttatttattttttattgttcgttcgatttgttattttcgcgtcggcggagaagcggggtggggaggggcgggtcgggggggggggtttagtgttcggtttcgttcggtttttaggtcgaaacgttgcgttgtaggtagttcgggtgcggcgttagtggatgtagtgggtgcggg

SEQ ID NO: 4260 - DNA, 770 bp, Artificial Sequence
  chemically treated genomic DNA (Homo sapiens) CpG-island No: 4260
cccgcacccactacatccactaacgccgcacccgaactacctacaacgcaacgtttcgacctaaaaaccgaacgaaaccgaacactaaacccccccccccgacccgcccctccccaccccgcttctccgccgacgcgaaaataacaaatcgaacgaacaataaaaaataaataaactaaaactaaccgataacgcacattattccgaccgaatattaaaaaacgcaatcaacgcccgccacctccccactttaaccgaccctactaaacgccctccctcgatcgctctcccctccttcttcccgaaaaacgcgacgcgaacgtaaactaaaaaaaaaaaaaccgaaaaaaaataaaattaaaaacaaaaaaacgaaaaattaaaaacgaaaaaaacgaaaacgacgaccgaaccgccctacgcccgaacgaaaccctacgatataaccgtaacttattcctaccgctttcgcaccctacgaccccccacccaatacaacaatacgaacgaacgtaaacctcgatacaccaaaaaacacttcccgcgaaaaacgctaaactcgcgctaattaaaacgaaaaaaaaaaacgacgaaaaaaaaaaaaactaacgcgcgacttaatttccattaaaaacgcaaaatttctactccgaaaaaaaacgacgacgccgcgaactcgtcgcctaaaaaaacaaaaacgaataaaaaatacgaataaccttaacctcaaccctaatacgcgaaaaccgaaaataataaccctcctaacc

SEQ ID NO: 4261 - DNA, 527 bp, Artificial Sequence
  chemically treated genomic DNA (Homo sapiens) CpG-island No: 4261
cgatttcgatttttaattcggttcgtagtcgaattcgagttgttttagtttttttttcgggacgtcggtcgcgtttttattttttttggttcggttcgcgggcgtttttatttgcgttcgggtttcgcggtcgttttagtttcgtcgcgtagtcgaatttttcgtttcggttcgcgagcgttcgtttttttttgcgggggcggggtcgatattcggggggcgggttttggcgtttcggtaaggttaatcgcgagtttcggttgcgggaggtcggagcgggggcggggcgcggggtaggtagcggggtaggttgcgtttaggagagtggggcggggtttcgggcgcgggcggggtcgggggcggggcgaagagcggttttttagggtgatttcgtgacgttaggaaggcgcgagtagtttcgcgagttcgaatttcgcgttaggtgagttggttcgaattttgtatgttagtttcgggggtttatttgttggggaagaatgttagtgattataattgttgtatcgttt

SEQ ID NO: 4262 - DNA, 527 bp, Artificial Sequence
  chemically treated genomic DNA (Homo sapiens) CpG-island No: 4262
aaacgatacaacaattataatcactaacattcttccccaacaaataaacccccgaaactaacatacaaaattcgaaccaactcacctaacgcgaaattcgaactcgcgaaactactcgcgccttcctaacgtcacgaaatcaccctaaaaaaccgctcttcgccccgcccccgaccccgcccgcgcccgaaaccccgccccactctcctaaacgcaacctaccccgctacctaccccgcgccccgcccccgctccgacctcccgcaaccgaaactcgcgattaaccttaccgaaacgccaaaacccgccccccgaatatcgaccccgcccccgcaaaaaaaaacgaacgctcgcgaaccgaaacgaaaaattcgactacgcgacgaaactaaaacgaccgcgaaacccgaacgcaaataaaaacgcccgcgaaccgaaccaaaaaaaataaaaacgcgaccgacgtcccgaaaaaaaaactaaaacaactcgaattcgactacgaaccgaattaaaaatcgaaatcg

SEQ ID NO: 4263 - DNA, 527 bp, Artificial Sequence
  chemically treated genomic DNA (Homo sapiens) CpG-island No: 4263
aagcggtgtagtagttatgattattgatatttttttttagtaaatgagttttcggagttggtatgtaggattcgaattagtttatttagcgcgggattcgaattcgcgaaattattcgcgtttttttgacgttacgaagttattttggaaagtcgtttttcgtttcgttttcggtttcgttcgcgttcggagtttcgttttatttttttgggcgtagtttatttcgttgtttgtttcgcgtttcgttttcgtttcggtttttcgtagtcggggttcgcgattggttttgtcgggacgttagggttcgtttttcgagtgtcggtttcgttttcgtagaggggagcgagcgttcgcgggtcggggcggagggttcggttgcgcggcggggttgaggcggtcgcggggttcgagcgtaggtaagggcgttcgcgaatcgggttaggggaagtgagggcgcggtcggcgtttcggagaggggattgggatagttcggattcggttgcggatcgagttgggggtcggagtcg

SEQ ID NO: 4264 - DNA, 527 bp, Artificial Sequence
  chemically treated genomic DNA (Homo sapiens) CpG-island No: 4264
cgactccgacccccaactcgatccgcaaccgaatccgaactatcccaatcccctctccgaaacgccgaccgcgccctcacttcccctaacccgattcgcgaacgcccttacctacgctcgaaccccgcgaccgcctcaaccccgccgcgcaaccgaaccctccgccccgacccgcgaacgctcgctcccctctacgaaaacgaaaccgacactcgaaaaacgaaccctaacgtcccgacaaaaccaatcgcgaaccccgactacgaaaaaccgaaacgaaaacgaaacgcgaaacaaacaacgaaataaactacgcccaaaaaaataaaacgaaactccgaacgcgaacgaaaccgaaaacgaaacgaaaaacgactttccaaaataacttcgtaacgtcaaaaaaacgcgaataatttcgcgaattcgaatcccgcgctaaataaactaattcgaatcctacataccaactccgaaaactcatttactaaaaaaaaatatcaataatcataactactacaccgctt

SEQ ID NO: 4265 - DNA, 685 bp, Artificial Sequence
  chemically treated genomic DNA (Homo sapiens) CpG-island No: 4265
cgaggggattaatgcggagaggggcggcggggtgggtttcggtggggcgggttcggtaggggggcgtttttcgggtgggggaggggaggcggtcgggagttgtttaaggtgagcgcggaggggtcggtcgggttcggcgggaagggacgggggacgttcggcgaggggtttcggagttacgcggggaagggttcggttttaaggttcgggaggttggggtcgggataaaggagggacgcgcggcggggaggacggtcggttgggggttgcgtagggatttttttttcgtttcgggtcgtttatttgggttcgttggtttttgcggcgtcgcggtcgttgtttttgttcgtttcggtgttcgttggcgtcgtcgtttttcgttcgttcgagtcgtcgtagtcgcgttcgcgtcgttttcgttcgtcgggtttcgcgtttcgtttcgtttcgtttcgtttcgtttcgtttcggggattcgcgtttacggggtcggcgcgtcgttcggttaaggttatcgtcgttttacgcgggatttttgttcgcgttcggggtgggagaggtcgttaggattcgggattttcgttttgttacgtagttatttgcgcgcgttttttttcggggtgggagttggggtcgtttttcggggaatttcgagtgggggttaggagttcggtttgggaggagt

SEQ ID NO: 4266 - DNA, 685 bp, Artificial Sequence
  chemically treated genomic DNA (Homo sapiens) CpG-island No: 4266
actcctcccaaaccgaactcctaacccccactcgaaattccccgaaaaacgaccccaactcccaccccgaaaaaaaacgcgcgcaaataactacgtaacaaaacgaaaatcccgaatcctaacgacctctcccaccccgaacgcgaacaaaaatcccgcgtaaaacgacgataaccttaaccgaacgacgcgccgaccccgtaaacgcgaatccccgaaacgaaacgaaacgaaacgaaacgaaacgaaacgcgaaacccgacgaacgaaaacgacgcgaacgcgactacgacgactcgaacgaacgaaaaacgacgacgccaacgaacaccgaaacgaacaaaaacaacgaccgcgacgccgcaaaaaccaacgaacccaaataaacgacccgaaacgaaaaaaaaatccctacgcaacccccaaccgaccgtcctccccgccgcgcgtccctcctttatcccgaccccaacctcccgaaccttaaaaccgaacccttccccgcgtaactccgaaacccctcgccgaacgtcccccgtcccttcccgccgaacccgaccgacccctccgcgctcaccttaaacaactcccgaccgcctcccctcccccacccgaaaaacgcccccctaccgaacccgccccaccgaaacccaccccgccgcccctctccgcattaatcccctcg

SEQ ID NO: 4267 - DNA, 685 bp, Artificial Sequence
  chemically treated genomic DNA (Homo sapiens) CpG-island No: 4267
gttttttttaagtcgggtttttggtttttattcggggtttttcgggaagcggttttagtttttatttcgagggagggcgcgcgtaggtggttacgtggtagggcgggggtttcggattttggcgattttttttatttcgggcgcgggtaggggtttcgcgtggggcggcggtgattttggtcgggcggcgcgtcggtttcgtgggcgcgggttttcggggcggggcggggcggggcggggcggggcggagcgcggggttcggcgggcggggacggcgcgggcgcgattgcggcggttcgggcgggcggggggcggcggcgttagcggatatcggagcgggtaggagtagcggtcgcggcgtcgtagggattagcgggtttaggtaggcggttcggggcggggagggggtttttgcgtagtttttagtcggtcgtttttttcgtcgcgcgttttttttttgtttcggttttagtttttcgggttttggggtcgggttttttttcgcgtggtttcggggtttttcgtcgggcgtttttcgttttttttcgtcgggttcggtcggttttttcgcgtttattttggatagttttcggtcgtttttttttttttattcggagggcgtttttttgtcgagttcgttttatcgaggtttatttcgtcgttttttttcgtattggttttttcg

SEQ ID NO: 4268 - DNA, 685 bp, Artificial Sequence
  chemically treated genomic DNA (Homo sapiens) CpG-island No: 4268
cgaaaaaaccaatacgaaaaaaaacgacgaaataaacctcgataaaacgaactcgacaaaaaaacgccctccgaataaaaaaaaaaaaacgaccgaaaactatccaaaataaacgcgaaaaaaccgaccgaacccgacgaaaaaaaacgaaaaacgcccgacgaaaaaccccgaaaccacgcgaaaaaaaacccgaccccaaaacccgaaaaactaaaaccgaaacaaaaaaaaaacgcgcgacgaaaaaaacgaccgactaaaaactacgcaaaaaccccctccccgccccgaaccgcctacctaaacccgctaatccctacgacgccgcgaccgctactcctacccgctccgatatccgctaacgccgccgccccccgcccgcccgaaccgccgcaatcgcgcccgcgccgtccccgcccgccgaaccccgcgctccgccccgccccgccccgccccgccccgccccgaaaacccgcgcccacgaaaccgacgcgccgcccgaccaaaatcaccgccgccccacgcgaaacccctacccgcgcccgaaataaaaaaaatcgccaaaatccgaaacccccgccctaccacgtaaccacctacgcgcgccctccctcgaaataaaaactaaaaccgcttcccgaaaaaccccgaataaaaaccaaaaacccgacttaaaaaaaac

SEQ ID NO: 4269 - DNA, 1120 bp, Artificial Sequence
  chemically treated genomic DNA (Homo sapiens) CpG-island No: 4269
gagggtagaggtgggtgacgcggttatacggtagggatatcgagggtagaggtgggtgacgtagttatacggtagggatttcgagggtagaggtgggtgacgcggttatacggtagggatatcgagggtagagatgggtgacgcggttatacggtagggatatcgagggtagaggtgggtgacgcggttatacggtagggatatcgagggtagaggtgggtgacgcggttatacggtagggatttcgagggtagaggtgggtgacgcggttatacggtagggatatcgagggtagagatgggtgacgcggttatacggtagggatatcgagggtagagatgggtgacgcggttatagggtagggatatcgagggtagagatgggtgacgcggttatacggcggggatatcgagggtagaggtgggtgacgcggttatacggtagggatatcgagggtagaggtgggtgacgcggttatacggtagggatttcgagggtagaggtgggtgacgcggttatacggtagggatatcgagggtagagatgggtgacgcggttatacggtagggatatcgagggtagaggtgggtgacgcggttatagggtagggatatcgagggtagaggtgggtgacgcggttatacggtagggatatcgagggtagaggtgggtgatacggttatacggtagggatttcgagggtagagatgggtgacgcggttatagggtagggatatcgagggtagagatgggtgacgcggttatacggtagggatatcgagggtagagatgggtgacgcggttatacggcggggatatcgagggtagaggtgggtgacgcggttatacggcggggatatcgagggtagaggtgggtgacgcggttatacggtagggatatcgagggtagaggtgggtgacgcggttatacggtagggatatcgagggtagaggtgggtgatacggttatacggtagggatttcgagggtagagatgggtgacgcggttatacggtagggatttcgagggtagagatgggtgacgcggttatagggtagggatatcgagggtagagatgggtgacgcggttatacggtagggatattagattgtttttat

SEQ ID NO: 4270 - DNA, 1120 bp, Artificial Sequence
  chemically treated genomic DNA (Homo sapiens) CpG-island No: 4270
ataaaaacaatctaatatccctaccgtataaccgcgtcacccatctctaccctcgatatccctaccctataaccgcgtcacccatctctaccctcgaaatccctaccgtataaccgcgtcacccatctctaccctcgaaatccctaccgtataaccgtatcacccacctctaccctcgatatccctaccgtataaccgcgtcacccacctctaccctcgatatccctaccgtataaccgcgtcacccacctctaccctcgatatccccgccgtataaccgcgtcacccacctctaccctcgatatccccgccgtataaccgcgtcacccatctctaccctcgatatccctaccgtataaccgcgtcacccatctctaccctcgatatccctaccctataaccgcgtcacccatctctaccctcgaaatccctaccgtataaccgtatcacccacctctaccctcgatatccctaccgtataaccgcgtcacccacctctaccctcgatatccctaccctataaccgcgtcacccacctctaccctcgatatccctaccgtataaccgcgtcacccatctctaccctcgatatccctaccgtataaccgcgtcacccacctctaccctcgaaatccctaccgtataaccgcgtcacccacctctaccctcgatatccctaccgtataaccgcgtcacccacctctaccctcgatatccccgccgtataaccgcgtcacccatctctaccctcgatatccctaccctataaccgcgtcacccatctctaccctcgatatccctaccgtataaccgcgtcacccatctctaccctcgatatccctaccgtataaccgcgtcacccacctctaccctcgaaatccctaccgtataaccgcgtcacccacctctaccctcgatatccctaccgtataaccgcgtcacccacctctaccctcgatatccctaccgtataaccgcgtcacccatctctaccctcgatatccctaccgtataaccgcgtcacccacctctaccctcgaaatccctaccgtataactacgtcacccacctctaccctcgatatccctaccgtataaccgcgtcacccacctctaccctc

SEQ ID NO: 4271 - DNA, 1120 bp, Artificial Sequence
  chemically treated genomic DNA (Homo sapiens) CpG-island No: 4271
gtgagggtaatttggtgtttttgtcgtgtggtcgcgttatttatttttgttttcggtgtttttgttttgtggtcgcgttatttatttttgttttcggagtttttgtcgtgtggtcgcgttatttatttttgttttcggagtttttgtcgtgtggtcgtgttatttatttttgttttcggtgtttttgtcgtgtggtcgcgttatttatttttgttttcggtgtttttgtcgtgtggtcgcgttatttatttttgttttcggtgttttcgtcgtgtggtcgcgttatttatttttgttttcggtgttttcgtcgtgtggtcgcgttatttatttttgttttcggtgtttttgtcgtgtggtcgcgttatttatttttgttttcggtgtttttgttttgtggtcgcgttatttatttttgttttcggagtttttgtcgtgtggtcgtgttatttatttttgttttcggtgtttttgtcgtgtggtcgcgttatttatttttgttttcggtgtttttgttttgtggtcgcgttatttatttttgttttcggtgtttttgtcgtgtggtcgcgttatttatttttgttttcggtgtttttgtcgtgtggtcgcgttatttatttttgttttcggagtttttgtcgtgtggtcgcgttatttatttttgttttcggtgtttttgtcgtgtggtcgcgttatttatttttgttttcggtgttttcgtcgtgtggtcgcgttatttatttttgttttcggtgtttttgttttgtggtcgcgttatttatttttgttttcggtgtttttgtcgtgtggtcgcgttatttatttttgttttcggtgtttttgtcgtgtggtcgcgttatttatttttgttttcggagtttttgtcgtgtggtcgcgttatttatttttgttttcggtgtttttgtcgtgtggtcgcgttatttatttttgttttcggtgtttttgtcgtgtggtcgcgttatttatttttgttttcggtgtttttgtcgtgtggtcgcgttatttatttttgttttcggagtttttgtcgtgtggttgcgttatttatttttgttttcggtgtttttgtcgtgtggtcgcgttatttatttttgttttt

SEQ ID NO: 4272 - DNA, 1120 bp, Artificial Sequence
  chemically treated genomic DNA (Homo sapiens) CpG-island No: 4272
aaaaacaaaaataaataacgcgaccacacgacaaaaacaccgaaaacaaaaataaataacgcaaccacacgacaaaaactccgaaaacaaaaataaataacgcgaccacacgacaaaaacaccgaaaacaaaaataaataacgcgaccacacgacaaaaacaccgaaaacaaaaataaataacgcgaccacacgacaaaaacaccgaaaacaaaaataaataacgcgaccacacgacaaaaactccgaaaacaaaaataaataacgcgaccacacgacaaaaacaccgaaaacaaaaataaataacgcgaccacacgacaaaaacaccgaaaacaaaaataaataacgcgaccacaaaacaaaaacaccgaaaacaaaaataaataacgcgaccacacgacgaaaacaccgaaaacaaaaataaataacgcgaccacacgacaaaaacaccgaaaacaaaaataaataacgcgaccacacgacaaaaactccgaaaacaaaaataaataacgcgaccacacgacaaaaacaccgaaaacaaaaataaataacgcgaccacacgacaaaaacaccgaaaacaaaaataaataacgcgaccacaaaacaaaaacaccgaaaacaaaaataaataacgcgaccacacgacaaaaacaccgaaaacaaaaataaataacacgaccacacgacaaaaactccgaaaacaaaaataaataacgcgaccacaaaacaaaaacaccgaaaacaaaaataaataacgcgaccacacgacaaaaacaccgaaaacaaaaataaataacgcgaccacacgacgaaaacaccgaaaacaaaaataaataacgcgaccacacgacgaaaacaccgaaaacaaaaataaataacgcgaccacacgacaaaaacaccgaaaacaaaaataaataacgcgaccacacgacaaaaacaccgaaaacaaaaataaataacacgaccacacgacaaaaactccgaaaacaaaaataaataacgcgaccacacgacaaaaactccgaaaacaaaaataaataacgcgaccacaaaacaaaaacaccgaaaacaaaaataaataacgcgaccacacgacaaaaacaccaaattaccctcac

SEQ ID NO: 4273 - DNA, 634 bp, Artificial Sequence
  chemically treated genomic DNA (Homo sapiens) CpG-island No: 4273
gagtcgcgtagaggtttagaggcgttagcggcgtgcgcggtttttaaggaaatcgttcgttttagttattttagcggttttggaatggtagagtaagaggtttcgtttacgtatcgtcgagattaataacggatcgggagggttacggcgagtgcgtagagggttttagcgtattttcggttttttttttttagttgtgggcggggtttaggggcgcgtgcgttttgttttttttgtgcgcgcgtcgttttagtatgtttcgggagcgcgggcggcgggttttttggtttttaggcggtcgtggcggcggtggcggcggttgggtcgaggtaggcggttttagtggtcgaggtggttggacgcgtagtaggtggaaggagggagggagtcgtaggcgtagatttattcgttatgaagtttttcgtaggtatcgattatttcgttcgtcggattcgggcgttttttgtattttcgtttttttcggggtcgcgatttgggtttaaggttggagcgaagcgattttcgagttattttcggtcgggttggaggggtagcgggggaggtggacgattttgttttttcgtttgtcgaatgaatgaattagtttttttagcgttttatttattttgtaaag

SEQ ID NO: 4274 - DNA, 634 bp, Artificial Sequence
  chemically treated genomic DNA (Homo sapiens) CpG-island No: 4274
ctttacaaaataaataaaacgctaaaaaaactaattcattcattcgacaaacgaaaaaacaaaatcgtccacctcccccgctacccctccaacccgaccgaaaataactcgaaaatcgcttcgctccaaccttaaacccaaatcgcgaccccgaaaaaaacgaaaatacaaaaaacgcccgaatccgacgaacgaaataatcgatacctacgaaaaacttcataacgaataaatctacgcctacgactccctccctccttccacctactacgcgtccaaccacctcgaccactaaaaccgcctacctcgacccaaccgccgccaccgccgccacgaccgcctaaaaaccaaaaaacccgccgcccgcgctcccgaaacatactaaaacgacgcgcgcacaaaaaaaacaaaacgcacgcgcccctaaaccccgcccacaactaaaaaaaaaaaaccgaaaatacgctaaaaccctctacgcactcgccgtaaccctcccgatccgttattaatctcgacgatacgtaaacgaaacctcttactctaccattccaaaaccgctaaaataactaaaacgaacgatttccttaaaaaccgcgcacgccgctaacgcctctaaacctctacgcgactc

SEQ ID NO: 4275 - DNA, 634 bp, Artificial Sequence
  chemically treated genomic DNA (Homo sapiens) CpG-island No: 4275
ttttgtagaatgaatgaagcgttggaaaagttggtttatttattcggtaaacgagagagtagggtcgtttatttttttcgttgtttttttagttcggtcgagggtggttcgggggtcgtttcgttttagttttaggtttaagtcgcgatttcgggaggagcgagggtgtaggggacgttcgggttcggcgagcggggtagtcggtatttgcggggggttttatggcgggtgggtttgcgtttgcggttttttttttttttttatttgttacgcgtttagttatttcggttattgaggtcgtttgtttcggtttaatcgtcgttatcgtcgttacggtcgtttgaggattaaggggttcgtcgttcgcgttttcggggtatgttggggcggcgcgcgtatagggagggtaggacgtacgcgtttttgagtttcgtttatagttaaaggaggagggtcgggagtgcgttggagttttttgcgtattcgtcgtaattttttcggttcgttattggtttcggcggtgcgtgggcggagttttttgttttattattttagagtcgttggggtggttaggacggacggtttttttggaaatcgcgtacgtcgttgacgtttttgagtttttgcgcggttt

SEQ ID NO: 4276 - DNA, 634 bp, Artificial Sequence
  chemically treated genomic DNA (Homo sapiens) CpG-island No: 4276
aaaccgcgcaaaaactcaaaaacgtcaacgacgtacgcgatttccaaaaaaaccgtccgtcctaaccaccccaacgactctaaaataataaaacaaaaaactccgcccacgcaccgccgaaaccaataacgaaccgaaaaaattacgacgaatacgcaaaaaactccaacgcactcccgaccctcctcctttaactataaacgaaactcaaaaacgcgtacgtcctaccctccctatacgcgcgccgccccaacataccccgaaaacgcgaacgacgaaccccttaatcctcaaacgaccgtaacgacgataacgacgattaaaccgaaacaaacgacctcaataaccgaaataactaaacgcgtaacaaataaaaaaaaaaaaaaaaccgcaaacgcaaacccacccgccataaaaccccccgcaaataccgactaccccgctcgccgaacccgaacgtcccctacaccctcgctcctcccgaaatcgcgacttaaacctaaaactaaaacgaaacgacccccgaaccaccctcgaccgaactaaaaaaacaacgaaaaaaataaacgaccctactctctcgtttaccgaataaataaaccaacttttccaacgcttcattcattctacaaaa

SEQ ID NO: 4277 - DNA, 518 bp, Artificial Sequence
  chemically treated genomic DNA (Homo sapiens) CpG-island No: 4277
ttttaatatcgttatttttaatatcgtcgtttttcgatatttttattttcggatatttttattttttgatttatttattttttaatattaatatttttcgatatatttatttttcgatatttttattttttaatattaatatttttcgatatttttatttttcgatatttttatttttcgatattaatattttttaatattaatatttttttatatttttattttttaatattaatattttttgatatttttatttttcgatatttttattttttaatattaatatttttcgatatttttatttttcgatattaatatttttcgatattaatatttttcgatattaatattttacgatatttatatttttcgatattaatatttttcgatattaatatttttcgatatttttatttttcgatatcgttatttttcgatattcgtatttttcgatattattatttttggtattaagtttttggtgtattttggaggggacgtatttaattagagtagag

SEQ ID NO: 4278 - DNA, 518 bp, Artificial Sequence
  chemically treated genomic DNA (Homo sapiens) CpG-island No: 4278
ctctactctaattaaatacgtcccctccaaaatacaccaaaaacttaataccaaaaataataatatcgaaaaatacgaatatcgaaaaataacgatatcgaaaaataaaaatatcgaaaaatattaatatcgaaaaatattaatatcgaaaaatataaatatcgtaaaatattaatatcgaaaaatattaatatcgaaaaatattaatatcgaaaaataaaaatatcgaaaaatattaatattaaaaaataaaaatatcgaaaaataaaaatatcaaaaaatattaatattaaaaaataaaaatataaaaaaatattaatattaaaaaatattaatatcgaaaaataaaaatatcgaaaaataaaaatatcgaaaaatattaatattaaaaaataaaaatatcgaaaaataaatatatcgaaaaatattaatattaaaaaataaataaatcaaaaaataaaaatatccgaaaataaaaatatcgaaaaacgacgatattaaaaataacgatattaaaa

SEQ ID NO: 4279 - DNA, 518 bp, Artificial Sequence
  chemically treated genomic DNA (Homo sapiens) CpG-island No: 4279
ttttgttttggttgggtgcgttttttttaaaatgtattaggaatttaatgttagagatggtggtgtcgggagatgcgggtatcgggaggtggcggtgtcgggaggtgggggtgtcggaaggtgttggtgtcgggaggtgttggtgtcgggaggtgtgggtgtcgtgaggtgttggtgtcgggaggtgttggtgtcgggaggtgttggtgtcgggaggtgggggtgtcgggaggtgttggtgttgggaggtgggggtgtcgggaggtgggggtgttaggaggtgttagtgttgggaggtgggggtgtggggaagtgttggtgttgggaggtgttggtgtcgggaggtgggggtgtcgggaagtgggggtgtcgggaggtgttggtattgggaggtgggggtgtcgggaggtgggtgtgtcgggaggtgttggtgttgggaggtgggtgggttaggaggtgggggtgttcggaggtggaggtatcgggagacggcggtgttggaggtggcggtgttggag

SEQ ID NO: 4280 - DNA, 518 bp, Artificial Sequence
  chemically treated genomic DNA (Homo sapiens) CpG-island No: 4280
ctccaacaccgccacctccaacaccgccgtctcccgatacctccacctccgaacacccccacctcctaacccacccacctcccaacaccaacacctcccgacacacccacctcccgacacccccacctcccaataccaacacctcccgacacccccacttcccgacacccccacctcccgacaccaacacctcccaacaccaacacttccccacacccccacctcccaacactaacacctcctaacacccccacctcccgacacccccacctcccaacaccaacacctcccgacacccccacctcccgacaccaacacctcccgacaccaacacctcccgacaccaacacctcacgacacccacacctcccgacaccaacacctcccgacaccaacaccttccgacacccccacctcccgacaccgccacctcccgatacccgcatctcccgacaccaccatctctaacattaaattcctaatacattttaaaaaaaacgcacccaaccaaaacaaaa

SEQ ID NO: 4281 - DNA, 635 bp, Artificial Sequence
  chemically treated genomic DNA (Homo sapiens) CpG-island No: 4281
ggggattttagcgaattatacggggtggatttaatagtcgtaggggtatcgtggttttgcggagacgtcgttcgttcggaggcggcgttgtgatttaggttggagagttaggagtttagcgtcgcgttgcggggtttgttgggatttgtagttcgtaggttcggggtgcgtaggcgtagtgtcgagtttatttttgcgcgcgtcggggttggtggcggcggttgcggcgagtttttgaggggcgtttgcggggggcgttcgtttcgagcgtcgaggagtcgagcggaggaggcgttttagggatacgtaggggaggtcggtcggtttgtacggggcgttttcgtttcgggggttttgtttggcgttttagcgcgcgtttcgatggttatttgcgtttatttgggtcggcgcgcgcggttttcggtagtttagtcgtaagtgtcgtcgtttttcgcgtcgcgattttcgtgtcgggtttgtcggggttttggtggggttgggtttggcggggtcgggtggtcggggtatgattttgtcgcgatagggtttttacgggagggtcgggagtcggtagttcgtttagggttttaacgtttaggatggtacggtttgtttttgttttgtgaaaacgtttt

SEQ ID NO: 4282 - DNA, 635 bp, Artificial Sequence
  chemically treated genomic DNA (Homo sapiens) CpG-island No: 4282
aaaacgttttcacaaaacaaaaacaaaccgtaccatcctaaacgttaaaaccctaaacgaactaccgactcccgaccctcccgtaaaaaccctatcgcgacaaaatcataccccgaccacccgaccccgccaaacccaaccccaccaaaaccccgacaaacccgacacgaaaatcgcgacgcgaaaaacgacgacacttacgactaaactaccgaaaaccgcgcgcgccgacccaaataaacgcaaataaccatcgaaacgcgcgctaaaacgccaaacaaaacccccgaaacgaaaacgccccgtacaaaccgaccgacctcccctacgtatccctaaaacgcctcctccgctcgactcctcgacgctcgaaacgaacgccccccgcaaacgcccctcaaaaactcgccgcaaccgccgccaccaaccccgacgcgcgcaaaaataaactcgacactacgcctacgcaccccgaacctacgaactacaaatcccaacaaaccccgcaacgcgacgctaaactcctaactctccaacctaaatcacaacgccgcctccgaacgaacgacgtctccgcaaaaccacgatacccctacgactattaaatccaccccgtataattcgctaaaatcccc

SEQ ID NO: 4283 - DNA, 635 bp, Artificial Sequence
  chemically treated genomic DNA (Homo sapiens) CpG-island No: 4283
ggggcgtttttatagggtaagggtagatcgtgttattttgggcgttggggttttgggcgagttgtcggttttcgattttttcgtggggattttatcgcgatagggttatgtttcggttattcggtttcgttagatttagttttattagagtttcggtaggttcggtacggaggtcgcggcgcgggaggcggcggtatttacggttgagttgtcgggagtcgcgcgcgtcggtttaggtgggcgtaggtgattatcggggcgcgcgttgaggcgttagatagggttttcgaggcgggagcgtttcgtgtaggtcggtcggttttttttgcgtgtttttgggacgtttttttcgttcggtttttcggcgttcggagcggacgtttttcgtaggcgttttttaggaattcgtcgtagtcgtcgttattaatttcgacgcgcgtagaggtaaattcggtattgcgtttgcgtatttcgaatttgcgaattataagttttagtaggtttcgtagcgcggcgttgggtttttgattttttaatttgggttatagcgtcgttttcgggcgggcggcgttttcgtaggattacgatgtttttgcggttgttggatttatttcgtgtggttcgttggagttttt

SEQ ID NO: 4284 - DNA, 635 bp, Artificial Sequence
  chemically treated genomic DNA (Homo sapiens) CpG-island No: 4284
aaaaactccaacgaaccacacgaaataaatccaacaaccgcaaaaacatcgtaatcctacgaaaacgccgcccgcccgaaaacgacgctataacccaaattaaaaaatcaaaaacccaacgccgcgctacgaaacctactaaaacttataattcgcaaattcgaaatacgcaaacgcaataccgaatttacctctacgcgcgtcgaaattaataacgacgactacgacgaattcctaaaaaacgcctacgaaaaacgtccgctccgaacgccgaaaaaccgaacgaaaaaaacgtcccaaaaacacgcaaaaaaaaccgaccgacctacacgaaacgctcccgcctcgaaaaccctatctaacgcctcaacgcgcgccccgataatcacctacgcccacctaaaccgacgcgcgcgactcccgacaactcaaccgtaaataccgccgcctcccgcgccgcgacctccgtaccgaacctaccgaaactctaataaaactaaatctaacgaaaccgaataaccgaaacataaccctatcgcgataaaatccccacgaaaaaatcgaaaaccgacaactcgcccaaaaccccaacgcccaaaataacacgatctacccttaccctataaaaacgcccc

SEQ ID NO: 4285 - DNA, 572 bp, Artificial Sequence
  chemically treated genomic DNA (Homo sapiens) CpG-island No: 4285
cgtttcggtcgcggttgtagcggttattagcgggtcgtttttttcgttcgtttcgtcgttcgtttcggtttcgaggtagtcgttggcggttgcggttaacgtaaaggattttagggtttcgggaggcgggggcggcggcggggcggttttttcggttggttcggtttcggtttcgttcgcgtaggatgttaggaggttggcggcggcggcggttgttgggttggtttcggcggttacggcggttaggacgtcggaagttgcggtcgagttgaggtttaggtttagggagttggtgttgtagtcgtaatttgttagcgtgttaagcgtcgtgttgatggttagtaggtcggtgtttgagaaggcgggtagcgcggcgggaaaggtttttacgttagttagttcggcggggtttagtaggtcggaggcggcggcggtcgacgttgcggtcgcggttggtagtatattcgcggggttggcgtacggagagtcggtggggttggagttggttacggggtttgttacgttggcgtagttgatgttgaggtagttgttgttttgggggtttttttgta

SEQ ID NO: 4286 - DNA, 572 bp, Artificial Sequence
  chemically treated genomic DNA (Homo sapiens) CpG-island No: 4286
tacaaaaaaacccccaaaacaacaactacctcaacatcaactacgccaacgtaacaaaccccgtaaccaactccaaccccaccgactctccgtacgccaaccccgcgaatatactaccaaccgcgaccgcaacgtcgaccgccgccgcctccgacctactaaaccccgccgaactaactaacgtaaaaacctttcccgccgcgctacccgccttctcaaacaccgacctactaaccatcaacacgacgcttaacacgctaacaaattacgactacaacaccaactccctaaacctaaacctcaactcgaccgcaacttccgacgtcctaaccgccgtaaccgccgaaaccaacccaacaaccgccgccgccgccaacctcctaacatcctacgcgaacgaaaccgaaaccgaaccaaccgaaaaaaccgccccgccgccgcccccgcctcccgaaaccctaaaatcctttacgttaaccgcaaccgccaacgactacctcgaaaccgaaacgaacgacgaaacgaacgaaaaaaacgacccgctaataaccgctacaaccgcgaccgaaacg

SEQ ID NO: 4287 - DNA, 572 bp, Artificial Sequence
  chemically treated genomic DNA (Homo sapiens) CpG-island No: 4287
tataagaagatttttagagtagtagttgttttaatattagttacgttaacgtggtaggtttcgtggttaattttaattttatcggtttttcgtacgttagtttcgcggatgtgttgttagtcgcggtcgtagcgtcggtcgtcgtcgttttcggtttgttgggtttcgtcgggttggttggcgtgggggtttttttcgtcgcgttgttcgtttttttaggtatcgatttgttggttattagtacggcgtttaatacgttggtaagttacggttataatattaattttttgggtttgggttttaattcggtcgtagttttcggcgttttggtcgtcgtggtcgtcggggttaatttagtagtcgtcgtcgtcgttaattttttggtattttacgcgggcgaggtcggggtcgggttagtcggaggggtcgtttcgtcgtcgttttcgtttttcggagttttggggttttttgcgttggtcgtagtcgttaacggttatttcggggtcggggcgggcggcggggcgggcggagggggcggttcgttggtggtcgttgtagtcgcggtcggggcg

SEQ ID NO: 4288 - DNA, 572 bp, Artificial Sequence
  chemically treated genomic DNA (Homo sapiens) CpG-island No: 4288
cgccccgaccgcgactacaacgaccaccaacgaaccgccccctccgcccgccccgccgcccgccccgaccccgaaataaccgttaacgactacgaccaacgcaaaaaaccccaaaactccgaaaaacgaaaacgacgacgaaacgacccctccgactaacccgaccccgacctcgcccgcgtaaaataccaaaaaattaacgacgacgacgactactaaattaaccccgacgaccacgacgaccaaaacgccgaaaactacgaccgaattaaaacccaaacccaaaaaattaatattataaccgtaacttaccaacgtattaaacgccgtactaataaccaacaaatcgatacctaaaaaaacgaacaacgcgacgaaaaaaacccccacgccaaccaacccgacgaaacccaacaaaccgaaaacgacgacgaccgacgctacgaccgcgactaacaacacatccgcgaaactaacgtacgaaaaaccgataaaattaaaattaaccacgaaacctaccacgttaacgtaactaatattaaaacaactactactctaaaaatcttcttata

SEQ ID NO: 4289 - DNA, 579 bp, Artificial Sequence
  chemically treated genomic DNA (Homo sapiens) CpG-island No: 4289
tcgagaggattcgagtggggtcgaggttagtagtttcggggttttgagtagaggtcgtagtttgcgtcgtattcgcggttaggcggagttaaagatgtcggtttttgttgcgcggtttcgttcgggtttcgggtagtttatagtttcgtttttttcgttattgttgttggcggtgttgagcggttcggtattcggtcgcgtttttcgttcggtgtttagaatttcgtttttaatttttggtaaggcgcggacgtttacgtttttagtttttcgcgtttatatttatatttatatttatttgttttttagatcgttcggtcggattcgggttttttagtttggtgtatggcgttttacgtcgtttacgtttcgtcgggatcggggcgagattttcgtattttatcgtattttttttgtatttttttcgcgttttttagttttttatttttagttcgggtttcgcgtttcggtttttacgatacgtttaggttgtattagcgggttttattttcggagtcgtaggagcgtttagtttttatcgtgtagattcggatattgaggtttagagttcgggtgggg

SEQ ID NO: 4290 - DNA, 579 bp, Artificial Sequence
  chemically treated genomic DNA (Homo sapiens) CpG-island No: 4290
ccccacccgaactctaaacctcaatatccgaatctacacgataaaaactaaacgctcctacgactccgaaaataaaacccgctaatacaacctaaacgtatcgtaaaaaccgaaacgcgaaacccgaactaaaaataaaaaactaaaaaacgcgaaaaaaatacaaaaaaaatacgataaaatacgaaaatctcgccccgatcccgacgaaacgtaaacgacgtaaaacgccatacaccaaactaaaaaacccgaatccgaccgaacgatctaaaaaacaaataaatataaatataaatataaacgcgaaaaactaaaaacgtaaacgtccgcgccttaccaaaaattaaaaacgaaattctaaacaccgaacgaaaaacgcgaccgaataccgaaccgctcaacaccgccaacaacaataacgaaaaaaacgaaactataaactacccgaaacccgaacgaaaccgcgcaacaaaaaccgacatctttaactccgcctaaccgcgaatacgacgcaaactacgacctctactcaaaaccccgaaactactaacctcgaccccactcgaatcctctcga

SEQ ID NO: 4291 - DNA, 579 bp, Artificial Sequence
  chemically treated genomic DNA (Homo sapiens) CpG-island No: 4291
ttttattcgagttttgggttttagtgttcgagtttgtacggtgaggattggacgtttttgcggtttcgggaatagggttcgttggtgtagtttgggcgtgtcgtgggagtcgaggcgcgaggttcgggttggggatgaggggttgaggggcgcgggagggatgtagagaggatgcggtgaagtgcgaagatttcgtttcggtttcggcggggcgtgggcggcgtgaaacgttatatattaggttgagaggttcgggttcggtcgagcggtttgaggagtaggtgggtgtgggtgtgggtgtgggcgcgaagggttgagggcgtgggcgttcgcgttttattagagattggaagcgaggttttgggtatcgagcgggggacgcggtcggatatcgggtcgtttagtatcgttagtagtagtagcgggaagggcgaggttgtaggttgttcgggattcgggcggggtcgcgtagtagaggtcggtatttttggtttcgtttggtcgcgggtgcggcgtaagttacggtttttgtttagggtttcggggttattggtttcggttttattcgggttttttcgg

SEQ ID NO: 4292 - DNA, 579 bp, Artificial Sequence
  chemically treated genomic DNA (Homo sapiens) CpG-island No: 4292
ccgaaaaaacccgaataaaaccgaaaccaataaccccgaaaccctaaacaaaaaccgtaacttacgccgcacccgcgaccaaacgaaaccaaaaataccgacctctactacgcgaccccgcccgaatcccgaacaacctacaacctcgcccttcccgctactactactaacgatactaaacgacccgatatccgaccgcgtcccccgctcgatacccaaaacctcgcttccaatctctaataaaacgcgaacgcccacgccctcaacccttcgcgcccacacccacacccacacccacctactcctcaaaccgctcgaccgaacccgaacctctcaacctaatatataacgtttcacgccgcccacgccccgccgaaaccgaaacgaaatcttcgcacttcaccgcatcctctctacatccctcccgcgcccctcaacccctcatccccaacccgaacctcgcgcctcgactcccacgacacgcccaaactacaccaacgaaccctattcccgaaaccgcaaaaacgtccaatcctcaccgtacaaactcgaacactaaaacccaaaactcgaataaaa

SEQ ID NO: 4293 - DNA, 769 bp, Artificial Sequence
  chemically treated genomic DNA (Homo sapiens) CpG-island No: 4293
aacgttcgcgtcggaatttgcgaaggacgttgtttggtagcgcgtagttgattaggaagacgtggatttcgagaaataggcgtaggacgaggaggtagaattcgattggcgcgtagagtagtagtacgagtagtaggaagtagttattcggaagtttgggggcgagaggcgaagtggttaggcgtcgaaggtcgagagtacgcggggatcggttttttttcgtcgggttttttatcggtgcgagttaaagagtcgtttcggtttcggttttgagggaagttttataattgttgttttaggagcgttcggtcgtcgtcgtcgtcgttattttcgcgttcggtcgtaggggtttttgggaaggcggagtttttgggtattcgttcggggtgaggggattcgaagttttgaggcgcgtcggaagggttagcggttttagtatatttcgcggttttttgggtcgttttataattcgcgttcggcggagattataattttcggtattcgtggggtagggaggagtcggtttttcggaattttggtttcggcgtgtatttttgaaggattttaggtatcggcgtgtttcgcgttttattgttcgtttgttcgcgttttgggtgtcgtttttgagtagggcgggcgaggaggtagttaaggcggagttgatggttgcgtcgagggcggggcggggtgtaggttggagttttcgggtatggcgggttttggggggtattcgttgggggaggagatttcgtttgatttttgattttcg

SEQ ID NO: 4294 - DNA, 769 bp, Artificial Sequence
  chemically treated genomic DNA (Homo sapiens) CpG-island No: 4294
cgaaaatcaaaaatcaaacgaaatctcctcccccaacgaataccccccaaaacccgccatacccgaaaactccaacctacaccccgccccgccctcgacgcaaccatcaactccgccttaactacctcctcgcccgccctactcaaaaacgacacccaaaacgcgaacaaacgaacaataaaacgcgaaacacgccgatacctaaaatccttcaaaaatacacgccgaaaccaaaattccgaaaaaccgactcctccctaccccacgaataccgaaaattataatctccgccgaacgcgaattataaaacgacccaaaaaaccgcgaaatatactaaaaccgctaacccttccgacgcgcctcaaaacttcgaatcccctcaccccgaacgaatacccaaaaactccgccttcccaaaaacccctacgaccgaacgcgaaaataacgacgacgacgacgaccgaacgctcctaaaacaacaattataaaacttccctcaaaaccgaaaccgaaacgactctttaactcgcaccgataaaaaacccgacgaaaaaaaaccgatccccgcgtactctcgaccttcgacgcctaaccacttcgcctctcgcccccaaacttccgaataactacttcctactactcgtactactactctacgcgccaatcgaattctacctcctcgtcctacgcctatttctcgaaatccacgtcttcctaatcaactacgcgctaccaaacaacgtccttcgcaaattccgacgcgaacgtt

SEQ ID NO: 4295 - DNA, 769 bp, Artificial Sequence
  chemically treated genomic DNA (Homo sapiens) CpG-island No: 4295
cggaggttaggggttaaacggggtttttttttttagcgaatgttttttaaagttcgttatgttcgaaggttttagtttgtatttcgtttcgttttcggcgtagttattagtttcgttttggttgttttttcgttcgttttatttagaggcggtatttaggacgcgagtaggcggatagtaggacgcggggtacgtcggtatttgaagttttttagaagtgtacgtcgggattaggatttcgggaggtcgatttttttttgttttacgaatgtcgggaattgtggttttcgtcggacgcgagttgtgagacggtttaaggggtcgcggggtatgttgggatcgttagttttttcggcgcgttttaggatttcgggtttttttatttcgggcggatgtttaaagatttcgtttttttaagagtttttgcggtcgggcgcgaaaatggcggcggcggcgacggtcgggcgtttttgaagtagtagttatggagttttttttagggtcggggtcggagcggttttttgattcgtatcggtaagagattcggcgggaagagatcgattttcgcgtgttttcggttttcggcgtttgattatttcgtttttcgtttttaggttttcgggtgattgttttttattgttcgtgttgttgttttacgcgttagtcgggttttgttttttcgttttgcgtttgtttttcgggatttacgtttttttggttagttgcgcgttgttagatagcgtttttcgtaggtttcgacgcgggcgtt

SEQ ID NO: 4296 - DNA, 769 bp, Artificial Sequence
  chemically treated genomic DNA (Homo sapiens) CpG-island No: 4296
aacgcccgcgtcgaaacctacgaaaaacgctatctaacaacgcgcaactaaccaaaaaaacgtaaatcccgaaaaacaaacgcaaaacgaaaaaacaaaacccgactaacgcgtaaaacaacaacacgaacaataaaaaacaatcacccgaaaacctaaaaacgaaaaacgaaataatcaaacgccgaaaaccgaaaacacgcgaaaatcgatctcttcccgccgaatctcttaccgatacgaatcaaaaaaccgctccgaccccgaccctaaaaaaaactccataactactacttcaaaaacgcccgaccgtcgccgccgccgccattttcgcgcccgaccgcaaaaactcttaaaaaaacgaaatctttaaacatccgcccgaaataaaaaaacccgaaatcctaaaacgcgccgaaaaaactaacgatcccaacataccccgcgaccccttaaaccgtctcacaactcgcgtccgacgaaaaccacaattcccgacattcgtaaaacaaaaaaaaatcgacctcccgaaatcctaatcccgacgtacacttctaaaaaacttcaaataccgacgtaccccgcgtcctactatccgcctactcgcgtcctaaataccgcctctaaataaaacgaacgaaaaaacaaccaaaacgaaactaataactacgccgaaaacgaaacgaaatacaaactaaaaccttcgaacataacgaactttaaaaaacattcgctaaaaaaaaaaaccccgtttaacccctaacctccg

SEQ ID NO: 4297 - DNA, 504 bp, Artificial Sequence
  chemically treated genomic DNA (Homo sapiens) CpG-island No: 4297
cgtatttcgaggagttgaggaatagagagcgaggtgaggcgtcgaaataaggaaggagttagggggagtggagcgagattgggcggtggacgggacgggtcgggtcggggttagagggcggggtttgagtcgggagggggcggagataggggcggggtaggcgagggcgggagcggttgtcgtcgcgcggttaggattgtttgaggggaagttcgcgagcgttggttatgggttttggggcgcggttggcggcgttgttggcggtgttggcgttcgggataggagatttagaaagggttgcggttcggggcgatacgttttcggcgttgattagcgtggcgcgcgttttggcgttcgagcgtcggttgttggggttgttgaggcggtatttgcgcggggaggaggcgcggttgcgggatttgattaggtgagggtacgacgagtgggagcgattaaggggttttagtgggatatattgtgtcgtagggtggggtgatttaggtt

SEQ ID NO: 4298 - DNA, 504 bp, Artificial Sequence
  chemically treated genomic DNA (Homo sapiens) CpG-island No: 4298
aacctaaatcaccccaccctacgacacaatatatcccactaaaaccccttaatcgctcccactcgtcgtaccctcacctaatcaaatcccgcaaccgcgcctcctccccgcgcaaataccgcctcaacaaccccaacaaccgacgctcgaacgccaaaacgcgcgccacgctaatcaacgccgaaaacgtatcgccccgaaccgcaaccctttctaaatctcctatcccgaacgccaacaccgccaacaacgccgccaaccgcgccccaaaacccataaccaacgctcgcgaacttcccctcaaacaatcctaaccgcgcgacgacaaccgctcccgccctcgcctaccccgcccctatctccgccccctcccgactcaaaccccgccctctaaccccgacccgacccgtcccgtccaccgcccaatctcgctccactccccctaactccttccttatttcgacgcctcacctcgctctctattcctcaactcctcgaaatacg

SEQ ID NO: 4299 - DNA, 504 bp, Artificial Sequence
  chemically treated genomic DNA (Homo sapiens) CpG-island No: 4299
aatttgagttattttattttgcggtatagtgtattttattgaggttttttggtcgtttttattcgtcgtgtttttatttagttaggtttcgtagtcgcgtttttttttcgcgtaggtatcgttttagtagttttagtagtcggcgttcgggcgttagggcgcgcgttacgttggttagcgtcgagaacgtgtcgtttcgagtcgtagttttttttgggttttttgtttcgagcgttagtatcgttagtagcgtcgttagtcgcgttttaggatttatagttagcgttcgcgaatttttttttagatagttttggtcgcgcggcggtagtcgttttcgttttcgtttgtttcgtttttgttttcgttttttttcggtttaggtttcgttttttggtttcggttcggttcgtttcgtttatcgtttagtttcgttttattttttttgattttttttttgtttcgacgttttatttcgttttttattttttagtttttcggaatgcg

SEQ ID NO: 4300 - DNA, 504 bp, Artificial Sequence
  chemically treated genomic DNA (Homo sapiens) CpG-island No: 4300
cgcattccgaaaaactaaaaaataaaaaacgaaataaaacgtcgaaacaaaaaaaaaatcaaaaaaaataaaacgaaactaaacgataaacgaaacgaaccgaaccgaaaccaaaaaacgaaacctaaaccgaaaaaaaacgaaaacaaaaacgaaacaaacgaaaacgaaaacgactaccgccgcgcgaccaaaactatctaaaaaaaaattcgcgaacgctaactataaatcctaaaacgcgactaacgacgctactaacgatactaacgctcgaaacaaaaaacccaaaaaaaactacgactcgaaacgacacgttctcgacgctaaccaacgtaacgcgcgccctaacgcccgaacgccgactactaaaactactaaaacgatacctacgcgaaaaaaaaacgcgactacgaaacctaactaaataaaaacacgacgaataaaaacgaccaaaaaacctcaataaaatacactataccgcaaaataaaataactcaaatt

SEQ ID NO: 4301 - DNA, 550 bp, Artificial Sequence
  chemically treated genomic DNA (Homo sapiens) CpG-island No: 4301
ttgtcgtttttcgtcgtatgcgcgtatatcgatatcgttcgtattattcgttgcgcggtgacgagatttgttagatgtttaacgtgaagcggggcgttttttatttgcgtcgtcgatttgacgattatcgtttcggtttttagtgtagtagttcgattggtatataacgcggcgatacgattcgcgcgcgtagcgcgcgaatatcgtcggagtagttatacgagttagtcgacgtataggttagtaggtattcgttagtgtacggtaaggcgagaaaaggagttagcggtcgagtataagttcgggcgtatggtcgaattacgaaatattcggtttcgattcgtagaggcggtcgaagttcgttcgcgtcggattcggatttttataggttttattcgtttaatttggcgttcgtggttttgtggaatcgagttcgtatcgtcgtatatcggtaagttttatcgtattttaggtgcggttagattacggggttggttattgttgattcgtcgcggttaaggagtttatatagggtttttattaggggagg

SEQ ID NO: 4302 - DNA, 550 bp, Artificial Sequence
  chemically treated genomic DNA (Homo sapiens) CpG-island No: 4302
cctcccctaataaaaaccctatataaactccttaaccgcgacgaatcaacaataaccaaccccgtaatctaaccgcacctaaaatacgataaaacttaccgatatacgacgatacgaactcgattccacaaaaccacgaacgccaaattaaacgaataaaacctataaaaatccgaatccgacgcgaacgaacttcgaccgcctctacgaatcgaaaccgaatatttcgtaattcgaccatacgcccgaacttatactcgaccgctaactccttttctcgccttaccgtacactaacgaatacctactaacctatacgtcgactaactcgtataactactccgacgatattcgcgcgctacgcgcgcgaatcgtatcgccgcgttatataccaatcgaactactacactaaaaaccgaaacgataatcgtcaaatcgacgacgcaaataaaaaacgccccgcttcacgttaaacatctaacaaatctcgtcaccgcgcaacgaataatacgaacgatatcgatatacgcgcatacgacgaaaaacgacaa

SEQ ID NO: 4303 - DNA, 550 bp, Artificial Sequence
  chemically treated genomic DNA (Homo sapiens) CpG-island No: 4303
ttttttttggtgaagattttgtgtagattttttgatcgcggcgggttagtaatggttagtttcgtgatttaatcgtatttgggatgcgatgggatttatcgatatgcggcggtacgggttcggttttatagaattacggacgttaaattagacgggtaggatttgtagggattcggattcggcgcggacgggtttcggtcgtttttgcgggtcgggatcggatgtttcgtggttcggttatgcgttcgagtttgtattcggtcgttgattttttttttcgttttatcgtgtattaacgggtgtttgttggtttatacgtcggttgattcgtgtaattgtttcgacgatgttcgcgcgttgcgcgcgcgagtcgtgtcgtcgcgttgtgtgttaatcgaattgttgtattgagggtcgggacgatgatcgttaggtcggcgacgtagataggggacgtttcgttttacgttggatatttggtaaatttcgttatcgcgtaacgagtaatgcgggcgatatcgatatgcgcgtatgcgacgaaaggcggtag

SEQ ID NO: 4304 - DNA, 550 bp, Artificial Sequence
  chemically treated genomic DNA (Homo sapiens) CpG-island No: 4304
ctaccgcctttcgtcgcatacgcgcatatcgatatcgcccgcattactcgttacgcgataacgaaatttaccaaatatccaacgtaaaacgaaacgtcccctatctacgtcgccgacctaacgatcatcgtcccgaccctcaatacaacaattcgattaacacacaacgcgacgacacgactcgcgcgcgcaacgcgcgaacatcgtcgaaacaattacacgaatcaaccgacgtataaaccaacaaacacccgttaatacacgataaaacgaaaaaaaaaatcaacgaccgaatacaaactcgaacgcataaccgaaccacgaaacatccgatcccgacccgcaaaaacgaccgaaacccgtccgcgccgaatccgaatccctacaaatcctacccgtctaatttaacgtccgtaattctataaaaccgaacccgtaccgccgcatatcgataaatcccatcgcatcccaaatacgattaaatcacgaaactaaccattactaacccgccgcgatcaaaaaatctacacaaaatcttcaccaaaaaaaa

SEQ ID NO: 4305 - DNA, 1072 bp, Artificial Sequence
  chemically treated genomic DNA (Homo sapiens) CpG-island No: 4305
cgtaatgttatcgggattcgtaggtatagggcgatagtacggacgtcgtcgtttaggtcgtgtttattgtgcgtcgcggttagtttatcgcgatttcggtttaggaggcggcgggatttcgtattttttttttgtaacggagtttttttggtttgcgggtcgagttttataggcgttcgacgggtttcgcgcgtttataggattataattttcgtgatgtcgcgcgcgtcgatcgttgattggttgtgtagcggacggattcgcggggggggggggtcgtacgtcgtgtacgtgcgtacggcgacggtcggatggttgcgtggggttgtgtggttgcgttcggcgcggcgcgtgggttttgttggcgggcggcgcgcgcggttgcggggttttagggtcgtttcgttcgtaggtgttatgttgtgggtttcgtttaggtgaggacgttcgggttttggtcgagttattcgttatttagggtcggaggcggggcggggagtcgcggggaaggaggggcggtcgggttggtattttagttttttgggaattgtttggatcgtcgtcgcgttcgagtgtatcgcgtttttgttggagggcggatgcgttttgtttttttttgattcgttggcggtttcggaaacgttattttcgcgggagagcgttcgtgggacggtttgggttaggttgtttgttagtttttgcgtttttcggtagttttcgcgtttttgttttttttgcgcgttttttgatttttattatgaggacgtttgggtcgtgatttttatttgtatgtggaggaaattgggtcgcgcgtcgggagtcgcgtttgcgggtgtttcgtttttaagtgtttgtgggtttggtgcgggttttgggtttagtttagttcgttgtgatttcgattgagcgttggaggtttcgcgggcgggagtaggagggttggagtcggcgtttgttgtgtgttcggcgcggtagtgatgtgtgagttttttcgtaatttttgagaaggtgtgattttgtgtggttaggaagtcgaagtttgacgagtttttaagtacgtttttttaggttt

SEQ ID NO: 4306 - DNA, 1072 bp, Artificial Sequence
  chemically treated genomic DNA (Homo sapiens) CpG-island No: 4306
aaacctaaaaaaacgtacttaaaaactcgtcaaacttcgacttcctaaccacacaaaatcacaccttctcaaaaattacgaaaaaactcacacatcactaccgcgccgaacacacaacaaacgccgactccaaccctcctactcccgcccgcgaaacctccaacgctcaatcgaaatcacaacgaactaaactaaacccaaaacccgcaccaaacccacaaacacttaaaaacgaaacacccgcaaacgcgactcccgacgcgcgacccaatttcctccacatacaaataaaaatcacgacccaaacgtcctcataataaaaatcaaaaaacgcgcaaaaaaaacaaaaacgcgaaaactaccgaaaaacgcaaaaactaacaaacaacctaacccaaaccgtcccacgaacgctctcccgcgaaaataacgtttccgaaaccgccaacgaatcaaaaaaaaacaaaacgcatccgccctccaacaaaaacgcgatacactcgaacgcgacgacgatccaaacaattcccaaaaaactaaaataccaacccgaccgcccctccttccccgcgactccccgccccgcctccgaccctaaataacgaataactcgaccaaaacccgaacgtcctcacctaaacgaaacccacaacataacacctacgaacgaaacgaccctaaaaccccgcaaccgcgcgcgccgcccgccaacaaaacccacgcgccgcgccgaacgcaaccacacaaccccacgcaaccatccgaccgtcgccgtacgcacgtacacgacgtacgaccccccccccccgcgaatccgtccgctacacaaccaatcaacgatcgacgcgcgcgacatcacgaaaattataatcctataaacgcgcgaaacccgtcgaacgcctataaaactcgacccgcaaaccaaaaaaactccgttacaaaaaaaaaatacgaaatcccgccgcctcctaaaccgaaatcgcgataaactaaccgcgacgcacaataaacacgacctaaacgacgacgtccgtactatcgccctatacctacgaatcccgataacattacg

SEQ ID NO: 4307 - DNA, 1072 bp, Artificial Sequence
  chemically treated genomic DNA (Homo sapiens) CpG-island No: 4307
ggatttgagaaaacgtatttgaaaattcgttaagtttcggttttttgattatataaggttatatttttttagaagttgcggggaggtttatatattattatcgcgtcgggtatatagtaggcgtcggttttagtttttttgttttcgttcgcggagtttttagcgtttagtcgaggttatagcgagttgaattgaatttaaggttcgtattaaatttataggtatttgggggcggagtattcgtaggcgcggttttcggcgcgcggtttagttttttttatatgtagatgaaaattacgatttaaacgtttttatggtggaaattagaagacgcgtagggaaaatagggacgcggaaattgtcgggaagcgtaggggttgataagtagtttggtttaggtcgttttacgagcgttttttcgcgggagtagcgttttcgaggtcgttagcgagttagaggaaggtagggcgtattcgttttttagtaagaacgcgatgtattcgggcgcgacgacggtttaggtagtttttaggaggttgggatattagttcggtcgttttttttttttcgcggtttttcgtttcgttttcggttttgagtggcgagtggttcggttagaattcggacgtttttatttgagcggggtttatagtatagtatttgcgggcggggcggttttggagtttcgtagtcgcgcgcgtcgttcgttagtaaagtttacgcgtcgcgtcgagcgtagttatatagttttacgtagttattcggtcgtcgtcgtgcgtacgtgtacggcgtgcggtttttttttttcgcgagttcgttcgttgtatagttaattagcggtcggcgcgcgcggtattacgggagttgtagttttgtaagcgcgcggagttcgtcgggcgtttatggaattcgattcgtaggttaaaggggtttcgttgtaaggaagaagtgcggggtttcgtcgttttttagatcgagatcgcggtgagttggtcgcggcgtataatgggtacggtttgggcggcggcgttcgtattatcgttttgtgtttgcggatttcggtaatattgcg

SEQ ID NO: 4308 - DNA, 1072 bp, Artificial Sequence
  chemically treated genomic DNA (Homo sapiens) CpG-island No: 4308
cgcaatattaccgaaatccgcaaacacaaaacgataatacgaacgccgccgcccaaaccgtacccattatacgccgcgaccaactcaccgcgatctcgatctaaaaaacgacgaaaccccgcacttcttccttacaacgaaacccctttaacctacgaatcgaattccataaacgcccgacgaactccgcgcgcttacaaaactacaactcccgtaataccgcgcgcgccgaccgctaattaactatacaacgaacgaactcgcgaaaaaaaaaaaccgcacgccgtacacgtacgcacgacgacgaccgaataactacgtaaaactatataactacgctcgacgcgacgcgtaaactttactaacgaacgacgcgcgcgactacgaaactccaaaaccgccccgcccgcaaatactatactataaaccccgctcaaataaaaacgtccgaattctaaccgaaccactcgccactcaaaaccgaaaacgaaacgaaaaaccgcgaaaaaaaaaaaacgaccgaactaatatcccaacctcctaaaaactacctaaaccgtcgtcgcgcccgaatacatcgcgttcttactaaaaaacgaatacgccctaccttcctctaactcgctaacgacctcgaaaacgctactcccgcgaaaaaacgctcgtaaaacgacctaaaccaaactacttatcaacccctacgcttcccgacaatttccgcgtccctattttccctacgcgtcttctaatttccaccataaaaacgtttaaatcgtaattttcatctacatataaaaaaaactaaaccgcgcgccgaaaaccgcgcctacgaatactccgcccccaaatacctataaatttaatacgaaccttaaattcaattcaactcgctataacctcgactaaacgctaaaaactccgcgaacgaaaacaaaaaaactaaaaccgacgcctactatatacccgacgcgataataatatataaacctccccgcaacttctaaaaaaatataaccttatataatcaaaaaaccgaaacttaacgaattttcaaatacgttttctcaaatcc

SEQ ID NO: 4309 - DNA, 1561 bp, Artificial Sequence
  chemically treated genomic DNA (Homo sapiens) CpG-island No: 4309
gtgtgcgatggcgtgtgatcgaaggtcggtaagtttataggagggcgttataggtgtggggcgtgtgtgatggcgtgtgatcgaaggtcggtaagtttataggagggcgttataggtgtggagcgtgtgcgatggtatgtgatcgaaggtttgtgagtttataggagtgtgttataggtgtggggcgtgtgcgatggcgtgtgattgaaggtcggtaagtttataggagggcgttataggtgtggggcgtgtgcgatggcgtgtgatcgaaggtcggtaagtttataggagtgtgttataggtgtggggcgtgtgcgatggcgtgtgatcgaaggtcggtaagtttataggagtgtgttataggtgtggagcgtgtgcgatggtatgtgaaggtcggtaagtttataggagggcgtcgtaggtgtggggcgtgtgcgatggtatgtgatcgaaggtcggtaagtttataggagtgcgttataggtgtggggcgtgtgcgatggcgtgtgatcgaaggtttgtaagtttataggagtgcgttataggtgtggggcgtgtgcgatggcgtgtgatcgaaggtcggtaagtttataggagggcgttataggtgtggggcgtgtgcgatggcgtgtgatcgaaggtcggtaagtttataggagggcgttataggtgtggggcgtgtgcgatggcgtgtgatcgaaggtcggtaagtttataggagggcgttataggtgtggggcgtgtgcgatgacgtgtgatcgaaggtcggtaagtttataggagggcgttataggtgtggggcgtgtgcgatggcgtgtgatcgaatgtcggtaagtttataggagggcgttataggtgtggggcgtgtgcgatggcgtgtgatcgaaggtcggtaagtttataggagggcgttataggtgtggggcgtgtgcgatggcgtgtgatcgaaggtcggtaagtttataggagggcgttataggtgtggggcgtgtgcgatggcgtgtgatcgaaggtcggtaagtttataggagggcgttataggtgtggggcgtgtgcgatgacgtgtgattgaaggtcggtaagtttataggagggcgttataggtgtggggcgtgtgcgatgatgtgtgattgaaggtcggtaagtttataggagggcgttataggtgtggggcgtgtgcgatgacgtgtgatcgaaggtttgtaagtttataggagtgtgttataggtgtggagcgtgtgcgatggcgtgtgatcgaaggtcggtaagtttataggagggcgttataggtgtggggcgtgtgcgatgacgtgtgattgaaggtcggtaagtttataggagggcgttataggtgtggagcgtgtgcgatggcgtgtgatcgaaggtttgtaagtttataggagtgtgttataggtgtggagcgtgtgcgatggcgtgtgatcgaaggtcggtaagtttataggagggcgttataggtgtggagcgtgtgcgatggtatgtgattgaaggtcggtaagtttataggagggcgttataggtgtggaggggagggtttggagta

SEQ ID NO: 4310 - DNA, 1561 bp, Artificial Sequence
  chemically treated genomic DNA (Homo sapiens) CpG-island No: 4310
tactccaaaccctcccctccacacctataacgccctcctataaacttaccgaccttcaatcacataccatcgcacacgctccacacctataacgccctcctataaacttaccgaccttcgatcacacgccatcgcacacgctccacacctataacacactcctataaacttacaaaccttcgatcacacgccatcgcacacgctccacacctataacgccctcctataaacttaccgaccttcaatcacacgtcatcgcacacgccccacacctataacgccctcctataaacttaccgaccttcgatcacacgccatcgcacacgctccacacctataacacactcctataaacttacaaaccttcgatcacacgtcatcgcacacgccccacacctataacgccctcctataaacttaccgaccttcaatcacacatcatcgcacacgccccacacctataacgccctcctataaacttaccgaccttcaatcacacgtcatcgcacacgccccacacctataacgccctcctataaacttaccgaccttcgatcacacgccatcgcacacgccccacacctataacgccctcctataaacttaccgaccttcgatcacacgccatcgcacacgccccacacctataacgccctcctataaacttaccgaccttcgatcacacgccatcgcacacgccccacacctataacgccctcctataaacttaccgacattcgatcacacgccatcgcacacgccccacacctataacgccctcctataaacttaccgaccttcgatcacacgtcatcgcacacgccccacacctataacgccctcctataaacttaccgaccttcgatcacacgccatcgcacacgccccacacctataacgccctcctataaacttaccgaccttcgatcacacgccatcgcacacgccccacacctataacgccctcctataaacttaccgaccttcgatcacacgccatcgcacacgccccacacctataacgcactcctataaacttacaaaccttcgatcacacgccatcgcacacgccccacacctataacgcactcctataaacttaccgaccttcgatcacataccatcgcacacgccccacacctacgacgccctcctataaacttaccgaccttcacataccatcgcacacgctccacacctataacacactcctataaacttaccgaccttcgatcacacgccatcgcacacgccccacacctataacacactcctataaacttaccgaccttcgatcacacgccatcgcacacgccccacacctataacgccctcctataaacttaccgaccttcaatcacacgccatcgcacacgccccacacctataacacactcctataaactcacaaaccttcgatcacataccatcgcacacgctccacacctataacgccctcctataaacttaccgaccttcgatcacacgccatcacacacgccccacacctataacgccctcctataaacttaccgaccttcgatcacacgccatcgcacac

SEQ ID NO: 4311 - DNA, 1561 bp, Artificial Sequence
  chemically treated genomic DNA (Homo sapiens) CpG-island No: 4311
tattttaagtttttttttttatatttgtggcgtttttttgtgagtttatcggtttttaattatatgttatcgtatacgttttatatttgtgacgtttttttgtgagtttatcggttttcgattatacgttatcgtatacgttttatatttgtggtatatttttgtgagtttataggttttcgattatacgttatcgtatacgttttatatttgtggcgtttttttgtgagtttatcggtttttaattatacgttatcgtatacgttttatatttgtgacgtttttttgtgagtttatcggttttcgattatacgttatcgtatacgttttatatttgtggtatatttttgtgagtttataggttttcgattatacgttatcgtatacgttttatatttgtgacgtttttttgtgagtttatcggtttttaattatatattatcgtatacgttttatatttgtgacgtttttttgtgagtttatcggtttttaattatacgttatcgtatacgttttatatttgtgacgtttttttgtgagtttatcggttttcgattatacgttatcgtatacgttttatatttgtgacgtttttttgtgagtttatcggttttcgattatacgttatcgtatacgttttatatttgtgacgtttttttgtgagtttatcggttttcgattatacgttatcgtatacgttttatatttgtgacgtttttttgtgagtttatcggtattcgattatacgttatcgtatacgttttatatttgtgacgtttttttgtgagtttatcggttttcgattatacgttatcgtatacgttttatatttgtgacgtttttttgtgagtttatcggttttcgattatacgttatcgtatacgttttatatttgtgacgtttttttgtgagtttatcggttttcgattatacgttatcgtatacgttttatatttgtgacgtttttttgtgagtttatcggttttcgattatacgttatcgtatacgttttatatttgtgacgtatttttgtgagtttataggttttcgattatacgttatcgtatacgttttatatttgtggcgtatttttgtgagtttatcggttttcgattatatgttatcgtatacgttttatatttgcgacgtttttttgtgagtttatcggtttttatatgttatcgtatacgttttatatttgtggtatatttttgtgagtttatcggttttcgattatacgttatcgtatacgttttatatttgtggtatatttttgtgagtttatcggttttcgattatacgttatcgtatacgttttatatttgtggcgtttttttgtgagtttatcggtttttaattatacgttatcgtatacgttttatatttgtggtatatttttgtgagtttataggttttcgattatatgttatcgtatacgttttatatttgtggcgtttttttgtgagtttatcggttttcgattatacgttattatatacgttttatatttgtgacgtttttttgtgagtttatcggttttcgattatacgttatcgtatat

SEQ ID NO: 4312 - DNA, 1561 bp, Artificial Sequence
  chemically treated genomic DNA (Homo sapiens) CpG-island No: 4312
atatacgataacgtataatcgaaaaccgataaactcacaaaaaaacgtcacaaatataaaacgtatataataacgtataatcgaaaaccgataaactcacaaaaaaacgccacaaatataaaacgtatacgataacatataatcgaaaacctataaactcacaaaaatataccacaaatataaaacgtatacgataacgtataattaaaaaccgataaactcacaaaaaaacgccacaaatataaaacgtatacgataacgtataatcgaaaaccgataaactcacaaaaatataccacaaatataaaacgtatacgataacgtataatcgaaaaccgataaactcacaaaaatataccacaaatataaaacgtatacgataacatataaaaaccgataaactcacaaaaaaacgtcgcaaatataaaacgtatacgataacatataatcgaaaaccgataaactcacaaaaatacgccacaaatataaaacgtatacgataacgtataatcgaaaacctataaactcacaaaaatacgtcacaaatataaaacgtatacgataacgtataatcgaaaaccgataaactcacaaaaaaacgtcacaaatataaaacgtatacgataacgtataatcgaaaaccgataaactcacaaaaaaacgtcacaaatataaaacgtatacgataacgtataatcgaaaaccgataaactcacaaaaaaacgtcacaaatataaaacgtatacgataacgtataatcgaaaaccgataaactcacaaaaaaacgtcacaaatataaaacgtatacgataacgtataatcgaataccgataaactcacaaaaaaacgtcacaaatataaaacgtatacgataacgtataatcgaaaaccgataaactcacaaaaaaacgtcacaaatataaaacgtatacgataacgtataatcgaaaaccgataaactcacaaaaaaacgtcacaaatataaaacgtatacgataacgtataatcgaaaaccgataaactcacaaaaaaacgtcacaaatataaaacgtatacgataacgtataattaaaaaccgataaactcacaaaaaaacgtcacaaatataaaacgtatacgataatatataattaaaaaccgataaactcacaaaaaaacgtcacaaatataaaacgtatacgataacgtataatcgaaaacctataaactcacaaaaatataccacaaatataaaacgtatacgataacgtataatcgaaaaccgataaactcacaaaaaaacgtcacaaatataaaacgtatacgataacgtataattaaaaaccgataaactcacaaaaaaacgccacaaatataaaacgtatacgataacgtataatcgaaaacctataaactcacaaaaatataccacaaatataaaacgtatacgataacgtataatcgaaaaccgataaactcacaaaaaaacgtcacaaatataaaacgtatacgataacatataattaaaaaccgataaactcacaaaaaaacgccacaaatataaaaaaaaaaacttaaaata

SEQ ID NO: 4313 - DNA, 1244 bp, Artificial Sequence
  chemically treated genomic DNA (Homo sapiens) CpG-island No: 4313
atttttagcgatttttttaggagttcgcgttttatgggagttttttcgtatcgggtcgtttcgttttggcggttgttcgcgttttttttcgttttttttaggttatagggttttcgattcgattgtgacgtattgtattttcgtttttttttttttcgttgatttagcgcgtcgcgttttttttttttttggtttcgttgttttttttttttttcgaatttagttttggttttttcgtcgttagtttttttttttttcggcgggattcgtttttcgtttcgtttcgtttcgttttcgtttcgtttgtttttatcgcggttcgttcggtttatcgtttgttttttttttttgtcgttcggttcggttcgtttagtttagtggttttagttcggatttcgtcgtcgttcggtttaggtgcgagtttttattgttggggaggcggcgggtttcggtttttttcggtcgtttagttcgtttcgttcgttcggggttggcggggagggaatagttgggcggttttagagtttttcggaggataatgcgttcggcgttcggttattttcgttcggtttttttcgcgttcggttttttttcgtcgttttcggtagtcgttcggttgtagttttttttttttcgcgggggtttttttcgcggtcggagaggtttcggcgatagtagtattagtattagtattagtcgcgggggaggcggcggtagacgcggcgggggcggcggtttttcgagtagtagtacgggcgtcgagcgcgaggacgacgacgagagttttagcgttagtaagtcgttggtgtttaacgtcgcgtttttggggtcgtcggtttaggtgggcgttttcgtcggtttcgcgtttgtcgtttttttttttttagcggttatttttttttttatttttacgtttatttttttttgtagtatgatagtcgcggatttcggcgggggcgtcgcggtcggggtcgtcgggggtttcgggagtcgttcggcggggggcgcgggcggtatcgggatcggtagcggcgttttttgttgttcgtgttgttgttgttgcggttgtttagatcgtttcggtcgtagaggtcggcgtcgcggttgcgtttttagttttaggtgtcgttggggttattaggcgttgttcgtggtgttgttgttggcgtagggcggtttgttggatttgtattttatcgtcgttatcgatttgtattggtgtttttggatcgttattgatttgg

SEQ ID NO: 4314 - DNA, 1244 bp, Artificial Sequence
  chemically treated genomic DNA (Homo sapiens) CpG-island No: 4314
ccaaatcaataacgatccaaaaacaccaatacaaatcgataacgacgataaaatacaaatccaacaaaccgccctacgccaacaacaacaccacgaacaacgcctaataaccccaacgacacctaaaactaaaaacgcaaccgcgacgccgacctctacgaccgaaacgatctaaacaaccgcaacaacaacaacacgaacaacaaaaaacgccgctaccgatcccgataccgcccgcgccccccgccgaacgactcccgaaacccccgacgaccccgaccgcgacgcccccgccgaaatccgcgactatcatactacaaaaaaaaataaacgtaaaaataaaaaaaaaaataaccgctaaaaaaaaaaaaacgacaaacgcgaaaccgacgaaaacgcccacctaaaccgacgaccccaaaaacgcgacgttaaacaccaacgacttactaacgctaaaactctcgtcgtcgtcctcgcgctcgacgcccgtactactactcgaaaaaccgccgcccccgccgcgtctaccgccgcctcccccgcgactaatactaatactaatactactatcgccgaaacctctccgaccgcgaaaaaaacccccgcgaaaaaaaaaaaactacaaccgaacgactaccgaaaacgacgaaaaaaaaccgaacgcgaaaaaaaccgaacgaaaataaccgaacgccgaacgcattatcctccgaaaaactctaaaaccgcccaactattccctccccgccaaccccgaacgaacgaaacgaactaaacgaccgaaaaaaaccgaaacccgccgcctccccaacaataaaaactcgcacctaaaccgaacgacgacgaaatccgaactaaaaccactaaactaaacgaaccgaaccgaacgacaaaaaaaaaaaacaaacgataaaccgaacgaaccgcgataaaaacaaacgaaacgaaaacgaaacgaaacgaaacgaaaaacgaatcccgccgaaaaaaaaaaaaactaacgacgaaaaaaccaaaactaaattcgaaaaaaaaaaaaaacaacgaaaccaaaaaaaaaaaaaacgcgacgcgctaaatcaacgaaaaaaaaaaaaacgaaaatacaatacgtcacaatcgaatcgaaaaccctataacctaaaaaaaacgaaaaaaaacgcgaacaaccgccaaaacgaaacgacccgatacgaaaaaactcccataaaacgcgaactcctaaaaaaatcgctaaaaat

SEQ ID NO: 4315 - DNA, 1244 bp, Artificial Sequence
  chemically treated genomic DNA (Homo sapiens) CpG-island No: 4315
ttaggttagtggcgatttaggagtattagtataggtcggtgacggcgatgaggtataggtttagtaggtcgttttgcgttagtagtagtattacggatagcgtttggtagttttagcggtatttgggattgggggcgtagtcgcggcgtcgatttttgcggtcggggcggtttgggtagtcgtagtagtagtaatacgggtagtaggaggcgtcgttgtcggtttcggtgtcgttcgcgtttttcgtcgagcggttttcggggttttcgacggtttcggtcgcggcgttttcgtcgaagttcgcggttgttatgttgtaggaggaggtgggcgtggaggtggaggaggaggtggtcgttgaggaggagaaggcgataggcgcggggtcggcgggggcgtttatttgagtcggcggttttaggagcgcggcgttgggtattagcggtttgttgacgttgaggttttcgtcgtcgttttcgcgttcggcgttcgtgttgttgttcggggagtcgtcgttttcgtcgcgtttgtcgtcgtttttttcgcggttggtgttggtgttggtgttgttgtcgtcggagttttttcggtcgcggaaggagttttcgcggaggaagaggggttgtagtcgggcggttgtcgggggcggcgggaaggaatcggacgcggaggagatcgagcgagggtggtcgagcgtcgggcgtattgtttttcgaggggttttggggtcgtttagttgtttttttttcgttaatttcgggcgggcgaggcgggttaggcggtcgaggggagtcggggttcgtcgtttttttagtagtggggattcgtatttgggtcgggcggcggcgagattcggattggagttattggattgggcgagtcgggtcgggcggtagggagagggggtaggcggtgaatcgagcggatcgcggtgaagataggcgaggcgggggcggggcggggcggggcggggagcgagtttcgtcgggagggagggaggttggcggcggggaaattaggattggattcgagggggagaggaagtagcgagattagaggaggagaaagcgcggcgcgttggattaacgggaagagaaggggcgggggtgtagtgcgttatagtcgggtcgggagttttgtggtttggaggaagcgggaggaggcgcgggtagtcgttagggcgaggcgattcggtgcggggggatttttatggagcgcggatttttaaggaagtcgttgggaat

SEQ ID NO: 4316 - DNA, 1244 bp, Artificial Sequence
  chemically treated genomic DNA (Homo sapiens) CpG-island No: 4316
attcccaacgacttccttaaaaatccgcgctccataaaaatccccccgcaccgaatcgcctcgccctaacgactacccgcgcctcctcccgcttcctccaaaccacaaaactcccgacccgactataacgcactacacccccgccccttctcttcccgttaatccaacgcgccgcgctttctcctcctctaatctcgctacttcctctccccctcgaatccaatcctaatttccccgccgccaacctccctccctcccgacgaaactcgctccccgccccgccccgccccgcccccgcctcgcctatcttcaccgcgatccgctcgattcaccgcctaccccctctccctaccgcccgacccgactcgcccaatccaataactccaatccgaatctcgccgccgcccgacccaaatacgaatccccactactaaaaaaacgacgaaccccgactcccctcgaccgcctaacccgcctcgcccgcccgaaattaacgaaaaaaaaacaactaaacgaccccaaaacccctcgaaaaacaatacgcccgacgctcgaccaccctcgctcgatctcctccgcgtccgattccttcccgccgcccccgacaaccgcccgactacaacccctcttcctccgcgaaaactccttccgcgaccgaaaaaactccgacgacaacaacaccaacaccaacaccaaccgcgaaaaaaacgacgacaaacgcgacgaaaacgacgactccccgaacaacaacacgaacgccgaacgcgaaaacgacgacgaaaacctcaacgtcaacaaaccgctaatacccaacgccgcgctcctaaaaccgccgactcaaataaacgcccccgccgaccccgcgcctatcgccttctcctcctcaacgaccacctcctcctccacctccacgcccacctcctcctacaacataacaaccgcgaacttcgacgaaaacgccgcgaccgaaaccgtcgaaaaccccgaaaaccgctcgacgaaaaacgcgaacgacaccgaaaccgacaacgacgcctcctactacccgtattactactactacgactacccaaaccgccccgaccgcaaaaatcgacgccgcgactacgcccccaatcccaaataccgctaaaactaccaaacgctatccgtaatactactactaacgcaaaacgacctactaaacctatacctcatcgccgtcaccgacctatactaatactcctaaatcgccactaacctaa

SEQ ID NO: 4317 - DNA, 692 bp, Artificial Sequence
  chemically treated genomic DNA (Homo sapiens) CpG-island No: 4317
tcggggtcgtcggggcggcgtagttagcggcgcgtataattattatttgtattattattacgtcgcgtcgtttttgtatttgttcgttttttcggtcgttatcgttggggttaaggtacgcggagttcgcgggggcgtcggcggcgcggggggcggtttgggggcggtcgcggtagcgggcgagttcgttttcgtttatttggtttggtttatttattttatcgtttttatttttaaggtggtgttgattttgggtacgtttattttagattttatcgagttacgcgcgtttttcggtattacgggttttcgttttattatggcgttgtcggtgtttttgttttatagtttggtgcgggttattagcgaggcgggcgcgttttcgggatcggtaggatttttgttgttgtagttttagcggtatcgcgcggtcggatgttttttgggtacgtgtttggatttgttcgatagttttacgttggtggagttgatgttggagggtcgcgtgtcgttgttcgcgtatttgcgttatttgtttatcgtcgtttatttttttattttcgtttcgtcggtgttttggttttacgagtttaacgtcgcggtcgtagcggttgtattttggggttaggttttcgggtttggtagttgtagtcgttttttgcgtttgttgggcggttgtttggtggacgtgt

SEQ ID NO: 4318 - DNA, 692 bp, Artificial Sequence
  chemically treated genomic DNA (Homo sapiens) CpG-island No: 4318
acacgtccaccaaacaaccgcccaacaaacgcaaaaaacgactacaactaccaaacccgaaaacctaaccccaaaatacaaccgctacgaccgcgacgttaaactcgtaaaaccaaaacaccgacgaaacgaaaataaaaaaataaacgacgataaacaaataacgcaaatacgcgaacaacgacacgcgaccctccaacatcaactccaccaacgtaaaactatcgaacaaatccaaacacgtacccaaaaaacatccgaccgcgcgataccgctaaaactacaacaacaaaaatcctaccgatcccgaaaacgcgcccgcctcgctaataacccgcaccaaactataaaacaaaaacaccgacaacgccataataaaacgaaaacccgtaataccgaaaaacgcgcgtaactcgataaaatctaaaataaacgtacccaaaatcaacaccaccttaaaaataaaaacgataaaataaataaaccaaaccaaataaacgaaaacgaactcgcccgctaccgcgaccgcccccaaaccgccccccgcgccgccgacgcccccgcgaactccgcgtaccttaaccccaacgataacgaccgaaaaaacgaacaaatacaaaaacgacgcgacgtaataataatacaaataataattatacgcgccgctaactacgccgccccgacgaccccga

SEQ ID NO: 4319 - DNA, 692 bp, Artificial Sequence
  chemically treated genomic DNA (Homo sapiens) CpG-island No: 4319
gtacgtttattaggtagtcgtttagtaggcgtagaaggcggttgtagttgttaggttcggaggtttggttttaggatgtagtcgttgcggtcgcggcgttgagttcgtagagttagagtatcggcgaggcgagggtgaggaagtagacggcgataagtaggtagcgtaggtgcgcgggtagcggtacgcggttttttagtattagttttattagcgtgaagttgtcgagtaggtttaagtacgtgtttaggaagtattcggtcgcgcggtgtcgttggggttgtagtagtaggggttttgtcgatttcgggggcgcgttcgtttcgttgatggttcgtattaagttgtagagtaggggtatcgatagcgttatggtgagacggaagttcgtggtgtcgaagggcgcgcgtagttcgatgaggtttaggatggacgtgtttaggattagtattattttgggagtgaaggcgatggagtagataagttaggttaggtaggcgaaggcgaattcgttcgttgtcgcggtcgtttttaggtcgtttttcgcgtcgtcggcgttttcgcgggtttcgcgtgttttggttttagcggtagcggtcgagggggcgggtagatgtaggggcggcgcggcgtggtggtggtgtaggtggtggttgtgcgcgtcgttggttgcgtcgtttcgacggtttcgg

SEQ ID NO: 4320 - DNA, 692 bp, Artificial Sequence
  chemically treated genomic DNA (Homo sapiens) CpG-island No: 4320
ccgaaaccgtcgaaacgacgcaaccaacgacgcgcacaaccaccacctacaccaccaccacgccgcgccgcccctacatctacccgccccctcgaccgctaccgctaaaaccaaaacacgcgaaacccgcgaaaacgccgacgacgcgaaaaacgacctaaaaacgaccgcgacaacgaacgaattcgccttcgcctacctaacctaacttatctactccatcgccttcactcccaaaataatactaatcctaaacacgtccatcctaaacctcatcgaactacgcgcgcccttcgacaccacgaacttccgtctcaccataacgctatcgatacccctactctacaacttaatacgaaccatcaacgaaacgaacgcgcccccgaaatcgacaaaacccctactactacaaccccaacgacaccgcgcgaccgaatacttcctaaacacgtacttaaacctactcgacaacttcacgctaataaaactaatactaaaaaaccgcgtaccgctacccgcgcacctacgctacctacttatcgccgtctacttcctcaccctcgcctcgccgatactctaactctacgaactcaacgccgcgaccgcaacgactacatcctaaaaccaaacctccgaacctaacaactacaaccgccttctacgcctactaaacgactacctaataaacgtac

SEQ ID NO: 4321 - DNA, 576 bp, Artificial Sequence
  chemically treated genomic DNA (Homo sapiens) CpG-island No: 4321
taggcggtcgttttttcgtttttaggggtgggcgcgcgacgcgggtagggatcgggcgttcggaggattaagcgagcgtatttcgtttattcgtgttgggatattatttagtttggacgtcgtttttcgtttttttttttcgcgtatcgttagcgttaattaaagattttcgtcgggaaagtttttttgttaagttggaaagcgttgaaggcggatcgttttttagatttgggtttgtaggtttataaggttcgggaggtttacggtgggcgtttgtttaatagagggtttttgcggagaagcgtagaacgataaatgttagaggcggtgatcgcgttttttggatattagcgtcgtatcgcgtattcgcgtcgtttgcgcgttttgtagtcggttgggttattcggtttttatatattaggcggattcgcgtcgggacggggcggagcggggtgggcggggagggggtggggaaggtcgaacggttttttgggagtcgtagttcgattacgtagttttgtcgtagttagaataaaagttaaataaggatggaaatggttagggtttgtttattat

SEQ ID NO: 4322 - DNA, 576 bp, Artificial Sequence
  chemically treated genomic DNA (Homo sapiens) CpG-island No: 4322
ataataaacaaaccctaaccatttccatccttatttaacttttattctaactacgacaaaactacgtaatcgaactacgactcccaaaaaaccgttcgaccttccccaccccctccccgcccaccccgctccgccccgtcccgacgcgaatccgcctaatatataaaaaccgaataacccaaccgactacaaaacgcgcaaacgacgcgaatacgcgatacgacgctaatatccaaaaaacgcgatcaccgcctctaacatttatcgttctacgcttctccgcaaaaaccctctattaaacaaacgcccaccgtaaacctcccgaaccttataaacctacaaacccaaatctaaaaaacgatccgccttcaacgctttccaacttaacaaaaaaactttcccgacgaaaatctttaattaacgctaacgatacgcgaaaaaaaaaaacgaaaaacgacgtccaaactaaataatatcccaacacgaataaacgaaatacgctcgcttaatcctccgaacgcccgatccctacccgcgtcgcgcgcccacccctaaaaacgaaaaaacgaccgccta

SEQ ID NO: 4323 - DNA, 576 bp, Artificial Sequence
  chemically treated genomic DNA (Homo sapiens) CpG-island No: 4323
gtggtgggtaaattttaattatttttatttttgtttagtttttgttttgattacgataggattacgtagtcgaattacgatttttaggaagtcgttcggttttttttatttttttttcgtttatttcgtttcgtttcgtttcggcgcgggttcgtttggtatataagggtcgaatggtttagtcgattgtagggcgcgtaggcggcgcgggtgcgcggtgcggcgttggtatttagaggacgcggttatcgtttttggtatttgtcgttttgcgttttttcgtaaggattttttgttaggtaggcgtttatcgtaagtttttcgggttttgtgaatttgtaaatttaagtttgagagacgattcgtttttagcgttttttagtttggtagagaggttttttcggcggggatttttggttggcgttggcgatgcgcggggaagaaaggcgaggagcggcgtttaggttgggtgatgttttagtacgagtaggcgggatgcgttcgtttggtttttcgggcgttcggtttttgttcgcgtcgcgcgtttatttttggggacgagaaggcggtcgtttg

SEQ ID NO: 4324 - DNA, 576 bp, Artificial Sequence
  chemically treated genomic DNA (Homo sapiens) CpG-island No: 4324
caaacgaccgccttctcgtccccaaaaataaacgcgcgacgcgaacaaaaaccgaacgcccgaaaaaccaaacgaacgcatcccgcctactcgtactaaaacatcacccaacctaaacgccgctcctcgcctttcttccccgcgcatcgccaacgccaaccaaaaatccccgccgaaaaaacctctctaccaaactaaaaaacgctaaaaacgaatcgtctctcaaacttaaatttacaaattcacaaaacccgaaaaacttacgataaacgcctacctaacaaaaaatccttacgaaaaaacgcaaaacgacaaataccaaaaacgataaccgcgtcctctaaataccaacgccgcaccgcgcacccgcgccgcctacgcgccctacaatcgactaaaccattcgacccttatataccaaacgaacccgcgccgaaacgaaacgaaacgaaataaacgaaaaaaaaataaaaaaaaccgaacgacttcctaaaaatcgtaattcgactacgtaatcctatcgtaatcaaaacaaaaactaaacaaaaataaaaataattaaaatttacccaccac

SEQ ID NO: 4325 - DNA, 1237 bp, Artificial Sequence
  chemically treated genomic DNA (Homo sapiens) CpG-island No: 4325
tggagtcgtattcgtttttacgtatttgcgttagtttattaaaatttaatttgggtatttttatgtaatcgtggcgggtttaggcgcgttttttcgcggtttttcgttttagtataggtcggtaggttttggtttatgtatttttttatttcgcgatcgcgtcggggtttatttttattgtagaatttgtcgttaaatttagtgtggttgtagtcgtagtttatttcgtcgggggttagtacggtgtagagatcgtcgttggcgtagggattgcgcgtaggcgtatatagagggtcggcggtcgtatcgcgtagattttggttatttagtagcgtcggcggtcgttcgtttagttttaggttggttagaaggtcgcggaaaggcggttcgtatttgacggtgttgagcgtgagtgtagataggcgtacgtcgggagggatgtcgtttacgaataggtcgttggttatttgtatttcgcgtcgttttgagcggatttcggcggcgcgggtttcgtcgtttatcgttagcgtcgtgcgtcgcgcgtcgcgggttagtaatattatgtgttagcggtcgtcggttatcggcgtgtttagttgtagcgtggcgggtttcgcgtaagatagcgtgaagcgtagtcgtaggcgttcgtttattagtagtagttttaagaagtcgtagtcgtcgtcgtcgtttaggtagagtagtagcgcgcgcgtggcgttggtgcgtaggttgaagttgagttcgtcggtgttcgtcgttttcgtttaacgcgcgtagcgagttttttgtttggggtcgttgtcgaattttaagttacggacgtttgtcgttagcgttagtagtaatagtagcggcggtagttggggtggcggttgttatcgattttcgagcgttatgttttcggcggtttcgacgtcgttcggttttcggtttcgtttaggttttagagtcgcgggcgtatggggcggggagggggtcgggcgtttttcgcgcggagcggggttttttcgtcgatttatagtgttatggatttagtagtcggggtttacgtgtttacgttttcggaaggtaacgacggcggttgcggtggtggagtttttttttcgcggcgggttcgtatggaaggtgggggagggacgtttgtagggaaatagagaggaaaggtttaatcgaaggtttagatttaaggggtgtcgtcggtgtttggttttttattttaaattagtaggtg

SEQ ID NO: 4326 - DNA, 1237 bp, Artificial Sequence
  chemically treated genomic DNA (Homo sapiens) CpG-island No: 4326
cacctactaatttaaaataaaaaaccaaacaccgacgacaccccttaaatctaaaccttcgattaaacctttcctctctatttccctacaaacgtccctcccccaccttccatacgaacccgccgcgaaaaaaaaactccaccaccgcaaccgccgtcgttaccttccgaaaacgtaaacacgtaaaccccgactactaaatccataacactataaatcgacgaaaaaaccccgctccgcgcgaaaaacgcccgaccccctccccgccccatacgcccgcgactctaaaacctaaacgaaaccgaaaaccgaacgacgtcgaaaccgccgaaaacataacgctcgaaaatcgataacaaccgccaccccaactaccgccgctactattactactaacgctaacgacaaacgtccgtaacttaaaattcgacaacgaccccaaacaaaaaactcgctacgcgcgttaaacgaaaacgacgaacaccgacgaactcaacttcaacctacgcaccaacgccacgcgcgcgctactactctacctaaacgacgacgacgactacgacttcttaaaactactactaataaacgaacgcctacgactacgcttcacgctatcttacgcgaaacccgccacgctacaactaaacacgccgataaccgacgaccgctaacacataatattactaacccgcgacgcgcgacgcacgacgctaacgataaacgacgaaacccgcgccgccgaaatccgctcaaaacgacgcgaaatacaaataaccaacgacctattcgtaaacgacatccctcccgacgtacgcctatctacactcacgctcaacaccgtcaaatacgaaccgcctttccgcgaccttctaaccaacctaaaactaaacgaacgaccgccgacgctactaaataaccaaaatctacgcgatacgaccgccgaccctctatatacgcctacgcgcaatccctacgccaacgacgatctctacaccgtactaacccccgacgaaataaactacgactacaaccacactaaatttaacgacaaattctacaataaaaataaaccccgacgcgatcgcgaaataaaaaaatacataaaccaaaacctaccgacctatactaaaacgaaaaaccgcgaaaaaacgcgcctaaacccgccacgattacataaaaatacccaaattaaattttaataaactaacgcaaatacgtaaaaacgaatacgactcca

SEQ ID NO: 4327 - DNA, 1237 bp, Artificial Sequence
  chemically treated genomic DNA (Homo sapiens) CpG-island No: 4327
tatttgttaatttgagatggagagttagatatcgacgatattttttgaatttgaattttcgattaaattttttttttttgtttttttgtaggcgttttttttttattttttatacgagttcgtcgcgggggaggggttttattatcgtagtcgtcgtcgttgtttttcggggacgtggatacgtgagtttcggttattgagtttatggtattgtgaatcggcgagggagtttcgtttcgcgcgaggggcgttcggtttttttttcgttttatgcgttcgcggttttgaagtttgagcggggtcgggggtcgggcggcgtcggggtcgtcggaggtatggcgttcgggagtcggtggtaatcgttattttagttgtcgtcgttgttgttgttgttggcgttggcggtaggcgttcgtggtttggagttcggtagcggttttaggtagagggttcgttacgcgcgttgggcgggagcggcgagtatcggcgagtttagttttagtttgcgtattaacgttacgcgcgcgttgttgttttatttggacgacggcggcgattgcgattttttggagttgttgttggtggacgggcgtttgcggttgcgttttacgttgttttgcgcggagttcgttacgttgtagttggatacgtcggtggtcgacgatcgttggtatatggtgttgttgattcgcgacgcgcggcgtacggcgttggcggtggacggcgaagttcgcgtcgtcgaggttcgtttaaagcggcgcgagatgtaggtggttagcgatttgttcgtgggcggtatttttttcgacgtgcgtttatttgtatttacgtttagtatcgttaagtacgagtcgttttttcgcggttttttggttaatttgaagttgggcgagcggtcgtcggcgttgttgggtagttagggtttgcgcggtgcggtcgtcgattttttgtgtgcgtttgcgcgtaatttttgcgttaacggcggtttttgtatcgtgttagttttcggcgaggtgggttgcgattgtagttatattggatttggcggtaagttttgtagtgaaggtgagtttcggcgcggtcgcgagatggaagggtgtatgggttagggtttatcggtttgtgttggggcgggaggtcgcgggagagcgcgtttaaattcgttacggttgtatggagatgtttagattaggttttagtaaattggcgtaagtgcgtgaggacggatgcgatttta

SEQ ID NO: 4328 - DNA, 1237 bp, Artificial Sequence
  chemically treated genomic DNA (Homo sapiens) CpG-island No: 4328
taaaatcgcatccgtcctcacgcacttacgccaatttactaaaacctaatctaaacatctccatacaaccgtaacgaatttaaacgcgctctcccgcgacctcccgccccaacacaaaccgataaaccctaacccatacacccttccatctcgcgaccgcgccgaaactcaccttcactacaaaacttaccgccaaatccaatataactacaatcgcaacccacctcgccgaaaactaacacgatacaaaaaccgccgttaacgcaaaaattacgcgcaaacgcacacaaaaaatcgacgaccgcaccgcgcaaaccctaactacccaacaacgccgacgaccgctcgcccaacttcaaattaaccaaaaaaccgcgaaaaaacgactcgtacttaacgatactaaacgtaaatacaaataaacgcacgtcgaaaaaaataccgcccacgaacaaatcgctaaccacctacatctcgcgccgctttaaacgaacctcgacgacgcgaacttcgccgtccaccgccaacgccgtacgccgcgcgtcgcgaatcaacaacaccatataccaacgatcgtcgaccaccgacgtatccaactacaacgtaacgaactccgcgcaaaacaacgtaaaacgcaaccgcaaacgcccgtccaccaacaacaactccaaaaaatcgcaatcgccgccgtcgtccaaataaaacaacaacgcgcgcgtaacgttaatacgcaaactaaaactaaactcgccgatactcgccgctcccgcccaacgcgcgtaacgaaccctctacctaaaaccgctaccgaactccaaaccacgaacgcctaccgccaacgccaacaacaacaacaacgacgacaactaaaataacgattaccaccgactcccgaacgccatacctccgacgaccccgacgccgcccgacccccgaccccgctcaaacttcaaaaccgcgaacgcataaaacgaaaaaaaaaccgaacgcccctcgcgcgaaacgaaactccctcgccgattcacaataccataaactcaataaccgaaactcacgtatccacgtccccgaaaaacaacgacgacgactacgataataaaacccctcccccgcgacgaactcgtataaaaaataaaaaaaaaacgcctacaaaaaaacaaaaaaaaaaaatttaatcgaaaattcaaattcaaaaaatatcgtcgatatctaactctccatctcaaattaacaaata

SEQ ID NO: 4329 - DNA, 642 bp, Artificial Sequence
  chemically treated genomic DNA (Homo sapiens) CpG-island No: 4329
tcgcgcgcgtgttcgtttatttatttttgggattcgtagcgcggatttcgaattttgttcggttagcgttattttcgtgcgttttcgttcgtcggtttcgttgcggttgcggtttttattcggttttcgcgtcgcggtttagcgttttgtcgtttcgtttttttttcgtttttgtatttcgcgtcgcgttttttttatcggggattttttttttcgtttcgcgcgcgtcgggttttgaagtatattaattttttttttgtcgttttagagagtttaatcgcgggcggggggttgcgttattgttggtgtggggatcgcgtgtagtagtttttttttatcgcgatattttcgggttttgcgtttcgtttgggtgtcgtacggaggaagtcgggaggggtaggaagcggattgcggtggggaaggggcgtttcgtttagtttttcggttcgggtttttgttttcgagataaatcgtttttacggggtttattttgttcgggttcgggcgtttttttgcgggcggcggaggttcgggcgtggtggaggtcgcgggcgtggggttgcggatttttgcgatggtttgggggaggggttgggatagaatgcgagttggttttggtttagtggagttttaaaaagttag

SEQ ID NO: 4330 - DNA, 642 bp, Artificial Sequence
  chemically treated genomic DNA (Homo sapiens) CpG-island No: 4330
ctaactttttaaaactccactaaaccaaaaccaactcgcattctatcccaacccctcccccaaaccatcgcaaaaatccgcaaccccacgcccgcgacctccaccacgcccgaacctccgccgcccgcaaaaaaacgcccgaacccgaacaaaataaaccccgtaaaaacgatttatctcgaaaacaaaaacccgaaccgaaaaactaaacgaaacgccccttccccaccgcaatccgcttcctacccctcccgacttcctccgtacgacacccaaacgaaacgcaaaacccgaaaatatcgcgataaaaaaaaactactacacgcgatccccacaccaacaataacgcaaccccccgcccgcgattaaactctctaaaacgacaaaaaaaaaattaatatacttcaaaacccgacgcgcgcgaaacgaaaaaaaaaatccccgataaaaaaaacgcgacgcgaaatacaaaaacgaaaaaaaaacgaaacgacaaaacgctaaaccgcgacgcgaaaaccgaataaaaaccgcaaccgcaacgaaaccgacgaacgaaaacgcacgaaaataacgctaaccgaacaaaattcgaaatccgcgctacgaatcccaaaaataaataaacgaacacgcgcgcga

SEQ ID NO: 4331 - DNA, 642 bp, Artificial Sequence
  chemically treated genomic DNA (Homo sapiens) CpG-island No: 4331
ttggttttttgaggttttattggattaaaattagttcgtattttgttttagttttttttttaggttatcgtaaggattcgtagttttacgttcgcgatttttattacgttcgggttttcgtcgttcgtaggaagacgttcgggttcgggtagggtgaatttcgtgggaacggtttgtttcgaaaataggaattcggatcggggggttgggcggggcgttttttttttatcgtagttcgttttttgtttttttcggtttttttcgtgcgatatttaggcggggcgtagagttcgggggtgtcgcggtgggggagggttgttgtacgcggtttttatattaatagtggcgtagtttttcgttcgcggttaaattttttggggcggtaggggaggggttaatatgttttagggttcggcgcgcgcggggcgagagggggagttttcggtggaggaggcgcggcgcggggtgtaggggcggggagggggcggggcggtagggcgttgggtcgcggcgcggagatcgggtgggagtcgtagtcgtagcgaggtcggcgggcgggagcgtacggaggtggcgttggtcgggtagggttcggggttcgcgttgcgggttttaagagtgagtgagcgagtacgcgcgcgg

SEQ ID NO: 4332 - DNA, 642 bp, Artificial Sequence
  chemically treated genomic DNA (Homo sapiens) CpG-island No: 4332
ccgcgcgcgtactcgctcactcactcttaaaacccgcaacgcgaaccccgaaccctacccgaccaacgccacctccgtacgctcccgcccgccgacctcgctacgactacgactcccacccgatctccgcgccgcgacccaacgccctaccgccccgccccctccccgcccctacaccccgcgccgcgcctcctccaccgaaaactccccctctcgccccgcgcgcgccgaaccctaaaacatattaacccctcccctaccgccccaaaaaatttaaccgcgaacgaaaaactacgccactattaatataaaaaccgcgtacaacaaccctcccccaccgcgacacccccgaactctacgccccgcctaaatatcgcacgaaaaaaaccgaaaaaaacaaaaaacgaactacgataaaaaaaaaacgccccgcccaaccccccgatccgaattcctattttcgaaacaaaccgttcccacgaaattcaccctacccgaacccgaacgtcttcctacgaacgacgaaaacccgaacgtaataaaaatcgcgaacgtaaaactacgaatccttacgataacctaaaaaaaaaactaaaacaaaatacgaactaattttaatccaataaaacctcaaaaaaccaa

SEQ ID NO: 4333 - DNA, 796 bp, Artificial Sequence
  chemically treated genomic DNA (Homo sapiens) CpG-island No: 4333
ggatcggtagtagcggtttttcgtttttcgcggcgattttttttttacgaatttttcgggagttggaggtgggggggaggggattcgattacgcggttgaagagcgcggggagttcgtttttttacgcggcgggcggcggcggcgttagacgtataaagagggaggagaaaggacgtcgcgggggcgggttcggggcggaggggtcgcggtttggattgggtcggttcgaggtgaggtcggaggtagcggttttcgattggtggagtattggttttttttaatatgggtcgggattggtcgaatcgttaggttcggcgacgaaatggcggcggggtcgggggaattgggaggtgtcgtagcgcgtattttttgttattgcgcggattgaggttagagtggtaggggaataggagggggtaaagtttgtgacgtgagagaacggttagtttattggttgaaatcgatggaggtaagcgtttcggcgtcgtagtgttatacgattggttgaaacgattttttttttttaggagttagtcgttcgagaatggagaaagtcgggaggagaagtcggaattaaggcggagagtaggggtgcgtatgcgtagggagggtacgcgtgttttcgtttttttttttagaggggcggaacggaggttttaagtgacgttagttattgtgttagaggtaattagggatcgcggcgaaggggcgggttcgagttgacgaataggatacgtcgaagttgtaggtagagtagagaaagattttttgttttttttgaaaaatagtgttacg

SEQ ID NO: 4334 - DNA, 796 bp, Artificial Sequence
  chemically treated genomic DNA (Homo sapiens) CpG-island No: 4334
cgtaacactatttttcaaaaaaaacaaaaaatctttctctactctacctacaacttcgacgtatcctattcgtcaactcgaacccgccccttcgccgcgatccctaattacctctaacacaataactaacgtcacttaaaacctccgttccgcccctctaaaaaaaaaaacgaaaacacgcgtaccctccctacgcatacgcacccctactctccgccttaattccgacttctcctcccgactttctccattctcgaacgactaactcctaaaaaaaaaaaatcgtttcaaccaatcgtataacactacgacgccgaaacgcttacctccatcgatttcaaccaataaactaaccgttctctcacgtcacaaactttaccccctcctattcccctaccactctaacctcaatccgcgcaataacaaaaaatacgcgctacgacacctcccaattcccccgaccccgccgccatttcgtcgccgaacctaacgattcgaccaatcccgacccatattaaaaaaaaccaatactccaccaatcgaaaaccgctacctccgacctcacctcgaaccgacccaatccaaaccgcgacccctccgccccgaacccgcccccgcgacgtcctttctcctccctctttatacgtctaacgccgccgccgcccgccgcgtaaaaaaacgaactccccgcgctcttcaaccgcgtaatcgaatcccctcccccccacctccaactcccgaaaaattcgtaaaaaaaaaatcgccgcgaaaaacgaaaaaccgctactaccgatcc

SEQ ID NO: 4335 - DNA, 796 bp, Artificial Sequence
  chemically treated genomic DNA (Homo sapiens) CpG-island No: 4335
cgtaatattattttttagagaaaataggaagtttttttttattttatttgtagtttcgacgtattttgttcgttagttcgagttcgttttttcgtcgcggtttttagttatttttagtataatgattaacgttatttaaggttttcgtttcgtttttttggggaagggggcggggatacgcgtgttttttttacgtatgcgtatttttgtttttcgttttggtttcggttttttttttcggttttttttattttcgagcggttggtttttgggggaggggaatcgttttagttaatcgtgtggtattacgacgtcgaggcgtttatttttatcggttttagttaatgagttagtcgtttttttacgttatagattttgtttttttttatttttttgttattttggttttagttcgcgtagtaataaggagtgcgcgttgcgatattttttagttttttcggtttcgtcgttatttcgtcgtcgggtttaacggttcggttaatttcgatttatattgaaaagagttagtgttttattaatcggaggtcgttgttttcgattttatttcgggtcggtttaatttaggtcgcggttttttcgtttcgagttcgttttcgcggcgtttttttttttttttttttgtgcgtttggcgtcgtcgtcgttcgtcgcgtgagaggacgggtttttcgcgttttttagtcgcgtagtcgggtttttttttttttatttttagttttcggaaggttcgtgaaggagaagtcgtcgcggaggacgaggaatcgttgttgtcggttt

SEQ ID NO: 4336 - DNA, 796 bp, Artificial Sequence
  chemically treated genomic DNA (Homo sapiens) CpG-island No: 4336
aaaccgacaacaacgattcctcgtcctccgcgacgacttctccttcacgaaccttccgaaaactaaaaataaaaaaaaaaaaacccgactacgcgactaaaaaacgcgaaaaacccgtcctctcacgcgacgaacgacgacgacgccaaacgcacaaaaaaaaaaaaaaaaaaacgccgcgaaaacgaactcgaaacgaaaaaaccgcgacctaaattaaaccgacccgaaataaaatcgaaaacaacgacctccgattaataaaacactaactcttttcaatataaatcgaaattaaccgaaccgttaaacccgacgacgaaataacgacgaaaccgaaaaaactaaaaaatatcgcaacgcgcactccttattactacgcgaactaaaaccaaaataacaaaaaaataaaaaaaaacaaaatctataacgtaaaaaaacgactaactcattaactaaaaccgataaaaataaacgcctcgacgtcgtaataccacacgattaactaaaacgattcccctcccccaaaaaccaaccgctcgaaaataaaaaaaaccgaaaaaaaaaaccgaaaccaaaacgaaaaacaaaaatacgcatacgtaaaaaaaacacgcgtatccccgcccccttccccaaaaaaacgaaacgaaaaccttaaataacgttaatcattatactaaaaataactaaaaaccgcgacgaaaaaacgaactcgaactaacgaacaaaatacgtcgaaactacaaataaaataaaaaaaaacttcctattttctctaaaaaataatattacg

SEQ ID NO: 4337 - DNA, 544 bp, Artificial Sequence
  chemically treated genomic DNA (Homo sapiens) CpG-island No: 4337
tatcgcggttagttcggacgtgacggtgttacgggtttaggggcgagaagcggggtgaggagggggcggggtcggggttttcgcggcgggacgtgaagatgtattttttttttgcgttttcgttcgtttcgtagtttcgtttagcgtattttgtaaacgtcgttataggtttcggtttttatacgttgtagtagttcgaagcggtttcgcggattttgtagcgatacgtttcgtaatagcgttatggttcggcgtcggattcgtcggcgggcgtaagttgcggagtcggcgcggagcggcgcggggtggggcggggcgaagcgagcgggtaggtaggggtagcgtcgagattcggaggtcgtaggggcggggttagttcggggcggggttagttcggggttgtttcgtcgttcgtttggtcgagaggaggcgttttggttgcgcggggaagttttagaagtaggggcggagtttaggtattttttttaattttcgtcgcgttataggtgtagagtataaagtttaaaattttaaaatagtaaaa

SEQ ID NO: 4338 - DNA, 544 bp, Artificial Sequence
  chemically treated genomic DNA (Homo sapiens) CpG-island No: 4338
ttttactattttaaaattttaaactttatactctacacctataacgcgacgaaaattaaaaaaaatacctaaactccgcccctacttctaaaacttccccgcgcaaccaaaacgcctcctctcgaccaaacgaacgacgaaacaaccccgaactaaccccgccccgaactaaccccgcccctacgacctccgaatctcgacgctacccctacctacccgctcgcttcgccccgccccaccccgcgccgctccgcgccgactccgcaacttacgcccgccgacgaatccgacgccgaaccataacgctattacgaaacgtatcgctacaaaatccgcgaaaccgcttcgaactactacaacgtataaaaaccgaaacctataacgacgtttacaaaatacgctaaacgaaactacgaaacgaacgaaaacgcaaaaaaaaaatacatcttcacgtcccgccgcgaaaaccccgaccccgccccctcctcaccccgcttctcgcccctaaacccgtaacaccgtcacgtccgaactaaccgcgata

SEQ ID NO: 4339 - DNA, 544 bp, Artificial Sequence
  chemically treated genomic DNA (Homo sapiens) CpG-island No: 4339
ttttgttgttttaggattttgaattttatgttttgtatttgtagcgcggcgagaattgggaggggtatttaagtttcgtttttgtttttgggattttttcgcgtaattagggcgttttttttcggttaggcgggcggcggggtagtttcgggttggtttcgtttcgggttggtttcgtttttacggttttcgagtttcggcgttgtttttgtttgttcgttcgtttcgtttcgttttatttcgcgtcgtttcgcgtcggtttcgtagtttgcgttcgtcggcgggttcggcgtcgggttatggcgttgttgcgggacgtgtcgttgtaggattcgcgggatcgtttcgagttgttatagcgtgtgggggtcgggatttatggcgacgtttataaggtgcgttgagcggggttgcgggacgggcgggagcgtaggaggagggtgtatttttacgtttcgtcgcgggaatttcggtttcgttttttttttatttcgtttttcgtttttaggttcgtgatatcgttacgttcgaattggtcgcggtg

SEQ ID NO: 4340 - DNA, 544 bp, Artificial Sequence
  chemically treated genomic DNA (Homo sapiens) CpG-island No: 4340
caccgcgaccaattcgaacgtaacgatatcacgaacctaaaaacgaaaaacgaaataaaaaaaaaacgaaaccgaaattcccgcgacgaaacgtaaaaatacaccctcctcctacgctcccgcccgtcccgcaaccccgctcaacgcaccttataaacgtcgccataaatcccgacccccacacgctataacaactcgaaacgatcccgcgaatcctacaacgacacgtcccgcaacaacgccataacccgacgccgaacccgccgacgaacgcaaactacgaaaccgacgcgaaacgacgcgaaataaaacgaaacgaaacgaacgaacaaacaaaaacaacgccgaaactcgaaaaccgtaaaaacgaaaccaacccgaaacgaaaccaacccgaaactaccccgccgcccgcctaaccgaaaaaaaacgccctaattacgcgaaaaaatcccaaaaacaaaaacgaaacttaaatacccctcccaattctcgccgcgctacaaatacaaaacataaaattcaaaatcctaaaacaacaaaa

SEQ ID NO: 4341 - DNA, 747 bp, Artificial Sequence
  chemically treated genomic DNA (Homo sapiens) CpG-island No: 4341
ttttgcgcgtttcgaaggggtcggggcgtagggtggagtttcgagcggcgcgtttagtcggtggttattattatttgagtttcgggcggcgggatttcggttcgtttcgtattttcgtcgcggttagtttttttcggtatttattcgttacgcgaatggattttagtatcgtcgtttcgaggttcggggcggcgggtttcgcgggtttaggggaaagggtcgcgtaggggcgggcggtttttagtttttgattcgggtttcggtggcgggggcgcggcgggaggcggtttttcgttatttggagtaggataaggagggtaagggcggacgaagacgtatcgatattgattgtgagtagcgtttttattagttcgtagttattggaaggtatatacggcggttttacggtgtttagtagcgtttagaatttgttatcgtgacgtagtcgtttcgtcggttgttaggaaattgttttcggggttcgcgcgcgttgcgttttacggagtttgcgcgtcgttgggggcgttcgtgcgacgaaggttcgcgggcggcgagagagagtgggaggaattataattttcggcgtgtatagcgcgggttagtgttttcggggtttgtggttgtgttcgcgagcgcgttggggtttttagttagtgggtaacgtatattgattgattttttagagacgtttgtattcgtttaaaggtgatttaattttatggtgcgttgtgatattcggttttagtt

SEQ ID NO: 4342 - DNA, 747 bp, Artificial Sequence
  chemically treated genomic DNA (Homo sapiens) CpG-island No: 4342
aactaaaaccgaatatcacaacgcaccataaaattaaatcacctttaaacgaatacaaacgtctctaaaaaatcaatcaatatacgttacccactaactaaaaaccccaacgcgctcgcgaacacaaccacaaaccccgaaaacactaacccgcgctatacacgccgaaaattataattcctcccactctctctcgccgcccgcgaaccttcgtcgcacgaacgcccccaacgacgcgcaaactccgtaaaacgcaacgcgcgcgaaccccgaaaacaatttcctaacaaccgacgaaacgactacgtcacgataacaaattctaaacgctactaaacaccgtaaaaccgccgtatataccttccaataactacgaactaataaaaacgctactcacaatcaatatcgatacgtcttcgtccgcccttaccctccttatcctactccaaataacgaaaaaccgcctcccgccgcgcccccgccaccgaaacccgaatcaaaaactaaaaaccgcccgcccctacgcgaccctttcccctaaacccgcgaaacccgccgccccgaacctcgaaacgacgatactaaaatccattcgcgtaacgaataaataccgaaaaaaactaaccgcgacgaaaatacgaaacgaaccgaaatcccgccgcccgaaactcaaataataataaccaccgactaaacgcgccgctcgaaactccaccctacgccccgaccccttcgaaacgcgcaaaa

SEQ ID NO: 4343 - DNA, 747 bp, Artificial Sequence
  chemically treated genomic DNA (Homo sapiens) CpG-island No: 4343
agttagggtcgagtgttatagcgtattatggagttaagttatttttgaacgggtataaacgtttttgaaagattagttaatatgcgttatttattggttggagattttagcgcgttcgcgggtatagttataagtttcggaggtattggttcgcgttgtgtacgtcgggagttgtagttttttttattttttttcgtcgttcgcgggttttcgtcgtacgagcgtttttagcggcgcgtaggtttcgtgaagcgtagcgcgcgcggatttcgggggtagttttttagtaatcggcggagcggttacgttacggtggtaggttttaagcgttgttgggtatcgtaaggtcgtcgtgtgtattttttagtagttacgggttggtggaagcgttgtttatagttagtgtcggtacgttttcgttcgtttttattttttttattttgttttaggtagcggagagtcgtttttcgtcgcgttttcgttatcgaggttcgggttagaggttagaggtcgttcgtttttgcgcggtttttttttttgagttcgcggagttcgtcgtttcgggtttcggggcgacgatgttggagtttattcgcgtgacgggtgagtgtcgggaagggttggtcgcggcgggggtgcggggcggatcggggtttcgtcgttcggggtttaggtaatggtagttatcggttgggcgcgtcgttcgggattttattttgcgtttcgattttttcggggcgcgtagga

SEQ ID NO: 4344 - DNA, 747 bp, Artificial Sequence
  chemically treated genomic DNA (Homo sapiens) CpG-island No: 4344
tcctacgcgccccgaaaaaatcgaaacgcaaaataaaatcccgaacgacgcgcccaaccgataactaccattacctaaaccccgaacgacgaaaccccgatccgccccgcacccccgccgcgaccaacccttcccgacactcacccgtcacgcgaataaactccaacatcgtcgccccgaaacccgaaacgacgaactccgcgaactcaaaaaaaaaaaccgcgcaaaaacgaacgacctctaacctctaacccgaacctcgataacgaaaacgcgacgaaaaacgactctccgctacctaaaacaaaataaaaaaaataaaaacgaacgaaaacgtaccgacactaactataaacaacgcttccaccaacccgtaactactaaaaaatacacacgacgaccttacgatacccaacaacgcttaaaacctaccaccgtaacgtaaccgctccgccgattactaaaaaactacccccgaaatccgcgcgcgctacgcttcacgaaacctacgcgccgctaaaaacgctcgtacgacgaaaacccgcgaacgacgaaaaaaaataaaaaaaactacaactcccgacgtacacaacgcgaaccaatacctccgaaacttataactatacccgcgaacgcgctaaaatctccaaccaataaataacgcatattaactaatctttcaaaaacgtttatacccgttcaaaaataacttaactccataatacgctataacactcgaccctaact

SEQ ID NO: 4345 - DNA, 526 bp, Artificial Sequence
  chemically treated genomic DNA (Homo sapiens) CpG-island No: 4345
agtcgcgtttcgttttatcgcgaagtttaggcgcgatcgaagggttgtaggtggagtagattcggacgttttcgcgaggcggttatcgaaggagagtttggggttttcggcgcgggcgtttaggagggagttggggttttcgggaggtggggggtatttttggataggtaagacgagggcgtatcgggcgaggcgagcggtcggggtttgcgtttaaggggcgggtcggattttatttgttttttgttaacgaggaaattaatcgtcgttagtattattttttttcgggagtcgtagtgcgtggtagacgagtttttttagtttttaggtcgaggttgcgattttatattggggaacgaggatcgcggggatttggagaggggtcggggtaggttggcgggcgcggttttagtttgagatttgcgcggagggcggaggcggggaggtttttttagaaagtcgtttgtttcgcggggttcgaggggaggttgtatttttgggttttttttttagtttttttaaatag

SEQ ID NO: 4346 - DNA, 526 bp, Artificial Sequence
  chemically treated genomic DNA (Homo sapiens) CpG-island No: 4346
ctatttaaaaaaactaaaaaaaaaacccaaaaatacaacctcccctcgaaccccgcgaaacaaacgactttctaaaaaaacctccccgcctccgccctccgcgcaaatctcaaactaaaaccgcgcccgccaacctaccccgacccctctccaaatccccgcgatcctcgttccccaatataaaatcgcaacctcgacctaaaaactaaaaaaactcgtctaccacgcactacgactcccgaaaaaaaataatactaacgacgattaatttcctcgttaacaaaaaacaaataaaatccgacccgccccttaaacgcaaaccccgaccgctcgcctcgcccgatacgccctcgtcttacctatccaaaaataccccccacctcccgaaaaccccaactccctcctaaacgcccgcgccgaaaaccccaaactctccttcgataaccgcctcgcgaaaacgtccgaatctactccacctacaacccttcgatcgcgcctaaacttcgcgataaaacgaaacgcgact

SEQ ID NO: 4347 - DNA, 526 bp, Artificial Sequence
  chemically treated genomic DNA (Homo sapiens) CpG-island No: 4347
ttgtttagggaagttgaggaaggaatttaaaaatatagttttttttcggatttcgcgggataggcggttttttgagaggattttttcgttttcgtttttcgcgtaggttttaaattgaagtcgcgttcgttagtttgtttcggtttttttttaggttttcgcgattttcgttttttagtgtggagtcgtagtttcgatttgggagttgggagaattcgtttattacgtattgcggttttcggggaggggtggtgttggcggcggttagttttttcgttggtaaaaggtaggtggggttcgattcgttttttgggcgtagatttcggtcgttcgtttcgttcggtgcgttttcgttttgtttatttaagagtgttttttatttttcggggattttagtttttttttgggcgttcgcgtcgaaagttttaggttttttttcgatggtcgtttcgcggagacgttcgggtttgttttatttgtagtttttcggtcgcgtttgggtttcgcggtggagcgggacgcggtt

SEQ ID NO: 4348 - DNA, 526 bp, Artificial Sequence
  chemically treated genomic DNA (Homo sapiens) CpG-island No: 4348
aaccgcgtcccgctccaccgcgaaacccaaacgcgaccgaaaaactacaaataaaacaaacccgaacgtctccgcgaaacgaccatcgaaaaaaaacctaaaactttcgacgcgaacgcccaaaaaaaaactaaaatccccgaaaaataaaaaacactcttaaataaacaaaacgaaaacgcaccgaacgaaacgaacgaccgaaatctacgcccaaaaaacgaatcgaaccccacctaccttttaccaacgaaaaaactaaccgccgccaacaccacccctccccgaaaaccgcaatacgtaataaacgaattctcccaactcccaaatcgaaactacgactccacactaaaaaacgaaaatcgcgaaaacctaaaaaaaaaccgaaacaaactaacgaacgcgacttcaatttaaaacctacgcgaaaaacgaaaacgaaaaaatcctctcaaaaaaccgcctatcccgcgaaatccgaaaaaaaactatatttttaaattccttcctcaacttccctaaacaa

SEQ ID NO: 4349 - DNA, 1069 bp, Artificial Sequence
  chemically treated genomic DNA (Homo sapiens) CpG-island No: 4349
gtagtttcggcgggtgggtagcgttcgtttttcgggtgcgcgttaggatttcgtcgcgttttgggaagatagcgcggggcgtacgtgcgggatttcggttttaggcgtttattagtattcggttttcgtttattgacgtcgattttgcgtagttgggcggggaaagtgagggaagaaagttgggagcggttcggggcgtcggaggtttcggcggtcgtttttcgtttggtttgtagttcggtgttttacgcgttttttttttcgttcgttttagattttttcggtcgaagaacgaaacgtttcgtttttttcgcggtttcggtcggcggcgtagttgattttaaggaaataggaaaggacgggcgggggcgcgggcgtcgagtcggtgcgtcggtgcgcggttggacgggttgcggggttcggggcgcgattcgggggcggcgcgggagtcggcgagatacgtttttatttttttttttttttagagttcgattcgtcgggtagagcgtagttagtagacgttaggagtagattgtaacggcgcgtttcggaggggtcgtatcgttgtttttcgaagagttcgtttcggttttttcgattaatattggacggagttagggggcgtgcgcggtggttgtggcgttggcggcgaggcggggattcgggcggacgtcgacgaggtggtttgtcgttcggtttgggcgcggcgtcggggttagttcgggattgcgtttcggtcgcgtcgggcgtttatatcgtgcggggggcggaggttgttgcggtcgtcgttgcgtcgggggttgttcggacgtttagttcgcgcgggtcgaggcgcggggaggtagggcgggaggaggagggattaggcggcggaggagggatcgggaggagtagaggaggaggagaatgcgaggaggagggaggagaattagtagcggggttttaaggttagcgttcggacgtggatagcggtggttttcgcgggatttagttttcggcgggagtggggcggcgtatgggaggggagcgggtgttttgaggagttaattttcgagaggggcgtttttag

SEQ ID NO: 4350 - DNA, 1069 bp, Artificial Sequence
  chemically treated genomic DNA (Homo sapiens) CpG-island No: 4350
ctaaaaacgcccctctcgaaaattaactcctcaaaacacccgctcccctcccatacgccgccccactcccgccgaaaactaaatcccgcgaaaaccaccgctatccacgtccgaacgctaaccttaaaaccccgctactaattctcctccctcctcctcgcattctcctcctcctctactcctcccgatccctcctccgccgcctaatccctcctcctcccgccctacctccccgcgcctcgacccgcgcgaactaaacgtccgaacaacccccgacgcaacgacgaccgcaacaacctccgccccccgcacgatataaacgcccgacgcgaccgaaacgcaatcccgaactaaccccgacgccgcgcccaaaccgaacgacaaaccacctcgtcgacgtccgcccgaatccccgcctcgccgccaacgccacaaccaccgcgcacgccccctaactccgtccaatattaatcgaaaaaaccgaaacgaactcttcgaaaaacaacgatacgacccctccgaaacgcgccgttacaatctactcctaacgtctactaactacgctctacccgacgaatcgaactctaaaaaaaaaaaaaaataaaaacgtatctcgccgactcccgcgccgcccccgaatcgcgccccgaaccccgcaacccgtccaaccgcgcaccgacgcaccgactcgacgcccgcgcccccgcccgtcctttcctatttccttaaaatcaactacgccgccgaccgaaaccgcgaaaaaaacgaaacgtttcgttcttcgaccgaaaaaatctaaaacgaacgaaaaaaaaaacgcgtaaaacaccgaactacaaaccaaacgaaaaacgaccgccgaaacctccgacgccccgaaccgctcccaactttcttccctcactttccccgcccaactacgcaaaatcgacgtcaataaacgaaaaccgaatactaataaacgcctaaaaccgaaatcccgcacgtacgccccgcgctatcttcccaaaacgcgacgaaatcctaacgcgcacccgaaaaacgaacgctacccacccgccgaaactac

SEQ ID NO: 4351 - DNA, 1069 bp, Artificial Sequence
  chemically treated genomic DNA (Homo sapiens) CpG-island No: 4351
ttgggaacgtttttttcggaaattaattttttagggtattcgttttttttttatgcgtcgttttattttcgtcggagattaggtttcgcgggggttatcgttgtttacgttcgggcgttggttttgggatttcgttgttggtttttttttttttttttcgtatttttttttttttttgtttttttcgatttttttttcgtcgtttggtttttttttttttcgttttgttttttcgcgtttcggttcgcgcgagttagacgttcgggtagttttcggcgtagcgacggtcgtagtagttttcgtttttcgtacggtgtgagcgttcgacgcggtcgaggcgtagtttcgagttagtttcggcgtcgcgtttagatcggacgataggttatttcgtcggcgttcgttcgagttttcgtttcgtcgttaacgttataattatcgcgtacgttttttgatttcgtttagtattgatcgggagagtcggagcgagtttttcggggagtagcgatgcgattttttcgggacgcgtcgttgtagtttgtttttggcgtttgttggttgcgttttgttcggcgagtcgggttttggaggaaaagaaaggtaagggcgtgtttcgtcggttttcgcgtcgttttcggatcgcgtttcggatttcgtagttcgtttaatcgcgtatcggcgtatcggttcggcgttcgcgttttcgttcgtttttttttgtttttttgagattagttgcgtcgtcgatcgggatcgcgggaggaacgggacgtttcgtttttcggtcgggagagtttggggcgggcggaggaggagacgcgtgggatatcgggttgtaggttaggcggggaacggtcgtcgggattttcggcgtttcgaatcgtttttaattttttttttttatttttttcgtttagttgcgtaggatcggcgttagtgggcgaaagtcgggtgttggtgggcgtttggggtcggggtttcgtacgtgcgtttcgcgttgtttttttagggcgcgacggggttttggcgcgtattcgaggggcgggcgttgtttattcgtcgagattgt

SEQ ID NO: 4352 - DNA, 1069 bp, Artificial Sequence
  chemically treated genomic DNA (Homo sapiens) CpG-island No: 4352
acaatctcgacgaataaacaacgcccgcccctcgaatacgcgccaaaaccccgtcgcgccctaaaaaaacaacgcgaaacgcacgtacgaaaccccgaccccaaacgcccaccaacacccgactttcgcccactaacgccgatcctacgcaactaaacgaaaaaaataaaaaaaaaaaattaaaaacgattcgaaacgccgaaaatcccgacgaccgttccccgcctaacctacaacccgatatcccacgcgtctcctcctccgcccgccccaaactctcccgaccgaaaaacgaaacgtcccgttcctcccgcgatcccgatcgacgacgcaactaatctcaaaaaaacaaaaaaaaacgaacgaaaacgcgaacgccgaaccgatacgccgatacgcgattaaacgaactacgaaatccgaaacgcgatccgaaaacgacgcgaaaaccgacgaaacacgcccttacctttcttttcctccaaaacccgactcgccgaacaaaacgcaaccaacaaacgccaaaaacaaactacaacgacgcgtcccgaaaaaatcgcatcgctactccccgaaaaactcgctccgactctcccgatcaatactaaacgaaatcaaaaaacgtacgcgataattataacgttaacgacgaaacgaaaactcgaacgaacgccgacgaaataacctatcgtccgatctaaacgcgacgccgaaactaactcgaaactacgcctcgaccgcgtcgaacgctcacaccgtacgaaaaacgaaaactactacgaccgtcgctacgccgaaaactacccgaacgtctaactcgcgcgaaccgaaacgcgaaaaaacaaaacgaaaaaaaaaaaaaccaaacgacgaaaaaaaaatcgaaaaaaacaaaaaaaaaaaaaaatacgaaaaaaaaaaaaaaaaaccaacaacgaaatcccaaaaccaacgcccgaacgtaaacaacgataacccccgcgaaacctaatctccgacgaaaataaaacgacgcataaaaaaaaaacgaataccctaaaaaattaatttccgaaaaaaacgttcccaa

SEQ ID NO: 4353 - DNA, 1598 bp, Artificial Sequence
  chemically treated genomic DNA (Homo sapiens) CpG-island No: 4353
ggtcgcggaagggggaggcggagtaaggtcggcgggagttaatcggtttggcggtacgagggggcgggggcggggttaacgcgcgcgatttaaatatacgggtcgggcgtattttgtagtcgcgtcgtttcgcggtttttcggcgcggggtcggggaattttttttttatttgcgtatttttcgttttcgcggtttagattttttcgttagttcggtttttttttcgtagggggagcgaggcgacggttgtcgggaagcgcgcgttattttttttttttatttttcgtttttttttcgcgcgttattcgtttttttttttttttcgttaataatagttgggtggttgggggaggagggaaggtggtttcggcggagtttgggcgggcgttttttatttagtcgttagtcgtcgtgggagtcggaggatggcggcggtagtagcggtcgttcgagaggaggcggtgtcgagatcgggggcgtcgagcgcggtagtagagagcggtagcggttcgtcgtggcgtattagaatcgaaattagcggtagtcgtacggttatttgagtcgtttttttttgttggagttagcgaggggtgtttgtagtcgggattttttttttttcgcgttttttcgtttttcgcgttcgcgttaggtcgtcggtttcgttcgtcgttttaagaagagcgcgtcgggcgtcgattgtttttttggacgtcgggcggcggttttggacgtgcgggggtttttttgggtcggtcgcggcgtttgggttttgttttttagttttcgcgttcgttttcgttttttcggttttcggggcgtagcgcgcgggttcggttcggggtagggcggatatgggcgttaaatagagcggttcggtcgtcgttaacggtcgtacgcgcgcgtattcgggttcggatttattttttagtagtagcggaggcgttaatgggatcgcgggcggcggcgggggcgttcgggtcgtcgtcgcggggaggttttcggtttaggtgtttagcgcgtattagtttagcgttttcggcggcgtcgcggcggtcgcggcggtttcggtagtttcggcggtttcgcgtagtcgttttttcggcggggtcgtggggagcgtggcgtcgggggttcgcgcggcgtagtttttttttagtatttcgaatagtagtagcggttcgtacggttcgtaggattcggtgtatagtagttttgaggacggcggcggcggtcgggatcggtcggtgggcgggagtttcggcgggtcgcgtttggtgatcggttttttattagtttatttttcgtcgtatatgtttggaggtacggattttttttcgcgtattcgcgttcggttttttcgcggttgtacgtgggtcgtggtcgtcggttatttttatttttttttttttttttttttgtcggggcgtcgggggttgtttttcggattagttcgcgtcggtttttattttggaagaaattcggcgtttaatatcggcggtgtcgttatcgtatagacgcgtggttttgtttttaaatattttgagtatttttattttagcggttgtttagtagagaaagtttattttttagtgagatg

SEQ ID NO: 4354 - DNA, 1598 bp, Artificial Sequence
  chemically treated genomic DNA (Homo sapiens) CpG-island No: 4354
catctcactaaaaaataaactttctctactaaacaaccgctaaaataaaaatactcaaaatatttaaaaacaaaaccacgcgtctatacgataacgacaccgccgatattaaacgccgaatttcttccaaaataaaaaccgacgcgaactaatccgaaaaacaacccccgacgccccgacaaaaaaaaaaaaaaaaaaaaataaaaataaccgacgaccacgacccacgtacaaccgcgaaaaaaccgaacgcgaatacgcgaaaaaaaatccgtacctccaaacatatacgacgaaaaataaactaataaaaaaccgatcaccaaacgcgacccgccgaaactcccgcccaccgaccgatcccgaccgccgccgccgtcctcaaaactactatacaccgaatcctacgaaccgtacgaaccgctactactattcgaaatactaaaaaaaaactacgccgcgcgaacccccgacgccacgctccccacgaccccgccgaaaaaacgactacgcgaaaccgccgaaactaccgaaaccgccgcgaccgccgcgacgccgccgaaaacgctaaactaatacgcgctaaacacctaaaccgaaaacctccccgcgacgacgacccgaacgcccccgccgccgcccgcgatcccattaacgcctccgctactactaaaaaataaatccgaacccgaatacgcgcgcgtacgaccgttaacgacgaccgaaccgctctatttaacgcccatatccgccctaccccgaaccgaacccgcgcgctacgccccgaaaaccgaaaaaacgaaaacgaacgcgaaaactaaaaaacaaaacccaaacgccgcgaccgacccaaaaaaacccccgcacgtccaaaaccgccgcccgacgtccaaaaaaacaatcgacgcccgacgcgctcttcttaaaacgacgaacgaaaccgacgacctaacgcgaacgcgaaaaacgaaaaaacgcgaaaaaaaaaaaatcccgactacaaacacccctcgctaactccaacaaaaaaaaacgactcaaataaccgtacgactaccgctaatttcgattctaatacgccacgacgaaccgctaccgctctctactaccgcgctcgacgcccccgatctcgacaccgcctcctctcgaacgaccgctactaccgccgccatcctccgactcccacgacgactaacgactaaataaaaaacgcccgcccaaactccgccgaaaccaccttccctcctcccccaaccacccaactattattaacgaaaaaaaaaaaaaaacgaataacgcgcgaaaaaaaaacgaaaaataaaaaaaaaaaataacgcgcgcttcccgacaaccgtcgcctcgctccccctacgaaaaaaaaaccgaactaacgaaaaaatctaaaccgcgaaaacgaaaaatacgcaaataaaaaaaaaattccccgaccccgcgccgaaaaaccgcgaaacgacgcgactacaaaatacgcccgacccgtatatttaaatcgcgcgcgttaaccccgcccccgccccctcgtaccgccaaaccgattaactcccgccgaccttactccgcctcccccttccgcgacc

SEQ ID NO: 4355 - DNA, 1598 bp, Artificial Sequence
  chemically treated genomic DNA (Homo sapiens) CpG-island No: 4355
tattttattggaaaatagattttttttattgggtagtcgttgaggtgagggtgtttaggatgtttaaaaataaaattacgcgtttatgcggtagcggtatcgtcggtgttaagcgtcgggttttttttaggatggagatcgacgcgggttggttcgggaggtagttttcggcgtttcggtagaaggagaaaaggagaagggtaaaaatagtcggcggttacggtttacgtgtagtcgcgggaggatcgagcgcgggtgcgcggagaggggttcgtatttttaaatatgtgcggcgagaggtgagttggtaaggagtcgattattaggcgcggttcgtcggggttttcgtttatcggtcggtttcggtcgtcgtcgtcgtttttagggttgttgtgtatcgagttttgcgagtcgtacgggtcgttgttgttgttcgggatgttgaagggggattgcgtcgcgcgggttttcgacgttacgttttttacggtttcgtcgagggagcggttgcgcggggtcgtcggggttgtcggggtcgtcgcggtcgtcgcggcgtcgtcggaggcgttgggttggtgcgcgttgggtatttgagtcgggaattttttcgcggcggcggttcgagcgttttcgtcgtcgttcgcggttttattggcgttttcgttgttattggaaggtagattcgagttcgagtacgcgcgcgtgcggtcgttagcggcggtcgggtcgttttgtttggcgtttatgttcgttttgtttcgggtcgggttcgcgcgttgcgtttcgagagtcgggagggcgggagcgagcgcgggagttagagggtagggtttaggcgtcgcggtcggtttagagaggttttcgtacgtttagggtcgtcgttcggcgtttagaggggtagtcggcgttcggcgcgttttttttggggcggcgggcgaggtcgacggtttgacgcgggcgcgggagacgaggagacgcggagaggaaggggtttcggttgtaggtatttttcgttggttttagtaggaaggggcggtttaagtggtcgtgcggttgtcgttggtttcggttttggtgcgttacgacgggtcgttatcgttttttgttgtcgcgttcggcgttttcgatttcggtatcgttttttttcgggcggtcgttgttatcgtcgttatttttcggtttttacggcggttggcggttgagtgggaggcgttcgtttagatttcgtcggggttattttttttttttttttagttatttagttgttattaacggagaaagaggaaaaacgggtggcgcgcgaggggagaacgaaaaatgggagggagaggtggcgcgcgtttttcggtaatcgtcgtttcgttttttttgcgaaggaggggtcgggttggcgggaggatttgggtcgcgaaggcggggggtgcgtagatggggaggaggtttttcggtttcgcgtcggaaggtcgcggagcggcgcggttgtagggtgcgttcggttcgtgtgtttgggtcgcgcgcgttgatttcgttttcgttttttcgtgtcgttaggtcgattggttttcgtcggttttgtttcgtttttttttttcgcgatt

SEQ ID NO: 4356 - DNA, 1598 bp, Artificial Sequence
  chemically treated genomic DNA (Homo sapiens) CpG-island No: 4356
aatcgcgaaaaaaaaaaacgaaacaaaaccgacgaaaaccaatcgacctaacgacacgaaaaaacgaaaacgaaatcaacgcgcgcgacccaaacacacgaaccgaacgcaccctacaaccgcgccgctccgcgaccttccgacgcgaaaccgaaaaacctcctccccatctacgcaccccccgccttcgcgacccaaatcctcccgccaacccgacccctccttcgcaaaaaaaacgaaacgacgattaccgaaaaacgcgcgccacctctccctcccatttttcgttctcccctcgcgcgccacccgtttttcctctttctccgttaataacaactaaataactaaaaaaaaaaaaaaaataaccccgacgaaatctaaacgaacgcctcccactcaaccgccaaccgccgtaaaaaccgaaaaataacgacgataacaacgaccgcccgaaaaaaaacgataccgaaatcgaaaacgccgaacgcgacaacaaaaaacgataacgacccgtcgtaacgcaccaaaaccgaaaccaacgacaaccgcacgaccacttaaaccgccccttcctactaaaaccaacgaaaaatacctacaaccgaaaccccttcctctccgcgtctcctcgtctcccgcgcccgcgtcaaaccgtcgacctcgcccgccgccccaaaaaaaacgcgccgaacgccgactacccctctaaacgccgaacgacgaccctaaacgtacgaaaacctctctaaaccgaccgcgacgcctaaaccctaccctctaactcccgcgctcgctcccgccctcccgactctcgaaacgcaacgcgcgaacccgacccgaaacaaaacgaacataaacgccaaacaaaacgacccgaccgccgctaacgaccgcacgcgcgcgtactcgaactcgaatctaccttccaataacaacgaaaacgccaataaaaccgcgaacgacgacgaaaacgctcgaaccgccgccgcgaaaaaattcccgactcaaatacccaacgcgcaccaacccaacgcctccgacgacgccgcgacgaccgcgacgaccccgacaaccccgacgaccccgcgcaaccgctccctcgacgaaaccgtaaaaaacgtaacgtcgaaaacccgcgcgacgcaatcccccttcaacatcccgaacaacaacaacgacccgtacgactcgcaaaactcgatacacaacaaccctaaaaacgacgacgacgaccgaaaccgaccgataaacgaaaaccccgacgaaccgcgcctaataatcgactccttaccaactcacctctcgccgcacatatttaaaaatacgaacccctctccgcgcacccgcgctcgatcctcccgcgactacacgtaaaccgtaaccgccgactatttttacccttctccttttctccttctaccgaaacgccgaaaactacctcccgaaccaacccgcgtcgatctccatcctaaaaaaaacccgacgcttaacaccgacgataccgctaccgcataaacgcgtaattttatttttaaacatcctaaacaccctcacctcaacgactacccaataaaaaaaatctattttccaataaaata

SEQ ID NO: 4357 - DNA, 754 bp, Artificial Sequence
  chemically treated genomic DNA (Homo sapiens) CpG-island No: 4357
gatttcgtcgttaggttttgggaattgtttgggcgtcgttaaagttcgagtcggagttgttatttggggtagcggtcgggaagaggtaacgatgttagtaagaaagtagcggaggtaggaggcggtcggaggagtggattggagcggacggagtttcgtcgttttttagttcggagcgtttggagcgaaagttaagcgtttttcgagggcgatttttttttttcgggcgcgcgtttattcgttgtagtcggtagttcggcgggagaggtggtagttgtagtttcgtatcggggagagcgagttttttgcgcgcgcgtttattcgttttttaggtgattcggcgttttcgtcgcgttcgttggaagtttgtaaatttttttcgggggtttcgtcgttacgttgggaagttggggacgcggggggaggtttttggttcgtcgttttcgttgtcgtttgatcgtatttttggagggtttcgtattttgttaggtttttggaggtaaatatatattttcgatttataattggttttcgcgttaggggattcgcgcgtttttatatacgtacgtacgtcgggcggattcggcgtcggttttacgttagtatttttttaggcgcgcgcgcggcggttatcgagcgtttcggtatttacgcggcgcggggtttttagggtggttttaggatatagtcgaattttatagtttattagtattcggggtcggatttttttttggttcgttaaaatgtttataaa

SEQ ID NO: 4358 - DNA, 754 bp, Artificial Sequence
  chemically treated genomic DNA (Homo sapiens) CpG-island No: 4358
tttataaacattttaacgaaccaaaaaaaaatccgaccccgaatactaataaactataaaattcgactatatcctaaaaccaccctaaaaaccccgcgccgcgtaaataccgaaacgctcgataaccgccgcgcgcgcgcctaaaaaaatactaacgtaaaaccgacgccgaatccgcccgacgtacgtacgtatataaaaacgcgcgaatcccctaacgcgaaaaccaattataaatcgaaaatatatatttacctccaaaaacctaacaaaatacgaaaccctccaaaaatacgatcaaacgacaacgaaaacgacgaaccaaaaacctccccccgcgtccccaacttcccaacgtaacgacgaaacccccgaaaaaaatttacaaacttccaacgaacgcgacgaaaacgccgaatcacctaaaaaacgaataaacgcgcgcgcaaaaaactcgctctccccgatacgaaactacaactaccacctctcccgccgaactaccgactacaacgaataaacgcgcgcccgaaaaaaaaaaatcgccctcgaaaaacgcttaactttcgctccaaacgctccgaactaaaaaacgacgaaactccgtccgctccaatccactcctccgaccgcctcctacctccgctactttcttactaacatcgttacctcttcccgaccgctaccccaaataacaactccgactcgaactttaacgacgcccaaacaattcccaaaacctaacgacgaaatc

SEQ ID NO: 4359 - DNA, 754 bp, Artificial Sequence
  chemically treated genomic DNA (Homo sapiens) CpG-island No: 4359
tttgtaaatattttggcggattagagggaagttcggtttcgagtgttggtagattgtggaattcggttgtgttttgaggttattttagagatttcgcgtcgcgtgagtgtcggagcgttcggtggtcgtcgcgcgcgcgtttggagggatgttaacgtggagtcggcgtcgagttcgttcggcgtgcgtgcgtgtgtgggagcgcgcgagttttttgacgcggggattagttatgaatcgggggtgtgtgtttgtttttagagatttggtaaggtgcggagttttttagaagtgcggttaagcggtagcggagacggcgagttaggaattttttttcgcgtttttagttttttagcgtggcggcggaattttcggagaaagtttgtaaatttttagcgggcgcggcgaggacgtcgggttatttagggggcgggtgggcgcgcgcgtagggggttcgtttttttcggtgcggagttgtagttgttatttttttcgtcgggttgtcggttgtagcgggtgggcgcgcgttcggggaggggaggtcgttttcggagggcgtttggttttcgttttaggcgtttcgggttggagagcggcgaggtttcgttcgttttagtttattttttcggtcgttttttgttttcgttgtttttttgttggtatcgttattttttttcggtcgttgttttaaatgatagtttcggttcgagttttggcggcgtttaggtaatttttaagatttggcggcggagtt

SEQ ID NO: 4360 - DNA, 754 bp, Artificial Sequence
  chemically treated genomic DNA (Homo sapiens) CpG-island No: 4360
aactccgccgccaaatcttaaaaattacctaaacgccgccaaaactcgaaccgaaactatcatttaaaacaacgaccgaaaaaaaataacgataccaacaaaaaaacaacgaaaacaaaaaacgaccgaaaaaataaactaaaacgaacgaaacctcgccgctctccaacccgaaacgcctaaaacgaaaaccaaacgccctccgaaaacgacctcccctccccgaacgcgcgcccacccgctacaaccgacaacccgacgaaaaaaataacaactacaactccgcaccgaaaaaaacgaaccccctacgcgcgcgcccacccgccccctaaataacccgacgtcctcgccgcgcccgctaaaaatttacaaactttctccgaaaattccgccgccacgctaaaaaactaaaaacgcgaaaaaaaattcctaactcgccgtctccgctaccgcttaaccgcacttctaaaaaactccgcaccttaccaaatctctaaaaacaaacacacacccccgattcataactaatccccgcgtcaaaaaactcgcgcgctcccacacacgcacgcacgccgaacgaactcgacgccgactccacgttaacatccctccaaacgcgcgcgcgacgaccaccgaacgctccgacactcacgcgacgcgaaatctctaaaataacctcaaaacacaaccgaattccacaatctaccaacactcgaaaccgaacttccctctaatccgccaaaatatttacaaa

SEQ ID NO: 4361 - DNA, 610 bp, Artificial Sequence
  chemically treated genomic DNA (Homo sapiens) CpG-island No: 4361
tttcgttattcgttttatttgtatggcgttgtttttttttcgttgttattggttagcgtcgggtttcgtttacggtttttagatcgcggtagggtttcgttttttcgagtcgtacggagttgcggtagcgggcggattgttaaatcgcggcggcgcggcggcggcggcggcggcggcggcggcggcggcggtcgggcgggaagcggggcgcgttttggagacgagttagcggcgtttcgggtgggggaggcgggcgggtagttagagattattttagtagtttttattacggtcggatcgaaggtgcggcggcggaggggagttagggcgttttagtaggcgagtggtcggcgttttagcggcgggatgacgggggtgggtttttttttttggggacggcggtagcgcggggaggggagaagattgtcgggtggatttgcgggttaggcgatcgatcggtagttttttcgtttttcgaattttttgggttgttggattttggtttcggtacgggatcgcgttttagggcgggggtttgatcgtagttaaatttaaacggttaaatttaatagttttggtagttggggagggaaggggtttagggaggggt

SEQ ID NO: 4362 - DNA, 610 bp, Artificial Sequence
  chemically treated genomic DNA (Homo sapiens) CpG-island No: 4362
acccctccctaaaccccttccctccccaactaccaaaactattaaatttaaccgtttaaatttaactacgatcaaacccccgccctaaaacgcgatcccgtaccgaaaccaaaatccaacaacccaaaaaattcgaaaaacgaaaaaactaccgatcgatcgcctaacccgcaaatccacccgacaatcttctcccctccccgcgctaccgccgtccccaaaaaaaaaaacccacccccgtcatcccgccgctaaaacgccgaccactcgcctactaaaacgccctaactcccctccgccgccgcaccttcgatccgaccgtaataaaaactactaaaataatctctaactacccgcccgcctcccccacccgaaacgccgctaactcgtctccaaaacgcgccccgcttcccgcccgaccgccgccgccgccgccgccgccgccgccgccgccgcgccgccgcgatttaacaatccgcccgctaccgcaactccgtacgactcgaaaaaacgaaaccctaccgcgatctaaaaaccgtaaacgaaacccgacgctaaccaataacaacgaaaaaaaaacaacgccatacaaataaaacgaataacgaaa

SEQ ID NO: 4363 - DNA, 610 bp, Artificial Sequence
  chemically treated genomic DNA (Homo sapiens) CpG-island No: 4363
atttttttttagattttttttttttttagttgttaaggttgttaggtttagtcgtttaaatttggttgcggttagattttcgttttagagcgcgatttcgtgtcgagattagagtttagtagtttagaggattcggggggcgaaggggttgtcggtcggtcgtttgattcgtaagtttattcggtagttttttttttttttcgcgttgtcgtcgtttttaagagggaagatttattttcgttatttcgtcgttgagacgtcggttattcgtttgttggggcgttttggttttttttcgtcgtcgtattttcggttcggtcgtggtgggggttgttgaggtgatttttagttgttcgttcgttttttttattcggggcgtcgttgattcgtttttagagcgcgtttcgtttttcgttcggtcgtcgtcgtcgtcgtcgtcgtcgtcgtcgtcgtcgcgtcgtcgcggtttaatagttcgttcgttgtcgtagtttcgtgcggttcggggggacggaattttgtcgcggtttgggagtcgtgggcggggttcggcgttagttaatggtaacgggggaggggtagcgttatgtaaatgaagcgggtggcggga

SEQ ID NO: 4364 - DNA, 610 bp, Artificial Sequence
  chemically treated genomic DNA (Homo sapiens) CpG-island No: 4364
tcccgccacccgcttcatttacataacgctacccctcccccgttaccattaactaacgccgaaccccgcccacgactcccaaaccgcgacaaaattccgtccccccgaaccgcacgaaactacgacaacgaacgaactattaaaccgcgacgacgcgacgacgacgacgacgacgacgacgacgacgacgaccgaacgaaaaacgaaacgcgctctaaaaacgaatcaacgacgccccgaataaaaaaaacgaacgaacaactaaaaatcacctcaacaacccccaccacgaccgaaccgaaaatacgacgacgaaaaaaaaccaaaacgccccaacaaacgaataaccgacgtctcaacgacgaaataacgaaaataaatcttccctcttaaaaacgacgacaacgcgaaaaaaaaaaaaaactaccgaataaacttacgaatcaaacgaccgaccgacaaccccttcgccccccgaatcctctaaactactaaactctaatctcgacacgaaatcgcgctctaaaacgaaaatctaaccgcaaccaaatttaaacgactaaacctaacaaccttaacaactaaaaaaaaaaaaaatctaaaaaaaaat

SEQ ID NO: 4365 - DNA, 780 bp, Artificial Sequence
  chemically treated genomic DNA (Homo sapiens) CpG-island No: 4365
tcggcgtttagacgttaggttttatagaatacgtatatataggtacggggcggtaagggtcgagacgttagttggggattgcgttttagttttagacggtagacgttagttttcgtttggtgttttcgttgtagcggtttaggatgaggtcggcgttcggtcgcgggggtatcgtcggttgcggtttagagcgttgcgtttgtcgttttttttttgcgggtagagagcggggtcgagttagacgtttcgtttcgtatattggtttcgtttatagcgttttttggtttcgtttcgtcgcggtttttaatttttgtttcgcgttttggtttcgtttttcgtttgtgtttttttttttgatttcgttttttagggatcgtttcgttttttagcgttggttttttttttgttttcgtttttagttttcgtttttttttttgatttcgttttttggtttcgtttcgttattttggttttatttttggtttcgtttttttcgttgatttcgtttttaggtttgttttttttgttttttttcgttgtatttatcgagcgggttttcggggttttgcggtttcggtcgcgtttggcggcgtcgttgttgtagaaaacggacgttgttgcggcgataggcgttttggttgaggcgttttcgcgatcgttggtggatgttgtgtacgttgcggatggacgatttggtttagcgggacggggcgtcgttaaagttcgaggcgtttttgtttttagggatttagatgggtatttttggttcgaggaagtggg

SEQ ID NO: 4366 - DNA, 780 bp, Artificial Sequence
  chemically treated genomic DNA (Homo sapiens) CpG-island No: 4366
cccacttcctcgaaccaaaaatacccatctaaatccctaaaaacaaaaacgcctcgaactttaacgacgccccgtcccgctaaaccaaatcgtccatccgcaacgtacacaacatccaccaacgatcgcgaaaacgcctcaaccaaaacgcctatcgccgcaacaacgtccgttttctacaacaacgacgccgccaaacgcgaccgaaaccgcaaaaccccgaaaacccgctcgataaatacaacgaaaaaaaacaaaaaaaacaaacctaaaaacgaaatcaacgaaaaaaacgaaaccaaaaataaaaccaaaataacgaaacgaaaccaaaaaacgaaatcaaaaaaaaaaacgaaaactaaaaacgaaaacaaaaaaaaaaccaacgctaaaaaacgaaacgatccctaaaaaacgaaatcaaaaaaaaaaacacaaacgaaaaacgaaaccaaaacgcgaaacaaaaattaaaaaccgcgacgaaacgaaaccaaaaaacgctataaacgaaaccaatatacgaaacgaaacgtctaactcgaccccgctctctacccgcaaaaaaaaaacgacaaacgcaacgctctaaaccgcaaccgacgatacccccgcgaccgaacgccgacctcatcctaaaccgctacaacgaaaacaccaaacgaaaactaacgtctaccgtctaaaactaaaacgcaatccccaactaacgtctcgacccttaccgccccgtacctatatatacgtattctataaaacctaacgtctaaacgccga

SEQ ID NO: 4367 - DNA, 780 bp, Artificial Sequence
  chemically treated genomic DNA (Homo sapiens) CpG-island No: 4367
tttattttttcggattaggggtgtttatttgagtttttgggggtaggggcgtttcgggttttgacgacgtttcgtttcgttgggttaggtcgtttattcgtaacgtgtatagtatttattagcggtcgcggaagcgttttagttaggacgtttatcgtcgtaatagcgttcgttttttgtagtagcgacgtcgttaggcgcggtcgggatcgtagagtttcgggagttcgttcggtgagtgtagcgggagagggtaggaagggtaagtttaggggcggagttagcgggagaggcggggttagaggtagggttagagtagcggggcgggattagagggcggaattagagggagaggcggggattggaggcgggggtagaggaggagttagcgttagggggcggagcgatttttaagaggcggagttagagggagaggtataagcgggaggcgaggttagagcgcggagtaggagttggagatcgcggcggggcgaggttagagagcgttgtgggcggggttagtgtgcggggcggggcgtttgattcggtttcgttttttgttcgtagaggaggagcggtagacgtagcgttttaaatcgtagtcggcggtgttttcgcggtcgagcgtcgattttattttgaatcgttgtagcgagagtattaagcggaagttggcgtttgtcgtttgaggttggagcgtagtttttagttagcgtttcggtttttgtcgtttcgtgtttgtatatacgtgttttatagagtttggcgtttggacgtcga

SEQ ID NO: 4368 - DNA, 780 bp, Artificial Sequence
  chemically treated genomic DNA (Homo sapiens) CpG-island No: 4368
tcgacgtccaaacgccaaactctataaaacacgtatatacaaacacgaaacgacaaaaaccgaaacgctaactaaaaactacgctccaacctcaaacgacaaacgccaacttccgcttaatactctcgctacaacgattcaaaataaaatcgacgctcgaccgcgaaaacaccgccgactacgatttaaaacgctacgtctaccgctcctcctctacgaacaaaaaacgaaaccgaatcaaacgccccgccccgcacactaaccccgcccacaacgctctctaacctcgccccgccgcgatctccaactcctactccgcgctctaacctcgcctcccgcttatacctctccctctaactccgcctcttaaaaatcgctccgccccctaacgctaactcctcctctacccccgcctccaatccccgcctctccctctaattccgccctctaatcccgccccgctactctaaccctacctctaaccccgcctctcccgctaactccgcccctaaacttacccttcctaccctctcccgctacactcaccgaacgaactcccgaaactctacgatcccgaccgcgcctaacgacgtcgctactacaaaaaacgaacgctattacgacgataaacgtcctaactaaaacgcttccgcgaccgctaataaatactatacacgttacgaataaacgacctaacccaacgaaacgaaacgtcgtcaaaacccgaaacgcccctacccccaaaaactcaaataaacacccctaatccgaaaaaataaa

SEQ ID NO: 4369 - DNA, 715 bp, Artificial Sequence
  chemically treated genomic DNA (Homo sapiens) CpG-island No: 4369
tatttcgcgttcgggagtttttcggaataaatatttttaggtttcgggttacgggttggcgagatttcgcggggtggtcgtaggttaaagattatttatagcggtaagcggtcggtgttcggaggtagtaattatagatgggggttggagtttttttcgtttttcggtgtggttcgcgtagggattcggcggttttcggaggattttgtagggcggggttacgggtttagagtcgcgatttttttaatgtattttgttttggaaataacggagacggattttggttgtcgttttggagtttggaattcgagcgcggggcggggcgggatcgggtagggcgattcgcgtaggtaattagattttcggtggtggcggcgtaagtcgaggatggcggggtcggggtcggtcggattttcgaaacggttggcggagtcggtcgggcgcgggtatcggaaatcgtggagattttagaggggcgggggtaagggcgtttcgtttatttttgacgtcggtattagttattttattttacgttaattttttttttgtcggggtagtattcggcgtaaaggggaggggcgttatttgtttagtcgtttcgtttgttagtttacgagcgtatcgattcgggttttagatttattcgtttttgtattttcgaggggataatttagtttttttagttcgggttggtttttttttttatttttttttt

SEQ ID NO: 4370 - DNA, 715 bp, Artificial Sequence
  chemically treated genomic DNA (Homo sapiens) CpG-island No: 4370
aaaaaaaaaataaaaaaaaaaaccaacccgaactaaaaaaactaaattatcccctcgaaaatacaaaaacgaataaatctaaaacccgaatcgatacgctcgtaaactaacaaacgaaacgactaaacaaataacgcccctcccctttacgccgaatactaccccgacaaaaaaaaaattaacgtaaaataaaataactaataccgacgtcaaaaataaacgaaacgcccttacccccgcccctctaaaatctccacgatttccgatacccgcgcccgaccgactccgccaaccgtttcgaaaatccgaccgaccccgaccccgccatcctcgacttacgccgccaccaccgaaaatctaattacctacgcgaatcgccctacccgatcccgccccgccccgcgctcgaattccaaactccaaaacgacaaccaaaatccgtctccgttatttccaaaacaaaatacattaaaaaaatcgcgactctaaacccgtaaccccgccctacaaaatcctccgaaaaccgccgaatccctacgcgaaccacaccgaaaaacgaaaaaaactccaacccccatctataattactacctccgaacaccgaccgcttaccgctataaataatctttaacctacgaccaccccgcgaaatctcgccaacccgtaacccgaaacctaaaaatatttattccgaaaaactcccgaacgcgaaata

SEQ ID NO: 4371 - DNA, 715 bp, Artificial Sequence
  chemically treated genomic DNA (Homo sapiens) CpG-island No: 4371
aaaaggaaagtgaggagggggattaattcgggttagggggattgagttgttttttcgggggtgtaggagcgggtagatttggagttcgagtcggtacgttcgtgggttggtaggcggggcggttagataggtggcgttttttttttttgcgtcgggtgttgtttcggtaggagaagggttaacgtggggtggggtaattagtgtcgacgttaaaggtgagcgggacgtttttgttttcgtttttttgaggtttttacggttttcggtattcgcgttcggtcggtttcgttagtcgtttcgagagttcggtcggtttcggtttcgttattttcggtttgcgtcgttattatcggggatttggttatttgcgcgggtcgttttgttcggtttcgtttcgtttcgcgttcgggttttaaattttagggcggtaattaaagttcgttttcgttatttttagggtaaaatgtattaggaaaatcgcggttttgggttcgtgatttcgttttgtagagtttttcgagggtcgtcgggtttttgcgcgggttatatcggagagcggaggaaattttaatttttatttgtagttgttgttttcgggtatcgatcgtttatcgttataaataatttttggtttgcggttatttcgcggggtttcgttagttcgtggttcggagtttggaaatatttatttcgagaggttttcgagcgcggggtg

SEQ ID NO: 4372 - DNA, 715 bp, Artificial Sequence
  chemically treated genomic DNA (Homo sapiens) CpG-island No: 4372
caccccgcgctcgaaaacctctcgaaataaatatttccaaactccgaaccacgaactaacgaaaccccgcgaaataaccgcaaaccaaaaattatttataacgataaacgatcgatacccgaaaacaacaactacaaataaaaattaaaatttcctccgctctccgatataacccgcgcaaaaacccgacgaccctcgaaaaactctacaaaacgaaatcacgaacccaaaaccgcgattttcctaatacattttaccctaaaaataacgaaaacgaactttaattaccgccctaaaatttaaaacccgaacgcgaaacgaaacgaaaccgaacaaaacgacccgcgcaaataaccaaatccccgataataacgacgcaaaccgaaaataacgaaaccgaaaccgaccgaactctcgaaacgactaacgaaaccgaccgaacgcgaataccgaaaaccgtaaaaacctcaaaaaaacgaaaacaaaaacgtcccgctcacctttaacgtcgacactaattaccccaccccacgttaacccttctcctaccgaaacaacacccgacgcaaaaaaaaaaaacgccacctatctaaccgccccgcctaccaacccacgaacgtaccgactcgaactccaaatctacccgctcctacacccccgaaaaaacaactcaatccccctaacccgaattaatccccctcctcactttcctttt

SEQ ID NO: 4373 - DNA, 541 bp, Artificial Sequence
  chemically treated genomic DNA (Homo sapiens) CpG-island No: 4373
  misc_feature (4)..(4): n is either a, c, g or t
  misc_feature (16)..(16): n is either a, c, g or t
  misc_feature (20)..(20): n is either a, c, g or t
  misc_feature (70)..(70): n is either a, c, g or t
  misc_feature (150)..(150): n is either a, c, g or t
  misc_feature (156)..(156): n is either a, c, g or t
  misc_feature (163)..(163): n is either a, c, g or t
  misc_feature (171)..(171): n is either a, c, g or t
  misc_feature (178)..(178): n is either a, c, g or t
  misc_feature (183)..(183): n is either a, c, g or t
  misc_feature (194)..(194): n is either a, c, g or t
  misc_feature (212)..(212): n is either a, c, g or t
  misc_feature (220)..(220): n is either a, c, g or t
  misc_feature (257)..(257): n is either a, c, g or t
  misc_feature (313)..(313): n is either a, c, g or t
  misc_feature (424)..(424): n is either a, c, g or t
atantcgtatttggtngcgnagttcgcgtaggttgtcgatgaggttttggagttgttcgtattgttgtangcgttcggttggtcgtcgtttttgcgttttttatcgcggtcgtcgtattattttcgttatcgttttttttttttttttantatcgncggtcgngcggagtntcgtagncggtntaaggcggggnagttcggggcgtcggcgncgtaggtnaagggattttcgattcgggagagttggattaggaggnttttttagcgttgttcgagttaggacgtcggtagagttggtagtcgagtgtgtcgntttcgtttttagagtcgcggcgggtaaaaagttgcggcgtcgggggtaaaaaggcgcggcgtcgggggtaaagagttgtggcggcgggggtaaagagtcgcgacggtaaanatacgcggcggcgggggtaaaaagtcgcgggggtaaaagttataaaaagttacggcggtaggggtaaaaattcgcggcggcgggggtaaaaaatcgcgtcggtaaaaaatagcggcg

SEQ ID NO: 4374 - DNA, 541 bp, Artificial Sequence
  chemically treated genomic DNA (Homo sapiens) CpG-island No: 4374
  misc_feature (118)..(118): n is either a, c, g or t
  misc_feature (229)..(229): n is either a, c, g or t
  misc_feature (285)..(285): n is either a, c, g or t
  misc_feature (322)..(322): n is either a, c, g or t
  misc_feature (330)..(330): n is either a, c, g or t
  misc_feature (348)..(348): n is either a, c, g or t
  misc_feature (359)..(359): n is either a, c, g or t
  misc_feature (364)..(364): n is either a, c, g or t
  misc_feature (371)..(371): n is either a, c, g or t
  misc_feature (379)..(379): n is either a, c, g or t
  misc_feature (386)..(386): n is either a, c, g or t
  misc_feature (392)..(392): n is either a, c, g or t
  misc_feature (472)..(472): n is either a, c, g or t
  misc_feature (522)..(522): n is either a, c, g or t
  misc_feature (526)..(526): n is either a, c, g or t
  misc_feature (538)..(538): n is either a, c, g or t
cgccgctattttttaccgacgcgattttttacccccgccgccgcgaatttttacccctaccgccgtaactttttataacttttacccccgcgactttttacccccgccgccgcgtatntttaccgtcgcgactctttacccccgccgccacaactctttacccccgacgccgcgcctttttacccccgacgccgcaactttttacccgccgcgactctaaaaacgaaancgacacactcgactaccaactctaccgacgtcctaactcgaacaacgctaaaaaancctcctaatccaactctcccgaatcgaaaatcccttnacctacgncgccgacgccccgaactnccccgccttanaccgnctacganactccgcncgaccgncgatantaaaaaaaaaaaaaaaacgataacgaaaataatacgacgaccgcgataaaaaacgcaaaaacgacgaccaaccgaacgcntacaacaatacgaacaactccaaaacctcatcgacaacctacgcgaactncgcnaccaaatacgantat

SEQ ID NO: 4375 - DNA, 541 bp, Artificial Sequence
  chemically treated genomic DNA (Homo sapiens) CpG-island No: 4375
  misc_feature (118)..(118): n is either a, c, g or t
  misc_feature (229)..(229): n is either a, c, g or t
  misc_feature (285)..(285): n is either a, c, g or t
  misc_feature (322)..(322): n is either a, c, g or t
  misc_feature (330)..(330): n is either a, c, g or t
  misc_feature (348)..(348): n is either a, c, g or t
  misc_feature (359)..(359): n is either a, c, g or t
  misc_feature (364)..(364): n is either a, c, g or t
  misc_feature (371)..(371): n is either a, c, g or t
  misc_feature (379)..(379): n is either a, c, g or t
  misc_feature (386)..(386): n is either a, c, g or t
  misc_feature (392)..(392): n is either a, c, g or t
  misc_feature (472)..(472): n is either a, c, g or t
  misc_feature (522)..(522): n is either a, c, g or t
  misc_feature (526)..(526): n is either a, c, g or t
  misc_feature (538)..(538): n is either a, c, g or t
cgtcgttgttttttgtcggcgcggttttttgttttcgtcgtcgcgggtttttgtttttgtcgtcgtggttttttgtggtttttgttttcgcggttttttgttttcgtcgtcgcgtgtntttgtcgtcgcggttttttgttttcgtcgttatagttttttgttttcgacgtcgcgtttttttgttttcgacgtcgtagttttttgttcgtcgcggttttgagggcgggancggtatattcggttgttagttttatcggcgttttggttcgggtagcgttgaggggnttttttggtttagttttttcggatcgggggttttttngtttacgncgtcggcgtttcgggttntttcgttttgngtcgnttgcggngtttcgtncggtcgncgatgntgagagaagaaggagggcggtggcgggggtgatgcggcggtcgcggtgggaggcgtaggggcggcggttagtcgggcgtntgtagtagtgcgggtagttttagaattttatcggtagtttgcgcgggttncgtnattaagtgcggntgt

SEQ ID NO: 4376 - DNA, 541 bp, Artificial Sequence
  chemically treated genomic DNA (Homo sapiens) CpG-island No: 4376
  misc_feature (4)..(4): n is either a, c, g or t
  misc_feature (16)..(16): n is either a, c, g or t
  misc_feature (20)..(20): n is either a, c, g or t
  misc_feature (70)..(70): n is either a, c, g or t
  misc_feature (150)..(150): n is either a, c, g or t
  misc_feature (156)..(156): n is either a, c, g or t
  misc_feature (163)..(163): n is either a, c, g or t
  misc_feature (171)..(171): n is either a, c, g or t
  misc_feature (178)..(178): n is either a, c, g or t
  misc_feature (183)..(183): n is either a, c, g or t
  misc_feature (194)..(194): n is either a, c, g or t
  misc_feature (212)..(212): n is either a, c, g or t
  misc_feature (220)..(220): n is either a, c, g or t
  misc_feature (257)..(257): n is either a, c, g or t
  misc_feature (313)..(313): n is either a, c, g or t
  misc_feature (424)..(424): n is either a, c, g or t
acanccgcacttaatnacgnaacccgcgcaaactaccgataaaattctaaaactacccgcactactacanacgcccgactaaccgccgcccctacgcctcccaccgcgaccgccgcatcacccccgccaccgccctccttcttctctcancatcgncgaccgnacgaaacnccgcaancgacncaaaacgaaanaacccgaaacgccgacgncgtaaacnaaaaaacccccgatccgaaaaaactaaaccaaaaaancccctcaacgctacccgaaccaaaacgccgataaaactaacaaccgaatataccgntcccgccctcaaaaccgcgacgaacaaaaaactacgacgtcgaaaacaaaaaaacgcgacgtcgaaaacaaaaaactataacgacgaaaacaaaaaaccgcgacgacaaanacacgcgacgacgaaaacaaaaaaccgcgaaaacaaaaaccacaaaaaaccacgacgacaaaaacaaaaacccgcgacgacgaaaacaaaaaaccgcgccgacaaaaaacaacgacg

SEQ ID NO: 4377 - DNA, 1259 bp, Artificial Sequence
  chemically treated genomic DNA (Homo sapiens) CpG-island No: 4377
ggcgggcgaatcggtttttcgtggtattggtaaagttgggaacgttttttttaggtttcgttttttcgcgttcgtgtcgggaattcgaatttaggtaagcgttcgggttacgcgtcggggttgtttcgttgtttttagttttttagagttggcgtttgggaggaagagcgcgtgtattacgttttttttttcgtttcgttttcgcgtattgcgacgcgttgtcgcgtttcgttttttttcggttttcggagggtgacggggtgaaggcgggggaatcgaggtggggagttcgttagagtttttagattgcgagtacgcgagtcgtcgtagtcgttattcgcgtcgcgttacggttttcgggttcgtttttttttgatttttttttttttttcgtttttttttttttttttttttcgtcgatcgagtagtgatttaagtaacggagcgcggtgaagtttattttttttttttttcgtagtcgcgttagggagttcgcgcggcggtttttgtttttcggttcgagatgaattttgcggtagaagtcgagtttaatatttttttggttatcgatttttataaggtaaagttcggggttcgggtagatgaggaggagcggggcgcgttggggacgagcgcgcggtaggggggcgggggcggttggggttggggttggggttggggttggggttagggtcgcggcgcggggaggttcgggggaggcgcgggcggcggcggttggggtaggtgaggaggcgtcgtagtgggtaggaggtggtttgaggaggatggagggttgggcggtggaggcggggtttgggggcgtacggcggcggcggcgcggcggggggttgaggcgggttttagcggattttcgggcgtcggtgttcggggttcggggttcggggtttgggcgtcgtcggcgagcgtatgtttttttttgaagcgcggttttttggtttggagttgggattagttaggtaacggtttcggggattcgtagtggagagtgagcggggatatttaagtcgggttagttcggcgcgttcgtttttggttgggtaggtaagtttttcggggcgcgaggtgggagaagttttgcgcgggcgtcggagtagtcgcggttttttgcggtttcggcgcggaggatattcgtttggtttcggtagtcgtagtggatttttttgttttatttcgtcgggtttcgttttaaattttttggtatttagtgattgttcgtgttttttatttttgggtgtaga

SEQ ID NO: 4378 - DNA, 1259 bp, Artificial Sequence
  chemically treated genomic DNA (Homo sapiens) CpG-island No: 4378
tctacacccaaaaataaaaaacacgaacaatcactaaataccaaaaaatttaaaacgaaacccgacgaaataaaacaaaaaaatccactacgactaccgaaaccaaacgaatatcctccgcgccgaaaccgcaaaaaaccgcgactactccgacgcccgcgcaaaacttctcccacctcgcgccccgaaaaacttacctacccaaccaaaaacgaacgcgccgaactaacccgacttaaatatccccgctcactctccactacgaatccccgaaaccgttacctaactaatcccaactccaaaccaaaaaaccgcgcttcaaaaaaaaacatacgctcgccgacgacgcccaaaccccgaaccccgaaccccgaacaccgacgcccgaaaatccgctaaaacccgcctcaaccccccgccgcgccgccgccgccgtacgcccccaaaccccgcctccaccgcccaaccctccatcctcctcaaaccacctcctacccactacgacgcctcctcacctaccccaaccgccgccgcccgcgcctcccccgaacctccccgcgccgcgaccctaaccccaaccccaaccccaaccccaaccccaaccgcccccgcccccctaccgcgcgctcgtccccaacgcgccccgctcctcctcatctacccgaaccccgaactttaccttataaaaatcgataaccaaaaaaatattaaactcgacttctaccgcaaaattcatctcgaaccgaaaaacaaaaaccgccgcgcgaactccctaacgcgactacgaaaaaaaaaaaaaataaacttcaccgcgctccgttacttaaatcactactcgatcgacgaaaaaaaaaaaaaaaaaaaaacgaaaaaaaaaaaaaaatcaaaaaaaaacgaacccgaaaaccgtaacgcgacgcgaataacgactacgacgactcgcgtactcgcaatctaaaaactctaacgaactccccacctcgattcccccgccttcaccccgtcaccctccgaaaaccgaaaaaaaacgaaacgcgacaacgcgtcgcaatacgcgaaaacgaaacgaaaaaaaaaacgtaatacacgcgctcttcctcccaaacgccaactctaaaaaactaaaaacaacgaaacaaccccgacgcgtaacccgaacgcttacctaaattcgaattcccgacacgaacgcgaaaaaacgaaacctaaaaaaaacgttcccaactttaccaataccacgaaaaaccgattcgcccgcc

SEQ ID NO: 4379 - DNA, 1259 bp, Artificial Sequence
  chemically treated genomic DNA (Homo sapiens) CpG-island No: 4379
tttatatttagggataaggagtacgagtaattattaggtgttaaggagtttgaaacggagttcggcggagtgggataggggaatttattacggttatcggggttaggcgagtgtttttcgcgtcggagtcgtagaggatcgcggttgtttcggcgttcgcgtaggattttttttatttcgcgtttcgggagatttatttgtttagttaggggcgagcgcgtcgggttggttcggtttgaatattttcgtttattttttattgcgggttttcggggtcgttatttaattggttttagttttaggttaagaggtcgcgttttagggaagggtatgcgttcgtcggcgacgtttaagtttcgagtttcgagtttcgagtatcggcgttcgggagttcgttggggttcgttttagtttttcgtcgcgtcgtcgtcgtcgtgcgtttttaggtttcgtttttatcgtttagttttttattttttttaagttattttttgtttattgcggcgtttttttatttgttttagtcgtcgtcgttcgcgtttttttcgggttttttcgcgtcgcgattttagttttagttttagttttaattttagttttagtcgttttcgtttttttgtcgcgcgttcgtttttagcgcgtttcgtttttttttatttgttcgggtttcgagttttattttgtaggagtcggtggttaggaggatgttgaattcggtttttgtcgtaggatttatttcgggtcggaggataggggtcgtcgcgcgagttttttggcgcggttgcgaggaaggagaaaaatgagttttatcgcgtttcgttgtttaagttattgttcggtcggcggaggagggggagagggggaaacggagagaggggaggggttagaggagggcgggttcgggagtcgtgacgcggcgcgggtgacggttgcggcggttcgcgtgttcgtagtttgggagttttggcggattttttatttcggttttttcgtttttatttcgttatttttcgggggtcgagaaagggcggggcgcggtagcgcgtcgtagtgcgcggaggcggggcggggaggaggacgtgatgtacgcgtttttttttttagacgttagttttgggaagttggaggtagcggggtagtttcggcgcgtgattcgggcgtttatttaagttcgagttttcggtacgggcgcgggagggcggggtttggagggggcgtttttagttttgttagtgttacgaggagtcggttcgttcgtt

SEQ ID NO: 4380 - DNA, 1259 bp, Artificial Sequence
  chemically treated genomic DNA (Homo sapiens) CpG-island No: 4380
aacgaacgaaccgactcctcgtaacactaacaaaactaaaaacgccccctccaaaccccgccctcccgcgcccgtaccgaaaactcgaacttaaataaacgcccgaatcacgcgccgaaactaccccgctacctccaacttcccaaaactaacgtctaaaaaaaaaaacgcgtacatcacgtcctcctccccgccccgcctccgcgcactacgacgcgctaccgcgccccgccctttctcgacccccgaaaaataacgaaataaaaacgaaaaaaccgaaataaaaaatccgccaaaactcccaaactacgaacacgcgaaccgccgcaaccgtcacccgcgccgcgtcacgactcccgaacccgccctcctctaacccctcccctctctccgtttccccctctccccctcctccgccgaccgaacaataacttaaacaacgaaacgcgataaaactcatttttctccttcctcgcaaccgcgccaaaaaactcgcgcgacgacccctatcctccgacccgaaataaatcctacgacaaaaaccgaattcaacatcctcctaaccaccgactcctacaaaataaaactcgaaacccgaacaaataaaaaaaaacgaaacgcgctaaaaacgaacgcgcgacaaaaaaacgaaaacgactaaaactaaaattaaaactaaaactaaaactaaaatcgcgacgcgaaaaaacccgaaaaaaacgcgaacgacgacgactaaaacaaataaaaaaacgccgcaataaacaaaaaataacttaaaaaaaataaaaaactaaacgataaaaacgaaacctaaaaacgcacgacgacgacgacgcgacgaaaaactaaaacgaaccccaacgaactcccgaacgccgatactcgaaactcgaaactcgaaacttaaacgtcgccgacgaacgcatacccttccctaaaacgcgacctcttaacctaaaactaaaaccaattaaataacgaccccgaaaacccgcaataaaaaataaacgaaaatattcaaaccgaaccaacccgacgcgctcgcccctaactaaacaaataaatctcccgaaacgcgaaataaaaaaaatcctacgcgaacgccgaaacaaccgcgatcctctacgactccgacgcgaaaaacactcgcctaaccccgataaccgtaataaattcccctatcccactccgccgaactccgtttcaaactccttaacacctaataattactcgtactccttatccctaaatataaa

SEQ ID NO: 4381 - DNA, 1509 bp, Artificial Sequence
  chemically treated genomic DNA (Homo sapiens) CpG-island No: 4381
agaggcgtgtcgcgtgtgcgcgtgagtgtgcgcgtgtgagggtgagggtgtgagtatgtgtgtgtgtgtgttggggtgtatgcgtaggcgcgcgtgcgtattaagattcggggtgtaatttcgtaaagaaggtttaggagatcgggtatcgttagtatggatagagttttgtgtttaaataggtagtgtaaggattaattcgcgagggcggggagtggggttttttcgggaggggtaatgcgaggagtcgaggttgggtatcggaggggagcgggatttttatttcggacgggacgtttggatgtgggaagtttcggatttgggtttttgtcggagggttcgtgcgttttagattcggttggttcgacgcgggtgatatttatattatacggatgttttatgttaggtatcgcgtacgggtcgcgaggtcgggttttcgaaacggcgttttagtagcggagtaggagtggtttttagggggacgttatatttttcgtttcgattcggtttttcggatttttcgggcgttttgttcgttcgtatcgggttttattcggtagcggagttcgtatcgttcgtttcggggttttttcggcggagtatacggggcgcggggcgcgggttacggttttttattttgcgtttatcgtcgtttatcgcgcgggagttcgggcgtagggacgtatcgtcgcgtttatattttcgtcggtttcggcggttttttttttaggtatttataaaattgtcgtcgtagtcgttgttcggatatagtatatagaaggagacgtcggggtcggcgtagaaatttattttgcgttcggttttttcggtggcgatgagttcgaagggcgtgttggagtattattttttcgtaacgtcggttagttgttggaaatttatcgcggtttcgcgttcgtttttcgtcgtcgttcgttttttcgtttttaggcgtttttttttcgggcgggtagcgcggcgttcggttcggtttgcgcgggttttttcggggtcgggttgggtcggttgggattgtttatatgcggtgcggagtggggcgggcggcggtcggggaaatagcgcgagcgcgttcgcggtttttttttcgtttcgttttttttcgtttttttgcgggtcgtcgtgggggttggcgcggtcgggtcgggacgcggggcggcgggaggagcggtcggtattttcgcgggcgttcggatttttttgggcgttttcgttttttttttatttttaaataaattcggagtatttcgggttttggttatcgcggtgtcgtttcgggtcgtgacgttatgggttttagttaattatcggagtttgagatcgcgtcggtttgcgagttcggtgacgttatagcgcgagtttggaattcgtagtttcgcgggttatttggaagcggtgcgagcgtttaatatttggttagcgtttttgtggagttagaaagtttaggaagcgtttgtttaaatgcgatttaaatgtaagggaggttatagaatt

SEQ ID NO: 4382 - DNA, 1509 bp, Artificial Sequence
  chemically treated genomic DNA (Homo sapiens) CpG-island No: 4382
aattctataacctcccttacatttaaatcgcatttaaacaaacgcttcctaaactttctaactccacaaaaacgctaaccaaatattaaacgctcgcaccgcttccaaataacccgcgaaactacgaattccaaactcgcgctataacgtcaccgaactcgcaaaccgacgcgatctcaaactccgataattaactaaaacccataacgtcacgacccgaaacgacaccgcgataaccaaaacccgaaatactccgaatttatttaaaaataaaaaaaaaacgaaaacgcccaaaaaaatccgaacgcccgcgaaaataccgaccgctcctcccgccgccccgcgtcccgacccgaccgcgccaacccccacgacgacccgcaaaaaaacgaaaaaaaacgaaacgaaaaaaaaaccgcgaacgcgctcgcgctatttccccgaccgccgcccgccccactccgcaccgcatataaacaatcccaaccgacccaacccgaccccgaaaaaacccgcgcaaaccgaaccgaacgccgcgctacccgcccgaaaaaaaaacgcctaaaaacgaaaaaacgaacgacgacgaaaaacgaacgcgaaaccgcgataaatttccaacaactaaccgacgttacgaaaaaataatactccaacacgcccttcgaactcatcgccaccgaaaaaaccgaacgcaaaataaatttctacgccgaccccgacgtctccttctatatactatatccgaacaacgactacgacgacaattttataaatacctaaaaaaaaaaccgccgaaaccgacgaaaatataaacgcgacgatacgtccctacgcccgaactcccgcgcgataaacgacgataaacgcaaaataaaaaaccgtaacccgcgccccgcgccccgtatactccgccgaaaaaaccccgaaacgaacgatacgaactccgctaccgaataaaacccgatacgaacgaacaaaacgcccgaaaaatccgaaaaaccgaatcgaaacgaaaaatataacgtccccctaaaaaccactcctactccgctactaaaacgccgtttcgaaaacccgacctcgcgacccgtacgcgatacctaacataaaacatccgtataatataaatatcacccgcgtcgaaccaaccgaatctaaaacgcacgaaccctccgacaaaaacccaaatccgaaacttcccacatccaaacgtcccgtccgaaataaaaatcccgctcccctccgatacccaacctcgactcctcgcattacccctcccgaaaaaaccccactccccgccctcgcgaattaatccttacactacctatttaaacacaaaactctatccatactaacgatacccgatctcctaaaccttctttacgaaattacaccccgaatcttaatacgcacgcgcgcctacgcatacaccccaacacacacacacacatactcacaccctcaccctcacacgcgcacactcacgcgcacacgcgacacgcctct

SEQ ID NO: 4383 - DNA, 1509 bp, Artificial Sequence
  chemically treated genomic DNA (Homo sapiens) CpG-island No: 4383
agttttatggttttttttgtatttaaatcgtatttgggtaaacgttttttgggttttttaattttatagaaacgttaattaggtattgggcgttcgtatcgtttttaggtaattcgcggagttgcggattttaggttcgcgttgtgacgttatcgggttcgtaagtcggcgcggttttaggtttcggtgattggttggggtttatgacgttacggttcggggcggtatcgcgatggttagggttcgggatgtttcgggtttgtttaaaaataaagggggggcgggagcgtttaggaaaattcgggcgttcgcgggggtgtcggtcgtttttttcgtcgtttcgcgtttcggttcggtcgcgttaatttttacggcggttcgtaagggggcggggggaggcggggcggaggaggagtcgcgggcgcgttcgcgttgttttttcggtcgtcgttcgttttatttcgtatcgtatgtaaatagttttagtcggtttagttcggtttcggaggagttcgcgtaggtcgagtcgagcgtcgcgttgttcgttcgggaggagggcgtttaggagcgggagggcgggcggcggcgggaggcgggcgcggggtcgcgatggatttttagtagttggtcgacgttgcggagaaatggtgttttaatacgtttttcgagtttatcgttatcgaggagatcgaacgtaggatggatttttacgtcgatttcggcgtttttttttatgtgttgtgttcggataacggttgcggcgataattttgtgagtgtttggaggagggatcgtcggagtcggcgggagtgtggacgcggcggtgcgtttttgcgttcgagttttcgcgcggtgggcggcggtgggcgtagagtggggggtcgtaattcgcgtttcgcgtttcgtgtgtttcgtcggggaagtttcggggcgggcggtgcgggtttcgttgtcgggtggggttcggtgcgggcgggtaaggcgttcggaggattcgaggagtcgggtcggggcgggaggtgtggcgtttttttaaaggttatttttatttcgttgttggggcgtcgtttcgggaattcgatttcgcggttcgtgcgcggtgtttggtatggagtattcgtgtggtgtgggtgttattcgcgtcggattagtcgggtttggggcgtacggatttttcggtaggagtttaggttcggagttttttatatttaggcgtttcgttcgggataggaatttcgttttttttcggtgtttagtttcggtttttcgtattgtttttttcgggagaattttatttttcgttttcgcgggttagtttttgtattgtttgtttggatataaagttttgtttatattagcgatgttcgattttttggattttttttgcggaattatatttcggattttaatacgtacgcgcgtttgcgtatatattttaatatatatatatatatgtttatatttttatttttatacgcgtatatttacgcgtatacgcggtacgttttt

SEQ ID NO: 4384 - DNA, 1509 bp, Artificial Sequence
  chemically treated genomic DNA (Homo sapiens) CpG-island No: 4384
aaaaacgtaccgcgtatacgcgtaaatatacgcgtataaaaataaaaatataaacatatatatatatatattaaaatatatacgcaaacgcgcgtacgtattaaaatccgaaatataattccgcaaaaaaaatccaaaaaatcgaacatcgctaatataaacaaaactttatatccaaacaaacaatacaaaaactaacccgcgaaaacgaaaaataaaattctcccgaaaaaaacaatacgaaaaaccgaaactaaacaccgaaaaaaaacgaaattcctatcccgaacgaaacgcctaaatataaaaaactccgaacctaaactcctaccgaaaaatccgtacgccccaaacccgactaatccgacgcgaataacacccacaccacacgaatactccataccaaacaccgcgcacgaaccgcgaaatcgaattcccgaaacgacgccccaacaacgaaataaaaataacctttaaaaaaacgccacacctcccgccccgacccgactcctcgaatcctccgaacgccttacccgcccgcaccgaaccccacccgacaacgaaacccgcaccgcccgccccgaaacttccccgacgaaacacacgaaacgcgaaacgcgaattacgaccccccactctacgcccaccgccgcccaccgcgcgaaaactcgaacgcaaaaacgcaccgccgcgtccacactcccgccgactccgacgatccctcctccaaacactcacaaaattatcgccgcaaccgttatccgaacacaacacataaaaaaaaacgccgaaatcgacgtaaaaatccatcctacgttcgatctcctcgataacgataaactcgaaaaacgtattaaaacaccatttctccgcaacgtcgaccaactactaaaaatccatcgcgaccccgcgcccgcctcccgccgccgcccgccctcccgctcctaaacgccctcctcccgaacgaacaacgcgacgctcgactcgacctacgcgaactcctccgaaaccgaactaaaccgactaaaactatttacatacgatacgaaataaaacgaacgacgaccgaaaaaacaacgcgaacgcgcccgcgactcctcctccgccccgcctccccccgcccccttacgaaccgccgtaaaaattaacgcgaccgaaccgaaacgcgaaacgacgaaaaaaacgaccgacacccccgcgaacgcccgaattttcctaaacgctcccgccccccctttatttttaaacaaacccgaaacatcccgaaccctaaccatcgcgataccgccccgaaccgtaacgtcataaaccccaaccaatcaccgaaacctaaaaccgcgccgacttacgaacccgataacgtcacaacgcgaacctaaaatccgcaactccgcgaattacctaaaaacgatacgaacgcccaatacctaattaacgtttctataaaattaaaaaacccaaaaaacgtttacccaaatacgatttaaatacaaaaaaaaccataaaact

SEQ ID NO: 4385 - DNA, 657 bp, Artificial Sequence
  chemically treated genomic DNA (Homo sapiens) CpG-island No: 4385
tcgggcgaggtttagatcgagggaaagcggagtttttggtattgcgaaaggttggcgttggggatttggggagtttcggtttcgcggagaggaggtcgggaagagttgggtaatcggtcgtagtttagatggaggagtttgtaggaagaaggtgttgggaaggcgcgttcggttgagaggaatggtcgggaaagacgagaggaggacgagggtcgagggagaaagagaaggacgtgaaaggttaggtcgcgggaaggcggcgtcgagagtcggttgggtttaggcgtcgcgaggaagtgggaatcgagagagtgaagtatagcgcgtagcgtcgcgtacgttatttttttgttttcgcgtcgttttttttgggtaattcgtgcgggtttcgattgtcggggacgggaaacgcggttaggtaggaggcgaggaagtatttcggtcgttttgtagagtcggggtttttttttttcgcggttgtcgacgttgttttttttacgttttgttttcgcggagcgcgtaagacgttttttttcgtatttgttttgagggttacgggacggagtttaggtttttagtatttcgtattttatttttgttttcgttatagtagtcgtttcgaatgggtttagaattaggggattggttcgagaggcg

SEQ ID NO: 4386 - DNA, 657 bp, Artificial Sequence
  chemically treated genomic DNA (Homo sapiens) CpG-island No: 4386
cgcctctcgaaccaatcccctaattctaaacccattcgaaacgactactataacgaaaacaaaaataaaatacgaaatactaaaaacctaaactccgtcccgtaaccctcaaaacaaatacgaaaaaaaacgtcttacgcgctccgcgaaaacaaaacgtaaaaaaaacaacgtcgacaaccgcgaaaaaaaaaaaccccgactctacaaaacgaccgaaatacttcctcgcctcctacctaaccgcgtttcccgtccccgacaatcgaaacccgcacgaattacccaaaaaaaacgacgcgaaaacaaaaaaataacgtacgcgacgctacgcgctatacttcactctctcgattcccacttcctcgcgacgcctaaacccaaccgactctcgacgccgccttcccgcgacctaacctttcacgtccttctctttctccctcgaccctcgtcctcctctcgtctttcccgaccattcctctcaaccgaacgcgccttcccaacaccttcttcctacaaactcctccatctaaactacgaccgattacccaactcttcccgacctcctctccgcgaaaccgaaactccccaaatccccaacgccaacctttcgcaataccaaaaactccgctttccctcgatctaaacctcgcccga

SEQ ID NO: 4387 - DNA, 657 bp, Artificial Sequence
  chemically treated genomic DNA (Homo sapiens) CpG-island No: 4387
cgtttttcgggttagttttttagttttaggtttattcggaacggttattgtggcgggggtagaaatggagtgcgggatgttgagagtttggatttcgtttcgtgatttttaaggtaagtgcggagaaaagcgttttgcgcgtttcgcggggataggacgtggagggagtagcgtcggtaatcgcgggaggaaaaggtttcggttttgtagggcggtcggggtgttttttcgttttttgtttagtcgcgtttttcgttttcggtaatcgggattcgtacggattgtttaggggagacggcgcgggagtaggagggtggcgtgcgcggcgttacgcgttgtgttttattttttcggtttttattttttcgcggcgtttgggtttagtcggttttcggcgtcgttttttcgcggtttggttttttacgtttttttttttttttttcggttttcgtttttttttcgtttttttcggttattttttttagtcgaacgcgtttttttagtattttttttttgtaagtttttttatttggattgcgatcgattatttagtttttttcggtttttttttcgcgaggtcgaggttttttaggtttttagcgttagtttttcgtaatgttaagggtttcgttttttttcgatttgggtttcgttcgg

SEQ ID NO: 4388 - DNA, 657 bp, Artificial Sequence
  chemically treated genomic DNA (Homo sapiens) CpG-island No: 4388
ccgaacgaaacccaaatcgaaaaaaaacgaaacccttaacattacgaaaaactaacgctaaaaacctaaaaaacctcgacctcgcgaaaaaaaaaccgaaaaaaactaaataatcgatcgcaatccaaataaaaaaacttacaaaaaaaaaatactaaaaaaacgcgttcgactaaaaaaaataaccgaaaaaaacgaaaaaaaaacgaaaaccgaaaaaaaaaaaaaaaaacgtaaaaaaccaaaccgcgaaaaaacgacgccgaaaaccgactaaacccaaacgccgcgaaaaaataaaaaccgaaaaaataaaacacaacgcgtaacgccgcgcacgccaccctcctactcccgcgccgtctcccctaaacaatccgtacgaatcccgattaccgaaaacgaaaaacgcgactaaacaaaaaacgaaaaaacaccccgaccgccctacaaaaccgaaaccttttcctcccgcgattaccgacgctactccctccacgtcctatccccgcgaaacgcgcaaaacgcttttctccgcacttaccttaaaaatcacgaaacgaaatccaaactctcaacatcccgcactccatttctacccccgccacaataaccgttccgaataaacctaaaactaaaaaactaacccgaaaaacg

SEQ ID NO: 4389 - DNA, 690 bp, Artificial Sequence
  chemically treated genomic DNA (Homo sapiens) CpG-island No: 4389
tgcggcgatcggtcgtttcgagcgtagcgttagatatttgggttggggggtgttagtttgacgcgtaggaagggcgtacggcgggagggggttttattttagatttgggaggtttgttggcgtcggtttcgttcgtttttcgtcggtggaggtcgcggttggcggagatcgtaagttagaggaggggattcgaggtttcggttgggcgaaggttttggagggggagaagacggtcgaggcgtggaggggtagtcgcggcggggcgatttttatttgtttattgcggggtttgttcgtggggtcggggtagatttcgtaaaggacgcgtatttgtaagttcgcggttcgcgcgcgcgggatggggagcgtgtgttcgaggagcgcgcgtcgagtcgggttttcgcgtttgtgtggtcggttggcggcggggttcgtgtgtttttgcgcggcggcgtgtgcgtgtgcgtacgcgggattacgttcgttcggagtcgtcgtcgtcgtcgttattttttgttcggggtcgagcgtagcgttttttttgttcgtttcgcgcgcgcggtagtttagtttggtttcgttttgcgggagaggcgtcgttttcgtcgcgaagttaggttgggcgttggagggaggcgatcgattatcgtttttttttgtttattttataggttggggagggggtgttgt

SEQ ID NO: 4390 - DNA, 690 bp, Artificial Sequence
  chemically treated genomic DNA (Homo sapiens) CpG-island No: 4390
acaacaccccctccccaacctataaaataaacaaaaaaaaacgataatcgatcgcctccctccaacgcccaacctaacttcgcgacgaaaacgacgcctctcccgcaaaacgaaaccaaactaaactaccgcgcgcgcgaaacgaacaaaaaaaacgctacgctcgaccccgaacaaaaaataacgacgacgacgacgactccgaacgaacgtaatcccgcgtacgcacacgcacacgccgccgcgcaaaaacacacgaaccccgccgccaaccgaccacacaaacgcgaaaacccgactcgacgcgcgctcctcgaacacacgctccccatcccgcgcgcgcgaaccgcgaacttacaaatacgcgtcctttacgaaatctaccccgaccccacgaacaaaccccgcaataaacaaataaaaatcgccccgccgcgactacccctccacgcctcgaccgtcttctccccctccaaaaccttcgcccaaccgaaacctcgaatcccctcctctaacttacgatctccgccaaccgcgacctccaccgacgaaaaacgaacgaaaccgacgccaacaaacctcccaaatctaaaataaaaccccctcccgccgtacgcccttcctacgcgtcaaactaacaccccccaacccaaatatctaacgctacgctcgaaacgaccgatcgccgca

SEQ ID NO: 4391 - DNA, 690 bp, Artificial Sequence
  chemically treated genomic DNA (Homo sapiens) CpG-island No: 4391
gtagtattttttttttagtttgtgaagtgagtagggggaggcggtggtcggtcgtttttttttagcgtttagtttggtttcgcggcggaggcggcgtttttttcgtaggacggagttaagttggattgtcgcgcgcgcggggcgggtaaagggggcgttgcgttcggtttcgggtagggagtgacggcggcggcggcggtttcgggcgagcgtggtttcgcgtgcgtatacgtatacgtcgtcgcgtagggatatacggatttcgtcgttagtcggttatataggcgcggagattcggttcggcgcgcgtttttcgggtatacgttttttatttcgcgcgcgcgggtcgcggatttgtaggtgcgcgttttttgcggagtttgtttcggttttacggataggtttcgtagtgagtaggtaagggtcgtttcgtcgcggttgtttttttacgtttcggtcgttttttttttttttagaattttcgtttagtcgggatttcggatttttttttttggtttgcggttttcgttagtcgcgatttttatcgacggagagcgggcgaggtcggcgttagtaagttttttagatttgaaatgaagttttttttcgtcgtgcgttttttttgcgcgttaggttgatattttttaatttaagtgtttggcgttgcgttcggggcggtcgatcgtcgta

SEQ ID NO: 4392 - DNA, 690 bp, Artificial Sequence
  chemically treated genomic DNA (Homo sapiens) CpG-island No: 4392
tacgacgatcgaccgccccgaacgcaacgccaaacacttaaattaaaaaatatcaacctaacgcgcaaaaaaaacgcacgacgaaaaaaaacttcatttcaaatctaaaaaacttactaacgccgacctcgcccgctctccgtcgataaaaatcgcgactaacgaaaaccgcaaaccaaaaaaaaaaatccgaaatcccgactaaacgaaaattctaaaaaaaaaaaaaacgaccgaaacgtaaaaaaacaaccgcgacgaaacgacccttacctactcactacgaaacctatccgtaaaaccgaaacaaactccgcaaaaaacgcgcacctacaaatccgcgacccgcgcgcgcgaaataaaaaacgtatacccgaaaaacgcgcgccgaaccgaatctccgcgcctatataaccgactaacgacgaaatccgtatatccctacgcgacgacgtatacgtatacgcacgcgaaaccacgctcgcccgaaaccgccgccgccgccgtcactccctacccgaaaccgaacgcaacgccccctttacccgccccgcgcgcgcgacaatccaacttaactccgtcctacgaaaaaaacgccgcctccgccgcgaaaccaaactaaacgctaaaaaaaaacgaccgaccaccgcctccccctactcacttcacaaactaaaaaaaaaatactac

SEQ ID NO: 4393 - DNA, 559 bp, Artificial Sequence
  chemically treated genomic DNA (Homo sapiens) CpG-island No: 4393
tcggtcggttggggttcgtcgttaggcgcgttggttgggtagtttttgggagatgaagcgacgtaggcgttttaggtattggttgtagagttcgatgtcgttgtgttcggcgttttttatttatagcggttttatcgttttggggtagcgttcgtagagcgttagttcgtgtgagaagtcgattatttcgttttttatgtcgtggatgatgagtacgggcgacgtgattttggatattttttcgatgttagggaaggcgtcgaagtagtaggttttggtgtcggggaaggcgacgcgtatgttcgaggtgagcggcgagtgtagtattatcgcggtatattcgtagcgcgaggttaggtttacggtgggtatcgtgtcgatgttttgttcgtataggatgatgttgttcgggttgatgtcgtatttggcggcgtcggagtagggttagtcgcggttttcgacgcgggcgtattttttttattagcgggcgttttcgggtttagtttcggatgcgattttttagtttttttatttagttaagttagtgggttagatttag

SEQ ID NO: 4394 - DNA, 559 bp, Artificial Sequence
  chemically treated genomic DNA (Homo sapiens) CpG-island No: 4394
ctaaatctaacccactaacttaactaaataaaaaaactaaaaaatcgcatccgaaactaaacccgaaaacgcccgctaataaaaaaaatacgcccgcgtcgaaaaccgcgactaaccctactccgacgccgccaaatacgacatcaacccgaacaacatcatcctatacgaacaaaacatcgacacgatacccaccgtaaacctaacctcgcgctacgaatataccgcgataatactacactcgccgctcacctcgaacatacgcgtcgccttccccgacaccaaaacctactacttcgacgccttccctaacatcgaaaaaatatccaaaatcacgtcgcccgtactcatcatccacgacataaaaaacgaaataatcgacttctcacacgaactaacgctctacgaacgctaccccaaaacgataaaaccgctataaataaaaaacgccgaacacaacgacatcgaactctacaaccaatacctaaaacgcctacgtcgcttcatctcccaaaaactacccaaccaacgcgcctaacgacgaaccccaaccgaccga

SEQ ID NO: 4395 - DNA, 559 bp, Artificial Sequence
  chemically treated genomic DNA (Homo sapiens) CpG-island No: 4395
ttgggtttgatttattgatttagttgagtggggagattggagggtcgtattcggagttgggttcggggacgttcgttggtgggaagggtgcgttcgcgtcggaggtcgcggttgattttgtttcggcgtcgttaggtacggtattagttcggatagtattattttgtacgggtagagtatcggtacggtgtttatcgtggatttggtttcgcgttacgagtgtgtcgcggtggtgttgtattcgtcgtttatttcgggtatgcgcgtcgtttttttcgatattaagatttattgtttcgacgttttttttaatatcgagaaggtgtttaagattacgtcgttcgtgtttattatttacggtatggaggacgaggtgatcgattttttatacgggttggcgttttacgagcgttgttttaaggcggtggagtcgttgtgggtggagggcgtcgggtataacgatatcgagttttatagttagtatttggagcgtttgcgtcgttttattttttaggagttgtttagttagcgcgtttagcggcgggttttaatcggtcgg

SEQ ID NO: 4396 - DNA, 559 bp, Artificial Sequence
  chemically treated genomic DNA (Homo sapiens) CpG-island No: 4396
ccgaccgattaaaacccgccgctaaacgcgctaactaaacaactcctaaaaaataaaacgacgcaaacgctccaaatactaactataaaactcgatatcgttatacccgacgccctccacccacaacgactccaccgccttaaaacaacgctcgtaaaacgccaacccgtataaaaaatcgatcacctcgtcctccataccgtaaataataaacacgaacgacgtaatcttaaacaccttctcgatattaaaaaaaacgtcgaaacaataaatcttaatatcgaaaaaaacgacgcgcatacccgaaataaacgacgaatacaacaccaccgcgacacactcgtaacgcgaaaccaaatccacgataaacaccgtaccgatactctacccgtacaaaataatactatccgaactaataccgtacctaacgacgccgaaacaaaatcaaccgcgacctccgacgcgaacgcacccttcccaccaacgaacgtccccgaacccaactccgaatacgaccctccaatctccccactcaactaaatcaataaatcaaacccaa

SEQ ID NO: 4397 - DNA, 525 bp, Artificial Sequence
  chemically treated genomic DNA (Homo sapiens) CpG-island No: 4397
gatcgagtgagcgtttgcgcgggttcgggcggggtgggttggagcgggatatttttttttatttttttcgcggtatcgtttttttttttttttggaaatcgggtcggcgtcgcgggcgcggaggtagttggatgcggtttttttttttcgtaggagacgcggttgttcggcggttttcgcgcgttggttattaggtgagtagggcggtgggcgcggtcgcggttttttacgtgttcgttcgagtcgtcgtttatttgttcgtttttcgttttgtaggcgttgttgacgttgtcgtttttttttttggggttgtcgttgttttggacggtgttgttggatttcggcgtcgttttcgcgtggttttggagttttatttcggagacgacgttgcgtcgtttgcgttatacgttgttttcgttgttggagttgcgcgttaacgggttgttgttaatttaagtgtagcgtttcgcgtttggttttaggtggattttagggtatcggttttatttttggtgtatttttttt

SEQ ID NO: 4398 - DNA, 525 bp, Artificial Sequence
  chemically treated genomic DNA (Homo sapiens) CpG-island No: 4398
aaaaaaaatacaccaaaaataaaaccgataccctaaaatccacctaaaaccaaacgcgaaacgctacacttaaattaacaacaacccgttaacgcgcaactccaacaacgaaaacaacgtataacgcaaacgacgcaacgtcgtctccgaaataaaactccaaaaccacgcgaaaacgacgccgaaatccaacaacaccgtccaaaacaacgacaaccccaaaaaaaaaaacgacaacgtcaacaacgcctacaaaacgaaaaacgaacaaataaacgacgactcgaacgaacacgtaaaaaaccgcgaccgcgcccaccgccctactcacctaataaccaacgcgcgaaaaccgccgaacaaccgcgtctcctacgaaaaaaaaaaaccgcatccaactacctccgcgcccgcgacgccgacccgatttccaaaaaaaaaaaaaaacgataccgcgaaaaaaataaaaaaaaatatcccgctccaacccaccccgcccgaacccgcgcaaacgctcactcgatc

SEQ ID NO: 4399 - DNA, 525 bp, Artificial Sequence
  chemically treated genomic DNA (Homo sapiens) CpG-island No: 4399
gagaggagtgtattagaaataaagtcggtgttttggagtttatttggagttaggcgcggggcgttgtatttaggttggtagtagttcgttagcgcgtagttttagtagcggggatagcgtgtagcgtaggcggcgtagcgtcgttttcgaggtgaggttttagagttacgcggagacggcgtcggggtttaatagtatcgtttagagtagcgatagttttaggaagaggagcggtagcgttagtagcgtttgtagggcgaaaggcgggtaggtgggcggcggttcgggcgggtacgtgggggatcgcggtcgcgtttatcgttttgtttatttgatggttagcgcgcgaggatcgtcgaatagtcgcgttttttgcggggagagagggtcgtatttagttattttcgcgttcgcggcgtcggttcggtttttaggaggagggggaggcggtatcgcgggggggatggggaggggtgtttcgttttagtttatttcgttcggattcgcgtaggcgtttattcggtt

SEQ ID NO: 4400 - DNA, 525 bp, Artificial Sequence
  chemically treated genomic DNA (Homo sapiens) CpG-island No: 4400
aaccgaataaacgcctacgcgaatccgaacgaaataaactaaaacgaaacacccctccccatcccccccgcgataccgcctccccctcctcctaaaaaccgaaccgacgccgcgaacgcgaaaataactaaatacgaccctctctccccgcaaaaaacgcgactattcgacgatcctcgcgcgctaaccatcaaataaacaaaacgataaacgcgaccgcgatcccccacgtacccgcccgaaccgccgcccacctacccgcctttcgccctacaaacgctactaacgctaccgctcctcttcctaaaactatcgctactctaaacgatactattaaaccccgacgccgtctccgcgtaactctaaaacctcacctcgaaaacgacgctacgccgcctacgctacacgctatccccgctactaaaactacgcgctaacgaactactaccaacctaaatacaacgccccgcgcctaactccaaataaactccaaaacaccgactttatttctaatacactcctctc

SEQ ID NO: 4401 - DNA, 524 bp, Artificial Sequence
  chemically treated genomic DNA (Homo sapiens) CpG-island No: 4401
ttacgacgttgggaaagcggggtcgagaaggagggattcggggcgattcgatagcgttagatagggcggtcggcgtcgagggtcgttatttcggtgcggcggtatagcgtggttttttcgaaggcgtcgcggtttaggacgcggatggggatgtagtgtagttttttttgtttcgtcgcgtcgtcgtcggttcgcggtttttgattggcgttaggtttcggattcgagttttcgtaattttcggattcgtttttaaagttcgagttgatggaatcgtagtgtcgttcgtattcgtttagtatcgatatggcggcggtcgcgggttttggggattagtttgcgtatgttcggaggttttggtcgcgttgcgtttcgttcgttttagatgtcggttcgcggattcgttagtttagtaatttcgcgaagttcgatggtggtttttgtttttcgattcggaaatagttttttgtgttttcggtttggttgagtttttttcgtttttgtttatttttttggttagttta

SEQ ID NO: 4402 - DNA, 524 bp, Artificial Sequence
  chemically treated genomic DNA (Homo sapiens) CpG-island No: 4402
taaactaaccaaaaaaataaacaaaaacgaaaaaaactcaaccaaaccgaaaacacaaaaaactatttccgaatcgaaaaacaaaaaccaccatcgaacttcgcgaaattactaaactaacgaatccgcgaaccgacatctaaaacgaacgaaacgcaacgcgaccaaaacctccgaacatacgcaaactaatccccaaaacccgcgaccgccgccatatcgatactaaacgaatacgaacgacactacgattccatcaactcgaactttaaaaacgaatccgaaaattacgaaaactcgaatccgaaacctaacgccaatcaaaaaccgcgaaccgacgacgacgcgacgaaacaaaaaaaactacactacatccccatccgcgtcctaaaccgcgacgccttcgaaaaaaccacgctataccgccgcaccgaaataacgaccctcgacgccgaccgccctatctaacgctatcgaatcgccccgaatccctccttctcgaccccgctttcccaacgtcgtaa

SEQ ID NO: 4403 - DNA, 524 bp, Artificial Sequence
  chemically treated genomic DNA (Homo sapiens) CpG-island No: 4403
tagattagttaagagggtaagtaaaggcggaggaaatttagttaggtcggaaatatagagaattgttttcgggtcggggggtaggagttattatcgagtttcgcggggttgttgggttgacggattcgcgggtcggtatttgaagcgagcgggacgtagcgcggttagggttttcgggtatacgtaggttggtttttaaggttcgcggtcgtcgttatgtcggtgttgggcgagtacgagcgatattgcgattttattaattcggattttgggagcgagttcgggggttgcggggattcgagttcggggtttagcgttagttaggggtcgcgagtcggcggcggcgcggcggagtaggaggaattgtattatatttttattcgcgttttgggtcgcggcgttttcggggaagttacgttgtatcgtcgtatcgaggtagcggttttcggcgtcggtcgttttgtttggcgttgtcgggtcgtttcgagtttttttttttcggtttcgtttttttagcgtcgtga

SEQ ID NO: 4404 - DNA, 524 bp, Artificial Sequence
  chemically treated genomic DNA (Homo sapiens) CpG-island No: 4404
tcacgacgctaaaaaaacgaaaccgaaaaaaaaaaactcgaaacgacccgacaacgccaaacaaaacgaccgacgccgaaaaccgctacctcgatacgacgatacaacgtaacttccccgaaaacgccgcgacccaaaacgcgaataaaaatataatacaattcctcctactccgccgcgccgccgccgactcgcgacccctaactaacgctaaaccccgaactcgaatccccgcaacccccgaactcgctcccaaaatccgaattaataaaatcgcaatatcgctcgtactcgcccaacaccgacataacgacgaccgcgaaccttaaaaaccaacctacgtatacccgaaaaccctaaccgcgctacgtcccgctcgcttcaaataccgacccgcgaatccgtcaacccaacaaccccgcgaaactcgataataactcctaccccccgacccgaaaacaattctctatatttccgacctaactaaatttcctccgcctttacttaccctcttaactaatcta

SEQ ID NO: 4405 - DNA, 807 bp, Artificial Sequence
  chemically treated genomic DNA (Homo sapiens) CpG-island No: 4405
ggggcggcggtatcggtaggcgggatttcgatttttttttttttatatttttttaagcgcgggtttttatcgggcgcgggagcggacgcgggttcgggtttcggtttcggttcggttttgggttcgtttcgcggcggcggtggcggtggcggtggtggtggcggcggcggcgggggtgggggcggcggcggcggcgcggggggtgtcgcggggttcgggttcggggggttgggcgggggcgttttcgcgggcgcgcgttttcgggcgtttttcgcgcgcggtttcgtcgtcgttttgtttttcgtttttgttattcggtattgggcggtggaggcggttattttggtttcggcgtacgcggggcggtcgttttaggcgggagtagttgagcgtcgagtgtcgagtgtcgttgtcgtcgtcgttaaattcgtttcgtttcgttttttagggcgcgtttaggttggtttgtcgagtgtcgagcgtcgagcgtcgagtgttacgagcgaaatcgttcgtttgggttttgagggcggacggttgtagttgttggaagtttgtcgcgcgttttggttagcggatgtatttacgttgggcgtttagcggtttttaatcgtcgttttagtttagttttcggatatttttatttttaggatgggaatttttcggttttatttagatttttttaaataacgttaaaatttttaagagtttcgacgggcggagttaggatttgttttaggattttgttttatttttttttcggaaagtttttattttcgagtcggggattttggaaaatatttgatt

SEQ ID NO: 4406 - DNA, 807 bp, Artificial Sequence
  chemically treated genomic DNA (Homo sapiens) CpG-island No: 4406
aatcaaatattttccaaaatccccgactcgaaaataaaaactttccgaaaaaaaaataaaacaaaatcctaaaacaaatcctaactccgcccgtcgaaactcttaaaaattttaacgttatttaaaaaaatctaaataaaaccgaaaaattcccatcctaaaaataaaaatatccgaaaactaaactaaaacgacgattaaaaaccgctaaacgcccaacgtaaatacatccgctaaccaaaacgcgcgacaaacttccaacaactacaaccgtccgccctcaaaacccaaacgaacgatttcgctcgtaacactcgacgctcgacgctcgacactcgacaaaccaacctaaacgcgccctaaaaaacgaaacgaaacgaatttaacgacgacgacaacgacactcgacactcgacgctcaactactcccgcctaaaacgaccgccccgcgtacgccgaaaccaaaataaccgcctccaccgcccaataccgaataacaaaaacgaaaaacaaaacgacgacgaaaccgcgcgcgaaaaacgcccgaaaacgcgcgcccgcgaaaacgcccccgcccaaccccccgaacccgaaccccgcgacaccccccgcgccgccgccgccgcccccacccccgccgccgccgccaccaccaccgccaccgccaccgccgccgcgaaacgaacccaaaaccgaaccgaaaccgaaacccgaacccgcgtccgctcccgcgcccgataaaaacccgcgcttaaaaaaatataaaaaaaaaaaaatcgaaatcccgcctaccgataccgccgcccc

SEQ ID NO: 4407 - DNA, 807 bp, Artificial Sequence
  chemically treated genomic DNA (Homo sapiens) CpG-island No: 4407
gattaggtgttttttaggattttcgattcggagatggagatttttcggaaagggaatggggtagggttttagggtaggttttagtttcgttcgtcggggtttttaagagttttgacgttgtttaagggggtttgagtgaggtcggaagatttttattttagggatagagatgttcggggattgggttggggcggcggttagaggtcgttgggcgtttagcgtgggtgtattcgttagttagggcgcgcgataagtttttagtagttgtagtcgttcgtttttagggtttagacgaacggtttcgttcgtggtattcggcgttcggcgttcggtattcggtaggttaatttgggcgcgttttgaggggcggggcggagcgggtttggcggcggcggtagcggtattcggtattcggcgtttagttgttttcgtttggggcggtcgtttcgcgtgcgtcggagttaagatggtcgtttttatcgtttagtgtcgagtgataaaagcggagagtaaggcggcggcggggtcgcgcgcggggggcgttcgggagcgcgcgttcgcgggggcgttttcgtttagtttttcgagttcgggtttcgcggtatttttcgcgtcgtcgtcgtcgtttttattttcgtcgtcgtcgttattattatcgttatcgttatcgtcgtcgcgggacgggtttaaggtcgagtcggagtcggggttcgggttcgcgttcgttttcgcgttcggtaagagttcgcgtttgggagggtgtggggaggggaaggtcggaatttcgtttgtcggtgtcgtcgtttt

SEQ ID NO: 4408 - DNA, 807 bp, Artificial Sequence
  chemically treated genomic DNA (Homo sapiens) CpG-island No: 4408
aaaacgacgacaccgacaaacgaaattccgaccttcccctccccacaccctcccaaacgcgaactcttaccgaacgcgaaaacgaacgcgaacccgaaccccgactccgactcgaccttaaacccgtcccgcgacgacgataacgataacgataataataacgacgacgacgaaaataaaaacgacgacgacgacgcgaaaaataccgcgaaacccgaactcgaaaaactaaacgaaaacgcccccgcgaacgcgcgctcccgaacgccccccgcgcgcgaccccgccgccgccttactctccgcttttatcactcgacactaaacgataaaaacgaccatcttaactccgacgcacgcgaaacgaccgccccaaacgaaaacaactaaacgccgaataccgaataccgctaccgccgccgccaaacccgctccgccccgcccctcaaaacgcgcccaaattaacctaccgaataccgaacgccgaacgccgaataccacgaacgaaaccgttcgtctaaaccctaaaaacgaacgactacaactactaaaaacttatcgcgcgccctaactaacgaatacacccacgctaaacgcccaacgacctctaaccgccgccccaacccaatccccgaacatctctatccctaaaataaaaatcttccgacctcactcaaacccccttaaacaacgtcaaaactcttaaaaaccccgacgaacgaaactaaaacctaccctaaaaccctaccccattccctttccgaaaaatctccatctccgaatcgaaaatcctaaaaaacacctaatc

SEQ ID NO: 4409 - DNA, 524 bp, Artificial Sequence
  chemically treated genomic DNA (Homo sapiens) CpG-island No: 4409
ggatcgcggtgggtgttcggggaggcggattttcggtgtatttttgcgcgtgtgtatttttttttgcgtgcgtgttcgcgcgtgcgtgttcgtatatgcgcgttattttcgtattgttttcgttttttgcgtttgtttaggttatcgtttgttttggtttttaggttttggtttttagtggacgagaattatcgagtttgcggggttagacgttgatcgttcgggttagtatttaggcgggcgggagttgtgcggtttagggttcgcgcgggtcgggtagaggttcgagttaggattttcgagcgtgaatttcggagtcggcggcgttggggttagaggggcgggcgggaggtgatggcggaggcgaaggggcgacgggatttgggtttggttcgtgtgtgtttttagaggtttggcgtcggtcgtcgttgtacggtgagttttagggaggcggatttgggtttcgagaaggatatttatttggatttgttttataggttcggttcgcgttttcgggagtagaa

SEQ ID NO: 4410 - DNA, 524 bp, Artificial Sequence
  chemically treated genomic DNA (Homo sapiens) CpG-island No: 4410
ttctactcccgaaaacgcgaaccgaacctataaaacaaatccaaataaatatccttctcgaaacccaaatccgcctccctaaaactcaccgtacaacgacgaccgacgccaaacctctaaaaacacacacgaaccaaacccaaatcccgtcgccccttcgcctccgccatcacctcccgcccgcccctctaaccccaacgccgccgactccgaaattcacgctcgaaaatcctaactcgaacctctacccgacccgcgcgaaccctaaaccgcacaactcccgcccgcctaaatactaacccgaacgatcaacgtctaaccccgcaaactcgataattctcgtccactaaaaaccaaaacctaaaaaccaaaacaaacgataacctaaacaaacgcaaaaaacgaaaacaatacgaaaataacgcgcatatacgaacacgcacgcgcgaacacgcacgcaaaaaaaaatacacacgcgcaaaaatacaccgaaaatccgcctccccgaacacccaccgcgatcc

SEQ ID NO: 4411 - DNA, 524 bp, Artificial Sequence
  chemically treated genomic DNA (Homo sapiens) CpG-island No: 4411
ttttgttttcgagggcgcgggtcgggtttatggggtaaatttaggtgggtgtttttttcggggtttagattcgtttttttggggtttatcgtatagcgacggtcggcgttaggtttttgaggatatatacgggttaggtttaggtttcgtcgttttttcgttttcgttattatttttcgttcgtttttttggttttagcgtcgtcggtttcggggtttacgttcgggggttttggttcgagtttttattcggttcgcgcgaattttgggtcgtatagttttcgttcgtttaggtgttggttcgggcggttagcgtttagtttcgtagattcggtgattttcgtttattagaggttaaagtttgggaattagagtaagcgatgatttgaataggcgtaggaagcgagggtagtgcggaggtggcgcgtatgtgcgagtacgtacgcgcgaatacgtacgtagggagaggtgtatacgcgtaggagtgtatcggaagttcgttttttcggatatttatcgcggttt

SEQ ID NO: 4412 - DNA, 524 bp, Artificial Sequence
  chemically treated genomic DNA (Homo sapiens) CpG-island No: 4412
aaaccgcgataaatatccgaaaaaacgaacttccgatacactcctacgcgtatacacctctccctacgtacgtattcgcgcgtacgtactcgcacatacgcgccacctccgcactaccctcgcttcctacgcctattcaaatcatcgcttactctaattcccaaactttaacctctaataaacgaaaatcaccgaatctacgaaactaaacgctaaccgcccgaaccaacacctaaacgaacgaaaactatacgacccaaaattcgcgcgaaccgaataaaaactcgaaccaaaacccccgaacgtaaaccccgaaaccgacgacgctaaaaccaaaaaaacgaacgaaaaataataacgaaaacgaaaaaacgacgaaacctaaacctaacccgtatatatcctcaaaaacctaacgccgaccgtcgctatacgataaaccccaaaaaaacgaatctaaaccccgaaaaaaacacccacctaaatttaccccataaacccgacccgcgccctcgaaaacaaaa

SEQ ID NO: 4413 - DNA, 701 bp, Artificial Sequence
  chemically treated genomic DNA (Homo sapiens) CpG-island No: 4413
cgggttcgtgtcgcggtcgcgtggaggtgttgtacgtcgggggttggggtatcgtgtgcgacgatgattgggattttgcggacgcgcgcgtggtttgtcgcgaagcgggttgcgggtttgcgttgggttaacgggattgggttatttcggttacggcgcggttcgtgttgttggataacgtgggttgcgtcggtatcgaggttcgtttgagcgattgtttttatttgggttggggtagtataattgcggttattacgaggacgcgggagcgtttgcgtaggtgaggttgatagcgaaggtgaggttgatagcggggtcgcgtattgcggcgtgggaggggcggggcggcgttacgcgcgaggttttttttgcggtattgtcgttcggggagtatgcgtatttcgtagaggggcgtcgcgttcgtgcgttcgttttgcggttgcgcggcggggcgaggtcggaacggagagttttttgtagtggaaaatggggcggggtttggggagcgtcgcgtggtgtagttgtgaggggcggtgttcgaaggttagggttaaggtcgattttagttcgagaaaggtattaagttcgtaaagggtggggtcgtttgttttcggttaaatttagatttcgtaaaattttattaagtagagagtggattatttttattagagttagcgtgtgatttttgggcggagttagtg

SEQ ID NO: 4414 - DNA, 701 bp, Artificial Sequence
  chemically treated genomic DNA (Homo sapiens) CpG-island No: 4414
cactaactccgcccaaaaatcacacgctaactctaataaaaataatccactctctacttaataaaattttacgaaatctaaatttaaccgaaaacaaacgaccccaccctttacgaacttaatacctttctcgaactaaaatcgaccttaaccctaaccttcgaacaccgcccctcacaactacaccacgcgacgctccccaaaccccgccccattttccactacaaaaaactctccgttccgacctcgccccgccgcgcaaccgcaaaacgaacgcacgaacgcgacgcccctctacgaaatacgcatactccccgaacgacaataccgcaaaaaaaacctcgcgcgtaacgccgccccgcccctcccacgccgcaatacgcgaccccgctatcaacctcaccttcgctatcaacctcacctacgcaaacgctcccgcgtcctcgtaataaccgcaattatactaccccaacccaaataaaaacaatcgctcaaacgaacctcgataccgacgcaacccacgttatccaacaacacgaaccgcgccgtaaccgaaataacccaatcccgttaacccaacgcaaacccgcaacccgcttcgcgacaaaccacgcgcgcgtccgcaaaatcccaatcatcgtcgcacacgataccccaacccccgacgtacaacacctccacgcgaccgcgacacgaacccg

SEQ ID NO: 4415 - DNA, 701 bp, Artificial Sequence
  chemically treated genomic DNA (Homo sapiens) CpG-island No: 4415
tattgatttcgtttaaaggttatacgttagttttggtaagggtgatttattttttgtttaatagagttttgcggggtttagatttagtcgggagtaaacggttttattttttacggatttgatgtttttttcgaattgggatcggttttagttttgattttcggatatcgttttttatagttgtattacgcggcgttttttaggtttcgttttattttttattgtagaaggtttttcgtttcggtttcgtttcgtcgcgtagtcgtagagcgggcgtacgagcgcggcgtttttttgcggagtgcgtatgtttttcgggcggtagtgtcgtaagagaggtttcgcgcgtggcgtcgtttcgttttttttacgtcgtagtgcgcggtttcgttgttagttttattttcgttgttagttttatttgcgtagacgttttcgcgttttcgtggtggtcgtagttgtgttgttttagtttaggtggaagtagtcgtttaggcgagtttcggtgtcggcgtagtttacgttgtttagtagtacgggtcgcgtcgtagtcgaagtggtttagtttcgttagtttagcgtaggttcgtagttcgtttcgcggtaggttacgcgcgcgttcgtaaagttttagttatcgtcgtatacggtgttttagttttcggcgtgtaatatttttacgcggtcgcggtacggattcg

SEQ ID NO: 4416 - DNA, 701 bp, Artificial Sequence
  chemically treated genomic DNA (Homo sapiens) CpG-island No: 4416
cgaatccgtaccgcgaccgcgtaaaaatattacacgccgaaaactaaaacaccgtatacgacgataactaaaactttacgaacgcgcgcgtaacctaccgcgaaacgaactacgaacctacgctaaactaacgaaactaaaccacttcgactacgacgcgacccgtactactaaacaacgtaaactacgccgacaccgaaactcgcctaaacgactacttccacctaaactaaaacaacacaactacgaccaccacgaaaacgcgaaaacgtctacgcaaataaaactaacaacgaaaataaaactaacaacgaaaccgcgcactacgacgtaaaaaaaacgaaacgacgccacgcgcgaaacctctcttacgacactaccgcccgaaaaacatacgcactccgcaaaaaaacgccgcgctcgtacgcccgctctacgactacgcgacgaaacgaaaccgaaacgaaaaaccttctacaataaaaaataaaacgaaacctaaaaaacgccgcgtaatacaactataaaaaacgatatccgaaaatcaaaactaaaaccgatcccaattcgaaaaaaacatcaaatccgtaaaaaataaaaccgtttactcccgactaaatctaaaccccgcaaaactctattaaacaaaaaataaatcacccttaccaaaactaacgtataacctttaaacgaaatcaata

SEQ ID NO: 4417 - DNA, 582 bp, Artificial Sequence
  chemically treated genomic DNA (Homo sapiens) CpG-island No: 4417
tcgttgttatttttttggacggttacgcgtgtggatacggtcgcggatggatgcgtaggatattattaaataaatttatacgttgtattttatttttttttttttggagtgttattagggttttcgcgaggagggttgatcgggtgcggggaggtcgagtgtatcgggcgtgtgttgattaattcgggtttagtgatagttttgcgacgaatttttattttttcgcgcggggcgaggggaacgggttgcggggtttgtttcgagttttcggttcgatcggtattcgcgattacgattttcggacgtttttttttaggtgggggtgatagcgcgtttcgggttttcgtcgtttcgggttttcgtcgtttcggattttttttttatttgtgttgttattcgtcgagaaatcgggcgagttgagtttggtttttttggggttgggcggttcgtttagtaagtttttagttatttttatttgttcgcgaaaatagtttcgggtacgggcggtcgggtcggcgagggttcggacgggggtcggggattatatagtttatatttgtaattttaattatttaggaagtt

SEQ ID NO: 4418 - DNA, 582 bp, Artificial Sequence
  chemically treated genomic DNA (Homo sapiens) CpG-island No: 4418
aacttcctaaataattaaaattacaaatataaactatataatccccgacccccgtccgaaccctcgccgacccgaccgcccgtacccgaaactattttcgcgaacaaataaaaataactaaaaacttactaaacgaaccgcccaaccccaaaaaaaccaaactcaactcgcccgatttctcgacgaataacaacacaaataaaaaaaaaatccgaaacgacgaaaacccgaaacgacgaaaacccgaaacgcgctatcacccccacctaaaaaaaaacgtccgaaaatcgtaatcgcgaataccgatcgaaccgaaaactcgaaacaaaccccgcaacccgttcccctcgccccgcgcgaaaaaataaaaattcgtcgcaaaactatcactaaacccgaattaatcaacacacgcccgatacactcgacctccccgcacccgatcaaccctcctcgcgaaaaccctaataacactccaaaaaaaaaaaaataaaatacaacgtataaatttatttaataatatcctacgcatccatccgcgaccgtatccacacgcgtaaccgtccaaaaaaataacaacga

SEQ ID NO: 4419 - DNA, 582 bp, Artificial Sequence
  chemically treated genomic DNA (Homo sapiens) CpG-island No: 4419
agttttttgagtaattgggattataggtgtgagttgtgtgattttcgattttcgttcgggttttcgtcggttcggtcgttcgtgttcggggttgttttcgcgagtaggtgaaaatggttgagaatttgttggacggatcgtttaattttaaaagagttaaatttagttcgttcggtttttcggcgaatgatagtataggtgaggagggggttcggggcggcgggggttcggggcggcgggggttcggggcgcgttgttatttttatttgaaagagagcgttcgggggtcgtggtcgcggatatcgatcgagtcgggagttcggagtaggtttcgtagttcgtttttttcgtttcgcgcgggagggtggaagttcgtcgtaggattgttattgggttcgagttggttagtatacgttcggtgtattcggttttttcgtattcgattagtttttttcgcggggattttagtggtattttaggagggaagaagtaaagtgtagcgtgtgggtttgtttggtaatgttttacgtatttattcgcggtcgtgtttatacgcgtggtcgtttagaggaatgatagcgg

SEQ ID NO: 4420 - DNA, 582 bp, Artificial Sequence
  chemically treated genomic DNA (Homo sapiens) CpG-island No: 4420
ccgctatcattcctctaaacgaccacgcgtataaacacgaccgcgaataaatacgtaaaacattaccaaacaaacccacacgctacactttacttcttccctcctaaaataccactaaaatccccgcgaaaaaaactaatcgaatacgaaaaaaccgaatacaccgaacgtatactaaccaactcgaacccaataacaatcctacgacgaacttccaccctcccgcgcgaaacgaaaaaaacgaactacgaaacctactccgaactcccgactcgatcgatatccgcgaccacgacccccgaacgctctctttcaaataaaaataacaacgcgccccgaacccccgccgccccgaacccccgccgccccgaaccccctcctcacctatactatcattcgccgaaaaaccgaacgaactaaatttaactcttttaaaattaaacgatccgtccaacaaattctcaaccattttcacctactcgcgaaaacaaccccgaacacgaacgaccgaaccgacgaaaacccgaacgaaaatcgaaaatcacacaactcacacctataatcccaattactcaaaaaact

SEQ ID NO: 4421 - DNA, 535 bp, Artificial Sequence
  chemically treated genomic DNA (Homo sapiens) CpG-island No: 4421
cgtcggtgcgttattttttcgcggcgttattacgtacggttttcgtttcgttttttttatttgcgtcggtcgtggcggaaagagtcgagcgtgttcgggtcgaagggttgaaggcgcggtcgttaagcgtagggaagttggcggttcggcgcgggttaggtttgcggggcgtttgggtttcgggttgagttatagtttttgttttgatggcgattaggcgtagagggtcggggtttcgggttttagcgggtttcgggagcggcggtttggtcgcgggttgggttttcgggcgcggattcgacgttagttcgggttcgttcgtttcgttggggcggcgttgcgtgtttttagtttttcgcgtttttttttttagatttttttaggtggcgtcggtcgggaacggtcggggcgattttagtttaggtcgcgttattagttttcgtcgtcggttagggaagtggaatggtttttgtaggttatagatcgtttttgggttttgtcgacgaggtgggcggatggggaaattgaggcgggg

SEQ ID NO: 4422 - DNA, 535 bp, Artificial Sequence
  chemically treated genomic DNA (Homo sapiens) CpG-island No: 4422
ccccgcctcaatttccccatccgcccacctcgtcgacaaaacccaaaaacgatctataacctacaaaaaccattccacttccctaaccgacgacgaaaactaataacgcgacctaaactaaaatcgccccgaccgttcccgaccgacgccacctaaaaaaatctaaaaaaaaaaacgcgaaaaactaaaaacacgcaacgccgccccaacgaaacgaacgaacccgaactaacgtcgaatccgcgcccgaaaacccaacccgcgaccaaaccgccgctcccgaaacccgctaaaacccgaaaccccgaccctctacgcctaatcgccatcaaaacaaaaactataactcaacccgaaacccaaacgccccgcaaacctaacccgcgccgaaccgccaacttccctacgcttaacgaccgcgccttcaacccttcgacccgaacacgctcgactctttccgccacgaccgacgcaaataaaaaaaacgaaacgaaaaccgtacgtaataacgccgcgaaaaaataacgcaccgacg

SEQ ID NO: 4423 - DNA, 535 bp, Artificial Sequence
  chemically treated genomic DNA (Homo sapiens) CpG-island No: 4423
tttcgttttagtttttttattcgtttatttcgtcggtaggatttaagggcggtttgtaatttgtagaggttattttatttttttggtcggcggcgaaggttagtggcgcggtttgggttggggtcgtttcgatcgttttcgatcgacgttatttaggagggtttggggaaggggacgcgaggagttgggaatacgtagcgtcgttttagcgggacgggcgggttcgggttggcgtcgaattcgcgttcgagagtttagttcgcggttaggtcgtcgttttcggagttcgttggggttcggagtttcggttttttacgtttggtcgttattagaataaaagttgtggtttagttcggagtttaggcgtttcgtaggtttggttcgcgtcgggtcgttagtttttttacgtttggcggtcgcgtttttagtttttcggttcgagtacgttcggtttttttcgttacggtcggcgtaggtggagggggcggggcgggggtcgtgcgtggtgacgtcgcgggggggtgacgtatcggcg

SEQ ID NO: 4424 - DNA, 535 bp, Artificial Sequence
  chemically treated genomic DNA (Homo sapiens) CpG-island No: 4424
cgccgatacgtcacccccccgcgacgtcaccacgcacgacccccgccccgccccctccacctacgccgaccgtaacgaaaaaaaccgaacgtactcgaaccgaaaaactaaaaacgcgaccgccaaacgtaaaaaaactaacgacccgacgcgaaccaaacctacgaaacgcctaaactccgaactaaaccacaacttttattctaataacgaccaaacgtaaaaaaccgaaactccgaaccccaacgaactccgaaaacgacgacctaaccgcgaactaaactctcgaacgcgaattcgacgccaacccgaacccgcccgtcccgctaaaacgacgctacgtattcccaactcctcgcgtccccttccccaaaccctcctaaataacgtcgatcgaaaacgatcgaaacgaccccaacccaaaccgcgccactaaccttcgccgccgaccaaaaaaataaaataacctctacaaattacaaaccgcccttaaatcctaccgacgaaataaacgaataaaaaaactaaaacgaaa

SEQ ID NO: 4425 - DNA, 819 bp, Artificial Sequence
  chemically treated genomic DNA (Homo sapiens) CpG-island No: 4425
gataggcggttagggtataaaggggatttcgttaggaggagagaaagtcgttcggggtagggcgtttaggttattggggcgttgttatggggttaaagatttggtcgtcgttttttttattcggtttgcgttttttttttttttcggcgttcgttcgttcgttcgcggttcgcgttcgtttttttttttcgtagtcggtagggttttcgattttcgttcgggttttcgtcggttcggtcgttcgtgttcggggttgttttcgcgagtaggtgaaaatggttgagaatttgttggacggatcgtttaattttaaaagagttaaatttagttcgttcggtttttcggcgaatgatagtataggtgaggagggggttcggggcggcgggggttcggggcgcgttgttatttttatttgaaagagagcgttcgggggtcgtggtcgcggatatcgatcgagtcgggagttcggagtaggtttcgtagttcgtttttttcgtttcgcgcgggagggtggaagttcgtcgtaggattgttattgggttcgagttggttagtatacgttcggtgtattcggttttttcgtattcgattagtttttttcgcggggattttagtggtattttaggagggaagaagtaaagtgtagcgtgtgggtttgtttggtaatgttttacgtatttattcgcggtcgtgtttatacgcgtggtcgtttagaggaatgatagcggagggtatttttgatgtttagagaaagtaagatcgcggttaaaggtagggtagtgtgttttttggattggcgatatattgattaggttgtat

SEQ ID NO: 4426 - DNA, 819 bp, Artificial Sequence
  chemically treated genomic DNA (Homo sapiens) CpG-island No: 4426
atacaacctaatcaatatatcgccaatccaaaaaacacactaccctacctttaaccgcgatcttactttctctaaacatcaaaaataccctccgctatcattcctctaaacgaccacgcgtataaacacgaccgcgaataaatacgtaaaacattaccaaacaaacccacacgctacactttacttcttccctcctaaaataccactaaaatccccgcgaaaaaaactaatcgaatacgaaaaaaccgaatacaccgaacgtatactaaccaactcgaacccaataacaatcctacgacgaacttccaccctcccgcgcgaaacgaaaaaaacgaactacgaaacctactccgaactcccgactcgatcgatatccgcgaccacgacccccgaacgctctctttcaaataaaaataacaacgcgccccgaacccccgccgccccgaaccccctcctcacctatactatcattcgccgaaaaaccgaacgaactaaatttaactcttttaaaattaaacgatccgtccaacaaattctcaaccattttcacctactcgcgaaaacaaccccgaacacgaacgaccgaaccgacgaaaacccgaacgaaaatcgaaaaccctaccgactacgaaaaaaaaaaacgaacgcgaaccgcgaacgaacgaacgaacgccgaaaaaaaaaaaaaacgcaaaccgaataaaaaaaacgacgaccaaatctttaaccccataacaacgccccaataacctaaacgccctaccccgaacgactttctctcctcctaacgaaatcccctttataccctaaccgcctatc

SEQ ID NO: 4427 - DNA, 819 bp, Artificial Sequence
  chemically treated genomic DNA (Homo sapiens) CpG-island No: 4427
atgtagtttggttaatgtgtcgttaatttagaaaatatattgttttatttttggtcgcgattttgttttttttaagtattaaaggtatttttcgttgttatttttttggacggttacgcgtgtggatacggtcgcggatggatgcgtaggatattattaaataaatttatacgttgtattttatttttttttttttggagtgttattagggttttcgcgaggagggttgatcgggtgcggggaggtcgagtgtatcgggcgtgtgttgattaattcgggtttagtgatagttttgcgacgaatttttattttttcgcgcggggcgaggggaacgggttgcggggtttgtttcgagttttcggttcgatcggtattcgcgattacgattttcggacgtttttttttaggtgggggtgatagcgcgtttcgggttttcgtcgtttcggattttttttttatttgtgttgttattcgtcgagaaatcgggcgagttgagtttggtttttttggggttgggcggttcgtttagtaagtttttagttatttttatttgttcgcgaaaatagtttcgggtacgggcggtcgggtcggcgagggttcggacgggggtcgggggttttgtcggttgcgagggagaggagcgagcgcgggtcgcgagcgggcgggcgggcgtcgagggagagggagggcgtaagtcgggtgggggaggcggcggttaaatttttaattttataatagcgttttaataatttaaacgttttgtttcggacgattttttttttttttgacggggttttttttatattttgatcgtttatt

SEQ ID NO: 4428 - DNA, 819 bp, Artificial Sequence
  chemically treated genomic DNA (Homo sapiens) CpG-island No: 4428
aataaacgatcaaaatataaaaaaaaccccgtcaaaaaaaaaaaaaatcgtccgaaacaaaacgtttaaattattaaaacgctattataaaattaaaaatttaaccgccgcctcccccacccgacttacgccctccctctccctcgacgcccgcccgcccgctcgcgacccgcgctcgctcctctccctcgcaaccgacaaaacccccgacccccgtccgaaccctcgccgacccgaccgcccgtacccgaaactattttcgcgaacaaataaaaataactaaaaacttactaaacgaaccgcccaaccccaaaaaaaccaaactcaactcgcccgatttctcgacgaataacaacacaaataaaaaaaaaatccgaaacgacgaaaacccgaaacgcgctatcacccccacctaaaaaaaaacgtccgaaaatcgtaatcgcgaataccgatcgaaccgaaaactcgaaacaaaccccgcaacccgttcccctcgccccgcgcgaaaaaataaaaattcgtcgcaaaactatcactaaacccgaattaatcaacacacgcccgatacactcgacctccccgcacccgatcaaccctcctcgcgaaaaccctaataacactccaaaaaaaaaaaaataaaatacaacgtataaatttatttaataatatcctacgcatccatccgcgaccgtatccacacgcgtaaccgtccaaaaaaataacaacgaaaaatacctttaatacttaaaaaaaacaaaatcgcgaccaaaaataaaacaatatattttctaaattaacgacacattaaccaaactacat

SEQ ID NO: 4429 - DNA, 930 bp, Artificial Sequence
  chemically treated genomic DNA (Homo sapiens) CpG-island No: 4429
tcgagtcgttagtgggaagcgagaggtgcggagttttaggggcgtagggatttttcggaggtgtaagtttagcgggacgaggttttgggagaatttcgagggtttttcgtaagttttttcgcgtatttatttcgatttaggtaatcggaggttatttacgtgttattgggcgggtttcggggcgtattgatttggcgcgggataggagggtcggcggttcgggcggttgcggtaatttttttttaggggttcggttcgtcgttgggtgcgggaggttaggggagtttcgttttttgtaggtcggttcgtaagaacgtacggttatttattcgcgtcgcggtttatagcgcgtatttatatttttattggtattcgtacgcgcgtttttaattataaagttcgttcgcggcgggatagtgtgagtttagcgcgtcgtgtggcgggtcgagtagtcgtcgcggtttttggtttcgcgtttagggggcgtcgtttttatacgtcgcgtcggtttttttatttgcgttcgttgtcgtcgcgcgttttttttttgtcgttttcgggttggttttaggtcgcgcgtttagtttcggcggttttcgttttatcgttagtcgagttcggtttttcgttcgtttttcggtagtcgtttagagcggggtcgttttttgcgtttatttcgtcggggtttcgtgttcggtcgggcggcggggagggtttcgcggtttcgggttttggtcgttttagattcggttcgcgtttcgtagcggggttggagacggagtcgttatttagggagcgttagtcgttagtcggtttttattgttcggttttggcgcgttggtaggaggagggggcgtagagggagggttagaggagtagcgtcgacgttagtttttttttttttttcgtttttttttttttttgtttgtt

SEQ ID NO: 4430 - DNA, 930 bp, Artificial Sequence
  chemically treated genomic DNA (Homo sapiens) CpG-island No: 4430
aacaaacaaaaaaaaaaaaaaacgaaaaaaaaaaaaaaactaacgtcgacgctactcctctaaccctccctctacgccccctcctcctaccaacgcgccaaaaccgaacaataaaaaccgactaacgactaacgctccctaaataacgactccgtctccaaccccgctacgaaacgcgaaccgaatctaaaacgaccaaaacccgaaaccgcgaaaccctccccgccgcccgaccgaacacgaaaccccgacgaaataaacgcaaaaaacgaccccgctctaaacgactaccgaaaaacgaacgaaaaaccgaactcgactaacgataaaacgaaaaccgccgaaactaaacgcgcgacctaaaaccaacccgaaaacgacaaaaaaaaaacgcgcgacgacaacgaacgcaaataaaaaaaccgacgcgacgtataaaaacgacgccccctaaacgcgaaaccaaaaaccgcgacgactactcgacccgccacacgacgcgctaaactcacactatcccgccgcgaacgaactttataattaaaaacgcgcgtacgaataccaataaaaatataaatacgcgctataaaccgcgacgcgaataaataaccgtacgttcttacgaaccgacctacaaaaaacgaaactcccctaacctcccgcacccaacgacgaaccgaacccctaaaaaaaaattaccgcaaccgcccgaaccgccgaccctcctatcccgcgccaaatcaatacgccccgaaacccgcccaataacacgtaaataacctccgattacctaaatcgaaataaatacgcgaaaaaacttacgaaaaaccctcgaaattctcccaaaacctcgtcccgctaaacttacacctccgaaaaatccctacgcccctaaaactccgcacctctcgcttcccactaacgactcga

SEQ ID NO: 4431 - DNA, 930 bp, Artificial Sequence
  chemically treated genomic DNA (Homo sapiens) CpG-island No: 4431
aataagtagaaaagaaggaaggcggaggaagagaggaggttggcgtcggcgttgtttttttggttttttttttgcgttttttttttttgttagcgcgttaaagtcgggtagtaggggtcgattggcggttgacgttttttgagtggcgatttcgtttttagtttcgttgcggagcgcgggtcggatttggggcggttagggttcggagtcgcggagtttttttcgtcgttcggtcgagtacgggatttcggcggggtgggcgtagggggcggtttcgttttgggcgattgtcgaggggcgggcggagggtcgggttcggttggcggtggggcgggggtcgtcgggattgggcgcgcggtttgaagttagttcgggggcggtaggagagggacgcgcggcggtagcgagcgtaggtaagggggtcggcgcggcgtgtggggacggcgttttttgggcgcgaagttagaggtcgcggcgattgttcggttcgttatacggcgcgttgggtttatattgtttcgtcgcggacgggttttgtggttgggggcgcgcgtgcgagtgttagtgagagtgtgggtgcgcgttgtgggtcgcggcgcgggtgggtggtcgtgcgtttttgcgagtcggtttgtaggaggcgaggtttttttggtttttcgtatttagcggcggatcgagtttttggagggaagttgtcgtagtcgttcgggtcgtcggtttttttgtttcgcgttaggttagtgcgtttcggggttcgtttagtgatacgtaggtggttttcggttatttgggtcggggtgggtgcgcgggagggtttgcgaggggttttcgaaatttttttaaaatttcgtttcgttggatttgtattttcgaggggtttttgcgtttttggggtttcgtatttttcgttttttattgacgattcgg

SEQ ID NO: 4432 - DNA, 930 bp, Artificial Sequence
  chemically treated genomic DNA (Homo sapiens) CpG-island No: 4432
ccgaatcgtcaataaaaaacgaaaaatacgaaaccccaaaaacgcaaaaacccctcgaaaatacaaatccaacgaaacgaaattttaaaaaaatttcgaaaacccctcgcaaaccctcccgcgcacccaccccgacccaaataaccgaaaaccacctacgtatcactaaacgaaccccgaaacgcactaacctaacgcgaaacaaaaaaaccgacgacccgaacgactacgacaacttccctccaaaaactcgatccgccgctaaatacgaaaaaccaaaaaaacctcgcctcctacaaaccgactcgcaaaaacgcacgaccacccacccgcgccgcgacccacaacgcgcacccacactctcactaacactcgcacgcgcgcccccaaccacaaaacccgtccgcgacgaaacaatataaacccaacgcgccgtataacgaaccgaacaatcgccgcgacctctaacttcgcgcccaaaaaacgccgtccccacacgccgcgccgacccccttacctacgctcgctaccgccgcgcgtccctctcctaccgcccccgaactaacttcaaaccgcgcgcccaatcccgacgacccccgccccaccgccaaccgaacccgaccctccgcccgcccctcgacaatcgcccaaaacgaaaccgccccctacgcccaccccgccgaaatcccgtactcgaccgaacgacgaaaaaaactccgcgactccgaaccctaaccgccccaaatccgacccgcgctccgcaacgaaactaaaaacgaaatcgccactcaaaaaacgtcaaccgccaatcgacccctactacccgactttaacgcgctaacaaaaaaaaaaaacgcaaaaaaaaaaccaaaaaaacaacgccgacgccaacctcctctcttcctccgccttccttcttttctacttatt

SEQ ID NO: 4433 - DNA, 768 bp, Artificial Sequence
  chemically treated genomic DNA (Homo sapiens) CpG-island No: 4433
ttttttcgttggacgttgttttattttttagcgtttttgtttaggtcgcggtttaggcgaggttttagaaaatttcggtgttggttaattagttttgagttcgagcgcgtttagtgcgtaacgtggtttttttattggtttatttagtgggtcgcgcgtcgacgtcggggtttcggattgaacggcgcgtttaggtttttgtttttagttagacgtggcgttatcgtttttagttcgtagtttcggcgtagttaatggcggcgtttttcgggcggtaagcgcggtttttcgtcgttagagggcgtcgtcgcgggcgtaatcgagtcgttgtcgtcgtcgttaatcgagggagagttgcgagcgagtatttaggtttcgtcgtcgtcgtcgttatcgttgttcgtttgtcgtcgttcgttttcgtttgttttttgtcgtcggtcggcgcgtcgtttttataggtaggggtagggggacgtcgtcgggtatgaaggaaacgcgcgcgttcgcgttttcgtttttttcgcgcgcgtcgtcgtttcgtgttcgcgcgcggtcgttaacggacggcgggcggggcgggggaggggcggcggggttcggggttcgcggattcgagaggattttgagaggagtcgggtcggggtttgtgcgcgcggagggacgggtgggcgcgtcgttttttttttttatcgagaataacgtgatttatttttgtttgttattttttcggtaaaatgttttttttttggtgattttattaaaaaa

SEQ ID NO: 4434 - DNA, 768 bp, Artificial Sequence
  chemically treated genomic DNA (Homo sapiens) CpG-island No: 4434
ttttttaataaaatcaccaaaaaaaaaacattttaccgaaaaaataacaaacaaaaataaatcacgttattctcgataaaaaaaaaaaacgacgcgcccacccgtccctccgcgcgcacaaaccccgacccgactcctctcaaaatcctctcgaatccgcgaaccccgaaccccgccgcccctcccccgccccgcccgccgtccgttaacgaccgcgcgcgaacacgaaacgacgacgcgcgcgaaaaaaacgaaaacgcgaacgcgcgcgtttccttcatacccgacgacgtccccctacccctacctataaaaacgacgcgccgaccgacgacaaaaaacaaacgaaaacgaacgacgacaaacgaacaacgataacgacgacgacgacgaaacctaaatactcgctcgcaactctccctcgattaacgacgacgacaacgactcgattacgcccgcgacgacgccctctaacgacgaaaaaccgcgcttaccgcccgaaaaacgccgccattaactacgccgaaactacgaactaaaaacgataacgccacgtctaactaaaaacaaaaacctaaacgcgccgttcaatccgaaaccccgacgtcgacgcgcgacccactaaataaaccaataaaaaaaccacgttacgcactaaacgcgctcgaactcaaaactaattaaccaacaccgaaattttctaaaacctcgcctaaaccgcgacctaaacaaaaacgctaaaaaataaaacaacgtccaacgaaaaaa

SEQ ID NO: 4435 - DNA, 768 bp, Artificial Sequence
  chemically treated genomic DNA (Homo sapiens) CpG-island No: 4435
ttttttagtgaaattattaaaaaggagatattttgtcgagggaatggtaggtagaagtgggttacgttattttcggtgggggaaggggacggcgcgtttattcgttttttcgcgcgtataggtttcggttcggttttttttagggttttttcgggttcgcgggtttcggatttcgtcgtttttttttcgtttcgttcgtcgttcgttaacggtcgcgcgcgagtacgaggcggcggcgcgcgcggggggggcgggggcgcgggcgcgcgcgttttttttatgttcggcggcgtttttttatttttatttgtggggacgacgcgtcggtcggcggtagaaggtaggcggaggcgggcggcggtaggcgggtagcggtggcggcggcggcggcggggtttgggtgttcgttcgtagttttttttcggttagcggcggcggtagcggttcggttgcgttcgcggcggcgttttttagcggcgggaggtcgcgtttgtcgttcgggagacgtcgttattggttgcgtcggagttacgggttgggggcggtggcgttacgtttgattgggggtagggatttgggcgcgtcgtttaattcggagtttcggcgtcgacgcgcggtttattgggtgagttaatgggaaggttacgttgcgtattggacgcgttcggatttaagattgattaattagtatcggggttttttggggtttcgtttgggtcgcggtttgagtagaagcgttaggaggtagaatagcgtttagcggggaga

SEQ ID NO: 4436 - DNA, 768 bp, Artificial Sequence
  chemically treated genomic DNA (Homo sapiens) CpG-island No: 4436
tctccccgctaaacgctattctacctcctaacgcttctactcaaaccgcgacccaaacgaaaccccaaaaaaccccgatactaattaatcaatcttaaatccgaacgcgtccaatacgcaacgtaaccttcccattaactcacccaataaaccgcgcgtcgacgccgaaactccgaattaaacgacgcgcccaaatccctacccccaatcaaacgtaacgccaccgcccccaacccgtaactccgacgcaaccaataacgacgtctcccgaacgacaaacgcgacctcccgccgctaaaaaacgccgccgcgaacgcaaccgaaccgctaccgccgccgctaaccgaaaaaaaactacgaacgaacacccaaaccccgccgccgccgccgccaccgctacccgcctaccgccgcccgcctccgcctaccttctaccgccgaccgacgcgtcgtccccacaaataaaaataaaaaaacgccgccgaacataaaaaaaacgcgcgcgcccgcgcccccgccccccccgcgcgcgccgccgcctcgtactcgcgcgcgaccgttaacgaacgacgaacgaaacgaaaaaaaaacgacgaaatccgaaacccgcgaacccgaaaaaaccctaaaaaaaaccgaaccgaaacctatacgcgcgaaaaaacgaataaacgcgccgtccccttcccccaccgaaaataacgtaacccacttctacctaccattccctcgacaaaatatctcctttttaataatttcactaaaaaa

SEQ ID NO: 4437 - DNA, 746 bp, Artificial Sequence
  chemically treated genomic DNA (Homo sapiens) CpG-island No: 4437
gcgcggcgagagtagattatagcggtgttaaggttttaagtatttttcgcgggttttattttaagggagtagtttttttacgtttcgcgacggcgtttgcgtagatttcgtgagcggggtcgtgatcggtggggttaagattgggttgcgggcggggaaggttttcgtgtatttacgtagggtgtagggcgtggttcgttgggggcggggatttgggcggtgtcggtgttcgttcggatttcgtgagcggtgggcggagttgcgtgttttggggtgtgaggtggggcggatttcgcggcggcggcgcggttgacgtggagcgttcgggttagcgggtgcggcgagttgcgggattggggagtaacgggtcgggtcgggttttcgggttcgaggcggcggcggcggtataaagtcggcgattgggagtatgtaatgtcggaatgcggaggtcgcggcggcggtagtagtagtagcgaggacgtcgaggacgagggagggggcggcggcggtttcgcgggtttagattgttttagttcgagttcgattttggttatagcgttttcggcgggtcggtttcgtcgcgggttgcgtggcgttttttttatggcgcgttagcggtcggagttgttttgcggggtcgtggcgttcggttgcgcgttgtttttcgtttttaagtttatttgtaggtgaggcggttcggattttggggtttcgttagggcgttttttttgttttgtcgtttggag

SEQ ID NO: 4438 - DNA, 746 bp, Artificial Sequence
  chemically treated genomic DNA (Homo sapiens) CpG-island No: 4438
ctccaaacgacaaaacaaaaaaaacgccctaacgaaaccccaaaatccgaaccgcctcacctacaaataaacttaaaaacgaaaaacaacgcgcaaccgaacgccacgaccccgcaaaacaactccgaccgctaacgcgccataaaaaaaacgccacgcaacccgcgacgaaaccgacccgccgaaaacgctataaccaaaatcgaactcgaactaaaacaatctaaacccgcgaaaccgccgccgccccctccctcgtcctcgacgtcctcgctactactactaccgccgccgcgacctccgcattccgacattacatactcccaatcgccgactttataccgccgccgccgcctcgaacccgaaaacccgacccgacccgttactccccaatcccgcaactcgccgcacccgctaacccgaacgctccacgtcaaccgcgccgccgccgcgaaatccgccccacctcacaccccaaaacacgcaactccgcccaccgctcacgaaatccgaacgaacaccgacaccgcccaaatccccgcccccaacgaaccacgccctacaccctacgtaaatacacgaaaaccttccccgcccgcaacccaatcttaaccccaccgatcacgaccccgctcacgaaatctacgcaaacgccgtcgcgaaacgtaaaaaaactactcccttaaaataaaacccgcgaaaaatacttaaaaccttaacaccgctataatctactctcgccgcgc

SEQ ID NO: 4439 - DNA, 746 bp, Artificial Sequence
  chemically treated genomic DNA (Homo sapiens) CpG-island No: 4439
ttttaggcggtagagtaaggggagcgttttagcggggttttagggttcgggtcgttttatttgtaggtgaatttgagggcgaggagtagcgcgtagtcgagcgttacggtttcgtagagtagtttcggtcgttggcgcgttatgaggaaggcgttacgtagttcgcgacggagtcggttcgtcgaggacgttgtggttagggtcgggttcgagttgaggtagtttgagttcgcggggtcgtcgtcgttttttttttcgttttcggcgttttcgttgttgttgttgtcgtcgtcgcggttttcgtatttcgatattatatgtttttagtcgtcggttttatatcgtcgtcgtcgtttcgggttcgaaggttcggttcggttcgttgttttttaatttcgtagttcgtcgtattcgttaattcggacgttttacgttagtcgcgtcgtcgtcgcggggttcgttttattttatattttagagtacgtagtttcgtttatcgtttacggagttcgggcgggtatcgatatcgtttaaattttcgtttttaacgggttacgttttgtattttacgtaaatgtacggaagtttttttcgttcgtagtttagttttggttttatcggttacgatttcgtttacggagtttgcgtaggcgtcgtcgcggggcgtggagaagttgtttttttgggataaggttcgcggggaatatttggaattttgatatcgttgtagtttgttttcgtcgcgt

SEQ ID NO: 4440 - DNA, 746 bp, Artificial Sequence
  chemically treated genomic DNA (Homo sapiens) CpG-island No: 4440
acgcgacgaaaacaaactacaacgatatcaaaattccaaatattccccgcgaaccttatcccaaaaaaacaacttctccacgccccgcgacgacgcctacgcaaactccgtaaacgaaatcgtaaccgataaaaccaaaactaaactacgaacgaaaaaaacttccgtacatttacgtaaaatacaaaacgtaacccgttaaaaacgaaaatttaaacgatatcgatacccgcccgaactccgtaaacgataaacgaaactacgtactctaaaatataaaataaaacgaaccccgcgacgacgacgcgactaacgtaaaacgtccgaattaacgaatacgacgaactacgaaattaaaaaacaacgaaccgaaccgaaccttcgaacccgaaacgacgacgacgatataaaaccgacgactaaaaacatataatatcgaaatacgaaaaccgcgacgacgacaacaacaacaacgaaaacgccgaaaacgaaaaaaaaaacgacgacgaccccgcgaactcaaactacctcaactcgaacccgaccctaaccacaacgtcctcgacgaaccgactccgtcgcgaactacgtaacgccttcctcataacgcgccaacgaccgaaactactctacgaaaccgtaacgctcgactacgcgctactcctcgccctcaaattcacctacaaataaaacgacccgaaccctaaaaccccgctaaaacgctccccttactctaccgcctaaaa

SEQ ID NO: 4441 - DNA, 698 bp, Artificial Sequence
  chemically treated genomic DNA (Homo sapiens) CpG-island No: 4441
gggagcgtcgtatttatattagttaatttagatttcgaggttcgatagcgttcggtttagatttttacgtttgttaggagtaagtcgagagttagtcggtcggcgtatttcgatttcgagtagtttttgtttttcgattcgagtttcgcgtttttttcgggatttttgtttcgcgggtagcgttgttaatttgtcggttatggagatttcgttttagcggcgcgttattcgtagcggggcgtaggttagttttatttcgttgtcgtttattcgtattattcggttgtaggagaaggaggatttgtaggagtttaatgatcgtttggcggtttatatcgatcgtgtgcgttcgttggaaacggagaacgtagggttgcgttttcgtattatcgagtttgaagaggtggttagtcgcgaggtgttcggtattaaggtcgtttacgaggtcgagttcggggatgttcgtaagatttttgatttagtagttaaggagcgcgttcgtttgtagttggagttgagtaaagtgcgtgaggagtttaaggagttgaaagcgcggtgagttcgtttaggtggttgcgtgtttggcggggagtggagagggcggcgggtcggcgtttttggtcggtcgtaggaagggagtgagagggtttggaggtcgataattttgttatagtttttttttttttcggaattgtttt

SEQ ID NO: 4442 - DNA, 698 bp, Artificial Sequence
  chemically treated genomic DNA (Homo sapiens) CpG-island No: 4442
aaaacaattccgaaaaaaaaaaaaactataacaaaattatcgacctccaaaccctctcactcccttcctacgaccgaccaaaaacgccgacccgccgccctctccactccccgccaaacacgcaaccacctaaacgaactcaccgcgctttcaactccttaaactcctcacgcactttactcaactccaactacaaacgaacgcgctccttaactactaaatcaaaaatcttacgaacatccccgaactcgacctcgtaaacgaccttaataccgaacacctcgcgactaaccacctcttcaaactcgataatacgaaaacgcaaccctacgttctccgtttccaacgaacgcacacgatcgatataaaccgccaaacgatcattaaactcctacaaatcctccttctcctacaaccgaataatacgaataaacgacaacgaaataaaactaacctacgccccgctacgaataacgcgccgctaaaacgaaatctccataaccgacaaattaacaacgctacccgcgaaacaaaaatcccgaaaaaaacgcgaaactcgaatcgaaaaacaaaaactactcgaaatcgaaatacgccgaccgactaactctcgacttactcctaacaaacgtaaaaatctaaaccgaacgctatcgaacctcgaaatctaaattaactaatataaatacgacgctccc

SEQ ID NO: 4443 - DNA, 698 bp, Artificial Sequence
  chemically treated genomic DNA (Homo sapiens) CpG-island No: 4443
ggggtagtttcggggagggaggagattatggtaaagttatcggtttttaggtttttttattttttttttgcggtcggttaggggcgtcggttcgtcgttttttttatttttcgttaggtacgtagttatttgggcgaatttatcgcgtttttagttttttaaattttttacgtattttgtttagttttagttgtaggcgggcgcgttttttggttattgagttaagggttttgcgggtattttcgagttcggtttcgtaggcggttttgatgtcggatatttcgcggttgattatttttttagattcggtgatgcgaaggcgtagttttgcgtttttcgtttttagcgagcgtatacggtcgatgtagatcgttaagcgattattgagtttttgtaggtttttttttttttgtagtcgggtgatgcgggtgggcgatagcggagtggagttggtttgcgtttcgttgcgggtggcgcgtcgttgggacggggtttttatggtcggtaggttggtagcgttgttcgcggggtaggggtttcggaaagggcgcggggttcgggtcgaaggatagagattgttcggagtcggagtgcgtcggtcggttggttttcggtttgtttttggtaggcgtggggatttgggtcgggcgttgtcggatttcgggatttgggttggttggtgtaggtgcggcgttttt

SEQ ID NO: 4444 - DNA, 698 bp, Artificial Sequence
  chemically treated genomic DNA (Homo sapiens) CpG-island No: 4444
aaaaacgccgcacctacaccaaccaacccaaatcccgaaatccgacaacgcccgacccaaatccccacgcctaccaaaaacaaaccgaaaaccaaccgaccgacgcactccgactccgaacaatctctatccttcgacccgaaccccgcgccctttccgaaacccctaccccgcgaacaacgctaccaacctaccgaccataaaaaccccgtcccaacgacgcgccacccgcaacgaaacgcaaaccaactccactccgctatcgcccacccgcatcacccgactacaaaaaaaaaaaaacctacaaaaactcaataatcgcttaacgatctacatcgaccgtatacgctcgctaaaaacgaaaaacgcaaaactacgccttcgcatcaccgaatctaaaaaaataatcaaccgcgaaatatccgacatcaaaaccgcctacgaaaccgaactcgaaaatacccgcaaaacccttaactcaataaccaaaaaacgcgcccgcctacaactaaaactaaacaaaatacgtaaaaaatttaaaaaactaaaaacgcgataaattcgcccaaataactacgtacctaacgaaaaataaaaaaaacgacgaaccgacgcccctaaccgaccgcaaaaaaaaaataaaaaaacctaaaaaccgataactttaccataatctcctccctccccgaaactacccc

SEQ ID NO: 4445 - DNA, 553 bp, Artificial Sequence
  chemically treated genomic DNA (Homo sapiens) CpG-island No: 4445
agtttcgttttttcgttgtttttagttttcgatgattttttcgttttcgttttgttcggtgatagacgttttattgtttttaatcggaggtatttttcgcgggagcggttaatcgggagtttcggtaggcggggaggtcgggttagttagatttggaggtttaattttaatatggtcgaagtaagtagcgttaatttaggtagcggttgtgaggaaaaaaggtatgaggggtcgttttcggaatttgtgttattcggtattattatttcgagggtgaagtttttcgatattatggtggatatttttttttagaagttggtcgtcgtcggtaggtaaagtggacgtagtcgcggtgggagtgtttgttggtatcgaagtttaaatttcgcgaggttaggacggtcgtaggttggcgcgcggtgacgtgggttcgcgttgggggcggggtagtcggacgaggcgatttagttaaattttgagttttaggagttagggtatttacgtattgataatttgtagcggatcgggatagttagttatttttttttatagg

SEQ ID NO: 4446 - DNA, 553 bp, Artificial Sequence
  chemically treated genomic DNA (Homo sapiens) CpG-island No: 4446
cctataaaaaaaaataactaactatcccgatccgctacaaattatcaatacgtaaataccctaactcctaaaactcaaaatttaactaaatcgcctcgtccgactaccccgcccccaacgcgaacccacgtcaccgcgcgccaacctacgaccgtcctaacctcgcgaaatttaaacttcgataccaacaaacactcccaccgcgactacgtccactttacctaccgacgacgaccaacttctaaaaaaaaatatccaccataatatcgaaaaacttcaccctcgaaataataataccgaataacacaaattccgaaaacgacccctcataccttttttcctcacaaccgctacctaaattaacgctacttacttcgaccatattaaaattaaacctccaaatctaactaacccgacctccccgcctaccgaaactcccgattaaccgctcccgcgaaaaatacctccgattaaaaacaataaaacgtctatcaccgaacaaaacgaaaacgaaaaaatcatcgaaaactaaaaacaacgaaaaaacgaaact

SEQ ID NO: 4447 - DNA, 553 bp, Artificial Sequence
  chemically treated genomic DNA (Homo sapiens) CpG-island No: 4447
tttgtaggaaggagtagttagttatttcggttcgttataggttattagtgcgtgaatattttgatttttaaggtttaggatttgattgggtcgtttcgttcgattgtttcgtttttaacgcggatttacgttatcgcgcgttagtttgcggtcgttttgatttcgcgggatttgagtttcggtgttaataaatatttttatcgcggttgcgtttattttatttgtcggcggcgattagtttttgaagaaaagtgtttattatggtgtcgaggagttttattttcgaaatggtagtgtcgggtggtatagatttcgaagacgattttttatgttttttttttttatagtcgttgtttagattggcgttatttgtttcggttatgttgaagttgaatttttaaatttaattggttcggttttttcgtttgtcggagttttcgattggtcgttttcgcgaagggtgttttcgattggaagtagtagaacgtttgttatcgagtagggcgggggcggggaagttatcggaggttgagggtagcggggaggcgaggtt

SEQ ID NO: 4448 - DNA, 553 bp, Artificial Sequence
  chemically treated genomic DNA (Homo sapiens) CpG-island No: 4448
aacctcgcctccccgctaccctcaacctccgataacttccccgcccccgccctactcgataacaaacgttctactacttccaatcgaaaacacccttcgcgaaaacgaccaatcgaaaactccgacaaacgaaaaaaccgaaccaattaaatttaaaaattcaacttcaacataaccgaaacaaataacgccaatctaaacaacgactataaaaaaaaaaaacataaaaaatcgtcttcgaaatctataccacccgacactaccatttcgaaaataaaactcctcgacaccataataaacacttttcttcaaaaactaatcgccgccgacaaataaaataaacgcaaccgcgataaaaatatttattaacaccgaaactcaaatcccgcgaaatcaaaacgaccgcaaactaacgcgcgataacgtaaatccgcgttaaaaacgaaacaatcgaacgaaacgacccaatcaaatcctaaaccttaaaaatcaaaatattcacgcactaataacctataacgaaccgaaataactaactactccttcctacaaa

SEQ ID NO: 4449 - DNA, 1128 bp, Artificial Sequence
  chemically treated genomic DNA (Homo sapiens) CpG-island No: 4449
gtttttgataaagtattaaaggatttatacgggagaaaagtcgtttgagtgtgatatttgtgggaagtattttatcgagcgttcgttttttattatttattagcgggtgtatacgggcgagaagttttatgtttgcggggattgcggtaaggtttttagttagcgtatgaattttattgtgtattagcgtacgtatacgggcgagaagtcgtatgtgtgcgacgtgtgtggtaaggtttttcggaagatttttttttttatttagtacgagcggatttatacgggggagaagttttacgcgtgcggggattgcggtaaggtttttagttagaatatgtattttatcgtgtattagcgtacgtatatcggggagaagtcgtacgtgtgtttcgagtgcgggcgagtttttagttagaatatgtatttgatcgagtattagcgtacgtatatcggggagaagtcgtacgtttgtaaggagtgcggtaaggtttttaataagagtttttcgtttattttgtattagaggaattatatcggcgagaagttttacgtgtgcggcgagtgcggtaaggtttttagttagagtttttattttatttagtattagcgtttttatatcggcgtgaagtcgttcgagtgtagcgagtgcggtaaggtttttagtaagaatttttcgtttacgtagtattagcgtatttatatcggcgagaagttttacgagtgttatatttgtaagaagtattttacggggcgttcgttttttatcgtgtattagatcgtgtatatcggggagaagttttacgtgtgcggcgagtgcggtaaggtttttagttagagcgtttattttatcgagtattagcggatttatatcggcgagaagtcgtataggtgcggttagtgcgggaagttttttattaagaattttttttttattgtgtattagcggatttatacgggcgagaagttttatcgatgcggcgagtgcgggaagatttttagtcgtaatacgaatttgacgcgttatttgcggatttatatttgagcgtttttgtgtagggtttttattggcggtgtttaggacggacgttagatggttgcgcgttttgttagtagtgttgtgagaagttt

SEQ ID NO: 4450 - DNA, 1128 bp, Artificial Sequence
  chemically treated genomic DNA (Homo sapiens) CpG-island No: 4450
aaacttctcacaacactactaacaaaacgcgcaaccatctaacgtccgtcctaaacaccgccaataaaaaccctacacaaaaacgctcaaatataaatccgcaaataacgcgtcaaattcgtattacgactaaaaatcttcccgcactcgccgcatcgataaaacttctcgcccgtataaatccgctaatacacaataaaaaaaaaattcttaataaaaaacttcccgcactaaccgcacctatacgacttctcgccgatataaatccgctaatactcgataaaataaacgctctaactaaaaaccttaccgcactcgccgcacacgtaaaacttctccccgatatacacgatctaatacacgataaaaaacgaacgccccgtaaaatacttcttacaaatataacactcgtaaaacttctcgccgatataaatacgctaatactacgtaaacgaaaaattcttactaaaaaccttaccgcactcgctacactcgaacgacttcacgccgatataaaaacgctaatactaaataaaataaaaactctaactaaaaaccttaccgcactcgccgcacacgtaaaacttctcgccgatataattcctctaatacaaaataaacgaaaaactcttattaaaaaccttaccgcactccttacaaacgtacgacttctccccgatatacgtacgctaatactcgatcaaatacatattctaactaaaaactcgcccgcactcgaaacacacgtacgacttctccccgatatacgtacgctaatacacgataaaatacatattctaactaaaaaccttaccgcaatccccgcacgcgtaaaacttctcccccgtataaatccgctcgtactaaataaaaaaaaaaatcttccgaaaaaccttaccacacacgtcgcacacatacgacttctcgcccgtatacgtacgctaatacacaataaaattcatacgctaactaaaaaccttaccgcaatccccgcaaacataaaacttctcgcccgtatacacccgctaataaataataaaaaacgaacgctcgataaaatacttcccacaaatatcacactcaaacgacttttctcccgtataaatcctttaatactttatcaaaaac

SEQ ID NO: 4451 - DNA, 1128 bp, Artificial Sequence
  chemically treated genomic DNA (Homo sapiens) CpG-island No: 4451
gaattttttatagtattgttgataaagcgcgtagttatttggcgttcgttttgggtatcgttagtgagagttttgtatagaggcgtttaggtgtgaattcgtaggtggcgcgttaggttcgtgttgcggttgaaggttttttcgtattcgtcgtatcggtagggtttttcgttcgtgtggattcgttggtgtatagtgagggaggagtttttgatgaaggatttttcgtattggtcgtatttgtacggtttttcgtcggtgtggattcgttggtgttcgatgaggtaggcgttttggttgaaggttttgtcgtattcgtcgtatacgtagggttttttttcggtgtgtacgatttggtgtacgatgagggacgagcgtttcgtgaagtgttttttgtagatgtagtattcgtagggtttttcgtcggtgtggatgcgttggtgttgcgtgagcgaggagtttttgttgaaggttttgtcgtattcgttgtattcgaacggttttacgtcgatgtggaagcgttggtgttggatgaggtaggagttttggttgaaggttttgtcgtattcgtcgtatacgtagggtttttcgtcggtgtggtttttttggtgtagggtgagcgaggagtttttgttgaaggttttgtcgtattttttgtaggcgtacggttttttttcggtgtgcgtgcgttggtgttcggttaggtgtatgttttggttgaaggttcgttcgtattcggggtatacgtacggttttttttcggtgtgcgtgcgttggtgtacgatgaggtgtatgttttggttgaaggttttgtcgtagttttcgtacgcgtagggtttttttttcgtgtggattcgttcgtgttgggtgagagaggaagtttttcggaaggttttgttatatacgtcgtatatatacggtttttcgttcgtgtgcgtgcgttggtgtatagtgaggtttatgcgttggttgaaggttttgtcgtagttttcgtaggtatagggtttttcgttcgtgtgtattcgttggtggatggtgagggacgagcgttcgatgaagtgttttttataggtgttatatttaaacggtttttttttcgtgtggattttttggtgttttattagggat

SEQ ID NO: 4452 - DNA, 1128 bp, Artificial Sequence
  chemically treated genomic DNA (Homo sapiens) CpG-island No: 4452
atccctaataaaacaccaaaaaatccacacgaaaaaaaaaccgtttaaatataacacctataaaaaacacttcatcgaacgctcgtccctcaccatccaccaacgaatacacacgaacgaaaaaccctatacctacgaaaactacgacaaaaccttcaaccaacgcataaacctcactatacaccaacgcacgcacacgaacgaaaaaccgtatatatacgacgtatataacaaaaccttccgaaaaacttcctctctcacccaacacgaacgaatccacacgaaaaaaaaaccctacgcgtacgaaaactacgacaaaaccttcaaccaaaacatacacctcatcgtacaccaacgcacgcacaccgaaaaaaaaccgtacgtataccccgaatacgaacgaaccttcaaccaaaacatacacctaaccgaacaccaacgcacgcacaccgaaaaaaaaccgtacgcctacaaaaaatacgacaaaaccttcaacaaaaactcctcgctcaccctacaccaaaaaaaccacaccgacgaaaaaccctacgtatacgacgaatacgacaaaaccttcaaccaaaactcctacctcatccaacaccaacgcttccacatcgacgtaaaaccgttcgaatacaacgaatacgacaaaaccttcaacaaaaactcctcgctcacgcaacaccaacgcatccacaccgacgaaaaaccctacgaatactacatctacaaaaaacacttcacgaaacgctcgtccctcatcgtacaccaaatcgtacacaccgaaaaaaaaccctacgtatacgacgaatacgacaaaaccttcaaccaaaacgcctacctcatcgaacaccaacgaatccacaccgacgaaaaaccgtacaaatacgaccaatacgaaaaatccttcatcaaaaactcctccctcactatacaccaacgaatccacacgaacgaaaaaccctaccgatacgacgaatacgaaaaaaccttcaaccgcaacacgaacctaacgcgccacctacgaattcacacctaaacgcctctatacaaaactctcactaacgatacccaaaacgaacgccaaataactacgcgctttatcaacaatactataaaaaattc

SEQ ID NO: 4453 - DNA, 1155 bp, Artificial Sequence
  chemically treated genomic DNA (Homo sapiens) CpG-island No: 4453
atgagcgcggaggagaagttgaaggttttttcgtagtcgttgtattcgtagggttttttttcggtgtgtacgatgtggtgttggattaggtaggagcggttgttgaaggttttgtcgtattcggggtaggtgtagggtcgttcgttcgtgtgcgtgcgttggtgtagggcgagcgaggagttttggttgaaagttttgtcgtattcgtcgtatttgtagggtcgtttttcggtgtggattttttggtgttttataagcgaggatacgtggttgaaggcggtttcgtattgtaggtatttgtagggtcgtttatcggtgtgtacgaggcggtgttggaggaggtgggagcggttgttgaagcgtttgtcgtagtcgtggtaggggtaaggtcgtttttcggtgtgcgtgcgttggtgttgcgttaggtgcgatatttgggtgaaggttttggcgtattggtcgtacgcgtagggtttttcgtttgtgtggatgcgtcggtgttcggttagagaggcgttttggttgaagagcgcgtcgtagttttggtacgtgtagggtttttcgttcgtgtgtacgcgtcggtgttgggttaggtgcgcgatttgcgcgaaggttttggcgtattggtcgtagcggtagggtttttttttcgtgtggatgcgttggtggcggatgagcgttgaggagaagcggaaggttttggcgtacgcggagtattcgtagggttttttatcggtgtggatgcgttggtgttttattagggacgagcggttgcggaacgttttggcgtattgggcgtacgcgtagggtcgttcgttcgtgtgtacgcgtcggtgttgggttaggtgcgtgacgcgcgtgaaggttttgtcgtagtcggcgtagcggtgcggtttttcgttcgtgtgcgtgcgttagtgggacgttaggtacgagttttggttgaaggttttgtcgtattcgtggtaggcgtagggtttttcgttcgtgtgcgtgcgttggtgtagggttaggtgtacgttttggttgaaggttttgtcgtattcggggtacgtaaatggttttttttcggtgtggattttttggtgtaagatgaacgttgaatagtagttgaaggttttttcgtagttttcgtatttttacggttttttgggg

SEQ ID NO: 4454 - DNA, 1155 bp, Artificial Sequence
  chemically treated genomic DNA (Homo sapiens) CpG-island No: 4454
ccccaaaaaaccgtaaaaatacgaaaactacgaaaaaaccttcaactactattcaacgttcatcttacaccaaaaaatccacaccgaaaaaaaaccatttacgtaccccgaatacgacaaaaccttcaaccaaaacgtacacctaaccctacaccaacgcacgcacacgaacgaaaaaccctacgcctaccacgaatacgacaaaaccttcaaccaaaactcgtacctaacgtcccactaacgcacgcacacgaacgaaaaaccgcaccgctacgccgactacgacaaaaccttcacgcgcgtcacgcacctaacccaacaccgacgcgtacacacgaacgaacgaccctacgcgtacgcccaatacgccaaaacgttccgcaaccgctcgtccctaataaaacaccaacgcatccacaccgataaaaaaccctacgaatactccgcgtacgccaaaaccttccgcttctcctcaacgctcatccgccaccaacgcatccacacgaaaaaaaaaccctaccgctacgaccaatacgccaaaaccttcgcgcaaatcgcgcacctaacccaacaccgacgcgtacacacgaacgaaaaaccctacacgtaccaaaactacgacgcgctcttcaaccaaaacgcctctctaaccgaacaccgacgcatccacacaaacgaaaaaccctacgcgtacgaccaatacgccaaaaccttcacccaaatatcgcacctaacgcaacaccaacgcacgcacaccgaaaaacgaccttacccctaccacgactacgacaaacgcttcaacaaccgctcccacctcctccaacaccgcctcgtacacaccgataaacgaccctacaaatacctacaatacgaaaccgccttcaaccacgtatcctcgcttataaaacaccaaaaaatccacaccgaaaaacgaccctacaaatacgacgaatacgacaaaactttcaaccaaaactcctcgctcgccctacaccaacgcacgcacacgaacgaacgaccctacacctaccccgaatacgacaaaaccttcaacaaccgctcctacctaatccaacaccacatcgtacacaccgaaaaaaaaccctacgaatacaacgactacgaaaaaaccttcaacttctcctccgcgctcat

SEQ ID NO: 4455 - DNA, 1155 bp, Artificial Sequence
  chemically treated genomic DNA (Homo sapiens) CpG-island No: 4455
ttttaagaagtcgtggaaatgcggggattgcgggaaggtttttagttattgtttagcgtttattttatattagagaatttatatcggggagaagttatttgcgtgtttcgagtgcggtaaggtttttagttagagcgtgtatttgattttgtattagcgtacgtatacgggcgagaagttttacgtttgttacgagtgcggtaaggtttttagttagggttcgtatttggcgttttattggcgtacgtatacgggcgagaagtcgtatcgttgcgtcgattgcggtaaggtttttacgcgcgttacgtatttgatttagtatcggcgcgtgtatacgggcgagcggttttacgcgtgcgtttagtgcgttaaggcgtttcgtaatcgttcgtttttgatagagtattagcgtatttatatcggtgagaagttttacgagtgtttcgcgtgcgttaaggtttttcgtttttttttagcgtttattcgttattagcgtatttatacggaggagaagttttatcgttgcggttagtgcgttaaggttttcgcgtagatcgcgtatttgatttagtatcggcgcgtgtatacgggcgagaagttttatacgtgttaggattgcggcgcgttttttagttagagcgtttttttggtcgagtatcggcgtatttatataggcgagaagttttacgcgtgcggttagtgcgttaaggtttttatttaggtgtcgtatttgacgtagtattagcgtacgtatatcggagagcggttttatttttgttacgattgcggtaagcgttttagtaatcgtttttattttttttagtatcgtttcgtgtatatcggtgagcggttttataggtgtttgtaatgcggggtcgtttttagttacgtgttttcgtttatagagtattagaagatttatatcggagagcggttttataagtgcggcgagtgcggtaaagtttttagttagggtttttcgttcgttttgtattagcgtacgtatacgggcgagcggttttatatttgtttcgagtgcggtaaggtttttagtaatcgtttttatttgatttagtattatatcgtgtatatcggggagaagttttacgagtgtagcggttgcgggaaggtttttagtttttttttcgcgtttat

SEQ ID NO: 4456 - DNA, 1155 bp, Artificial Sequence
  chemically treated genomic DNA (Homo sapiens) CpG-island No: 4456
ataaacgcgaaaaaaaaactaaaaaccttcccgcaaccgctacactcgtaaaacttctccccgatatacacgatataatactaaatcaaataaaaacgattactaaaaaccttaccgcactcgaaacaaatataaaaccgctcgcccgtatacgtacgctaatacaaaacgaacgaaaaaccctaactaaaaactttaccgcactcgccgcacttataaaaccgctctccgatataaatcttctaatactctataaacgaaaacacgtaactaaaaacgaccccgcattacaaacacctataaaaccgctcaccgatatacacgaaacgatactaaaaaaaataaaaacgattactaaaacgcttaccgcaatcgtaacaaaaataaaaccgctctccgatatacgtacgctaatactacgtcaaatacgacacctaaataaaaaccttaacgcactaaccgcacgcgtaaaacttctcgcctatataaatacgccgatactcgaccaaaaaaacgctctaactaaaaaacgcgccgcaatcctaacacgtataaaacttctcgcccgtatacacgcgccgatactaaatcaaatacgcgatctacgcgaaaaccttaacgcactaaccgcaacgataaaacttctcctccgtataaatacgctaataacgaataaacgctaaaaaaaaacgaaaaaccttaacgcacgcgaaacactcgtaaaacttctcaccgatataaatacgctaatactctatcaaaaacgaacgattacgaaacgccttaacgcactaaacgcacgcgtaaaaccgctcgcccgtatacacgcgccgatactaaatcaaatacgtaacgcgcgtaaaaaccttaccgcaatcgacgcaacgatacgacttctcgcccgtatacgtacgccaataaaacgccaaatacgaaccctaactaaaaaccttaccgcactcgtaacaaacgtaaaacttctcgcccgtatacgtacgctaatacaaaatcaaatacacgctctaactaaaaaccttaccgcactcgaaacacgcaaataacttctccccgatataaattctctaatataaaataaacgctaaacaataactaaaaaccttcccgcaatccccgcatttccacgacttcttaaaa

SEQ ID NO: 4457 - DNA, 852 bp, Artificial Sequence
  chemically treated genomic DNA (Homo sapiens) CpG-island No: 4457
ggtcgaggagtagcgaggtgtaggggttgcgagggtcgagtcgggcgttgagggttcggtagggggcgtggagggggcggggtcggatgtggcgtggcgtaggaaatttgagggtcgtttttggtcgcgcgtttcgtttcgttttcgttttttggtttcgtttttaggttcgttttcgcgttttttttttttcggagttggtaggcgggcgcggcggcggcgggtagcggacgggcggattgacgggcgtttttattttgttttttttttggttgtcggtttttttttgtttttttgggcggcgatgagcgtagggtcggcgtagtagttgcgggcgtacggaggtaacgcgttgttagttatttttttcggtttcggcgcgttatgtgtcggtagcgttcgggttcgttgtagcgtcgtcggcgtcgaatttgggttcgggaagtacggcggatcgcgttttgcgtcggagtaggtagggaaggggcgggttgcggtttgttggttgttgaagtgtgtttcgggcgtgtgtattcggcgtgtgtatcggcgagcgttgcgattcggttttttgcgtgtgtgttgtgcgcgcgtgtgtgtgttcgggagtgttcgcgtttttttgcgcggtggagttgtgggtgattgcggacggtggtgtgtttttcgaatggcgtgtattcgtgggtatttatgtgtgttttaggtgtgtatattttggattgcgtttgtggaattgtgtgtcggggcgtagttgttggtggggagcggtgtttggcgggtgtcgtgtgtgagtagttgtgcgtagagcggggtggcggggtgggtgtgggtggtttagttttacgttta

SEQ ID NO: 4458 - DNA, 852 bp, Artificial Sequence
  chemically treated genomic DNA (Homo sapiens) CpG-island No: 4458
taaacgtaaaactaaaccacccacacccaccccgccaccccgctctacgcacaactactcacacacgacacccgccaaacaccgctccccaccaacaactacgccccgacacacaattccacaaacgcaatccaaaatatacacacctaaaacacacataaatacccacgaatacacgccattcgaaaaacacaccaccgtccgcaatcacccacaactccaccgcgcaaaaaaacgcgaacactcccgaacacacacacgcgcgcacaacacacacgcaaaaaaccgaatcgcaacgctcgccgatacacacgccgaatacacacgcccgaaacacacttcaacaaccaacaaaccgcaacccgccccttccctacctactccgacgcaaaacgcgatccgccgtacttcccgaacccaaattcgacgccgacgacgctacaacgaacccgaacgctaccgacacataacgcgccgaaaccgaaaaaaataactaacaacgcgttacctccgtacgcccgcaactactacgccgaccctacgctcatcgccgcccaaaaaaacaaaaaaaaaccgacaaccaaaaaaaaaacaaaataaaaacgcccgtcaatccgcccgtccgctacccgccgccgccgcgcccgcctaccaactccgaaaaaaaaaaaacgcgaaaacgaacctaaaaacgaaaccaaaaaacgaaaacgaaacgaaacgcgcgaccaaaaacgaccctcaaatttcctacgccacgccacatccgaccccgccccctccacgccccctaccgaaccctcaacgcccgactcgaccctcgcaacccctacacctcgctactcctcgacc

SEQ ID NO: 4459 - DNA, 852 bp, Artificial Sequence
  chemically treated genomic DNA (Homo sapiens) CpG-island No: 4459
tgggcgtggggttggattatttatatttatttcgttatttcgttttgcgtatagttgtttatatacgatattcgttaggtatcgttttttattagtaattgcgtttcgatatataattttataaacgtagtttaaaatgtgtatatttaaggtatatatggatgtttacgagtatacgttattcgaaagatatattatcgttcgtagttatttataattttatcgcgtagagaaacgcgggtattttcggatatatatacgcgcgtataatatatacgtaaagagtcggatcgtagcgttcgtcggtgtatacgtcgggtgtatacgttcggggtatattttagtagttagtagatcgtagttcgttttttttttatttgtttcggcgtaggacgcggttcgtcgtgtttttcgagtttaagttcggcgtcggcggcgttgtagcgggttcgggcgttgtcgatatatagcgcgtcgaggtcgggaggagtgattagtagcgcgttgttttcgtgcgttcgtagttgttgcgtcggttttgcgtttatcgtcgtttagaaagataaaaggaagtcggtagttagggagggagtaaggtggaggcgttcgttagttcgttcgttcgttgttcgtcgtcgtcgcgttcgtttgttagtttcgggaaggaagggacgcgaaggcggatttggaggcgggattaggaggcgggggcggggcggggcgcgcggttagaggcggtttttaagttttttacgttacgttatattcggtttcgttttttttacgttttttgtcggatttttagcgttcggttcggttttcgtagtttttgtatttcgttgtttttcggtt

SEQ ID NO: 4460 - DNA, 852 bp, Artificial Sequence
  chemically treated genomic DNA (Homo sapiens) CpG-island No: 4460
aaccgaaaaacaacgaaatacaaaaactacgaaaaccgaaccgaacgctaaaaatccgacaaaaaacgtaaaaaaaacgaaaccgaatataacgtaacgtaaaaaacttaaaaaccgcctctaaccgcgcgccccgccccgcccccgcctcctaatcccgcctccaaatccgccttcgcgtcccttccttcccgaaactaacaaacgaacgcgacgacgacgaacaacgaacgaacgaactaacgaacgcctccaccttactccctccctaactaccgacttccttttatctttctaaacgacgataaacgcaaaaccgacgcaacaactacgaacgcacgaaaacaacgcgctactaatcactcctcccgacctcgacgcgctatatatcgacaacgcccgaacccgctacaacgccgccgacgccgaacttaaactcgaaaaacacgacgaaccgcgtcctacgccgaaacaaataaaaaaaaaacgaactacgatctactaactactaaaatataccccgaacgtatacacccgacgtatacaccgacgaacgctacgatccgactctttacgtatatattatacgcgcgtatatatatccgaaaatacccgcgtttctctacgcgataaaattataaataactacgaacgataatatatctttcgaataacgtatactcgtaaacatccatatataccttaaatatacacattttaaactacgtttataaaattatatatcgaaacgcaattactaataaaaaacgatacctaacgaatatcgtatataaacaactatacgcaaaacgaaataacgaaataaatataaataatccaaccccacgccca

SEQ ID NO: 4461 - DNA, 1164 bp, Artificial Sequence
  chemically treated genomic DNA (Homo sapiens) CpG-island No: 4461
gaggcgggaggtgcggtacggatttgaaaggacgcgtaggatgtggacgaaagaagagagttaaggagagggagaagaagggaggtagtggggaaagaaagggaagagataaagattggaggcggcgggaaggatgtaagaatgtttaggcgcggggtcgcggttgggagggggttgcggggatcggcgcgtttttgggaagtcgcgggttgcgttttacgcgcgggcgtcggggacgcggggtgcgttcgtcgtttattttttaggatgagggtgtcgatgtttcggtcgatgtttaggaagtagtattttttttagaggttcgagtaggtggcgaagaggggtcggtcgtattcgcgtttagttcgtcgagttttaggagcgagcgttaggattcggggtcggcgcgtttcgggtcgttcgggagtagtcggcgttttagcgggggcgagtttcgtagcggtaggtgcgatagcggtattaggcggtttttttggttcggggggtcggcgttcgcgtcggttgcgttcgtagttttttttgtggcgtcgggggtcggtttcgtattagtggtcggtgaagatggtcgtgacgagtagttttagggagtataggttgaggtcgaggttgagcgtcgtgacgagcgttcgcggttttatggtttttcgtttcgtcgtagtcgtcggtgggttcgcgcgtcgtcgttagatataatgtatttggttttagtttttcgttcgtttttttttttttttttttatttgttttttattttttttttacggttttttcgttttgcgagttcggttcggttcgtttttttttttttggtttgatttcgttttttatcgttcgttcgttttcggttcggttttcgggtttttagttttttttcgcgtcgttttcgtttttttgtttttttttttttttttagtttttttttttcgtttcggcgttttttatttcgcgtatttttttcgtttttttttttattttcgatttatagttcgtttttttttttagcgattttttttttttttttaattttttttcgtcgtttttatttttttttttttttttaattttgtttttattttttttcgatttttttttaatttttttttttatatttttttttatttatttgtttttttgtttttcggt

SEQ ID NO: 4462 - DNA, 1164 bp, Artificial Sequence
  chemically treated genomic DNA (Homo sapiens) CpG-island No: 4462
accgaaaaacaaaaaaacaaataaataaaaaaaaatataaaaaaaaaaattaaaaaaaaatcgaaaaaaaataaaaacaaaattaaaaaaaaaaaaaaaaataaaaacgacgaaaaaaaattaaaaaaaaaaaaaaaatcgctaaaaaaaaaaacgaactataaatcgaaaataaaaaaaaaaacgaaaaaaatacgcgaaataaaaaacgccgaaacgaaaaaaaaaaactaaaaaaaaaaaaaaaaacaaaaaaacgaaaacgacgcgaaaaaaaactaaaaacccgaaaaccgaaccgaaaacgaacgaacgataaaaaacgaaatcaaaccaaaaaaaaaaaaacgaaccgaaccgaactcgcaaaacgaaaaaaccgtaaaaaaaaaataaaaaacaaataaaaaaaaaaaaaaaaaaacgaacgaaaaactaaaaccaaatacattatatctaacgacgacgcgcgaacccaccgacgactacgacgaaacgaaaaaccataaaaccgcgaacgctcgtcacgacgctcaacctcgacctcaacctatactccctaaaactactcgtcacgaccatcttcaccgaccactaatacgaaaccgacccccgacgccacaaaaaaaactacgaacgcaaccgacgcgaacgccgaccccccgaaccaaaaaaaccgcctaataccgctatcgcacctaccgctacgaaactcgcccccgctaaaacgccgactactcccgaacgacccgaaacgcgccgaccccgaatcctaacgctcgctcctaaaactcgacgaactaaacgcgaatacgaccgacccctcttcgccacctactcgaacctctaaaaaaaatactacttcctaaacatcgaccgaaacatcgacaccctcatcctaaaaaataaacgacgaacgcaccccgcgtccccgacgcccgcgcgtaaaacgcaacccgcgacttcccaaaaacgcgccgatccccgcaaccccctcccaaccgcgaccccgcgcctaaacattcttacatccttcccgccgcctccaatctttatctcttccctttctttccccactacctcccttcttctccctctccttaactctcttctttcgtccacatcctacgcgtcctttcaaatccgtaccgcacctcccgcctc

SEQ ID NO: 4463 - DNA, 1164 bp, Artificial Sequence
  chemically treated genomic DNA (Homo sapiens) CpG-island No: 4463
gtcggggagtagaggagtaaatgagtgggggaaagtgtgagaggaagagttggagaaaagtcgggggaaagtagggatagggttaaggggagagaggaggatgagggcggcgaggagagattaaaaggggaaggggggtcgttggagaggagggcggattgtggatcggaggtagggagaggggcgagaggagtgcgcggggtggggggcgtcggggcgaggagagggggttggggaagaggaggggggtaagaaagcgagagcggcgcgggggagggttaggagttcgggggtcgggtcgggggcgggcgggcggtgggaggcgagattaggttaggggagagggagcgagtcgggtcgggttcgtagggcgaggaggtcgtaggagggaggtggggggtaggtggggggaagagggagggagcgggcggagagttggggttaagtgtattgtgtttggcggcggcgcgcgagtttatcggcggttgcggcggggcgggaagttatggagtcgcgggcgttcgttacggcgtttagtttcggttttagtttgtgttttttggggttgttcgttacggttatttttatcgattattggtacgagatcgattttcggcgttataaggagagttgcgagcgtagtcggcgcgggcgtcgatttttcggattagaagaatcgtttgatgtcgttgtcgtatttgtcgttgcgggattcgttttcgttggggcgtcggttgttttcgggcggttcggggcgcgtcgatttcgagttttggcgttcgtttttggggttcggcgggttggacgcgagtgcggtcggttttttttcgttatttattcgggtttttggaggaagtgttattttttgggtatcgatcgggatatcgatatttttattttgaaaggtgagcggcgggcgtatttcgcgttttcggcgttcgcgcgtggagcgtagttcgcggttttttaggggcgcgtcggttttcgtagtttttttttagtcgcggtttcgcgtttgggtatttttgtatttttttcgtcgtttttagtttttattttttttttttttttttttattgtttttttttttttttttttttttgatttttttttttcgtttatattttgcgcgtttttttaagttcgtgtcgtatttttcgtttt

SEQ ID NO: 4464 - DNA, 1164 bp, Artificial Sequence
  chemically treated genomic DNA (Homo sapiens) CpG-island No: 4464
aaaacgaaaaatacgacacgaacttaaaaaaacgcgcaaaatataaacgaaaaaaaaaaatcaaaaaaaaaaaaaaaaaaaaaaacaataaaaaaaaaaaaaaaaaaaataaaaactaaaaacgacgaaaaaaatacaaaaatacccaaacgcgaaaccgcgactaaaaaaaaactacgaaaaccgacgcgcccctaaaaaaccgcgaactacgctccacgcgcgaacgccgaaaacgcgaaatacgcccgccgctcacctttcaaaataaaaatatcgatatcccgatcgatacccaaaaaataacacttcctccaaaaacccgaataaataacgaaaaaaaaccgaccgcactcgcgtccaacccgccgaaccccaaaaacgaacgccaaaactcgaaatcgacgcgccccgaaccgcccgaaaacaaccgacgccccaacgaaaacgaatcccgcaacgacaaatacgacaacgacatcaaacgattcttctaatccgaaaaatcgacgcccgcgccgactacgctcgcaactctccttataacgccgaaaatcgatctcgtaccaataatcgataaaaataaccgtaacgaacaaccccaaaaaacacaaactaaaaccgaaactaaacgccgtaacgaacgcccgcgactccataacttcccgccccgccgcaaccgccgataaactcgcgcgccgccgccaaacacaatacacttaaccccaactctccgcccgctccctccctcttccccccacctaccccccacctccctcctacgacctcctcgccctacgaacccgacccgactcgctccctctcccctaacctaatctcgcctcccaccgcccgcccgcccccgacccgacccccgaactcctaaccctcccccgcgccgctctcgctttcttacccccctcctcttccccaaccccctctcctcgccccgacgccccccaccccgcgcactcctctcgcccctctccctacctccgatccacaatccgccctcctctccaacgaccccccttccccttttaatctctcctcgccgccctcatcctcctctctccccttaaccctatccctactttcccccgacttttctccaactcttcctctcacactttcccccactcatttactcctctactccccgac

SEQ ID NO: 4465 - DNA, 733 bp, Artificial Sequence
  chemically treated genomic DNA (Homo sapiens) CpG-island No: 4465
cgcgaggggttttcggttttacggggggcgtaggttataaagtacgtttcgttttggaacgttttgaggagataaaagtcgcgtaggtttcgcgttcgtcgcgtatttcgatcgtttcgacgagggagttttgtattcgttgaaaatgattcgaaagttgtttcgttttttcgttttttaatttcggcgttcgttcggcgttatttcgtagttttttggtagtcggtttttttttttttttattcgtttttcgtttttggattcgtagattacgtttttgttttagtttatttattcgtttttttgttttatttgttattcgtttttgaattaattcgttttcgtttattatttcgttttgggtatcgttttgtcgagttttttttgtttgaatttttataagatttgtatttgtcgtttttatgttcgttggggttttaatttttattacgtttttttttatttttttacgttttcgtttagtttttgtttttagaagttgtttatagttcgttttcgtttagttatttacgcggttttgacgatttacgattttacggaggggtttttgtaggtatcgtgttcgggtagcgaaggagcggattttagggttttcgcggtttggttgtggatacggggacgtaggattacggatatttattttcggttttcgttgtttgtttagttagtcgcgttagtttttgtatttggtaatggttttttcgtgggtttt

SEQ ID NO: 4466 - DNA, 733 bp, Artificial Sequence
  chemically treated genomic DNA (Homo sapiens) CpG-island No: 4466
aaaacccacgaaaaaaccattaccaaatacaaaaactaacgcgactaactaaacaaacaacgaaaaccgaaaataaatatccgtaatcctacgtccccgtatccacaaccaaaccgcgaaaaccctaaaatccgctccttcgctacccgaacacgatacctacaaaaacccctccgtaaaatcgtaaatcgtcaaaaccgcgtaaataactaaacgaaaacgaactataaacaacttctaaaaacaaaaactaaacgaaaacgtaaaaaaataaaaaaaaacgtaataaaaattaaaaccccaacgaacataaaaacgacaaatacaaatcttataaaaattcaaacaaaaaaaactcgacaaaacgatacccaaaacgaaataataaacgaaaacgaattaattcaaaaacgaataacaaataaaacaaaaaaacgaataaataaactaaaacaaaaacgtaatctacgaatccaaaaacgaaaaacgaataaaaaaaaaaaaaaaccgactaccaaaaaactacgaaataacgccgaacgaacgccgaaattaaaaaacgaaaaaacgaaacaactttcgaatcattttcaacgaatacaaaactccctcgtcgaaacgatcgaaatacgcgacgaacgcgaaacctacgcgacttttatctcctcaaaacgttccaaaacgaaacgtactttataacctacgccccccgtaaaaccgaaaacccctcgcg

SEQ ID NO: 4467 - DNA, 733 bp, Artificial Sequence
  chemically treated genomic DNA (Homo sapiens) CpG-island No: 4467
aaggtttacggggaagttattgttaaatgtagaggttggcgcggttggttgagtaggtagcggaggtcgagggtgggtgttcgtggttttgcgttttcgtgtttatagttaggtcgcggggattttagggttcgttttttcgttgttcgagtacggtgtttgtaggggttttttcgtggggtcgtggatcgttagggtcgcgtgggtggttgggcgggggcgggttgtaggtagtttttaaaagtaggggttgggcgggggcgtggggggatagggagggacgtagtggaagttggggttttaacggatatgagggcggtagatgtagattttatgaagatttaggtaggaagagttcggtagggcgatgtttaagacggggtagtggacggggacgaattggtttagagacgggtagtagatggggtagaaggacgagtaggtgggttggaataggagcgtagtttgcgggtttagaaacgggggacggatgggaggaaagaagagtcgattgttagggagttgcggggtggcgtcgagcgggcgtcggggttgggaggcggagaggcggggtagttttcgagttatttttagcgagtgtaaagttttttcgtcggaacggtcggagtgcgcggcgagcgcggggtttgcgcggtttttatttttttagggcgttttagggcggaacgtgttttgtgatttgcgtttttcgtgaagtcgggagtttttcgcg

SEQ ID NO: 4468 - DNA, 733 bp, Artificial Sequence
  chemically treated genomic DNA (Homo sapiens) CpG-island No: 4468
cgcgaaaaactcccgacttcacgaaaaacgcaaatcacaaaacacgttccgccctaaaacgccctaaaaaaataaaaaccgcgcaaaccccgcgctcgccgcgcactccgaccgttccgacgaaaaaactttacactcgctaaaaataactcgaaaactaccccgcctctccgcctcccaaccccgacgcccgctcgacgccaccccgcaactccctaacaatcgactcttctttcctcccatccgtcccccgtttctaaacccgcaaactacgctcctattccaacccacctactcgtccttctaccccatctactacccgtctctaaaccaattcgtccccgtccactaccccgtcttaaacatcgccctaccgaactcttcctacctaaatcttcataaaatctacatctaccgccctcatatccgttaaaaccccaacttccactacgtccctccctatccccccacgcccccgcccaacccctacttttaaaaactacctacaacccgcccccgcccaaccacccacgcgaccctaacgatccacgaccccacgaaaaaacccctacaaacaccgtactcgaacaacgaaaaaacgaaccctaaaatccccgcgacctaactataaacacgaaaacgcaaaaccacgaacacccaccctcgacctccgctacctactcaaccaaccgcgccaacctctacatttaacaataacttccccgtaaacctt

SEQ ID NO: 4469 - DNA, 736 bp, Artificial Sequence
  chemically treated genomic DNA (Homo sapiens) CpG-island No: 4469
tcggggttcgttcgtttgtattaaggcgagttcgggttttgcgtttttgtatttgttgcgcggtcgttagggtttttttaacggtttttcggttagcgcgcggtcgtcgaagggttgggaaagaggtcggcgcggggtcgtagggttttcgggtgggttttttttaggtttttttagtttcgagttgtgaagacgggggtagaacgaggcgttcggattatttttatttagtcgcgggagaatttcgggtcgggaggaagcggcgttttaaggtcgtggttcgttcggcgattacgtgttttcgtaggtcggcgaggcgcgtcgtatacgtgttcggggttcgggtttcgtagttcgtttcggttttcgttttcgtttttttttttttttcgcggtcggggagttttttattttagagcgtttaggttcgtaggttagttttatggggaagcgtagacgtcggagtttgagtcgtagtcgtaggagcgttcggtcgttttcgtcggttcgttagcgtttggttttcgttcgtcggagacgtcggttcgaggtggcgtcggagttgttggtagaggggcggcgggcggcggcggcggcggttataggagggattgataaagttttacggtacgtcgttttttatttatagtatcggcgggtcgttatggagacgttttagtttaaattattcgcgatcggtttcggtcgggatatcgttcggggaggggcgggggtt

SEQ ID NO: 4470 - DNA, 736 bp, Artificial Sequence
  chemically treated genomic DNA (Homo sapiens) CpG-island No: 4470
aacccccgcccctccccgaacgatatcccgaccgaaaccgatcgcgaataatttaaactaaaacgtctccataacgacccgccgatactataaataaaaaacgacgtaccgtaaaactttatcaatccctcctataaccgccgccgccgccgcccgccgcccctctaccaacaactccgacgccacctcgaaccgacgtctccgacgaacgaaaaccaaacgctaacgaaccgacgaaaacgaccgaacgctcctacgactacgactcaaactccgacgtctacgcttccccataaaactaacctacgaacctaaacgctctaaaataaaaaactccccgaccgcgaaaaaaaaaaaaaaacgaaaacgaaaaccgaaacgaactacgaaacccgaaccccgaacacgtatacgacgcgcctcgccgacctacgaaaacacgtaatcgccgaacgaaccacgaccttaaaacgccgcttcctcccgacccgaaattctcccgcgactaaataaaaataatccgaacgcctcgttctacccccgtcttcacaactcgaaactaaaaaaacctaaaaaaaacccacccgaaaaccctacgaccccgcgccgacctctttcccaacccttcgacgaccgcgcgctaaccgaaaaaccgttaaaaaaaccctaacgaccgcgcaacaaatacaaaaacgcaaaacccgaactcgccttaatacaaacgaacgaaccccga

SEQ ID NO: 4471 - DNA, 736 bp, Artificial Sequence
  chemically treated genomic DNA (Homo sapiens) CpG-island No: 4471
ggttttcgttttttttcgggcggtgtttcggtcggaatcgatcgcggatggtttgagttggagcgtttttatggcgattcgtcggtgttataagtagggagcggcgtgtcgtggggttttgttagttttttttgtagtcgtcgtcgtcgtcgttcgtcgtttttttgttagtagtttcggcgttatttcgggtcggcgttttcggcgggcgggagttaggcgttgacgggtcggcgggggcggtcgagcgtttttgcggttgcgatttaggtttcggcgtttgcgtttttttatggggttggtttgcgggtttgggcgttttgaggtgagggatttttcggtcgcggaggaagggagggagcgagggcgggagtcggggcgggttgcgggattcgggtttcgggtacgtgtgcggcgcgtttcgtcggtttgcggagatacgtggtcgtcgagcgggttacgattttgaggcgtcgttttttttcggttcggggttttttcgcggttggataagggtgattcgggcgtttcgttttgttttcgtttttatagttcggggttggaggggtttaggggagatttattcggagattttgcggtttcgcgtcggttttttttttaatttttcggcggtcgcgcgttggtcggggagtcgttggggaggttttggcggtcgcgtagtaggtgtaggggcgtagagttcgggttcgttttggtatagacgagcgggtttcgg

SEQ ID NO: 4472 - DNA, 736 bp, Artificial Sequence
  chemically treated genomic DNA (Homo sapiens) CpG-island No: 4472
ccgaaacccgctcgtctataccaaaacgaacccgaactctacgcccctacacctactacgcgaccgccaaaacctccccaacgactccccgaccaacgcgcgaccgccgaaaaattaaaaaaaaaaccgacgcgaaaccgcaaaatctccgaataaatctcccctaaacccctccaaccccgaactataaaaacgaaaacaaaacgaaacgcccgaatcacccttatccaaccgcgaaaaaaccccgaaccgaaaaaaaacgacgcctcaaaatcgtaacccgctcgacgaccacgtatctccgcaaaccgacgaaacgcgccgcacacgtacccgaaacccgaatcccgcaacccgccccgactcccgccctcgctccctcccttcctccgcgaccgaaaaatccctcacctcaaaacgcccaaacccgcaaaccaaccccataaaaaaacgcaaacgccgaaacctaaatcgcaaccgcaaaaacgctcgaccgcccccgccgacccgtcaacgcctaactcccgcccgccgaaaacgccgacccgaaataacgccgaaactactaacaaaaaaacgacgaacgacgacgacgacgactacaaaaaaaactaacaaaaccccacgacacgccgctccctacttataacaccgacgaatcgccataaaaacgctccaactcaaaccatccgcgatcgattccgaccgaaacaccgcccgaaaaaaaacgaaaacc

SEQ ID NO: 4473 - DNA, 1137 bp, Artificial Sequence
  chemically treated genomic DNA (Homo sapiens) CpG-island No: 4473
gttttcgcgatacgttgttagtagcgtagcgtcggttcgttcgtgtggtcggagttcggggaggggatagggtacgcgtcgtttgatttatttgttttatcgtttacggtcgcggtcgttttgggtcgcgggattcgcgtcggttattttcgtttcgcggggtttaagaggcgaggtcgcgcggtttagtttcggttttcgttttggttgagtgttggggcgcgcgaggggcgcgggtagggttcgtttcggcgggttagtgtttcgcgttttaggtcgttggcggttaggtttacgtttttttttttttcggtttttttcgtttttcgttttgttttttttttcgttttttttttttttcgcgttttttttttttttgtttggttatgtgtcgtttttttttgtttgtagtggaaataatttttcgtcgttcggcgcgtttcggttcgacgcgtcgcggcggaggcgagcgggaggcgggacggggcggggagagcggcggggtcggcgggaggacgcgcggcgcggcgtcggcggacgtcgtaggttttatgtcgcgtcggcgattttcgcgtttttgtcgttcgcgttcgcggtcgtttttcgtcgttcgtcgtttcgggttcgtcgcgtcgcgttcgcgcgtttttagcggggttatcgagcgatgttcgtcgggcgttcgcgaaagtttgtcggtttttgttgaagggtagcggcgttttcgtattttcgtgtttcgtttcggttaggtgagtttgtatttcgtttttgtcggttttcgcgtgggttcggggggtattcggggcgggaggcgcgttcgagacggttttggagattatttcgtcgttttgggaagacgagggatttcgtaggttttggggggagggtcgggtgtggatttcgggagttttcgagtcgggaagttgtcgggttcgaagagttttttgtttcgacgtgcgtgttgtttttcggtgtttcggttttcgaaaagacgttcgtaaggaatagagttggtattgtttgcggaggacggggttttcgtcgtttcgggtcggggagggggtttcgattaagtggagattttaagatgagaaataggtttttaataaagattatttttcggttaaattgtgt

SEQ ID NO: 4474 - DNA, 1137 bp, Artificial Sequence
  chemically treated genomic DNA (Homo sapiens) CpG-island No: 4474
acacaatttaaccgaaaaataatctttattaaaaacctatttctcatcttaaaatctccacttaatcgaaaccccctccccgacccgaaacgacgaaaaccccgtcctccgcaaacaataccaactctattccttacgaacgtcttttcgaaaaccgaaacaccgaaaaacaacacgcacgtcgaaacaaaaaactcttcgaacccgacaacttcccgactcgaaaactcccgaaatccacacccgaccctccccccaaaacctacgaaatccctcgtcttcccaaaacgacgaaataatctccaaaaccgtctcgaacgcgcctcccgccccgaataccccccgaacccacgcgaaaaccgacaaaaacgaaatacaaactcacctaaccgaaacgaaacacgaaaatacgaaaacgccgctacccttcaacaaaaaccgacaaactttcgcgaacgcccgacgaacatcgctcgataaccccgctaaaaacgcgcgaacgcgacgcgacgaacccgaaacgacgaacgacgaaaaacgaccgcgaacgcgaacgacaaaaacgcgaaaatcgccgacgcgacataaaacctacgacgtccgccgacgccgcgccgcgcgtcctcccgccgaccccgccgctctccccgccccgtcccgcctcccgctcgcctccgccgcgacgcgtcgaaccgaaacgcgccgaacgacgaaaaattatttccactacaaacaaaaaaaaacgacacataaccaaacaaaaaaaaaaaaaacgcgaaaaaaaaaaaaaacgaaaaaaaaaacaaaacgaaaaacgaaaaaaaccgaaaaaaaaaaaaacgtaaacctaaccgccaacgacctaaaacgcgaaacactaacccgccgaaacgaaccctacccgcgcccctcgcgcgccccaacactcaaccaaaacgaaaaccgaaactaaaccgcgcgacctcgcctcttaaaccccgcgaaacgaaaataaccgacgcgaatcccgcgacccaaaacgaccgcgaccgtaaacgataaaacaaataaatcaaacgacgcgtaccctatcccctccccgaactccgaccacacgaacgaaccgacgctacgctactaacaacgtatcgcgaaaac

SEQ ID NO: 4475 - DNA, 1137 bp, Artificial Sequence
  chemically treated genomic DNA (Homo sapiens) CpG-island No: 4475
gtatagtttggtcggggggtgatttttgttaggagtttgttttttattttggggtttttatttgatcggaatttttttttcggttcggaacggcggggatttcgtttttcgtagataatattaattttgttttttgcgggcgttttttcggaaatcgaggtatcgggaagtagtacgtacgtcggggtaggaaatttttcggattcggtaatttttcggttcgggggttttcggggtttatattcgattttttttttaggatttgcggggtttttcgtttttttagagcggcgaggtagtttttaggatcgtttcggacgcgtttttcgtttcgggtgtttttcgagtttacgcgggagtcggtaggagcggggtgtaaatttatttggtcggagcggggtacgggggtgcgggggcgtcgttgttttttagtaggagtcgataaattttcgcgggcgttcggcgggtatcgttcggtggtttcgttaaggacgcgcgggcgcggcgcggcgagttcggggcggcgggcggcggggggcggtcgcgggcgcgggcggtaggggcgcgggggtcgtcggcgcggtatgggatttgcggcgttcgtcggcgtcgcgtcgcgcgttttttcgtcggtttcgtcgtttttttcgtttcgtttcgtttttcgttcgttttcgtcgcggcgcgtcgggtcggggcgcgtcgagcggcgagaaattgtttttattgtaaataaaaaaaggcgatatatgattaggtaggaggaggggaagcgcggggagggaggagggcggagggagggatagagcggagggcggagggagtcggagaaagggaaaacgtgggtttggtcgttagcggtttggggcgcggggtattgattcgtcggggcggattttgttcgcgtttttcgcgcgttttagtatttagttagggcggaggtcggggttgggtcgcgcggtttcgttttttgggtttcgcggggcgggggtgatcggcgcgggtttcgcgatttagggcggtcgcgatcgtgggcggtggggtaggtgggttaggcggcgcgtgttttgtttttttttcgggtttcggttatacgagcgggtcggcgttgcgttgttggtaacgtgtcgcgggaat

SEQ ID NO: 4476 - DNA, 1137 bp, Artificial Sequence
  chemically treated genomic DNA (Homo sapiens) CpG-island No: 4476
attcccgcgacacgttaccaacaacgcaacgccgacccgctcgtataaccgaaacccgaaaaaaaaacaaaacacgcgccgcctaacccacctaccccaccgcccacgatcgcgaccgccctaaatcgcgaaacccgcgccgatcacccccgccccgcgaaacccaaaaaacgaaaccgcgcgacccaaccccgacctccgccctaactaaatactaaaacgcgcgaaaaacgcgaacaaaatccgccccgacgaatcaataccccgcgccccaaaccgctaacgaccaaacccacgttttccctttctccgactccctccgccctccgctctatccctccctccgccctcctccctccccgcgcttcccctcctcctacctaatcatatatcgcctttttttatttacaataaaaacaatttctcgccgctcgacgcgccccgacccgacgcgccgcgacgaaaacgaacgaaaaacgaaacgaaacgaaaaaaacgacgaaaccgacgaaaaaacgcgcgacgcgacgccgacgaacgccgcaaatcccataccgcgccgacgacccccgcgcccctaccgcccgcgcccgcgaccgccccccgccgcccgccgccccgaactcgccgcgccgcgcccgcgcgtccttaacgaaaccaccgaacgatacccgccgaacgcccgcgaaaatttatcgactcctactaaaaaacaacgacgcccccgcacccccgtaccccgctccgaccaaataaatttacaccccgctcctaccgactcccgcgtaaactcgaaaaacacccgaaacgaaaaacgcgtccgaaacgatcctaaaaactacctcgccgctctaaaaaaacgaaaaaccccgcaaatcctaaaaaaaaaatcgaatataaaccccgaaaacccccgaaccgaaaaattaccgaatccgaaaaatttcctaccccgacgtacgtactacttcccgatacctcgatttccgaaaaaacgcccgcaaaaaacaaaattaatattatctacgaaaaacgaaatccccgccgttccgaaccgaaaaaaaaattccgatcaaataaaaaccccaaaataaaaaacaaactcctaacaaaaatcaccccccgaccaaactatac

SEQ ID NO: 4477 - DNA, 519 bp, Artificial Sequence
  chemically treated genomic DNA (Homo sapiens) CpG-island No: 4477
gttagttgttgcggggggcggcgggttttagcgtcgggagtttgggtagggggaagcgttcgggtcgttttcgttattgtagttgtagttttcgaggtcgtcgtagtaattcggattcgtagtattcgtattttcggcggtcgtagttttagtatcgtagagcggagagcggagttcggagttcgtcgttttaggtgagtcgcgtttgggagcgtagggcgtttgtagcgttgttttttcggcggttttattttattcgttatcgttattttttgcgttttattttttttcgttgttttttcgaattcgcgggtagcgttattttaggtcgattttcggtgttggttcgggcggttgggagtttgggggcggttagaggagaggtggtttcgtttgaagtcggggtgattcggttcggggattgcgggggtgtagtggagggatgtcggtttcgggttttcgtatcgtagtcgggtttttcgcgttgttttttttgggttttttttttttggtagttaa

SEQ ID NO: 4478 - DNA, 519 bp, Artificial Sequence
  chemically treated genomic DNA (Homo sapiens) CpG-island No: 4478
ttaactaccaaaaaaaaaaaacccaaaaaaaacaacgcgaaaaacccgactacgatacgaaaacccgaaaccgacatccctccactacacccccgcaatccccgaaccgaatcaccccgacttcaaacgaaaccacctctcctctaaccgcccccaaactcccaaccgcccgaaccaacaccgaaaatcgacctaaaataacgctacccgcgaattcgaaaaaacaacgaaaaaaaataaaacgcaaaaaataacgataacgaataaaataaaaccgccgaaaaaacaacgctacaaacgccctacgctcccaaacgcgactcacctaaaacgacgaactccgaactccgctctccgctctacgatactaaaactacgaccgccgaaaatacgaatactacgaatccgaattactacgacgacctcgaaaactacaactacaataacgaaaacgacccgaacgcttccccctacccaaactcccgacgctaaaacccgccgccccccgcaacaactaac

SEQ ID NO: 4479 - DNA, 519 bp, Artificial Sequence
  chemically treated genomic DNA (Homo sapiens) CpG-island No: 4479
ttggttgttaggaaaaggaaatttaggaagagtagcgcggggaattcggttgcggtgcgggagttcggggtcggtatttttttattgtattttcgtagttttcgagtcgagttatttcggttttaggcgaggttattttttttttgatcgtttttaggtttttagtcgttcgggttagtatcgggaatcggtttggggtaacgttattcgcgggttcggagggatagcgggaggagatgaaacgtaggaggtggcgatggcgggtggggtgaaatcgtcgggaaagtagcgttgtaaacgttttgcgtttttagacgcggtttatttggggcggcgggtttcgggtttcgtttttcgttttgcggtgttgaggttgcggtcgtcgagggtgcgggtgttgcgggttcggattattgcggcgatttcgggggttgtagttgtagtggcggaggcggttcgggcgtttttttttatttagattttcggcgttggggttcgtcgtttttcgtagtagttggt

SEQ ID NO: 4480 - DNA, 519 bp, Artificial Sequence
  chemically treated genomic DNA (Homo sapiens) CpG-island No: 4480
accaactactacgaaaaacgacgaaccccaacgccgaaaatctaaataaaaaaaaacgcccgaaccgcctccgccactacaactacaacccccgaaatcgccgcaataatccgaacccgcaacacccgcaccctcgacgaccgcaacctcaacaccgcaaaacgaaaaacgaaacccgaaacccgccgccccaaataaaccgcgtctaaaaacgcaaaacgtttacaacgctactttcccgacgatttcaccccacccgccatcgccacctcctacgtttcatctcctcccgctatccctccgaacccgcgaataacgttaccccaaaccgattcccgatactaacccgaacgactaaaaacctaaaaacgatcaaaaaaaaaataacctcgcctaaaaccgaaataactcgactcgaaaactacgaaaatacaataaaaaaataccgaccccgaactcccgcaccgcaaccgaattccccgcgctactcttcctaaatttccttttcctaacaaccaa

SEQ ID NO: 4481 - DNA, 522 bp, Artificial Sequence
  chemically treated genomic DNA (Homo sapiens) CpG-island No: 4481
acgttcggttcgttttatattttcggttcgggggcggggttattgcggcggtttcggcgtttgaagtttagttagtcggtgaattcgtggggcgaagtcggtacgttgtttataaggaggttcgggttcgggttttacgtgggtcggaggggtagtcgaagtttttaaagtgcggcgaacgagttgtcggtcgtaggcggcgttacggcgtattatttgaattttcgattcgtcgggttcgggacgcgttcgcgtatgtttagggcgtcgttcgcgcgtttttttttaaaatttatttcgggatttcgcggtagcggcggcggggcggagtttgcgggaacggttcgtagggaaattgagtttcgagacgcggattgcggattaggcgacgggaggagggaggtttttgagataagtgtggagcgtagttttgattgtaaatggtgttcgtcgtttgagggtttacgtgattttttacgatattttttgagttttagtttttatttttgttttaaagttgtt

SEQ ID NO: 4482 - DNA, 522 bp, Artificial Sequence
  chemically treated genomic DNA (Homo sapiens) CpG-island No: 4482
aacaactttaaaacaaaaataaaaactaaaactcaaaaaatatcgtaaaaaatcacgtaaaccctcaaacgacgaacaccatttacaatcaaaactacgctccacacttatctcaaaaacctccctcctcccgtcgcctaatccgcaatccgcgtctcgaaactcaatttccctacgaaccgttcccgcaaactccgccccgccgccgctaccgcgaaatcccgaaataaattttaaaaaaaaacgcgcgaacgacgccctaaacatacgcgaacgcgtcccgaacccgacgaatcgaaaattcaaataatacgccgtaacgccgcctacgaccgacaactcgttcgccgcactttaaaaacttcgactacccctccgacccacgtaaaacccgaacccgaacctccttataaacaacgtaccgacttcgccccacgaattcaccgactaactaaacttcaaacgccgaaaccgccgcaataaccccgcccccgaaccgaaaatataaaacgaaccgaacgt

SEQ ID NO: 4483 - DNA, 522 bp, Artificial Sequence
  chemically treated genomic DNA (Homo sapiens) CpG-island No: 4483
ggtagttttggaataagaatagggattagaatttaggaggtatcgtgagaggttacgtagatttttaaacggcgggtattatttatagttagaattgcgttttatatttgttttaggggttttttttttttcgtcgtttagttcgtagttcgcgtttcgggatttaatttttttgcgggtcgttttcgtaaatttcgtttcgtcgtcgttgtcgcgaaatttcggagtggattttgggaaggggcgcgcgagcggcgttttgggtatgcgcgagcgcgtttcgggttcggcgagtcgagggtttaggtggtgcgtcgtggcgtcgtttgcgatcggtagttcgttcgtcgtattttggaggtttcggttgttttttcgatttacgtagggttcggattcgggtttttttgtgaatagcgtgtcggtttcgttttacgggtttatcggttggttgggttttaagcgtcgaggtcgtcgtagtgatttcgttttcgggtcgaggatgtgaggcgggtcgggcgt

SEQ ID NO: 4484 - DNA, 522 bp, Artificial Sequence
  chemically treated genomic DNA (Homo sapiens) CpG-island No: 4484
acgcccgacccgcctcacatcctcgacccgaaaacgaaatcactacgacgacctcgacgcttaaaacccaaccaaccgataaacccgtaaaacgaaaccgacacgctattcacaaaaaaacccgaatccgaaccctacgtaaatcgaaaaaacaaccgaaacctccaaaatacgacgaacgaactaccgatcgcaaacgacgccacgacgcaccacctaaaccctcgactcgccgaacccgaaacgcgctcgcgcatacccaaaacgccgctcgcgcgccccttcccaaaatccactccgaaatttcgcgacaacgacgacgaaacgaaatttacgaaaacgacccgcaaaaaaattaaatcccgaaacgcgaactacgaactaaacgacgaaaaaaaaaaaacccctaaaacaaatataaaacgcaattctaactataaataatacccgccgtttaaaaatctacgtaacctctcacgatacctcctaaattctaatccctattcttattccaaaactacc

SEQ ID NO: 4485 - DNA, 540 bp, Artificial Sequence
  chemically treated genomic DNA (Homo sapiens) CpG-island No: 4485
gttttttcggtcgtttttttagtttttaggttttttttttattcgacggtgagtagcgtcgcggttcgtgtagttagacgcgcggggtgcggcggggtttcgggggcggggtgggggaggcggagggtgggttcgcggttacgtgagtcgggttagttgttgcggggggcggcgggtttagcgtcggggagtttgggtagggggaagcgttcggcgtcgttttcgttattgtagttgtagttttcgaggtcgtcgtagtaattcggattcggtagtattcgtattttcggcggtcgtagttttagtatcgtagaagagtagcgacgtcggagttcgtcgttttaggtgagtcgcgtttgggagcgtagggcgtttgtagcgttgttttttcggcggttttatatattcgttatcgttattttttgcgtgttattttttttcgttgtttttttgaatcgcgggtaggttatacgtaggcgatttacggtgttgggtttggcggcgtgggagtatggtgcggttagaggagaggtggtttcg

SEQ ID NO: 4486 - DNA, 540 bp, Artificial Sequence
  chemically treated genomic DNA (Homo sapiens) CpG-island No: 4486
cgaaaccacctctcctctaaccgcaccatactcccacgccgccaaacccaacaccgtaaatcgcctacgtataacctacccgcgattcaaaaaaacaacgaaaaaaaataacacgcaaaaaataacgataacgaatatataaaaccgccgaaaaaacaacgctacaaacgccctacgctcccaaacgcgactcacctaaaacgacgaactccgacgtcgctactcttctacgatactaaaactacgaccgccgaaaatacgaatactaccgaatccgaattactacgacgacctcgaaaactacaactacaataacgaaaacgacgccgaacgcttccccctacccaaactccccgacgctaaacccgccgccccccgcaacaactaacccgactcacgtaaccgcgaacccaccctccgcctcccccaccccgcccccgaaaccccgccgcaccccgcgcgtctaactacacgaaccgcgacgctactcaccgtcgaataaaaaaaaaacctaaaaactaaaaaaacgaccgaaaaaac

SEQ ID NO: 4487 - DNA, 540 bp, Artificial Sequence
  chemically treated genomic DNA (Homo sapiens) CpG-island No: 4487
cgaggttattttttttttgatcgtattatgtttttacgtcgttaggtttagtatcgtgaatcgtttgcgtgtaatttattcgcggtttagagggatagcgggaggagatgatacgtaggaggtggcgatggcgggtgtgtgaaatcgtcgggaaagtagcgttgtaaacgttttgcgtttttagacgcggtttatttggggcggcgggtttcggcgtcgttatttttttgcggtgttgaggttgcggtcgtcgagggtgcgggtgttgtcgggttcggattattgcggcgatttcgggggttgtagttgtagtggcggaggcggcgtcgggcgtttttttttatttagatttttcggcgttgggttcgtcgtttttcgtagtagttggttcgatttacgtgatcgcgggtttatttttcgttttttttatttcgttttcggggtttcgtcgtatttcgcgcgtttggttgtacgggtcgcggcgttgtttatcgtcgagtagggagggggtttgggagttggaggagcggtcgagagggt

SEQ ID NO: 4488 - DNA, 540 bp, Artificial Sequence
  chemically treated genomic DNA (Homo sapiens) CpG-island No: 4488
accctctcgaccgctcctccaactcccaaaccccctccctactcgacgataaacaacgccgcgacccgtacaaccaaacgcgcgaaatacgacgaaaccccgaaaacgaaataaaaaaaacgaaaaataaacccgcgatcacgtaaatcgaaccaactactacgaaaaacgacgaacccaacgccgaaaaatctaaataaaaaaaaacgcccgacgccgcctccgccactacaactacaacccccgaaatcgccgcaataatccgaacccgacaacacccgcaccctcgacgaccgcaacctcaacaccgcaaaaaaataacgacgccgaaacccgccgccccaaataaaccgcgtctaaaaacgcaaaacgtttacaacgctactttcccgacgatttcacacacccgccatcgccacctcctacgtatcatctcctcccgctatccctctaaaccgcgaataaattacacgcaaacgattcacgatactaaacctaacgacgtaaaaacataatacgatcaaaaaaaaaataacctcg

SEQ ID NO: 4489 - DNA, 701 bp, Artificial Sequence
  chemically treated genomic DNA (Homo sapiens) CpG-island No: 4489
gttttcggttaatatttcgttacgttttagtttttcgaatgtttttagagggttgagttttcgatttttttttcgcgtgggtattttcgaggttttagttttttcgtttattttagcgcgtcgagtttttttttcgatttcggcgacggttaatggttggggcgtttttttttttttcggggcggggtcgcgtgacgtgtcgggaagtcggagtttagagtttcgggcgcggggaggcgcggttatggtaggtacggcgggtttagcggggcggaggcgcggggcgcggggttgtaggggcgcggggttgtagagtcgtggggcgagcggtttttttgtagtttttcgttgttcgtagtttcggagtcgttgttttcggcgggcggtgcgggcgaggaggcgtcggaggaggacgaggacgaagcggaggtcgaggattttgagcggtcgaatgcgggagcgggcggtggacgtagtggcggcggcggtagtagcgttagcggaggaggcggcggcggcggggtcggggcggggggttgcggcgggttcgggggcgcgtttattaggcgcgcggttatattgcgggtgttttttaaagacgcgttgttggagtttggcgtcggggtgttgtttatttattatttggtgagtatttcgtttttttcgttttatcgcggttcgggtaggaaggggaaattgag

SEQ ID NO: 4490 - DNA, 701 bp, Artificial Sequence
  chemically treated genomic DNA (Homo sapiens) CpG-island No: 4490
ctcaatttccccttcctacccgaaccgcgataaaacgaaaaaaacgaaatactcaccaaataataaataaacaacaccccgacgccaaactccaacaacgcgtctttaaaaaacacccgcaatataaccgcgcgcctaataaacgcgcccccgaacccgccgcaaccccccgccccgaccccgccgccgccgcctcctccgctaacgctactaccgccgccgccactacgtccaccgcccgctcccgcattcgaccgctcaaaatcctcgacctccgcttcgtcctcgtcctcctccgacgcctcctcgcccgcaccgcccgccgaaaacaacgactccgaaactacgaacaacgaaaaactacaaaaaaaccgctcgccccacgactctacaaccccgcgcccctacaaccccgcgccccgcgcctccgccccgctaaacccgccgtacctaccataaccgcgcctccccgcgcccgaaactctaaactccgacttcccgacacgtcacgcgaccccgccccgaaaaaaaaaaaaacgccccaaccattaaccgtcgccgaaatcgaaaaaaaaactcgacgcgctaaaataaacgaaaaaactaaaacctcgaaaatacccacgcgaaaaaaaaatcgaaaactcaaccctctaaaaacattcgaaaaactaaaacgtaacgaaatattaaccgaaaac

SEQ ID NO: 4491 - DNA, 701 bp, Artificial Sequence
  chemically treated genomic DNA (Homo sapiens) CpG-island No: 4491
tttagttttttttttttgttcgagtcgcgatgggacgagggaggcggggtgtttattaggtagtagatggatagtatttcggcgttaggttttagtagcgcgtttttgaggagtattcgtagtgtgatcgcgcgtttggtgagcgcgttttcgggttcgtcgtagtttttcgtttcggtttcgtcgtcgtcgtttttttcgttgacgttattgtcgtcgtcgttattgcgtttatcgttcgttttcgtattcggtcgtttagggttttcggttttcgtttcgttttcgttttttttcggcgttttttcgttcgtatcgttcgtcggggatagcggtttcggagttgcggatagcgagaggttgtagggaggtcgttcgttttacggttttgtagtttcgcgtttttgtagtttcgcgtttcgcgttttcgtttcgttgggttcgtcgtatttgttatggtcgcgttttttcgcgttcggagttttagatttcggtttttcggtacgttacgcggtttcgtttcggggaggggaggggcgttttaattattggtcgtcgtcggggtcgggggaagggttcggcgcgttggggtgggcggagaaattgaggtttcggggatgtttacgcgggagagagatcgggaatttagttttttgggaatattcgggaaattgaggcgtgacggggtgttgatcgggagt

SEQ ID NO: 4492 - DNA, 701 bp, Artificial Sequence
  chemically treated genomic DNA (Homo sapiens) CpG-island No: 4492
actcccgatcaacaccccgtcacgcctcaatttcccgaatattcccaaaaaactaaattcccgatctctctcccgcgtaaacatccccgaaacctcaatttctccgcccaccccaacgcgccgaacccttcccccgaccccgacgacgaccaataattaaaacgcccctcccctccccgaaacgaaaccgcgtaacgtaccgaaaaaccgaaatctaaaactccgaacgcgaaaaaacgcgaccataacaaatacgacgaacccaacgaaacgaaaacgcgaaacgcgaaactacaaaaacgcgaaactacaaaaccgtaaaacgaacgacctccctacaacctctcgctatccgcaactccgaaaccgctatccccgacgaacgatacgaacgaaaaaacgccgaaaaaaaacgaaaacgaaacgaaaaccgaaaaccctaaacgaccgaatacgaaaacgaacgataaacgcaataacgacgacgacaataacgtcaacgaaaaaaacgacgacgacgaaaccgaaacgaaaaactacgacgaacccgaaaacgcgctcaccaaacgcgcgatcacactacgaatactcctcaaaaacgcgctactaaaacctaacgccgaaatactatccatctactacctaataaacaccccgcctccctcgtcccatcgcgactcgaacaaaaaaaaaaaactaaa

SEQ ID NO: 4493 - DNA, 1232 bp, Artificial Sequence
  chemically treated genomic DNA (Homo sapiens) CpG-island No: 4493
tttaataacgggtatcgtcgttatttttggcgtcggtaacgttattttaggaaaagtaaaatgttgcgttttaagaattattttatcgtcgttgcgggtggttttcgttagaattatcgttcgatgaatagtatgttttagttcgcgtacgtttttcggaaaattgtagtgttgtagtaaatttcgcgtttcggtatttaatattacgcgggagagtttttgtcgtaaacgatattgttcgtagaaatatttcgttagtagaatgatattatcgtttcgtttacgtagcggcggtatcgaaagtggaaatacgtttaggcgatgaaataaatcggcgcggaatcgttttgttagtattttttcgcgtaaatcgcggttagtcgtcgttagtacgcgtatatcgattcgtaaataacggttatcgttaacgcgttgaatatcgttatattgtaatatttttagtagtttggtttgtaatgttaacgataattcgtcgattttatttagaaatagcgtgtcgttattcgttattttaaatttttcgttgcgattattgatagcgttagtaaacgttttttttatatgttcgaataatttattttttcgtatatttttcggtagtgtagtatagttgagatagattagcggatttatcgttcgtggcgaggttttatgaatcgttttcgttattagttttttatcggttttagttttatcgttgattaggacgttgagatcggacgtcgttataattttaatttttttttttagttgcgttatgttaggggataagttaattatttgcgtttgttttatcgttttaaacggcgtggtatcgtttggtagtatattttggttttttagttgtttaattagtaacgtattgtttaacgttttcgtcgttagcgtagtaattagtcgtagtttttcgtcgttgaaaatatcgaattgatcgggttgtatttcgtcgagcgttagtgcgtcgattaggttttgttcggtaaataatggtagattaacgtaggcgtgaatttttagatttttttgtttaggaattaaatcgttatagggatcgggtaattcgttgtttgcgggaaagcgtattatattttcggcgcgggtaatcgtttttagtcgtggatgtttttttagcgtaaagcgtttatcgagtatattttttgttagatcgtcgatggtaagcggaataaattgtcgcgaatcgtaacgtagta

SEQ ID NO: 4494 - DNA, 1232 bp, Artificial Sequence
  chemically treated genomic DNA (Homo sapiens) CpG-island No: 4494
tactacgttacgattcgcgacaatttattccgcttaccatcgacgatctaacaaaaaatatactcgataaacgctttacgctaaaaaaacatccacgactaaaaacgattacccgcgccgaaaatataatacgctttcccgcaaacaacgaattacccgatccctataacgatttaattcctaaacaaaaaaatctaaaaattcacgcctacgttaatctaccattatttaccgaacaaaacctaatcgacgcactaacgctcgacgaaatacaacccgatcaattcgatattttcaacgacgaaaaactacgactaattactacgctaacgacgaaaacgttaaacaatacgttactaattaaacaactaaaaaaccaaaatatactaccaaacgataccacgccgtttaaaacgataaaacaaacgcaaataattaacttatcccctaacataacgcaactaaaaaaaaaaattaaaattataacgacgtccgatctcaacgtcctaatcaacgataaaactaaaaccgataaaaaactaataacgaaaacgattcataaaacctcgccacgaacgataaatccgctaatctatctcaactatactacactaccgaaaaatatacgaaaaaataaattattcgaacatataaaaaaaacgtttactaacgctatcaataatcgcaacgaaaaatttaaaataacgaataacgacacgctatttctaaataaaatcgacgaattatcgttaacattacaaaccaaactactaaaaatattacaatataacgatattcaacgcgttaacgataaccgttatttacgaatcgatatacgcgtactaacgacgactaaccgcgatttacgcgaaaaaatactaacaaaacgattccgcgccgatttatttcatcgcctaaacgtatttccactttcgataccgccgctacgtaaacgaaacgataatatcattctactaacgaaatatttctacgaacaatatcgtttacgacaaaaactctcccgcgtaatattaaataccgaaacgcgaaatttactacaacactacaattttccgaaaaacgtacgcgaactaaaacatactattcatcgaacgataattctaacgaaaaccacccgcaacgacgataaaataattcttaaaacgcaacattttacttttcctaaaataacgttaccgacgccaaaaataacgacgatacccgttattaaa

SEQ ID NO: 4495 - DNA, 1232 bp, Artificial Sequence
  chemically treated genomic DNA (Homo sapiens) CpG-island No: 4495
tgttacgttacgattcgcggtagtttatttcgtttgttatcgacggtttggtaaaggatgtattcggtagacgttttgcgttggaagggtatttacggttggaagcgattgttcgcgtcggggatgtggtgcgttttttcgtagatagcgaattgttcgatttttatgacggtttgatttttgggtaggagagtttgaaggtttacgtttgcgttggtttgttattgtttgtcgggtaaaatttgatcggcgtattgacgttcgacgggatgtagttcgattagttcgatgtttttagcgacgaagagttacggttgattgttgcgttggcggcgggagcgttaagtaatgcgttgttgattgaataattggaaagttagaatatgttgttaggcgatgttacgtcgtttgaagcggtgaaatagacgtagatgattggtttgttttttggtatgacgtaattgaaaaaagagattgagattgtggcggcgttcgattttaacgttttgattagcggtgagattggaatcggtaaggagttggtggcgaaagcgatttatgaagtttcgttacgggcggtgaattcgttggtttattttaattgtgttgtattgtcggaaagtgtgcggaaaagtgagttgttcgggtatgtgaaaggagcgtttattggcgttattagtaatcgtagcgggaagtttgaaatggcggataacggtacgttgtttttggatgagatcggcgagttgtcgttggtattgtaggttaagttgttgagggtgttgtagtatggcgatatttagcgcgttggcgatgatcgttgtttgcgggtcgatgtgcgcgtgttggcggcgattaatcgcgatttacgcgaagaggtgttggtagggcgatttcgcgtcgatttgttttatcgtttgagcgtgtttttattttcggtgtcgtcgttgcgtgagcggggcgatgatgttattttgttggcggggtatttttgcgagtagtgtcgtttgcggtaggggttttttcgcgtggtattaagtgtcggagcgcgaaatttattgtaatattatagtttttcgggaaacgtgcgcgaattggaatatgttatttatcgggcggtagttttggcgagagttattcgtagcggcgatgaagtgatttttgaggcgtaatattttgttttttttgaggtgacgttgtcgacgttagaagtggcggcggtgttcgttgttaag

SEQ ID NO: 4496 - DNA, 1232 bp, Artificial Sequence
  chemically treated genomic DNA (Homo sapiens) CpG-island No: 4496
cttaacaacgaacaccgccgccacttctaacgtcgacaacgtcacctcaaaaaaaacaaaatattacgcctcaaaaatcacttcatcgccgctacgaataactctcgccaaaactaccgcccgataaataacatattccaattcgcgcacgtttcccgaaaaactataatattacaataaatttcgcgctccgacacttaataccacgcgaaaaaacccctaccgcaaacgacactactcgcaaaaataccccgccaacaaaataacatcatcgccccgctcacgcaacgacgacaccgaaaataaaaacacgctcaaacgataaaacaaatcgacgcgaaatcgccctaccaacacctcttcgcgtaaatcgcgattaatcgccgccaacacgcgcacatcgacccgcaaacaacgatcatcgccaacgcgctaaatatcgccatactacaacaccctcaacaacttaacctacaataccaacgacaactcgccgatctcatccaaaaacaacgtaccgttatccgccatttcaaacttcccgctacgattactaataacgccaataaacgctcctttcacatacccgaacaactcacttttccgcacactttccgacaatacaacacaattaaaataaaccaacgaattcaccgcccgtaacgaaacttcataaatcgctttcgccaccaactccttaccgattccaatctcaccgctaatcaaaacgttaaaatcgaacgccgccacaatctcaatctcttttttcaattacgtcataccaaaaaacaaaccaatcatctacgtctatttcaccgcttcaaacgacgtaacatcgcctaacaacatattctaactttccaattattcaatcaacaacgcattacttaacgctcccgccgccaacgcaacaatcaaccgtaactcttcgtcgctaaaaacatcgaactaatcgaactacatcccgtcgaacgtcaatacgccgatcaaattttacccgacaaacaataacaaaccaacgcaaacgtaaaccttcaaactctcctacccaaaaatcaaaccgtcataaaaatcgaacaattcgctatctacgaaaaaacgcaccacatccccgacgcgaacaatcgcttccaaccgtaaatacccttccaacgcaaaacgtctaccgaatacatcctttaccaaaccgtcgataacaaacgaaataaactaccgcgaatcgtaacgtaaca

SEQ ID NO: 4497 - DNA, 610 bp, Artificial Sequence
  chemically treated genomic DNA (Homo sapiens) CpG-island No: 4497
  misc_feature (567)..(567): n is either a, c, g or t
tcgcggaatacgtggtcgcgaacgaggcgaagatttttttcgaataggtcgagggttagatgggggaggacgaggcggcggttatgttggaagtcgcgtttttatcgatgttgggtttttttgcgattttgcgttagaaggtatttttgcgtatgatcggcgaacgtattcgcgatggggagattatcgaggtgaagggtttggatgatttcgtttagaatcggtcggtttcgaattcgtttgtttagaattcgtttgttacggatcgttcggttttgaataagttagcgcggcgtaggcgtttttcggttagcgacgcgttagtcgttttttgatttattgttcggttagcgttttttttagcgtatcgggattcgtttagaagcggcggatggtaaagtcggagattatcgcggcggtcgaacgaatcgcgttgcgcgtttcgttttcgttttattcggttacgattagtcgttcgttttagttttcgtagaacggcgcgcgtagttcggtgacgttgtttttgatcgtcggatagagtttcgcgtttttggtcgtttttatcgngatgttttttttttttttttttgtttttttttttttttgtatt

SEQ ID NO: 4498 - DNA, 610 bp, Artificial Sequence
  chemically treated genomic DNA (Homo sapiens) CpG-island No: 4498
  misc_feature (44)..(44): n is either a, c, g or t
aatacaaaaaaaaaaaaaaacaaaaaaaaaaaaaaaaaacatcncgataaaaacgaccaaaaacgcgaaactctatccgacgatcaaaaacaacgtcaccgaactacgcgcgccgttctacgaaaactaaaacgaacgactaatcgtaaccgaataaaacgaaaacgaaacgcgcaacgcgattcgttcgaccgccgcgataatctccgactttaccatccgccgcttctaaacgaatcccgatacgctaaaaaaaacgctaaccgaacaataaatcaaaaaacgactaacgcgtcgctaaccgaaaaacgcctacgccgcgctaacttattcaaaaccgaacgatccgtaacaaacgaattctaaacaaacgaattcgaaaccgaccgattctaaacgaaatcatccaaacccttcacctcgataatctccccatcgcgaatacgttcgccgatcatacgcaaaaataccttctaacgcaaaatcgcaaaaaaacccaacatcgataaaaacgcgacttccaacataaccgccgcctcgtcctcccccatctaaccctcgacctattcgaaaaaaatcttcgcctcgttcgcgaccacgtattccgcga

SEQ ID NO: 4499 - DNA, 610 bp, Artificial Sequence
  chemically treated genomic DNA (Homo sapiens) CpG-island No: 4499
  misc_feature (44)..(44): n is either a, c, g or t
aatataaagagagagagaggtagagagagagagagaaggtattncgatggaggcggttaaggacgcggaattttattcggcggttaggagtagcgttatcgggttgcgcgcgtcgttttacgaaggttggaacgagcggttggtcgtggtcggatggagcgaggacgaagcgcgtaacgcggttcgttcggtcgtcgcgatgattttcggttttgttattcgtcgtttttgggcggatttcgatacgttggaggaaacgttgatcgagtagtggattaaggagcggttggcgcgtcgttgatcggggagcgtttgcgtcgcgttggtttgtttagggtcggacgattcgtggtagacgggttttgggtaggcgggttcggggtcggtcggttttgggcggggttatttaggttttttatttcgatagtttttttatcgcgggtgcgttcgtcgattatgcgtaggaatgttttttggcgtaggatcgtaaagaagtttagtatcgatggaagcgcgatttttagtatagtcgtcgtttcgtttttttttatttggttttcgatttgttcgaggaagattttcgtttcgttcgcggttacgtatttcgcgg

SEQ ID NO: 4500 - DNA, 610 bp, Artificial Sequence
  chemically treated genomic DNA (Homo sapiens) CpG-island No: 4500
  misc_feature (567)..(567): n is either a, c, g or t
ccgcgaaatacgtaaccgcgaacgaaacgaaaatcttcctcgaacaaatcgaaaaccaaataaaaaaaaacgaaacgacgactatactaaaaatcgcgcttccatcgatactaaacttctttacgatcctacgccaaaaaacattcctacgcataatcgacgaacgcacccgcgataaaaaaactatcgaaataaaaaacctaaataaccccgcccaaaaccgaccgaccccgaacccgcctacccaaaacccgtctaccacgaatcgtccgaccctaaacaaaccaacgcgacgcaaacgctccccgatcaacgacgcgccaaccgctccttaatccactactcgatcaacgtttcctccaacgtatcgaaatccgcccaaaaacgacgaataacaaaaccgaaaatcatcgcgacgaccgaacgaaccgcgttacgcgcttcgtcctcgctccatccgaccacgaccaaccgctcgttccaaccttcgtaaaacgacgcgcgcaacccgataacgctactcctaaccgccgaataaaattccgcgtccttaaccgcctccatcgnaataccttctctctctctctctacctctctctctctttatatt

SEQ ID NO: 4501 - DNA, 622 bp, Artificial Sequence
  chemically treated genomic DNA (Homo sapiens) CpG-island No: 4501
tcgttagcggcgtttgaggggagcgaggatcgcgtagcgttttttcggggagagacgtgattaggagtcgcgttaggattgtaaaggttggttttggcggggttttcgggtcgtcgggtttttaatgtggggtttgggacgggacgagaagggggtgcgttttgcggatcgttttttttttttcggatttaaagagtttacgcgaggttatagtttttttttttttttttcgagttataaaaaggaggaggggtcgttttcgaggagaaattcgagtcgggcggagggggtcgagtgacggcgggaggaaggatttttcggaggaagggttcgaagtagggagagcggggaattcgggtttaggttatttcgttcgcgcgtacggtttggagtttggggaattggggtgattttagcgaggttttaaggaaacgaagacggcgttggggagattggttttagaagtaatttgagatcgagcgtttaggaatattttgtacgacgcgtcgggcgttttagtggtttcgtgtgttttggttttgcggcgtgtgttttttcgggattttattttcgttgtagaagtaattatttgattttttatttagaatttgcgtaggaatgt

SEQ ID NO: 4502 - DNA, 622 bp, Artificial Sequence
  chemically treated genomic DNA (Homo sapiens) CpG-island No: 4502
acattcctacgcaaattctaaataaaaaatcaaataattacttctacaacgaaaataaaatcccgaaaaaacacacgccgcaaaaccaaaacacacgaaaccactaaaacgcccgacgcgtcgtacaaaatattcctaaacgctcgatctcaaattacttctaaaaccaatctccccaacgccgtcttcgtttccttaaaacctcgctaaaatcaccccaattccccaaactccaaaccgtacgcgcgaacgaaataacctaaacccgaattccccgctctccctacttcgaacccttcctccgaaaaatccttcctcccgccgtcactcgaccccctccgcccgactcgaatttctcctcgaaaacgacccctcctcctttttataactcgaaaaaaaaaaaaaaaaactataacctcgcgtaaactctttaaatccgaaaaaaaaaaaacgatccgcaaaacgcacccccttctcgtcccgtcccaaaccccacattaaaaacccgacgacccgaaaaccccgccaaaaccaacctttacaatcctaacgcgactcctaatcacgtctctccccgaaaaaacgctacgcgatcctcgctcccctcaaacgccgctaacga

SEQ ID NO: 4503 - DNA, 622 bp, Artificial Sequence
  chemically treated genomic DNA (Homo sapiens) CpG-island No: 4503
atatttttacgtagattttaaatggaggattaaatggttgtttttgtaacgaagatgggatttcgaaagggtatacgtcgtagaattaaggtatacggggttattgagacgttcggcgcgtcgtatagagtgtttttgggcgttcggttttaggttatttttagaattagtttttttaacgtcgttttcgtttttttaaaatttcgttagagttattttagttttttagattttaggtcgtgcgcgcgggcggggtggtttgagttcgggtttttcgttttttttgtttcgggtttttttttcgaggggttttttttttcgtcgttattcggtttttttcgttcgattcgggttttttttcggaggcggtttttttttttttttataattcgggggaggggagaggggattgtggtttcgcgtggattttttgggttcggggggaaagaggcgattcgtaaggcgtatttttttttcgtttcgttttaaattttatattgaggattcggcgattcgaaagtttcgttagagttagtttttgtagttttaacgcgatttttggttacgttttttttcgaaggggcgttgcgcggttttcgttttttttaaacgtcgttggcga

SEQ ID NO: 4504 - DNA, 622 bp, Artificial Sequence
  chemically treated genomic DNA (Homo sapiens) CpG-island No: 4504
tcgccaacgacgtttaaaaaaaacgaaaaccgcgcaacgccccttcgaaaaaaaacgtaaccaaaaatcgcgttaaaactacaaaaactaactctaacgaaactttcgaatcgccgaatcctcaatataaaatttaaaacgaaacgaaaaaaaaatacgccttacgaatcgcctctttccccccgaacccaaaaaatccacgcgaaaccacaatcccctctcccctcccccgaattataaaaaaaaaaaaaaaccgcctccgaaaaaaaacccgaatcgaacgaaaaaaaccgaataacgacgaaaaaaaaaacccctcgaaaaaaaaacccgaaacaaaaaaaacgaaaaacccgaactcaaaccaccccgcccgcgcgcacgacctaaaatctaaaaaactaaaataactctaacgaaattttaaaaaaacgaaaacgacgttaaaaaaactaattctaaaaataacctaaaaccgaacgcccaaaaacactctatacgacgcgccgaacgtctcaataaccccgtataccttaattctacgacgtataccctttcgaaatcccatcttcgttacaaaaacaaccatttaatcctccatttaaaatctacgtaaaaatat

SEQ ID NO: 4505 - DNA, 615 bp, Artificial Sequence
  chemically treated genomic DNA (Homo sapiens) CpG-island No: 4505
gtcgcggtagagttattcgattacgcgtcggtttagggttcgttttttttgtgtttttgattaaagaggtagtcgcggagacgcgcggcgtagagtagagtgtcgcggtatttagttcgggcggggcggcgacggtttttttcgggtcgtcgtaggatcgaagttaaggcggcgtttattttattatttttcgttcgtttcgtatttttcgatcgttttcgcgtattttcgcgtcgggtcgtcggtgcgtaacgttttggggaagaagcgttttcgggtatttttagggcgcgtcgttttggtcgtgtcgtttttatttaagggagatttcggggggacggggggaaaagttttgttttttttaaattttacgatttcgatgttatatacgtagaatttaatataatgttacgcgcgatggcgttataagaggagttgggtggcgtacggtgtttggggtagcgagtcggtcggtagtttagttatgcgttcgaataggtagcggtgcgtggcggcgatatatatcgttagttcggtttgaataaaattttaaatattcgttgcgtttattatttagattttttgttatgttttaaatatgttttgttttttttt

SEQ ID NO: 4506 - DNA, 615 bp, Artificial Sequence
  chemically treated genomic DNA (Homo sapiens) CpG-island No: 4506
aaaaaaaaacaaaacatatttaaaacataacaaaaaatctaaataataaacgcaacgaatatttaaaattttattcaaaccgaactaacgatatatatcgccgccacgcaccgctacctattcgaacgcataactaaactaccgaccgactcgctaccccaaacaccgtacgccacccaactcctcttataacgccatcgcgcgtaacattatattaaattctacgtatataacatcgaaatcgtaaaatttaaaaaaaacaaaacttttccccccgtccccccgaaatctcccttaaataaaaacgacacgaccaaaacgacgcgccctaaaaatacccgaaaacgcttcttccccaaaacgttacgcaccgacgacccgacgcgaaaatacgcgaaaacgatcgaaaaatacgaaacgaacgaaaaataataaaataaacgccgccttaacttcgatcctacgacgacccgaaaaaaaccgtcgccgccccgcccgaactaaataccgcgacactctactctacgccgcgcgtctccgcgactacctctttaatcaaaaacacaaaaaaaacgaaccctaaaccgacgcgtaatcgaataactctaccgcgac

SEQ ID NO: 4507 - DNA, 615 bp, Artificial Sequence
  chemically treated genomic DNA (Homo sapiens) CpG-island No: 4507
agagaggagtagagtatgtttgggatataataaaggatttgagtagtaaacgtagcgagtgtttggggttttatttagatcgggttgacggtgtgtgtcgtcgttacgtatcgttgtttgttcgaacgtatggttgagttgtcgatcggttcgttattttaaatatcgtacgttatttaattttttttgtaacgttatcgcgcgtggtattgtgttgggttttgcgtgtgtggtatcggagtcgtggaatttagggggaataaggttttttttttcgttttttcggggttttttttgggtgggggcgatacggttaaggcggcgcgttttgggggtgttcgggggcgttttttttttagggcgttacgtatcggcggttcggcgcggaggtgcgcgggggcgatcgggagatgcggggcgggcgaggggtggtgggatgggcgtcgttttaatttcgattttgcggcggttcgagagaagtcgtcgtcgtttcgttcgagttgggtgtcgcggtattttgttttgcgtcgcgcgttttcgcggttgtttttttaattaggaatatagaaggggcgggttttgagtcggcgcgtaatcggatagttttgtcgcggt

SEQ ID NO: 4508 - DNA, 615 bp, Artificial Sequence
  chemically treated genomic DNA (Homo sapiens) CpG-island No: 4508
accgcgacaaaactatccgattacgcgccgactcaaaacccgccccttctatattcctaattaaaaaaacaaccgcgaaaacgcgcgacgcaaaacaaaataccgcgacacccaactcgaacgaaacgacgacgacttctctcgaaccgccgcaaaatcgaaattaaaacgacgcccatcccaccacccctcgcccgccccgcatctcccgatcgcccccgcgcacctccgcgccgaaccgccgatacgtaacgccctaaaaaaaaaacgcccccgaacacccccaaaacgcgccgccttaaccgtatcgcccccacccaaaaaaaaccccgaaaaaacgaaaaaaaaaaccttattccccctaaattccacgactccgataccacacacgcaaaacccaacacaataccacgcgcgataacgttacaaaaaaaattaaataacgtacgatatttaaaataacgaaccgatcgacaactcaaccatacgttcgaacaaacaacgatacgtaacgacgacacacaccgtcaacccgatctaaataaaaccccaaacactcgctacgtttactactcaaatcctttattatatcccaaacatactctactcctctct

SEQ ID NO: 4509 - DNA, 615 bp, Artificial Sequence
  chemically treated genomic DNA (Homo sapiens) CpG-island No: 4509
cgcgtataggaaggtatcggtgtattttgagtaaatattgttcgtttttaacgtttattgggaataggtttttcgggaaggttttaaatttttttagtttcgtttattttgcgggcgggagcgcggcgttcgggtgttttatttgcgtcgggcggttcggttttcgttggtcggagtttgtagatttggcgtttaggtcgattttttcggagttgggtcgcgcgcgtcgggttaatgagcgcgtttcgcgagggtttcgtttttttcgcgcgcgttgattggttcgcggttttcgaggcgagtcgcgacggttgcgggtttaagaatttttcggtcgagtgggagtggcgcgcgcgtttagtcgcgtttcgttttttttcgttgcgttttttcgttttttttttgagttttcgggtttcggtagcgggttggcggggcgtcgtattgtatattttgggggcgtcgtagtgttcgtgggatggggtagcgggttgtagttggcggtcggaattcgcgcgtagttcgggtgagtagaggcgggtttttcgggagagtataaaagaataggggattggtgttagcggttcggtttaggcggggtttggttaaggtagg

SEQ ID NO: 4510 - DNA, 615 bp, Artificial Sequence
  chemically treated genomic DNA (Homo sapiens) CpG-island No: 4510
cctaccttaaccaaaccccgcctaaaccgaaccgctaacaccaatcccctattcttttatactctcccgaaaaacccgcctctactcacccgaactacgcgcgaattccgaccgccaactacaacccgctaccccatcccacgaacactacgacgcccccaaaatatacaatacgacgccccgccaacccgctaccgaaacccgaaaactcaaaaaaaaaacgaaaaaacgcaacgaaaaaaaacgaaacgcgactaaacgcgcgcgccactcccactcgaccgaaaaattcttaaacccgcaaccgtcgcgactcgcctcgaaaaccgcgaaccaatcaacgcgcgcgaaaaaaacgaaaccctcgcgaaacgcgctcattaacccgacgcgcgcgacccaactccgaaaaaatcgacctaaacgccaaatctacaaactccgaccaacgaaaaccgaaccgcccgacgcaaataaaacacccgaacgccgcgctcccgcccgcaaaataaacgaaactaaaaaaatttaaaaccttcccgaaaaacctattcccaataaacgttaaaaacgaacaatatttactcaaaatacaccgataccttcctatacgcg

SEQ ID NO: 4511 - DNA, 615 bp, Artificial Sequence
  chemically treated genomic DNA (Homo sapiens) CpG-island No: 4511
tttgttttggttaggtttcgtttaagtcgggtcgttggtattaattttttgtttttttgtgttttttcgggaagttcgtttttatttattcgggttgcgcgcggatttcggtcgttagttgtagttcgttgttttattttacgaatattgcggcgtttttagagtgtgtaatgcggcgtttcgttagttcgttgtcggagttcgggagtttagggaaggagcgagggagcgtagcggggagaggcggggcgcggttagacgcgcgcgttatttttattcgatcggggaatttttagattcgtagtcgtcgcggttcgtttcgagggtcgcggattaattagcgcgcgcggggggagcggagttttcgcggggcgcgtttattggttcggcgcgcgcggtttaatttcgggagaatcggtttgagcgttaagtttgtaaatttcggttagcgggagtcgagtcgttcggcgtaggtggggtattcgggcgtcgcgttttcgttcgtagggtgagcggaattggagagatttgggattttttcgggaagtttgtttttagtgagcgttggaagcgagtagtgtttgtttagggtgtatcgatatttttttgtgcgcg

SEQ ID NO: 4512 - DNA, 615 bp, Artificial Sequence
  chemically treated genomic DNA (Homo sapiens) CpG-island No: 4512
cgcgcacaaaaaaatatcgatacaccctaaacaaacactactcgcttccaacgctcactaaaaacaaacttcccgaaaaaatcccaaatctctccaattccgctcaccctacgaacgaaaacgcgacgcccgaataccccacctacgccgaacgactcgactcccgctaaccgaaatttacaaacttaacgctcaaaccgattctcccgaaattaaaccgcgcgcgccgaaccaataaacgcgccccgcgaaaactccgctccccccgcgcgcgctaattaatccgcgaccctcgaaacgaaccgcgacgactacgaatctaaaaattccccgatcgaataaaaataacgcgcgcgtctaaccgcgccccgcctctccccgctacgctccctcgctccttccctaaactcccgaactccgacaacgaactaacgaaacgccgcattacacactctaaaaacgccgcaatattcgtaaaataaaacaacgaactacaactaacgaccgaaatccgcgcgcaacccgaataaataaaaacgaacttcccgaaaaaacacaaaaaaacaaaaaattaataccaacgacccgacttaaacgaaacctaaccaaaacaaa

SEQ ID NO: 4513 - DNA, 719 bp, Artificial Sequence
  chemically treated genomic DNA (Homo sapiens) CpG-island No: 4513
  misc_feature (9)..(9): n is either a, c, g or t
  misc_feature (136)..(136): n is either a, c, g or t
  misc_feature (416)..(416): n is either a, c, g or t
  misc_feature (434)..(434): n is either a, c, g or t
  misc_feature (440)..(440): n is either a, c, g or t
  misc_feature (446)..(446): n is either a, c, g or t
  misc_feature (488)..(488): n is either a, c, g or t
  misc_feature (633)..(633): n is either a, c, g or t
  misc_feature (642)..(642): n is either a, c, g or t
  misc_feature (644)..(644): n is either a, c, g or t
ggtcgttanacgagtagttgtacggaggtgtagaagaaggaggttattgttatttttttgataagttgggggcgtgggaggtttcgggagttcgaagtcgtttcgagcgggggtgggcggtgagcggattttcggngtgttgattaggtgtttggtggtagagtagggaaggggggaacggacgtcgattttagggattttttattcgtttacgttttttggcgttggttatacgtcgtcgttttagtattaattggaggtttttagtggacgagtagtcgttcgagggtagtcgtttgagtcggtagatagcggttagttgggtagcggttcgaattttttcgtaatacgttttttagtatttcggtttgcggggtgtttaggagcgcgggcggtcggcgcggggatttaggatntcgggcgcggggtttatnggtagnggtcgnaggtcgttgaggtcgggtttttatttgcgtattcggggtcgntacgaggttcgggcgggggcggggcgggggcgggagttggattatttgtaattatttttcggttgcgtattttaatttcggttttttttttggaggttgcgtttaggtatcgcgttgaataagtcgtataggtgtgattcgggancgttggagntnagtttcggttgtatatttggaatcgtcgggagcgtggtagtggtgttttttttaatttatatgttacggttttag

SEQ ID NO: 4514 - DNA, 719 bp, Artificial Sequence
  chemically treated genomic DNA (Homo sapiens) CpG-island No: 4514
  misc_feature (76)..(76): n is either a, c, g or t
  misc_feature (78)..(78): n is either a, c, g or t
  misc_feature (87)..(87): n is either a, c, g or t
  misc_feature (232)..(232): n is either a, c, g or t
  misc_feature (274)..(274): n is either a, c, g or t
  misc_feature (280)..(280): n is either a, c, g or t
  misc_feature (286)..(286): n is either a, c, g or t
  misc_feature (304)..(304): n is either a, c, g or t
  misc_feature (584)..(584): n is either a, c, g or t
  misc_feature (711)..(711): n is either a, c, g or t
ctaaaaccgtaacatataaattaaaaaaaacaccactaccacgctcccgacgattccaaatatacaaccgaaactnanctccaacgntcccgaatcacacctatacgacttattcaacgcgatacctaaacgcaacctccaaaaaaaaaaccgaaattaaaatacgcaaccgaaaaataattacaaataatccaactcccgcccccgccccgcccccgcccgaacctcgtancgaccccgaatacgcaaataaaaacccgacctcaacgacctncgaccnctaccnataaaccccgcgcccganatcctaaatccccgcgccgaccgcccgcgctcctaaacaccccgcaaaccgaaatactaaaaaacgtattacgaaaaaattcgaaccgctacccaactaaccgctatctaccgactcaaacgactaccctcgaacgactactcgtccactaaaaacctccaattaatactaaaacgacgacgtataaccaacgccaaaaaacgtaaacgaataaaaaatccctaaaatcgacgtccgttccccccttccctactctaccaccaaacacctaatcaacacnccgaaaatccgctcaccgcccacccccgctcgaaacgacttcgaactcccgaaacctcccacgcccccaacttatcaaaaaaataacaataacctccttcttctacacctccgtacaactactcgtntaacgacc

SEQ ID NO: 4515 - DNA, 719 bp, Artificial Sequence
  chemically treated genomic DNA (Homo sapiens) CpG-island No: 4515
  misc_feature (76)..(76): n is either a, c, g or t
  misc_feature (78)..(78): n is either a, c, g or t
  misc_feature (87)..(87): n is either a, c, g or t
  misc_feature (232)..(232): n is either a, c, g or t
  misc_feature (274)..(274): n is either a, c, g or t
  misc_feature (280)..(280): n is either a, c, g or t
  misc_feature (286)..(286): n is either a, c, g or t
  misc_feature (304)..(304): n is either a, c, g or t
  misc_feature (584)..(584): n is either a, c, g or t
  misc_feature (711)..(711): n is either a, c, g or t
ttggaatcgtggtatgtggattgagaaaaatattattattacgttttcggcggttttaggtgtgtagtcggggttngnttttagcgntttcgagttatatttgtgcggtttatttaacgcgatgtttggacgtagtttttagagaggaggtcgggattggaatacgtagtcggggaatggttgtaggtggtttagttttcgttttcgtttcgttttcgttcgggtttcgtgncggtttcgggtgcgtaggtgaaagttcggttttagcggtttncggttnttgttnatggatttcgcgttcggngttttagattttcgcgtcggtcgttcgcgtttttgggtatttcgtaagtcgaggtgttggaggacgtgttgcgggagagttcgggtcgttgtttagttggtcgttgtttgtcggtttaagcggttgttttcgggcggttattcgtttattgaaaatttttagttggtgttggagcggcggcgtgtggttaacgttaaggagcgtgagcgggtgagggatttttagggtcgacgttcgttttttttttttttgttttattattaaatatttggttaatatntcgggggttcgtttatcgtttattttcgttcgaggcgatttcgagttttcgaggttttttacgtttttagtttgttaggagaatggtagtggttttttttttttgtattttcgtgtagttgttcgtntggcggtt

SEQ ID NO: 4516 - DNA, 719 bp, Artificial Sequence
  chemically treated genomic DNA (Homo sapiens) CpG-island No: 4516
  misc_feature (9)..(9): n is either a, c, g or t
  misc_feature (136)..(136): n is either a, c, g or t
  misc_feature (416)..(416): n is either a, c, g or t
  misc_feature (434)..(434): n is either a, c, g or t
  misc_feature (440)..(440): n is either a, c, g or t
  misc_feature (446)..(446): n is either a, c, g or t
  misc_feature (488)..(488): n is either a, c, g or t
  misc_feature (633)..(633): n is either a, c, g or t
  misc_feature (642)..(642): n is either a, c, g or t
  misc_feature (644)..(644): n is either a, c, g or t
aaccgccanacgaacaactacacgaaaatacaaaaaaaaaaaaccactaccattctcctaacaaactaaaaacgtaaaaaacctcgaaaactcgaaatcgcctcgaacgaaaataaacgataaacgaacccccganatattaaccaaatatttaataataaaacaaaaaaaaaaaaaacgaacgtcgaccctaaaaatccctcacccgctcacgctccttaacgttaaccacacgccgccgctccaacaccaactaaaaattttcaataaacgaataaccgcccgaaaacaaccgcttaaaccgacaaacaacgaccaactaaacaacgacccgaactctcccgcaacacgtcctccaacacctcgacttacgaaatacccaaaaacgcgaacgaccgacgcgaaaatctaaaacnccgaacgcgaaatccatnaacaanaaccgnaaaccgctaaaaccgaactttcacctacgcacccgaaaccgncacgaaacccgaacgaaaacgaaacgaaaacgaaaactaaaccacctacaaccattccccgactacgtattccaatcccgacctcctctctaaaaactacgtccaaacatcgcgttaaataaaccgcacaaatataactcgaaancgctaaaancnaaccccgactacacacctaaaaccgccgaaaacgtaataataatatttttctcaatccacataccacgattccaa

SEQ ID NO: 4517 - DNA, 579 bp, Artificial Sequence
  chemically treated genomic DNA (Homo sapiens) CpG-island No: 4517
agagtattttgtatcgcggcgttcgggtggttgttgttgaagaagacgtcgtgatacgtttgttcgtttatggcggtcgtagagtatcggggagttgtttcggcgtttagtagcggaggtaatagcggcggtaagtagcgttttttttttttttcgtcgtttcgtttatattttagttagtagggagtagttttttgagcgcgggggtcggtcgaatcgtgacgggtcgggaaatgggttaaattgcggcgcgttggcggttcggggtttgtcgggaaatgtagtcgcggggcggggcgcgggtagcgcgttcgggcggtttgtagcggttgtgtttttagatttgcgtgtttcgggttcgttcgtttcggttcgtcgcgtagggggtcggttgggcggggagagcgggttttttttggggtcggttgggcgcgggcgggcgggtttttagtttttttcgtacgcggaagattcgcgggcggcgtattttgttgtatttaaaaatatatatatatatatatatatatatatacggaagttgttacgttaagatatttgttcgagttgtatattttttaa

SEQ ID NO: 4518 - DNA, 579 bp, Artificial Sequence
  chemically treated genomic DNA (Homo sapiens) CpG-island No: 4518
ttaaaaaatatacaactcgaacaaatatcttaacgtaacaacttccgtatatatatatatatatatatatatatatttttaaatacaacaaaatacgccgcccgcgaatcttccgcgtacgaaaaaaactaaaaacccgcccgcccgcgcccaaccgaccccaaaaaaaacccgctctccccgcccaaccgaccccctacgcgacgaaccgaaacgaacgaacccgaaacacgcaaatctaaaaacacaaccgctacaaaccgcccgaacgcgctacccgcgccccgccccgcgactacatttcccgacaaaccccgaaccgccaacgcgccgcaatttaacccatttcccgacccgtcacgattcgaccgacccccgcgctcaaaaaactactccctactaactaaaatataaacgaaacgacgaaaaaaaaaaaaaacgctacttaccgccgctattacctccgctactaaacgccgaaacaactccccgatactctacgaccgccataaacgaacaaacgtatcacgacgtcttcttcaacaacaaccacccgaacgccgcgatacaaaatactct

SEQ ID NO: 4519 - DNA, 579 bp, Artificial Sequence
  chemically treated genomic DNA (Homo sapiens) CpG-island No: 4519
ttaaaagatgtgtagttcgggtaggtattttggcgtgataattttcgtgtgtgtgtgtgtgtgtgtgtgtgtgtgtttttgaatgtaatagggtgcgtcgttcgcgaatttttcgcgtgcgaggaagattggagattcgttcgttcgcgtttagtcggttttagaggaaattcgtttttttcgtttagtcggttttttacgcggcgagtcggggcgggcgggttcgaggtacgtaagtttggaggtatagtcgttataggtcgttcgggcgcgttattcgcgtttcgtttcgcgattatatttttcggtaagtttcgggtcgttagcgcgtcgtagtttgatttatttttcggttcgttacggttcggtcggttttcgcgtttaggaggttgttttttgttgattggggtgtgggcgggacggcggagggaggaggaggcgttgtttgtcgtcgttgttgttttcgttgttgggcgtcggggtagtttttcggtattttgcggtcgttatggacgagtaggcgtgttacggcgttttttttagtaataattattcgggcgtcgcggtgtaaggtgtttt

SEQ ID NO: 4520 - DNA, 579 bp, Artificial Sequence
  chemically treated genomic DNA (Homo sapiens) CpG-island No: 4520
aaaacaccttacaccgcgacgcccgaataattattactaaaaaaaacgccgtaacacgcctactcgtccataacgaccgcaaaataccgaaaaactaccccgacgcccaacaacgaaaacaacaacgacgacaaacaacgcctcctcctccctccgccgtcccgcccacaccccaatcaacaaaaaacaacctcctaaacgcgaaaaccgaccgaaccgtaacgaaccgaaaaataaatcaaactacgacgcgctaacgacccgaaacttaccgaaaaatataatcgcgaaacgaaacgcgaataacgcgcccgaacgacctataacgactatacctccaaacttacgtacctcgaacccgcccgccccgactcgccgcgtaaaaaaccgactaaacgaaaaaaacgaatttcctctaaaaccgactaaacgcgaacgaacgaatctccaatcttcctcgcacgcgaaaaattcgcgaacgacgcaccctattacattcaaaaacacacacacacacacacacacacacacacgaaaattatcacgccaaaatacctacccgaactacacatcttttaa

SEQ ID NO: 4521 - DNA, 719 bp, Artificial Sequence
  chemically treated genomic DNA (Homo sapiens) CpG-island No: 4521
tcgtgcgtagtttcgaaggacggttgtaggtgcgttttttgcgcgttagttttaagttgggatgcgggggcggtagtgcgtttgcgagtgcgtcggtatgtcggcggtttacgggtggaagagtttggagggtgagtttagcgcggggtcgtagggtatttgtaggaagttacggcggtcgcgcgttcggttggcgatgcggttataggtggcggttagtaatgttaggggcgagtgtttgtttaggttcggggaggcgttgggggtgcggttttgtataggcggcgagggagggcggagaagagataaaaggttagttttaagcgcggatttcgggttagttcgtcgtttttacgttcgttattatatcgtcgtttttttttcgtttcggtcgtttttttttcgttatcgtattttacgtacgtatttatcggtcgagggaaatttttggtgtttgcgttatttgaacgtggggttcgcgagcgttttttgttaaattatttggtgtattgagacgttatttagttttagaggaagtaggcgcgaagtgggagggggaggtattcgacgggtttttttcggtttcgtggttagtaagagtcgggaaatatttataatttcgtcggtcggtcgtttttttttttattttttaagtttttttgtttttattgttttcgcgtttttttttggttcgttttaggttgaaattagtaggaggg

SEQ ID NO: 4522 - DNA, 719 bp, Artificial Sequence
  chemically treated genomic DNA (Homo sapiens) CpG-island No: 4522
ccctcctactaatttcaacctaaaacgaaccaaaaaaaaacgcgaaaacaataaaaacaaaaaaacttaaaaaataaaaaaaaaaacgaccgaccgacgaaattataaatatttcccgactcttactaaccacgaaaccgaaaaaaacccgtcgaatacctccccctcccacttcgcgcctacttcctctaaaactaaataacgtctcaatacaccaaataatttaacaaaaaacgctcgcgaaccccacgttcaaataacgcaaacaccaaaaatttccctcgaccgataaatacgtacgtaaaatacgataacgaaaaaaaaacgaccgaaacgaaaaaaaaacgacgatataataacgaacgtaaaaacgacgaactaacccgaaatccgcgcttaaaactaaccttttatctcttctccgccctccctcgccgcctatacaaaaccgcacccccaacgcctccccgaacctaaacaaacactcgcccctaacattactaaccgccacctataaccgcatcgccaaccgaacgcgcgaccgccgtaacttcctacaaataccctacgaccccgcgctaaactcaccctccaaactcttccacccgtaaaccgccgacataccgacgcactcgcaaacgcactaccgcccccgcatcccaacttaaaactaacgcgcaaaaaacgcacctacaaccgtccttcgaaactacgcacga

SEQ ID NO: 4523 - DNA, 719 bp, Artificial Sequence
  chemically treated genomic DNA (Homo sapiens) CpG-island No: 4523
tttttttgttgattttagtttggggcgggttagggaggagcgcgaaggtagtgaggataagagagtttaaaagatgggagggagagcggtcggtcggcggggttgtgggtgtttttcgatttttattgattacggagtcgggaggggttcgtcggatgttttttttttttatttcgcgtttgttttttttaaggttggatggcgttttagtgtattaagtagtttagtaagaagcgttcgcgggttttacgtttaggtagcgtaggtattaaaagtttttttcggtcggtgggtgcgtgcgtggggtgcggtggcgggggagggacggtcgggacggaggaggggcggcggtataatagcgggcgtgggggcggcgggttggttcggagttcgcgtttggagttaattttttgtttttttttcgttttttttcgtcgtttatgtaggatcgtatttttagcgttttttcggatttgggtaagtattcgtttttggtattgttggtcgttatttgtagtcgtatcgttagtcgggcgcgcggtcgtcgtgattttttgtaggtgttttacgatttcgcgttgggtttattttttaggtttttttattcgtggatcgtcgatatgtcggcgtattcgtaggcgtattgtcgttttcgtattttagtttggggttgacgcgtagaagacgtatttgtagtcgtttttcggggttgcgtacga

SEQ ID NO: 4524 - DNA, 719 bp, Artificial Sequence
  chemically treated genomic DNA (Homo sapiens) CpG-island No: 4524
tcgtacgcaaccccgaaaaacgactacaaatacgtcttctacgcgtcaaccccaaactaaaatacgaaaacgacaatacgcctacgaatacgccgacatatcgacgatccacgaataaaaaaacctaaaaaataaacccaacgcgaaatcgtaaaacacctacaaaaaatcacgacgaccgcgcgcccgactaacgatacgactacaaataacgaccaacaataccaaaaacgaatacttacccaaatccgaaaaaacgctaaaaatacgatcctacataaacgacgaaaaaaaacgaaaaaaaaacaaaaaattaactccaaacgcgaactccgaaccaacccgccgcccccacgcccgctattataccgccgcccctcctccgtcccgaccgtccctcccccgccaccgcaccccacgcacgcacccaccgaccgaaaaaaacttttaatacctacgctacctaaacgtaaaacccgcgaacgcttcttactaaactacttaatacactaaaacgccatccaaccttaaaaaaaacaaacgcgaaataaaaaaaaaaaacatccgacgaacccctcccgactccgtaatcaataaaaatcgaaaaacacccacaaccccgccgaccgaccgctctccctcccatcttttaaactctcttatcctcactaccttcgcgctcctccctaacccgccccaaactaaaatcaacaaaaaaa

SEQ ID NO: 4525 - DNA, 553 bp, Artificial Sequence
  chemically treated genomic DNA (Homo sapiens) CpG-island No: 4525
tttgcgtagcgtattcgtggagagtagggattagggcgggtaggaagtatttatttcgggaggttgggtggtcggcgttgggatggggttggttgagaagtcgcgggaggagaggatttggttgaaaagttacggttgggcgttgggaagtttaggtggtcgttagtttatttatttcggttttgcgatagcgagtcgggtattttcgttttttttttgtatagcgtttagcgattcgttcggttcggttttgataggcgtaatttgttcggcgttatttttagttgttttttcgttttcgttagttttttttcgtacgcgagcgttaggagaagagagagattcggagaggcggttgtacggtttcggggtaggcgggggtagagtggggaggcggggatcggatcggcggggaaattacgaggtcgttgttcgcgggggtagttagtcggcggagcggcggggtttttttgtaggtgtttgatcgtttttggagttttatagggcgattataaatttagtttacggttttgcgttcggaaggaaaaaaaaa

SEQ ID NO: 4526 - DNA, 553 bp, Artificial Sequence
  chemically treated genomic DNA (Homo sapiens) CpG-island No: 4526
tttttttttccttccgaacgcaaaaccgtaaactaaatttataatcgccctataaaactccaaaaacgatcaaacacctacaaaaaaaccccgccgctccgccgactaactacccccgcgaacaacgacctcgtaatttccccgccgatccgatccccgcctccccactctacccccgcctaccccgaaaccgtacaaccgcctctccgaatctctctcttctcctaacgctcgcgtacgaaaaaaaactaacgaaaacgaaaaaacaactaaaaataacgccgaacaaattacgcctatcaaaaccgaaccgaacgaatcgctaaacgctatacaaaaaaaaaacgaaaatacccgactcgctatcgcaaaaccgaaataaataaactaacgaccacctaaacttcccaacgcccaaccgtaacttttcaaccaaatcctctcctcccgcgacttctcaaccaaccccatcccaacgccgaccacccaacctcccgaaataaatacttcctacccgccctaatccctactctccacgaatacgctacgcaaa

SEQ ID NO: 4527 - DNA, 553 bp, Artificial Sequence
  chemically treated genomic DNA (Homo sapiens) CpG-island No: 4527
ttttttttttttttcgggcgtaaaatcgtgagttggatttataatcgttttataaagttttagaggcggttaggtatttgtagaggagtttcgtcgtttcgtcgattagttgttttcgcgagtaacggtttcgtgattttttcgtcgattcggttttcgtttttttattttgttttcgtttatttcggagtcgtgtagtcgttttttcgaatttttttttttttttggcgttcgcgtgcgagagggaattagcgagaacgaggaagtagttggaggtgacgtcgggtagattacgtttgttagggtcgagtcgagcggatcgttgggcgttgtgtagaggaaaggcgggagtgttcggttcgttgtcgtagagtcgaggtgggtaagttagcgattatttggattttttagcgtttaatcgtggttttttagttaggtttttttttttcgcggttttttaattaattttattttagcgtcggttatttaatttttcgaaatgagtgttttttgttcgttttagtttttgttttttacgggtgcgttgcgtagg

SEQ ID NO: 4528 - DNA, 553 bp, Artificial Sequence
  chemically treated genomic DNA (Homo sapiens) CpG-island No: 4528
cctacgcaacgcacccgtaaaaaacaaaaactaaaacgaacaaaaaacactcatttcgaaaaattaaataaccgacgctaaaataaaattaattaaaaaaccgcgaaaaaaaaaaacctaactaaaaaaccacgattaaacgctaaaaaatccaaataatcgctaacttacccacctcgactctacgacaacgaaccgaacactcccgcctttcctctacacaacgcccaacgatccgctcgactcgaccctaacaaacgtaatctacccgacgtcacctccaactacttcctcgttctcgctaattccctctcgcacgcgaacgccaaaaaaaaaaaaaaattcgaaaaaacgactacacgactccgaaataaacgaaaacaaaataaaaaaacgaaaaccgaatcgacgaaaaaatcacgaaaccgttactcgcgaaaacaactaatcgacgaaacgacgaaactcctctacaaatacctaaccgcctctaaaactttataaaacgattataaatccaactcacgattttacgcccgaaaaaaaaaaaaaa

SEQ ID NO: 4529 - DNA, 667 bp, Artificial Sequence
  chemically treated genomic DNA (Homo sapiens) CpG-island No: 4529
ttcgtttaatttcggttttagcgattttgagttttttattttggtgagttttgacgtgtttcgcgaggtggtcgttgcgtatgaagcgtttgtcgtattcgggataggtaaagcgtttttcgttcgtgtgagttcgtaggtgtcgttgtagttcgttcgagcgcgtgaagtttttttcgtagaagagttagttgtatacgaagggtcgttcgttcgtgtgttagcgtaggtgcgtttttaggtgcgacgttttttcgtatattttgtcgtagttcggtacgtggtatacgtgttgttttttttttttcggtttcgttcgggggcgtcgtcgtcgtttggtagttgggatagcggtagcggcggtattttttggtcgtggtcgttaggggggttttggtttgtagtagcgcggcgatttggttttggtattgcgtaaagttcgacgggtttaatattaggtttttttgtagggcggcggcggtagtagtagcggcgtagaggcggggaagcggggcgcgtggggggttcggtataggcgtcggagaggtcgtttttcggaatttcggagttttcggttcggcgttcgttgcgggatgttttattacgggaggtcgtcgggggtcgggttgggtgataattggcggtaggtgggcggcgggggcggtgg

SEQ ID NO: 4530 - DNA, 667 bp, Artificial Sequence
  chemically treated genomic DNA (Homo sapiens) CpG-island No: 4530
ccaccgcccccgccgcccacctaccgccaattatcacccaacccgacccccgacgacctcccgtaataaaacatcccgcaacgaacgccgaaccgaaaactccgaaattccgaaaaacgacctctccgacgcctataccgaaccccccacgcgccccgcttccccgcctctacgccgctactactaccgccgccgccctacaaaaaaacctaatattaaacccgtcgaactttacgcaataccaaaaccaaatcgccgcgctactacaaaccaaaacccccctaacgaccacgaccaaaaaataccgccgctaccgctatcccaactaccaaacgacgacgacgcccccgaacgaaaccgaaaaaaaaaaaacaacacgtataccacgtaccgaactacgacaaaatatacgaaaaaacgtcgcacctaaaaacgcacctacgctaacacacgaacgaacgacccttcgtatacaactaactcttctacgaaaaaaacttcacgcgctcgaacgaactacaacgacacctacgaactcacacgaacgaaaaacgctttacctatcccgaatacgacaaacgcttcatacgcaacgaccacctcgcgaaacacgtcaaaactcaccaaaataaaaaactcaaaatcgctaaaaccgaaattaaacgaa

SEQ ID NO: 4531 - DNA, 667 bp, Artificial Sequence
  chemically treated genomic DNA (Homo sapiens) CpG-island No: 4531
ttatcgttttcgtcgtttatttgtcgttagttgttatttaattcggttttcgacgatttttcgtggtggagtatttcgtagcgggcgtcgggtcgggggtttcggggtttcgggaagcggttttttcggcgtttgtgtcgggttttttacgcgtttcgttttttcgtttttgcgtcgttgttgttgtcgtcgtcgttttataaagaggtttggtgttgggttcgtcggattttgcgtagtattagagttagatcgtcgcgttgttgtagattaaggtttttttggcggttacggttaggaggtgtcgtcgttgtcgttgttttaattgttaggcggcggcggcgttttcgagcggagtcggggaagaagaagtagtacgtgtgttacgtgtcgggttgcggtaaggtgtacgggaagacgtcgtatttgaaggcgtatttgcgttggtatacgggcgagcgatttttcgtgtgtaattggtttttttgcgggaagagttttacgcgttcggacgagttgtagcggtatttgcggatttatacgggcgagaagcgttttgtttgtttcgagtgcggtaagcgttttatgcgtagcgattatttcgcgaagtacgttaagatttattagaataagaagtttaaagtcgttgaggtcggggttaagcggg

SEQ ID NO: 4532 - DNA, 667 bp, Artificial Sequence
  chemically treated genomic DNA (Homo sapiens) CpG-island No: 4532
cccgcttaaccccgacctcaacgactttaaacttcttattctaataaatcttaacgtacttcgcgaaataatcgctacgcataaaacgcttaccgcactcgaaacaaacaaaacgcttctcgcccgtataaatccgcaaataccgctacaactcgtccgaacgcgtaaaactcttcccgcaaaaaaaccaattacacacgaaaaatcgctcgcccgtataccaacgcaaatacgccttcaaatacgacgtcttcccgtacaccttaccgcaacccgacacgtaacacacgtactacttcttcttccccgactccgctcgaaaacgccgccgccgcctaacaattaaaacaacgacaacgacgacacctcctaaccgtaaccgccaaaaaaaccttaatctacaacaacgcgacgatctaactctaatactacgcaaaatccgacgaacccaacaccaaacctctttataaaacgacgacgacaacaacaacgacgcaaaaacgaaaaaacgaaacgcgtaaaaaacccgacacaaacgccgaaaaaaccgcttcccgaaaccccgaaacccccgacccgacgcccgctacgaaatactccaccacgaaaaatcgtcgaaaaccgaattaaataacaactaacgacaaataaacgacgaaaacgataa

SEQ ID NO: 4533 - DNA, 520 bp, Artificial Sequence
  chemically treated genomic DNA (Homo sapiens) CpG-island No: 4533
tatatatcgagagttagttcggttagttgttcgcgcggacgtgggggtttcgagtcgggaacgtagcgtcgtcgtggagattgtacggcgcgtggaggaagttcgggtagtagcgagggtgggggttgggggaattgggcgacggcgggggaggtggcgggggcgggggcgggggtaggggtagttcgggaattacggagaggtagggtggaggcgggtttaggcgtaggcggtggagggcgcgggacggagcgggcgcgcgaggagggtcggggcgggttgggaggcgggttcggggggcggggtaggttcggtcgtcgatttgagggatagtttcgcgttgtgggtgttcgcggcgtcggaaattgggttatatattttcggattgacgtgcgtatttacggttatttttaggagcgtcgaagaaggaagaaggttggaatgtcggtgtttatatttgatttttagcgagggagagggaaggggtcgggtggtttagagttttaatttggggagtaaa

SEQ ID NO: 4534 - DNA, 520 bp, Artificial Sequence
  chemically treated genomic DNA (Homo sapiens) CpG-island No: 4534
tttactccccaaattaaaactctaaaccacccgaccccttccctctccctcgctaaaaatcaaatataaacaccgacattccaaccttcttccttcttcgacgctcctaaaaataaccgtaaatacgcacgtcaatccgaaaatatataacccaatttccgacgccgcgaacacccacaacgcgaaactatccctcaaatcgacgaccgaacctaccccgccccccgaacccgcctcccaacccgccccgaccctcctcgcgcgcccgctccgtcccgcgccctccaccgcctacgcctaaacccgcctccaccctacctctccgtaattcccgaactacccctacccccgcccccgcccccgccacctcccccgccgtcgcccaattcccccaacccccaccctcgctactacccgaacttcctccacgcgccgtacaatctccacgacgacgctacgttcccgactcgaaacccccacgtccgcgcgaacaactaaccgaactaactctcgatatata

SEQ ID NO: 4535 - DNA, 520 bp, Artificial Sequence
  chemically treated genomic DNA (Homo sapiens) CpG-island No: 4535
tttattttttaagttaaaattttgagttattcggttttttttttttttttcgttaggaattaggtatggatatcgatattttaattttttttttttttcggcgtttttgaaggtaatcgtgggtgcgtacgttaattcgagggtgtgtggtttagttttcggcgtcgcggatatttataacgcggggttgttttttaagtcggcggtcgggtttgtttcgtttttcggattcgttttttagttcgtttcggtttttttcgcgcgttcgtttcgtttcgcgttttttatcgtttacgtttgggttcgtttttattttgttttttcgtggttttcgggttgtttttgttttcgttttcgttttcgttatttttttcgtcgtcgtttaatttttttagtttttattttcgttgttgttcgagttttttttacgcgtcgtgtagtttttacggcgacgttgcgttttcgattcggagtttttacgttcgcgcgagtagttagtcgggttggttttcggtgtgtg

SEQ ID NO: 4536 - DNA, 520 bp, Artificial Sequence
  chemically treated genomic DNA (Homo sapiens) CpG-island No: 4536
cacacaccgaaaaccaacccgactaactactcgcgcgaacgtaaaaactccgaatcgaaaacgcaacgtcgccgtaaaaactacacgacgcgtaaaaaaaactcgaacaacaacgaaaataaaaactaaaaaaattaaacgacgacgaaaaaaataacgaaaacgaaaacgaaaacaaaaacaacccgaaaaccacgaaaaaacaaaataaaaacgaacccaaacgtaaacgataaaaaacgcgaaacgaaacgaacgcgcgaaaaaaaccgaaacgaactaaaaaacgaatccgaaaaacgaaacaaacccgaccgccgacttaaaaaacaaccccgcgttataaatatccgcgacgccgaaaactaaaccacacaccctcgaattaacgtacgcacccacgattaccttcaaaaacgccgaaaaaaaaaaaaaattaaaatatcgatatccatacctaattcctaacgaaaaaaaaaaaaaaaaccgaataactcaaaattttaacttaaaaaataaa

SEQ ID NO: 4537 - DNA, 697 bp, Artificial Sequence
  chemically treated genomic DNA (Homo sapiens) CpG-island No: 4537
cggtttttatcgcgtagcggcgttggggcggttcgggcgttcgtcgcgggggtgggcgtggcgttgcgcgggagggattcgtagacggtagagggttcgcggggagcgggcggggcgttgagagcgcgtatatagatatttaaaaaatatataaataagcggtttttgtgtcgcggcggaacgcgttgtgttcgcggtcgttcggttcgttcggtagtttcgggttagttcggtgaattaagcggattcgggatggtcgagtcgggggtcggcgttttggtggggttgtttgggagaggggtcggggcggcgttgggtggagaaggggttcgcgggggagcgcgggggcgcgcgggggcgcgtttcgagttagtacggtagtttcgggagaggggagtgcggcgggcggagaggtcggtagagggcggggagggtagttcggattttttattagtatagcgcggtgtacgcgtttttcgttgagatgttaggttttgtcgtttttttgatttggaaaagaaggaaagagttacgattttttttttttcgtattttagtgtttcgtttgtttattttgatcgtggtattcgtataagtcgtttgtgtgttttagagaggttagttttgtatgtgttgttcgtgagcgtgtttggatttacgtataggatttagttgagcgggatatttatacgattgt

SEQ ID NO: 4538 - DNA, 697 bp, Artificial Sequence
  chemically treated genomic DNA (Homo sapiens) CpG-island No: 4538
acaatcgtataaatatcccgctcaactaaatcctatacgtaaatccaaacacgctcacgaacaacacatacaaaactaacctctctaaaacacacaaacgacttatacgaataccacgatcaaaataaacaaacgaaacactaaaatacgaaaaaaaaaaaatcgtaactctttccttcttttccaaatcaaaaaaacgacaaaacctaacatctcaacgaaaaacgcgtacaccgcgctatactaataaaaaatccgaactaccctccccgccctctaccgacctctccgcccgccgcactcccctctcccgaaactaccgtactaactcgaaacgcgcccccgcgcgcccccgcgctcccccgcgaaccccttctccacccaacgccgccccgacccctctcccaaacaaccccaccaaaacgccgacccccgactcgaccatcccgaatccgcttaattcaccgaactaacccgaaactaccgaacgaaccgaacgaccgcgaacacaacgcgttccgccgcgacacaaaaaccgcttatttatatattttttaaatatctatatacgcgctctcaacgccccgcccgctccccgcgaaccctctaccgtctacgaatccctcccgcgcaacgccacgcccacccccgcgacgaacgcccgaaccgccccaacgccgctacgcgataaaaaccg

SEQ ID NO: 4539 - DNA, 697 bp, Artificial Sequence
  chemically treated genomic DNA (Homo sapiens) CpG-island No: 4539
gtagtcgtgtaaatgtttcgtttagttgggttttatgcgtaggtttaagtacgtttacggatagtatatgtagggttggtttttttggaatatatagacggtttatgcgggtgttacggttagggtgagtaaacggagtattggaatgcgagaggagagaggtcgtggtttttttttttttttttaagttaaagaggcggtagggtttggtattttagcgggaagcgcgtgtatcgcgttgtgttggtgggaggttcgggttgtttttttcgttttttgtcggttttttcgttcgtcgtatttttttttttcggagttgtcgtattggttcgaggcgcgttttcgcgcgttttcgcgttttttcgcgagttttttttttatttagcgtcgtttcggttttttttttagatagttttattagaacgtcggttttcggttcggttatttcgggttcgtttagtttatcgggttgattcggggttgtcggacgggtcggacggtcgcgagtatagcgcgtttcgtcgcggtataggggtcgtttgtttgtgtgttttttgggtgtttgtgtgcgcgtttttaacgtttcgttcgtttttcgcggattttttgtcgtttgcgggtttttttcgcgtagcgttacgtttattttcgcggcggacgttcgggtcgttttaacgtcgttgcgcggtggagatcg

SEQ ID NO: 4540 - DNA, 697 bp, Artificial Sequence
  chemically treated genomic DNA (Homo sapiens) CpG-island No: 4540
cgatctccaccgcgcaacgacgttaaaacgacccgaacgtccgccgcgaaaataaacgtaacgctacgcgaaaaaaacccgcaaacgacaaaaaatccgcgaaaaacgaacgaaacgttaaaaacgcgcacacaaacacccaaaaaacacacaaacaaacgacccctataccgcgacgaaacgcgctatactcgcgaccgtccgacccgtccgacaaccccgaatcaacccgataaactaaacgaacccgaaataaccgaaccgaaaaccgacgttctaataaaactatctaaaaaaaaaaccgaaacgacgctaaataaaaaaaaaactcgcgaaaaaacgcgaaaacgcgcgaaaacgcgcctcgaaccaatacgacaactccgaaaaaaaaaaatacgacgaacgaaaaaaccgacaaaaaacgaaaaaaacaacccgaacctcccaccaacacaacgcgatacacgcgcttcccgctaaaataccaaaccctaccgcctctttaacttaaaaaaaaaaaaaaaaaccacgacctctctcctctcgcattccaatactccgtttactcaccctaaccgtaacacccgcataaaccgtctatatattccaaaaaaaccaaccctacatatactatccgtaaacgtacttaaacctacgcataaaacccaactaaacgaaacatttacacgactac

SEQ ID NO: 4541 - DNA, 748 bp, Artificial Sequence
  chemically treated genomic DNA (Homo sapiens) CpG-island No: 4541
  misc_feature (6)..(6): n is either a, c, g or t
  misc_feature (75)..(75): n is either a, c, g or t
  misc_feature (95)..(95): n is either a, c, g or t
  misc_feature (108)..(108): n is either a, c, g or t
  misc_feature (111)..(111): n is either a, c, g or t
  misc_feature (135)..(135): n is either a, c, g or t
  misc_feature (146)..(146): n is either a, c, g or t
  misc_feature (153)..(153): n is either a, c, g or t
  misc_feature (158)..(158): n is either a, c, g or t
  misc_feature (165)..(165): n is either a, c, g or t
  misc_feature (179)..(179): n is either a, c, g or t
  misc_feature (181)..(181): n is either a, c, g or t
  misc_feature (183)..(183): n is either a, c, g or t
  misc_feature (185)..(185): n is either a, c, g or t
  misc_feature (187)..(187): n is either a, c, g or t
  misc_feature (195)..(195): n is either a, c, g or t
  misc_feature (231)..(231): n is either a, c, g or t
  misc_feature (319)..(319): n is either a, c, g or t
  misc_feature (542)..(543): n is either a, c, g or t
  misc_feature (545)..(545): n is either a, c, g or t
  misc_feature (548)..(548): n is either a, c, g or t
  misc_feature (697)..(697): n is either a, c, g or t
  misc_feature (739)..(739): n is either a, c, g or t
  misc_feature (741)..(741): n is either a, c, g or t
tgtttntgcgtaagcgttagtaagcgattaggagggggagtgagagagtgaaagggaatgtggaagtttcgatgncgttatttggcgttatttgngggttttaatttntgnacgtttgcgcggtggttttcgggntttcgcgcgtngcgggtngggtngttcggntgcgtattgcgtangntnangngcggcggntggtagggggaggtggaggttgtggagcggtagttntagtagcgggtttcgggattgaggtagtagcgggggcggcggcgggcggaagttcgaggtgacgaaggtagcggcggcggcggtcgtntttttttacggtggcggagattaaggcggcggcggcggacggggagcggttcggtttcggttttttgttcgttggttgtggtaggtcgtcgtggggcggttcgttttcgtttttcgcggtttttttttcggtttttttttcggggagacgtcgggggtttggtcggttcgtatttagattgttgttgtagtcgtcgtcgggggagtcggaggcggtggcggtnntnatngggcggtttggtttttgggggggatgtggagtcgggattgttcgtcgaggtgcgcggttttaacggggttttttataaggtgagacggcgcgtcgattggggacgtcggtttttagtttttttttttggtcggagtaggaacgcgtggnggcgggatcgagtttttggagttgagttttggtttttagaantntttggat

SEQ ID NO: 4542 - DNA, 748 bp, Artificial Sequence
  chemically treated genomic DNA (Homo sapiens) CpG-island No: 4542
  misc_feature (8)..(8): n is either a, c, g or t
  misc_feature (10)..(10): n is either a, c, g or t
  misc_feature (52)..(52): n is either a, c, g or t
  misc_feature (201)..(201): n is either a, c, g or t
  misc_feature (204)..(204): n is either a, c, g or t
  misc_feature (206)..(207): n is either a, c, g or t
  misc_feature (430)..(430): n is either a, c, g or t
  misc_feature (518)..(518): n is either a, c, g or t
  misc_feature (554)..(554): n is either a, c, g or t
  misc_feature (562)..(562): n is either a, c, g or t
  misc_feature (564)..(564): n is either a, c, g or t
  misc_feature (566)..(566): n is either a, c, g or t
  misc_feature (568)..(568): n is either a, c, g or t
  misc_feature (570)..(570): n is either a, c, g or t
  misc_feature (584)..(584): n is either a, c, g or t
  misc_feature (591)..(591): n is either a, c, g or t
  misc_feature (596)..(596): n is either a, c, g or t
  misc_feature (603)..(603): n is either a, c, g or t
  misc_feature (614)..(614): n is either a, c, g or t
  misc_feature (638)..(638): n is either a, c, g or t
  misc_feature (641)..(641): n is either a, c, g or t
  misc_feature (654)..(654): n is either a, c, g or t
  misc_feature (674)..(674): n is either a, c, g or t
  misc_feature (743)..(743): n is either a, c, g or t
atccaaananttctaaaaaccaaaactcaactccaaaaactcgatcccgccnccacgcgttcctactccgaccaaaaaaaaaaactaaaaaccgacgtccccaatcgacgcgccgtctcaccttataaaaaaccccgttaaaaccgcgcacctcgacgaacaatcccgactccacatcccccccaaaaaccaaaccgcccnatnannaccgccaccgcctccgactcccccgacgacgactacaacaacaatctaaatacgaaccgaccaaacccccgacgtctccccgaaaaaaaaaccgaaaaaaaaaccgcgaaaaacgaaaacgaaccgccccacgacgacctaccacaaccaacgaacaaaaaaccgaaaccgaaccgctccccgtccgccgccgccgccttaatctccgccaccgtaaaaaaanacgaccgccgccgccgctaccttcgtcacctcgaacttccgcccgccgccgcccccgctactacctcaatcccgaaacccgctactanaactaccgctccacaacctccacctccccctaccanccgccgcncntnancntacgcaatacgcanccgaacnacccnacccgcnacgcgcgaaancccgaaaaccaccgcgcaaacgtncanaaattaaaacccncaaataacgccaaataacgncatcgaaacttccacattccctttcactctctcactccccctcctaatcgcttactaacgcttacgcanaaaca

SEQ ID NO: 4543 - DNA, 748 bp, Artificial Sequence
  chemically treated genomic DNA (Homo sapiens) CpG-island No: 4543
  misc_feature (8)..(8): n is either a, c, g or t
  misc_feature (10)..(10): n is either a, c, g or t
  misc_feature (52)..(52): n is either a, c, g or t
  misc_feature (201)..(201): n is either a, c, g or t
  misc_feature (204)..(204): n is either a, c, g or t
  misc_feature (206)..(207): n is either a, c, g or t
  misc_feature (430)..(430): n is either a, c, g or t
  misc_feature (518)..(518): n is either a, c, g or t
  misc_feature (554)..(554): n is either a, c, g or t
  misc_feature (562)..(562): n is either a, c, g or t
  misc_feature (564)..(564): n is either a, c, g or t
  misc_feature (566)..(566): n is either a, c, g or t
  misc_feature (568)..(568): n is either a, c, g or t
  misc_feature (570)..(570): n is either a, c, g or t
  misc_feature (584)..(584): n is either a, c, g or t
  misc_feature (591)..(591): n is either a, c, g or t
  misc_feature (596)..(596): n is either a, c, g or t
  misc_feature (603)..(603): n is either a, c, g or t
  misc_feature (614)..(614): n is either a, c, g or t
  misc_feature (638)..(638): n is either a, c, g or t
  misc_feature (641)..(641): n is either a, c, g or t
  misc_feature (654)..(654): n is either a, c, g or t
  misc_feature (674)..(674): n is either a, c, g or t
  misc_feature (743)..(743): n is either a, c, g or t
gtttaagnanttttaagggttaggatttagttttagaagttcgatttcgttnttacgcgtttttgtttcggttaggggagggggttaaggatcggcgtttttagtcggcgcgtcgttttattttgtagaaggtttcgttggagtcgcgtatttcgacgggtagtttcggttttatattttttttagaggttaggtcgtttnatngnngtcgttatcgttttcgattttttcggcggcggttgtagtagtagtttgagtgcgggtcggttaggttttcggcgttttttcggaggaggagtcggagggggagtcgcggggggcgggagcgggtcgttttacggcggtttgttatagttaacgagtagggggtcggggtcgggtcgtttttcgttcgtcgtcgtcgttttggttttcgttatcgtgagggaanacggtcgtcgtcgtcgttgttttcgttatttcgagttttcgttcgtcgtcgttttcgttgttgttttagtttcgggattcgttgttgnggttgtcgttttatagtttttatttttttttgttantcgtcgtntntnantntgcgtaatgcgtantcgggtnatttngttcgtnacgcgcggggnttcgagggttatcgcgtaggcgtntanaggttagagtttntaggtagcgttaagtagcgntatcggggtttttatatttttttttatttttttatttttttttttggtcgtttgttagcgtttgcgtangaata

SEQ ID NO: 4544 - DNA, 748 bp, Artificial Sequence
  chemically treated genomic DNA (Homo sapiens) CpG-island No: 4544
  misc_feature (6)..(6): n is either a, c, g or t
  misc_feature (75)..(75): n is either a, c, g or t
  misc_feature (95)..(95): n is either a, c, g or t
  misc_feature (108)..(108): n is either a, c, g or t
  misc_feature (111)..(111): n is either a, c, g or t
  misc_feature (135)..(135): n is either a, c, g or t
  misc_feature (146)..(146): n is either a, c, g or t
  misc_feature (153)..(153): n is either a, c, g or t
  misc_feature (158)..(158): n is either a, c, g or t
  misc_feature (165)..(165): n is either a, c, g or t
  misc_feature (179)..(179): n is either a, c, g or t
  misc_feature (181)..(181): n is either a, c, g or t
  misc_feature (183)..(183): n is either a, c, g or t
  misc_feature (185)..(185): n is either a, c, g or t
  misc_feature (187)..(187): n is either a, c, g or t
  misc_feature (195)..(195): n is either a, c, g or t
  misc_feature (231)..(231): n is either a, c, g or t
  misc_feature (319)..(319): n is either a, c, g or t
  misc_feature (542)..(543): n is either a, c, g or t
  misc_feature (545)..(545): n is either a, c, g or t
  misc_feature (548)..(548): n is either a, c, g or t
  misc_feature (697)..(697): n is either a, c, g or t
  misc_feature (739)..(739): n is either a, c, g or t
  misc_feature (741)..(741): n is either a, c, g or t
tattcntacgcaaacgctaacaaacgaccaaaaaaaaaaataaaaaaataaaaaaaaatataaaaaccccgatancgctacttaacgctacctanaaactctaacctntanacgcctacgcgataaccctcgaanccccgcgcgtnacgaacnaaatnacccgantacgcattacgcanantnananacgacgantaacaaaaaaaaataaaaactataaaacgacaaccncaacaacgaatcccgaaactaaaacaacaacgaaaacgacgacgaacgaaaactcgaaataacgaaaacaacgacgacgacgaccgtnttccctcacgataacgaaaaccaaaacgacgacgacgaacgaaaaacgacccgaccccgaccccctactcgttaactataacaaaccgccgtaaaacgacccgctcccgccccccgcgactccccctccgactcctcctccgaaaaaacgccgaaaacctaaccgacccgcactcaaactactactacaaccgccgccgaaaaaatcgaaaacgataacgacnncnatnaaacgacctaacctctaaaaaaaatataaaaccgaaactacccgtcgaaatacgcgactccaacgaaaccttctacaaaataaaacgacgcgccgactaaaaacgccgatccttaaccccctcccctaaccgaaacaaaaacgcgtaanaacgaaatcgaacttctaaaactaaatcctaacccttaaaantncttaaac

SEQ ID NO: 4545 - DNA, 905 bp, Artificial Sequence
  chemically treated genomic DNA (Homo sapiens) CpG-island No: 4545
aaaacggaagtttttagaaagaggaaagataggattcgagcggggttttaggtagatggagcgcgtcggtagtttgtggttagggattttagtatcgacgggaaagaggaggtttgggtattttgcgtttcgggcgcgcgcggcgcgtgaggtgagggggagggcgcggtttcgtattagttagcggtcgtttggcgtttagtcgtatttcggggggcggggttgagttttcgggtcgtagtgcgattggcggaggcgagtgggtgacgttaacggtcggcgcgaggttcgttttcggtttgtttcgttttcgcgcgcgtcggcggcggggtagtttcgttttggttcgcgtcgcgttttcgcgtttagttcgcgcgttagtcggtttttagcgcggttgcggggcggagagttgcggttggtttagcgcgtttatttgaggaggcggcggggttcgtaggcgtcgcgggacgaggagatcggagtcgggagattcgcgtagcgttatggtttttattggttttaaagttgttgtcggagagagtaagtggagtcgggatttttttagtaggcggggattgcggttttcgaggagtttcgcgcggtttttgtcggtagcgtttaggttttcgagcgggttgtcggttttgcgtttcgggtttgaggtttttggttcgtggggtttcgttatttaggcgtcgttcgcgcgagaggaaggtttgtttcgttttttttttttttattttatgttttattttagttttttttttgtagttcgtttttttttttcgttatttttttttttcgcggtttttgttttttttttttttgtatttttttttttttttattttttttttttttttttttttttatttttattttttttttttcgttttatttttt

SEQ ID NO: 4546 - DNA, 905 bp, Artificial Sequence
  chemically treated genomic DNA (Homo sapiens) CpG-island No: 4546
aaaaaataaaacgaaaaaaaaaaaataaaaataaaaaaaaaaaaaaaaaaaaaaaataaaaaaaaaaaaaaatacaaaaaaaaaaaaaacaaaaaccgcgaaaaaaaaaaataacgaaaaaaaaaaacgaactacaaaaaaaaaactaaaataaaacataaaataaaaaaaaaaaaaacgaaacaaaccttcctctcgcgcgaacgacgcctaaataacgaaaccccacgaaccaaaaacctcaaacccgaaacgcaaaaccgacaacccgctcgaaaacctaaacgctaccgacaaaaaccgcgcgaaactcctcgaaaaccgcaatccccgcctactaaaaaaatcccgactccacttactctctccgacaacaactttaaaaccaataaaaaccataacgctacgcgaatctcccgactccgatctcctcgtcccgcgacgcctacgaaccccgccgcctcctcaaataaacgcgctaaaccaaccgcaactctccgccccgcaaccgcgctaaaaaccgactaacgcgcgaactaaacgcgaaaacgcgacgcgaaccaaaacgaaactaccccgccgccgacgcgcgcgaaaacgaaacaaaccgaaaacgaacctcgcgccgaccgttaacgtcacccactcgcctccgccaatcgcactacgacccgaaaactcaaccccgccccccgaaatacgactaaacgccaaacgaccgctaactaatacgaaaccgcgccctccccctcacctcacgcgccgcgcgcgcccgaaacgcaaaatacccaaacctcctctttcccgtcgatactaaaatccctaaccacaaactaccgacgcgctccatctacctaaaaccccgctcgaatcctatctttcctctttctaaaaacttccgtttt

SEQ ID NO: 4547 - DNA, 905 bp, Artificial Sequence
  chemically treated genomic DNA (Homo sapiens) CpG-island No: 4547
gaaggatggggcgaggggagagaaatgggggtgaagggaagagagggagggagggatggaggggaaggaggatgtagggaaaagggagatagggatcgcgaggaaggaggatggcgagggaggagggcgggttgtagggggagggttggggtgaaatatgaggtgagggaggggagagcggggtaagtttttttttcgcgcgggcggcgtttgaataacgggattttacggattaggagttttaggttcggggcgtagggtcggtagttcgttcggaggtttgggcgttgtcggtaggggtcgcgcggggtttttcgggagtcgtagttttcgtttgttggaaggatttcggttttatttatttttttcgataatagttttgaggttaatgggggttatggcgttgcgcgagtttttcggtttcgattttttcgtttcgcgacgtttgcggatttcgtcgtttttttaggtgggcgcgttgggttagtcgtagtttttcgtttcgtagtcgcgttagggatcgattgacgcgcggattgggcgcgggggcgcggcgcgagttagagcgaggttgtttcgtcgtcggcgcgcgcgggggcggggtaagtcgggggcgggtttcgcgtcggtcgttggcgttatttattcgttttcgttaatcgtattgcggttcggaggtttaatttcgtttttcgagatgcggttgggcgttaggcggtcgttggttggtgcggagtcgcgtttttttttttattttacgcgtcgcgcgcgttcggggcgtagggtatttaggttttttttttttcgtcggtgttgggatttttggttataggttatcgacgcgttttatttgtttgaaatttcgttcgggttttgttttttttttttttgggagttttcgtttt

SEQ ID NO: 4548 - DNA, 905 bp, Artificial Sequence
  chemically treated genomic DNA (Homo sapiens) CpG-island No: 4548
aaaacgaaaactcccaaaaaaaaaaaaaacaaaacccgaacgaaatttcaaacaaataaaacgcgtcgataacctataaccaaaaatcccaacaccgacgaaaaaaaaaaaacctaaataccctacgccccgaacgcgcgcgacgcgtaaaataaaaaaaaaaacgcgactccgcaccaaccaacgaccgcctaacgcccaaccgcatctcgaaaaacgaaattaaacctccgaaccgcaatacgattaacgaaaacgaataaataacgccaacgaccgacgcgaaacccgcccccgacttaccccgcccccgcgcgcgccgacgacgaaacaacctcgctctaactcgcgccgcgcccccgcgcccaatccgcgcgtcaatcgatccctaacgcgactacgaaacgaaaaactacgactaacccaacgcgcccacctaaaaaaacgacgaaatccgcaaacgtcgcgaaacgaaaaaatcgaaaccgaaaaactcgcgcaacgccataacccccattaacctcaaaactattatcgaaaaaaataaataaaaccgaaatccttccaacaaacgaaaactacgactcccgaaaaaccccgcgcgacccctaccgacaacgcccaaacctccgaacgaactaccgaccctacgccccgaacctaaaactcctaatccgtaaaatcccgttattcaaacgccgcccgcgcgaaaaaaaaacttaccccgctctcccctccctcacctcatatttcaccccaaccctccccctacaacccgccctcctccctcgccatcctccttcctcgcgatccctatctcccttttccctacatcctccttcccctccatccctccctccctctcttcccttcacccccatttctctcccctcgccccatccttc

SEQ ID NO: 4549 - DNA, 511 bp, Artificial Sequence
  chemically treated genomic DNA (Homo sapiens) CpG-island No: 4549
tttcgcgtttgttcgcgttcgttcgtttttcgtttcgggttttttggcgttttattcggtaagtcgggtcggaagtcgtattcgtaaaaggcgtttaaggtgtagcgtagggaagttaggttttaggcggcggtcgcggtcgagattagttcgagtagttcgaggagcgagttttagggtcggtagtcgcgcgtcgtagtcgttattcgggtgaggttcgagttcgttgtggggtagttaattgtttcgttcgggaattgtaattttcggcgtgtatcgtttcgtagtagttacgtttatcgtttataattttcgacgttttttttttcgtttttaaggttcgttcgtcgtttcgtagtaggattagaaggtggtttttagggggaattcgcgaatcgtttaattcgggacggcgggtcgcgtttttatggttacggtaattaggggattatcgtagtggtttagaaagaataaataaaggattacgattataaagggcgacgtaataatt

SEQ ID NO: 4550 - DNA, 511 bp, Artificial Sequence
  chemically treated genomic DNA (Homo sapiens) CpG-island No: 4550
aattattacgtcgccctttataatcgtaatcctttatttattctttctaaaccactacgataatcccctaattaccgtaaccataaaaacgcgacccgccgtcccgaattaaacgattcgcgaattccccctaaaaaccaccttctaatcctactacgaaacgacgaacgaaccttaaaaacgaaaaaaaaaacgtcgaaaattataaacgataaacgtaactactacgaaacgatacacgccgaaaattacaattcccgaacgaaacaattaactaccccacaacgaactcgaacctcacccgaataacgactacgacgcgcgactaccgaccctaaaactcgctcctcgaactactcgaactaatctcgaccgcgaccgccgcctaaaacctaacttccctacgctacaccttaaacgccttttacgaatacgacttccgacccgacttaccgaataaaacgccaaaaaacccgaaacgaaaaacgaacgaacgcgaacaaacgcgaaa

SEQ ID NO: 4551 - DNA, 511 bp, Artificial Sequence
  chemically treated genomic DNA (Homo sapiens) CpG-island No: 4551
aattgttacgtcgttttttgtggtcgtgattttttatttattttttttgagttattacgatggttttttagttatcgtggttatggaaacgcggttcgtcgtttcggattggacggttcgcgggttttttttggaggttattttttggttttgttgcggaacgacgggcgggttttggaggcggggagaggagcgtcgggagttgtaggcgatgggcgtggttgttgcggagcggtgtacgtcgggagttgtagttttcgggcgaggtagttgattgttttataacgagttcgggttttattcggatggcggttgcgacgcgcggttgtcggttttggggttcgtttttcgggttgttcgggttggtttcggtcgcggtcgtcgtttgggatttggtttttttgcgttgtattttgggcgttttttgcgaatgcgattttcggttcgatttgtcgggtgaggcgttagggagttcggagcgaggggcgggcggacgcgggtagacgcggga

SEQ ID NO: 4552 - DNA, 511 bp, Artificial Sequence
  chemically treated genomic DNA (Homo sapiens) CpG-island No: 4552
tcccgcgtctacccgcgtccgcccgcccctcgctccgaactccctaacgcctcacccgacaaatcgaaccgaaaatcgcattcgcaaaaaacgcccaaaatacaacgcaaaaaaaccaaatcccaaacgacgaccgcgaccgaaaccaacccgaacaacccgaaaaacgaaccccaaaaccgacaaccgcgcgtcgcaaccgccatccgaataaaacccgaactcgttataaaacaatcaactacctcgcccgaaaactacaactcccgacgtacaccgctccgcaacaaccacgcccatcgcctacaactcccgacgctcctctccccgcctccaaaacccgcccgtcgttccgcaacaaaaccaaaaaataacctccaaaaaaaacccgcgaaccgtccaatccgaaacgacgaaccgcgtttccataaccacgataactaaaaaaccatcgtaataactcaaaaaaaataaataaaaaatcacgaccacaaaaaacgacgtaacaatt

SEQ ID NO: 4553 - DNA, 901 bp, Artificial Sequence
  chemically treated genomic DNA (Homo sapiens) CpG-island No: 4553
agtcggcgtttcgggcgttttaattttgcggtttcggttcgtttcgattttacgcgtcgcgtttttttttcgggcgtttaggttttttaggttttcgttttcgagtttcgggacgcggtttatttgcggcggcgcggggagacggttgtatttattaaatagggttagggttattgtaaaggcgttcgtcgtcgttcgcgagtttaggcgttttttttaggcgggttagggattattttattagttcgtcgtatttatatttcggagagagtggggtgttcgatggggcgtgttgggggcgtcggcgttcggggaggttgtaggtcgggacgcgggggatcgttgtaagaaaaagttatttacgcgttattgtcgggcgtatcgggtttagggagtttcgttagtttttcgcgagtcggtatttgtcgttgttattaggcgcggagcgtgcgcgcgggaggaggtatttgcgaggtaggaggtttggtcgcggcgtagtggttggcggagaggcggcgtcgtattggcggcggcggcggcggcgacggggagagtagtagtagtttcgtatagttttcggcggggcgcgtttatttcgtatttcgcggtttcgtagacgttattttgcgatagcgttttttacgagttcggtcgcgtcgttgtttttcgtttttttttcgggtttttcggtcgagtgcgtttttatggtaacgggcgcgcgcgggggtaagagggtgcgtttttattttcgcggttgcgaggagttattagcgtttttttggaggcggtcgttcggagcgggatggagcggggtcggtgtgcgttttagttgaaagtttaggtttttttttgaatggaatttgaggaggcgtagagaggagaaaaacgttgttattcgaaa

SEQ ID NO: 4554 - DNA, 901 bp, Artificial Sequence
  chemically treated genomic DNA (Homo sapiens) CpG-island No: 4554
tttcgaataacaacgtttttctcctctctacgcctcctcaaattccattcaaaaaaaaacctaaactttcaactaaaacgcacaccgaccccgctccatcccgctccgaacgaccgcctccaaaaaaacgctaataactcctcgcaaccgcgaaaataaaaacgcaccctcttacccccgcgcgcgcccgttaccataaaaacgcactcgaccgaaaaacccgaaaaaaaaacgaaaaacaacgacgcgaccgaactcgtaaaaaacgctatcgcaaaataacgtctacgaaaccgcgaaatacgaaataaacgcgccccgccgaaaactatacgaaactactactactctccccgtcgccgccgccgccgccgccaatacgacgccgcctctccgccaaccactacgccgcgaccaaacctcctacctcgcaaatacctcctcccgcgcgcacgctccgcgcctaataacaacgacaaataccgactcgcgaaaaactaacgaaactccctaaacccgatacgcccgacaataacgcgtaaataactttttcttacaacgatcccccgcgtcccgacctacaacctccccgaacgccgacgcccccaacacgccccatcgaacaccccactctctccgaaatataaatacgacgaactaataaaataatccctaacccgcctaaaaaaaacgcctaaactcgcgaacgacgacgaacgcctttacaataaccctaaccctatttaataaatacaaccgtctccccgcgccgccgcaaataaaccgcgtcccgaaactcgaaaacgaaaacctaaaaaacctaaacgcccgaaaaaaaaacgcgacgcgtaaaatcgaaacgaaccgaaaccgcaaaattaaaacgcccgaaacgccgact

SEQ ID NO: 4555 - DNA, 901 bp, Artificial Sequence
  chemically treated genomic DNA (Homo sapiens) CpG-island No: 4555
tttcgagtaatagcgttttttttttttttgcgtttttttaaattttatttaagaaaaaatttgggtttttagttaaaacgtatatcggtttcgttttatttcgtttcgggcggtcgtttttaggggggcgttggtggtttttcgtagtcgcgggaatgagggcgtatttttttattttcgcgcgcgttcgttgttatgggaacgtattcgatcgggaagttcgagggagaggcgggaggtagcggcgcggtcgagttcgtgggagacgttatcgtaagatggcgtttgcgaggtcgcgggatgcggagtgagcgcgtttcgtcgggggttgtgcgaggttgttgttgtttttttcgtcgtcgtcgtcgtcgtcgttagtgcggcgtcgttttttcgttagttattgcgtcgcggttaagttttttgtttcgtaggtattttttttcgcgcgtacgtttcgcgtttgatggtagcgataagtgtcggttcgcggagagttagcggggttttttgggttcggtgcgttcgataataacgcgtgaataatttttttttgtagcggtttttcgcgtttcggtttgtagttttttcgggcgtcggcgtttttagtacgttttatcgggtattttatttttttcgaggtgtgggtgcggcgggttgatgaggtgatttttagttcgtttgggaggagcgtttggattcgcgggcggcggcgagcgtttttataatggttttgattttgtttggtaagtgtagtcgttttttcgcgtcgtcgtaggtgggtcgcgtttcggggttcgggggcgggggtttggggggtttgggcgttcggggagggggcgcggcgcgtggggtcggggcgggtcggggtcgtagagttggggcgttcggggcgtcggtt

SEQ ID NO: 4556 - DNA, 901 bp, Artificial Sequence
  chemically treated genomic DNA (Homo sapiens) CpG-island No: 4556
aaccgacgccccgaacgccccaactctacgaccccgacccgccccgaccccacgcgccgcgccccctccccgaacgcccaaaccccccaaacccccgcccccgaaccccgaaacgcgacccacctacgacgacgcgaaaaaacgactacacttaccaaacaaaatcaaaaccattataaaaacgctcgccgccgcccgcgaatccaaacgctcctcccaaacgaactaaaaatcacctcatcaacccgccgcacccacacctcgaaaaaaataaaatacccgataaaacgtactaaaaacgccgacgcccgaaaaaactacaaaccgaaacgcgaaaaaccgctacaaaaaaaaattattcacgcgttattatcgaacgcaccgaacccaaaaaaccccgctaactctccgcgaaccgacacttatcgctaccatcaaacgcgaaacgtacgcgcgaaaaaaaatacctacgaaacaaaaaacttaaccgcgacgcaataactaacgaaaaaacgacgccgcactaacgacgacgacgacgacgacgaaaaaaacaacaacaacctcgcacaacccccgacgaaacgcgctcactccgcatcccgcgacctcgcaaacgccatcttacgataacgtctcccacgaactcgaccgcgccgctacctcccgcctctccctcgaacttcccgatcgaatacgttcccataacaacgaacgcgcgcgaaaataaaaaaatacgccctcattcccgcgactacgaaaaaccaccaacgcccccctaaaaacgaccgcccgaaacgaaataaaacgaaaccgatatacgttttaactaaaaacccaaattttttcttaaataaaatttaaaaaaacgcaaaaaaaaaaaaaacgctattactcgaaa

SEQ ID NO: 4557 - DNA, 667 bp, Artificial Sequence
  chemically treated genomic DNA (Homo sapiens) CpG-island No: 4557
tttgaagacgcgttttaggcggttttatttagagtttttttttaaggtttaggaatgcggcgttgtcggaggtgtgcgcggtggttatatcgttgttcgggtttttaaagcgggtttcgtttttatttttcgttttggtttcgaattttgggtttagttttagcgttttgtgtgcgaatatcgtttcgtttcggatttagtttcgttttggggtttttttttgtttgttttttcgtgttcgattatattgtttttttttcggcgggcgatttagttcggtttatcgtggcggtttttagggcggtaggtttcgggagtattttcggggtcggttttaaggattgttttttttttttttatttttatttcgcggcggcggcgggcgagagcggcgatatagggttagggttcggagcggtggaggtttttggtcggggagtacgtcgttttattcggtaacgcgaggatggtggcggcgtagtcggttgttttggggttttaaggtataggggacgcgaggtatagatgttttatagtagttattgcggttttcgtagttgtttcgtcgtcgttgttcgtttttttttgttgtagttggcgtgatggtagcggtagttttggacgttttattgttgttattattagttttgtgaaataggtattattt

SEQ ID NO: 4558 - DNA, 667 bp, Artificial Sequence
  chemically treated genomic DNA (Homo sapiens) CpG-island No: 4558
aaataatacctatttcacaaaactaataataacaacaataaaacgtccaaaactaccgctaccatcacgccaactacaacaaaaaaaaacgaacaacgacgacgaaacaactacgaaaaccgcaataactactataaaacatctatacctcgcgtcccctataccttaaaaccccaaaacaaccgactacgccgccaccatcctcgcgttaccgaataaaacgacgtactccccgaccaaaaacctccaccgctccgaaccctaaccctatatcgccgctctcgcccgccgccgccgcgaaataaaaataaaaaaaaaaaaaacaatccttaaaaccgaccccgaaaatactcccgaaacctaccgccctaaaaaccgccacgataaaccgaactaaatcgcccgccgaaaaaaaaacaatataatcgaacacgaaaaaacaaacaaaaaaaaaccccaaaacgaaactaaatccgaaacgaaacgatattcgcacacaaaacgctaaaactaaacccaaaattcgaaaccaaaacgaaaaataaaaacgaaacccgctttaaaaacccgaacaacgatataaccaccgcgcacacctccgacaacgccgcattcctaaaccttaaaaaaaaactctaaataaaaccgcctaaaacgcgtcttcaaa

SEQ ID NO: 4559 - DNA, 667 bp, Artificial Sequence
  chemically treated genomic DNA (Homo sapiens) CpG-island No: 4559
aggtagtatttattttataaggttgatggtggtagtagtggggcgtttagagttgtcgttgttattacgttagttgtagtagggaggggcgggtagcggcggcggagtagttgcgggagtcgtagtggttgttgtgggatatttgtgtttcgcgttttttgtgttttgagattttaaagtagtcgattgcgtcgttattattttcgcgttgtcgggtggggcgacgtgtttttcggttaggagtttttatcgtttcggattttggttttatgtcgtcgttttcgttcgtcgtcgtcgcggagtgggagtggggaggaggggaatagtttttggagtcggtttcgggagtattttcggagtttgtcgttttggaagtcgttacgatggatcgggttgagtcgttcgtcggaggggaagtagtgtagtcgggtacggaggggtaggtagagaggggttttaaggcggagttgggttcggggcggagcggtgttcgtatataaagcgttggggttggatttagggttcggggttaaggcgagaagtgggagcggggttcgttttggggattcggatagcggtgtggttatcgcgtatattttcgatagcgtcgtatttttgggttttgggaggaggttttgagtagggtcgtttggggcgcgtttttagg

SEQ ID NO: 4560 - DNA, 667 bp, Artificial Sequence
  chemically treated genomic DNA (Homo sapiens) CpG-island No: 4560
cctaaaaacgcgccccaaacgaccctactcaaaacctcctcccaaaacccaaaaatacgacgctatcgaaaatatacgcgataaccacaccgctatccgaatccccaaaacgaaccccgctcccacttctcgccttaaccccgaaccctaaatccaaccccaacgctttatatacgaacaccgctccgccccgaacccaactccgccttaaaacccctctctacctacccctccgtacccgactacactacttcccctccgacgaacgactcaacccgatccatcgtaacgacttccaaaacgacaaactccgaaaatactcccgaaaccgactccaaaaactattcccctcctccccactcccactccgcgacgacgacgaacgaaaacgacgacataaaaccaaaatccgaaacgataaaaactcctaaccgaaaaacacgtcgccccacccgacaacgcgaaaataataacgacgcaatcgactactttaaaatctcaaaacacaaaaaacgcgaaacacaaatatcccacaacaaccactacgactcccgcaactactccgccgccgctacccgcccctccctactacaactaacgtaataacaacgacaactctaaacgccccactactaccaccatcaaccttataaaataaatactacct

SEQ ID NO: 4561 - DNA, 582 bp, Artificial Sequence
  chemically treated genomic DNA (Homo sapiens) CpG-island No: 4561
tagtttcgagaagcggatagatatacgtggagatttaggagggggcgggtttcgtttgggttgttcggacgcggcgtcggggtagtttttacggtttttagttttttcgtagggtcggcgcggtttttacggtcgattcgtaatttcggggggcgtagggagtcggtcgaggttgtacggtcgcgacgtcgggtcgttaagttcggtttgattcgtttatttttttttttcgcgagcgtttagatatttttttttttattttggcggtcgtttttttcgcgtcgcggtttttttttttttttttgttttttttgtttattttgtcgggttttaagtcgcgacgggatattaggaaagaaaacggttcgcgtttttcgttcggaaataggtgttcgtggggcggagttcggcgtatagaaatggagttattttcggtttcgagttcgagtcgttttcgggtagaggtgcggttgggttttttacgaggttcggttttggagtttcgttttcggtagcgggttcgggggtttcggattttgtataaggtttcggaaaagatgatcggtttcgggttgggcgcgg

SEQ ID NO: 4562 - DNA, 582 bp, Artificial Sequence
  chemically treated genomic DNA (Homo sapiens) CpG-island No: 4562
ccgcgcccaacccgaaaccgatcatcttttccgaaaccttatacaaaatccgaaacccccgaacccgctaccgaaaacgaaactccaaaaccgaacctcgtaaaaaacccaaccgcacctctacccgaaaacgactcgaactcgaaaccgaaaataactccatttctatacgccgaactccgccccacgaacacctatttccgaacgaaaaacgcgaaccgttttctttcctaatatcccgtcgcgacttaaaacccgacaaaataaacaaaaaaaacaaaaaaaaaaaaaaaaaccgcgacgcgaaaaaaacgaccgccaaaataaaaaaaaaaatatctaaacgctcgcgaaaaaaaaaaataaacgaatcaaaccgaacttaacgacccgacgtcgcgaccgtacaacctcgaccgactccctacgccccccgaaattacgaatcgaccgtaaaaaccgcgccgaccctacgaaaaaactaaaaaccgtaaaaactaccccgacgccgcgtccgaacaacccaaacgaaacccgccccctcctaaatctccacgtatatctatccgcttctcgaaacta

SEQ ID NO: 4563 - DNA, 582 bp, Artificial Sequence
  chemically treated genomic DNA (Homo sapiens) CpG-island No: 4563
tcgcgtttagttcggggtcggttatttttttcggggttttatgtagagttcgaggttttcgagttcgttgtcgaagacggagttttaagatcgaatttcgtaaagggtttagtcgtatttttattcggaagcggttcgaattcggggtcggaagtgattttatttttgtgcgtcgagtttcgttttacgagtatttgttttcgagcggagagcgcgggtcgtttttttttttggtgtttcgtcgcggtttgggattcggtaagatgggtaagaagggtaagaaggagaagaagggtcgcggcgcggagaagacggtcgttaagatggagaagaaggtgtttaagcgttcgcggaaggaggaggtgagcgggttagatcgggtttagcggttcgacgtcgcggtcgtgtagtttcggtcgattttttgcgtttttcggggttacgggtcggtcgtgggagtcgcgtcggttttgcgggagagttggaggtcgtaggaattgtttcggcgtcgcgttcgggtagtttagacggggttcgtttttttttgagtttttacgtgtgtttgttcgtttttcggagttg

SEQ ID NO: 4564 - DNA, 582 bp, Artificial Sequence
  chemically treated genomic DNA (Homo sapiens) CpG-island No: 4564
caactccgaaaaacgaacaaacacacgtaaaaactcaaaaaaaaacgaaccccgtctaaactacccgaacgcgacgccgaaacaattcctacgacctccaactctcccgcaaaaccgacgcgactcccacgaccgacccgtaaccccgaaaaacgcaaaaaatcgaccgaaactacacgaccgcgacgtcgaaccgctaaacccgatctaacccgctcacctcctccttccgcgaacgcttaaacaccttcttctccatcttaacgaccgtcttctccgcgccgcgacccttcttctccttcttacccttcttacccatcttaccgaatcccaaaccgcgacgaaacaccaaaaaaaaaaacgacccgcgctctccgctcgaaaacaaatactcgtaaaacgaaactcgacgcacaaaaataaaatcacttccgaccccgaattcgaaccgcttccgaataaaaatacgactaaaccctttacgaaattcgatcttaaaactccgtcttcgacaacgaactcgaaaacctcgaactctacataaaaccccgaaaaaaataaccgaccccgaactaaacgcga

SEQ ID NO: 4565 - DNA, 554 bp, Artificial Sequence
  chemically treated genomic DNA (Homo sapiens) CpG-island No: 4565
gtatcgcgcgtagttttttttaaattcgcgcgtcgaggtcgtacgttaggtatacggattttttttagtaggtttaaacgaaagtaacgataagcgttcgaaagaattcgagttagtatcgtttaattatataatcgagtagatttcgtttttgtataagacggttttattttagtttttaattatatatttcgtatttaaacgaagagataggtagaattcgggggtacgttaagcgagatatatcgaattcgtatataaggacggcggttattaatagggaagcgtataattttttttatttcgttttttttttaaattttaaaaaaaaatttaaaatatattgttatttatcgtgttttcgcgtttcgagttttttcggtttcggtttgcgtttgttagcgagcgcggggaatttacggtagtgtattgtttttgtgttaggttgtaggtaagcgcgggttagggtgcggaaggggttggggcgttcgtaagcggcgcgggggtatattagaggatttcgaatatttaggaattaattaaagtagtgaaag

SEQ ID NO: 4566 - DNA, 554 bp, Artificial Sequence
  chemically treated genomic DNA (Homo sapiens) CpG-island No: 4566
ctttcactactttaattaattcctaaatattcgaaatcctctaatatacccccgcgccgcttacgaacgccccaaccccttccgcaccctaacccgcgcttacctacaacctaacacaaaaacaatacactaccgtaaattccccgcgctcgctaacaaacgcaaaccgaaaccgaaaaaactcgaaacgcgaaaacacgataaataacaatatattttaaatttttttttaaaatttaaaaaaaaaacgaaataaaaaaaattatacgcttccctattaataaccgccgtccttatatacgaattcgatatatctcgcttaacgtacccccgaattctacctatctcttcgtttaaatacgaaatatataattaaaaactaaaataaaaccgtcttatacaaaaacgaaatctactcgattatataattaaacgatactaactcgaattctttcgaacgcttatcgttactttcgtttaaacctactaaaaaaaatccgtatacctaacgtacgacctcgacgcgcgaatttaaaaaaaactacgcgcgatac

SEQ ID NO: 4567 - DNA, 554 bp, Artificial Sequence
  chemically treated genomic DNA (Homo sapiens) CpG-island No: 4567
tttttattgttttggttaatttttaggtattcgggattttttagtgtgttttcgcgtcgtttgcggacgttttagtttttttcgtattttggttcgcgtttatttgtagtttggtatagggatagtatattgtcgtgggtttttcgcgttcgttagtaaacgtaggtcgggatcggaggggttcggggcgcgggggtacggtgggtggtagtgtgttttggatttttttttggagtttggggagggggcggggtgggggaaattgtgcgtttttttgttggtggtcgtcgtttttgtgtgcgagttcggtgtgtttcgtttggcgtgttttcgggttttgtttgttttttcgtttgggtgcggggtgtgtggttgggggttggggtggggtcgttttgtgtagggacgggatttgttcggttgtgtgattgggcggtgttagttcgggttttttcgggcgtttgtcgttgttttcgtttgagtttgttggggggggttcgtgtgtttggcgtgcggtttcggcgcgcgggtttagggggggttgcgcgcggtgt

SEQ ID NO: 4568 - DNA, 554 bp, Artificial Sequence
  chemically treated genomic DNA (Homo sapiens) CpG-island No: 4568
acaccgcgcgcaaccccccctaaacccgcgcgccgaaaccgcacgccaaacacacgaaccccccccaacaaactcaaacgaaaacaacgacaaacgcccgaaaaaacccgaactaacaccgcccaatcacacaaccgaacaaatcccgtccctacacaaaacgaccccaccccaacccccaaccacacaccccgcacccaaacgaaaaaacaaacaaaacccgaaaacacgccaaacgaaacacaccgaactcgcacacaaaaacgacgaccaccaacaaaaaaacgcacaatttcccccaccccgccccctccccaaactccaaaaaaaaatccaaaacacactaccacccaccgtacccccgcgccccgaacccctccgatcccgacctacgtttactaacgaacgcgaaaaacccacgacaatatactatccctataccaaactacaaataaacgcgaaccaaaatacgaaaaaaactaaaacgtccgcaaacgacgcgaaaacacactaaaaaatcccgaatacctaaaaattaaccaaaacaataaaaa

SEQ ID NO: 4569 - DNA, 558 bp, Artificial Sequence
  chemically treated genomic DNA (Homo sapiens) CpG-island No: 4569
acgatgttagttcgggcgcgggtagtggtcgggcggatgagcgttgttcgtggttttgaagatgtttttgggtttcggcggtggcggcggtagcggtgtttaggagggtcggtagcggggacggttacgaggtaaggaattcgggcggaggttgcgtttgcggtagttgcggatgtttttataggttgcgattttaggcgtttagttcgtttagtcgtcgttttagttcgtcgatgttttggcgttgggtgcggacgagtttttgttggtttagtacgatggttttgagttttttgaggtagagttcggcgtatcggattttttagaagtttttttaagtcgttcgttagttttttgagttttttttgcgtttgggcggcggtggggagcgcgagggcgcgggattttagtagtttagcggtcggtttttttttttttttttttggtttagtttttttttcgtcgtaggcgtcgcgttattgttattttgatttttatatatttatcgcggggtagggttatggtttagggtagttttttttgttttttggcgtttag

SEQ ID NO: 4570 - DNA, 558 bp, Artificial Sequence
  chemically treated genomic DNA (Homo sapiens) CpG-island No: 4570
ctaaacgccaaaaaacaaaaaaaactaccctaaaccataaccctaccccgcgataaatatataaaaatcaaaataacaataacgcgacgcctacgacgaaaaaaaaactaaaccaaaaaaaaaaaaaaaaaaaccgaccgctaaactactaaaatcccgcgccctcgcgctccccaccgccgcccaaacgcaaaaaaaactcaaaaaactaacgaacgacttaaaaaaacttctaaaaaatccgatacgccgaactctacctcaaaaaactcaaaaccatcgtactaaaccaacaaaaactcgtccgcacccaacgccaaaacatcgacgaactaaaacgacgactaaacgaactaaacgcctaaaatcgcaacctataaaaacatccgcaactaccgcaaacgcaacctccgcccgaattccttacctcgtaaccgtccccgctaccgaccctcctaaacaccgctaccgccgccaccgccgaaacccaaaaacatcttcaaaaccacgaacaacgctcatccgcccgaccactacccgcgcccgaactaacatcgt

SEQ ID NO: 4571 - DNA, 558 bp, Artificial Sequence
  chemically treated genomic DNA (Homo sapiens) CpG-island No: 4571
ttggacgttaagagataggaagggttgttttgggttatgattttgtttcgcggtgggtgtgtgaaagttagggtggtagtgacgcggcgtttgcggcgagaggaagattaggttagggggagaaggaagaaagtcgatcgttgggttgttgggatttcgcgttttcgcgttttttatcgtcgtttaggcgtaggaagggtttaagaggttggcgggcggtttggagagatttttggagaattcggtgcgtcgggttttattttaaggagtttagggttatcgtgttgaattaatagaggttcgttcgtatttagcgttagagtatcgacgagttggagcggcggttgaacgagttgagcgtttagaatcgtagtttgtgggagtattcgtagttgtcgtaagcgtagttttcgttcggattttttatttcgtagtcgttttcgttgtcggtttttttaggtatcgttgtcgtcgttatcgtcggggtttaggaatatttttaggattacggatagcgtttattcgttcggttattgttcgcgttcgagttggtatcgt

SEQ ID NO: 4572 - DNA, 558 bp, Artificial Sequence
  chemically treated genomic DNA (Homo sapiens) CpG-island No: 4572
acgataccaactcgaacgcgaacaataaccgaacgaataaacgctatccgtaatcctaaaaatattcctaaaccccgacgataacgacgacaacgatacctaaaaaaaccgacaacgaaaacgactacgaaataaaaaatccgaacgaaaactacgcttacgacaactacgaatactcccacaaactacgattctaaacgctcaactcgttcaaccgccgctccaactcgtcgatactctaacgctaaatacgaacgaacctctattaattcaacacgataaccctaaactccttaaaataaaacccgacgcaccgaattctccaaaaatctctccaaaccgcccgccaacctcttaaacccttcctacgcctaaacgacgataaaaaacgcgaaaacgcgaaatcccaacaacccaacgatcgactttcttccttctccccctaacctaatcttcctctcgccgcaaacgccgcgtcactaccaccctaactttcacacacccaccgcgaaacaaaatcataacccaaaacaacccttcctatctcttaacgtccaa

SEQ ID NO: 4573 - DNA, 618 bp, Artificial Sequence
  chemically treated genomic DNA (Homo sapiens) CpG-island No: 4573
gttaataatgtgacgttgtcggtcggggagtagcgtaaagacgtgtacgtttagttttatttgtagtattttacggttcgtaatcggtcgtcgtttttcgtcggtattaatagtaaggggttttcggatttttttagtgacgaagagcgcgagtttatttcggttttcggttttggggtcgtcgtcgcgggtcggagtcgagtagtcgtcggtagggtaaggacgcggggtcggggttataaaggcgggcgtttggcggttgtcgcgcgcgttcgtcgtcgtttgtagtttttttttttcgggcgttttttcgggttttttaggtgcggggttgtttttgcgttttttcgcgtcgtttttttttcgcggggttgtaggcgtcggagcggagaggttagaagttggggtcgcggggttcgcgttttttgacgtgtgggtttgggaggtgtggagttgcgttggcggcggttgttttgtacgtagtcgacgtcgtttttttggattattagtcgtttgtagcgggcgtttagacggggattttcgtgttttttcgaaagttttggagggtggttttaaaatgttataggttaagttcgagcgttttttcgttttattaat

SEQ ID NO: 4574 - DNA, 618 bp, Artificial Sequence
  chemically treated genomic DNA (Homo sapiens) CpG-island No: 4574
attaataaaacgaaaaaacgctcgaacttaacctataacattttaaaaccaccctccaaaactttcgaaaaaacacgaaaatccccgtctaaacgcccgctacaaacgactaataatccaaaaaaacgacgtcgactacgtacaaaacaaccgccgccaacgcaactccacacctcccaaacccacacgtcaaaaaacgcgaaccccgcgaccccaacttctaacctctccgctccgacgcctacaaccccgcgaaaaaaaaacgacgcgaaaaaacgcaaaaacaaccccgcacctaaaaaacccgaaaaaacgcccgaaaaaaaaaaactacaaacgacgacgaacgcgcgcgacaaccgccaaacgcccgcctttataaccccgaccccgcgtccttaccctaccgacgactactcgactccgacccgcgacgacgaccccaaaaccgaaaaccgaaataaactcgcgctcttcgtcactaaaaaaatccgaaaaccccttactattaataccgacgaaaaacgacgaccgattacgaaccgtaaaatactacaaataaaactaaacgtacacgtctttacgctactccccgaccgacaacgtcacattattaac

SEQ ID NO: 4575 - DNA, 618 bp, Artificial Sequence
  chemically treated genomic DNA (Homo sapiens) CpG-island No: 4575
gttaataaagcgggaaaacgttcgaatttaatttatagtattttggggttattttttagagttttcgaaagggtacggaagttttcgtttaaacgttcgttgtaggcggttggtggtttagggaagcggcgtcgattgcgtgtaaaataatcgtcgttaacgtaattttatattttttagatttatacgttaaagaacgcgaatttcgcggttttaatttttggttttttcgtttcggcgtttgtagtttcgcggggaaggggcgacgcgagggggcgtagggatagtttcgtatttgggaggttcgagggggcgttcgggagggaggggttgtaaacggcggcgagcgcgcgcggtaatcgttaaacgttcgtttttgtagtttcggtttcgcgtttttattttgtcgacggttgttcggtttcggttcgcggcggcggttttagagtcgaggatcggggtgggttcgcgtttttcgttattggagaagttcgggggttttttgttgttggtgtcggcggggagcggcggtcggttgcgagtcgtgaggtgttgtaggtagagttggacgtatacgtttttgcgttgtttttcggtcggtagcgttatattgttggt

SEQ ID NO: 4576 - DNA, 618 bp, Artificial Sequence
  chemically treated genomic DNA (Homo sapiens) CpG-island No: 4576
accaacaatataacgctaccgaccgaaaaacaacgcaaaaacgtatacgtccaactctacctacaacacctcacgactcgcaaccgaccgccgctccccgccgacaccaacaacaaaaaacccccgaacttctccaataacgaaaaacgcgaacccaccccgatcctcgactctaaaaccgccgccgcgaaccgaaaccgaacaaccgtcgacaaaataaaaacgcgaaaccgaaactacaaaaacgaacgtttaacgattaccgcgcgcgctcgccgccgtttacaacccctccctcccgaacgccccctcgaacctcccaaatacgaaactatccctacgccccctcgcgtcgccccttccccgcgaaactacaaacgccgaaacgaaaaaaccaaaaattaaaaccgcgaaattcgcgttctttaacgtataaatctaaaaaatataaaattacgttaacgacgattattttacacgcaatcgacgccgcttccctaaaccaccaaccgcctacaacgaacgtttaaacgaaaacttccgtaccctttcgaaaactctaaaaaataaccccaaaatactataaattaaattcgaacgttttcccgctttattaac

SEQ ID NO: 4577 - DNA, 710 bp, Artificial Sequence
  chemically treated genomic DNA (Homo sapiens) CpG-island No: 4577
taagtttttagatttcgcgttattattggatttttttttttttttgcgcgtaatttacgtcgtattttcgttttaagtattttttttacgtttcggttggattatcgaaggtttattattattgggcgattaatttttttattcggtcgtttttttttttttattcgaacggttttttacgcgaatttattttaacgtattcgtatttttttcgattaggatcggaattcgttttcgaattcgtaagcgatcgtaattcgaatttacgtgtatatcggtatcgtaattcgggcgcggcgaacgtaattttcgtttacgagtcgttgtttattgatatttcggatacgcggattttcgtatttcgcgtatcgggtagatcgggtatattttttaatttttcgaattcgcgtaatatgagtatcgttcggaatacgtacgtttattcgcgttttttcgcgcgtttcggtgacgcgtcgcgttgacggttaattttcgcgatttttcgagatcgcgggtttttattatatcgtagtagttcgttatttttttatttcgcgaatcgcgcgtcgcggttcgtagttttcgttattcgcgaatgtcgttaatcgatacggttgatcggcgacgcggtattcgaatattgaattcgttatttgaatcgttttcgcgatttgtaacggcgattgcgatacgtatttttttcgcgcgtt

SEQ ID NO: 4578 - DNA, 710 bp, Artificial Sequence
  chemically treated genomic DNA (Homo sapiens) CpG-island No: 4578
aacgcgcgaaaaaaatacgtatcgcaatcgccgttacaaatcgcgaaaacgattcaaataacgaattcaatattcgaataccgcgtcgccgatcaaccgtatcgattaacgacattcgcgaataacgaaaactacgaaccgcgacgcgcgattcgcgaaataaaaaaataacgaactactacgatataataaaaacccgcgatctcgaaaaatcgcgaaaattaaccgtcaacgcgacgcgtcaccgaaacgcgcgaaaaaacgcgaataaacgtacgtattccgaacgatactcatattacgcgaattcgaaaaattaaaaaatatacccgatctacccgatacgcgaaatacgaaaatccgcgtatccgaaatatcaataaacaacgactcgtaaacgaaaattacgttcgccgcgcccgaattacgataccgatatacacgtaaattcgaattacgatcgcttacgaattcgaaaacgaattccgatcctaatcgaaaaaaatacgaatacgttaaaataaattcgcgtaaaaaaccgttcgaataaaaaaaaaaaaacgaccgaataaaaaaattaatcgcccaataataataaaccttcgataatccaaccgaaacgtaaaaaaaatacttaaaacgaaaatacgacgtaaattacgcgcaaaaaaaaaaaaaaatccaataataacgcgaaatctaaaaactta

SEQ ID NO: 4579 - DNA, 710 bp, Artificial Sequence
  chemically treated genomic DNA (Homo sapiens) CpG-island No: 4579
ggcgcgcggggggagtgcgtgtcgtagtcgtcgttgtaaatcgcgagagcggtttaggtggcgagtttagtgttcggatatcgcgtcgtcggttagtcgtatcggttggcggtattcgcgaatagcgagagttgcgagtcgcggcgcgcgattcgcgaaataggggagtggcggattgttgcgatatggtaggagttcgcgatttcgagaggtcgcggagattgatcgttagcgcgacgcgttatcggggcgcgcggaggagcgcgagtgagcgtgcgtatttcgagcggtgtttatattgcgcgggttcgagagattagggggtgtgttcgatttgttcgatgcgcggaatacgaaggttcgcgtattcgaggtattagtagatagcgattcgtaggcggagattacgttcgtcgcgttcgggttgcggtgtcggtgtgtacgtgggttcgagttgcggtcgtttgcggattcgggggcggatttcgattttggtcggagaggatgcgagtgcgttggaatgggttcgcgtgaggggtcgttcgggtgggagagaaggagcggtcgggtgggggaattgatcgtttaatagtgataggttttcggtggtttagtcgggacgtggggaaggtgtttggagcgggggtacggcgtgagttgcgcgtagggagggggagaggtttagtggtagcgcggggtttgagggtttg

SEQ ID NO: 4580 - DNA, 710 bp, Artificial Sequence
  chemically treated genomic DNA (Homo sapiens) CpG-island No: 4580
caaaccctcaaaccccgcgctaccactaaacctctccccctccctacgcgcaactcacgccgtacccccgctccaaacaccttccccacgtcccgactaaaccaccgaaaacctatcactattaaacgatcaattcccccacccgaccgctccttctctcccacccgaacgacccctcacgcgaacccattccaacgcactcgcatcctctccgaccaaaatcgaaatccgcccccgaatccgcaaacgaccgcaactcgaacccacgtacacaccgacaccgcaacccgaacgcgacgaacgtaatctccgcctacgaatcgctatctactaatacctcgaatacgcgaaccttcgtattccgcgcatcgaacaaatcgaacacaccccctaatctctcgaacccgcgcaatataaacaccgctcgaaatacgcacgctcactcgcgctcctccgcgcgccccgataacgcgtcgcgctaacgatcaatctccgcgacctctcgaaatcgcgaactcctaccatatcgcaacaatccgccactcccctatttcgcgaatcgcgcgccgcgactcgcaactctcgctattcgcgaataccgccaaccgatacgactaaccgacgacgcgatatccgaacactaaactcgccacctaaaccgctctcgcgatttacaacgacgactacgacacgcactccccccgcgcgcc

SEQ ID NO: 4581 - DNA, 876 bp, Artificial Sequence
  chemically treated genomic DNA (Homo sapiens) CpG-island No: 4581
gcgttttcgcgagtagtttaagaattttgttaaattttgagttatagttatattttatttttatttttaattttatttcgtcggttttcggaacggtaattttcgggcgatgggaggcggggcggggtaaattagttttgattagcgtttttagtcgtcgcgatgtttattttgtcgcgtcgttttcgtcgggttttatttttagagtttgtttagcgttttgttgagttcggcgttgtgtaagtgcgggtattggttcgcgagttttttgcgcgtcgtttgcgtttatattatgaaggcgtttatgggtcgtttgacgtgcggtttgtttttgttggagtcgttgacgcgtatcggtatgggtattagcgtttagtcgtagtttttgagtatttggttgatcgtttcgcggatgtatacggggaatttgtttttttcgttttttttttttagatcgggttcgtttttggggaacgtgtttttttggggtcgcgtgttttcggtgttcgagtcggagttcgacgggtagggcgagttcgcggagttttcggatatggtggggttgggggcgtcggataggttttttttttgttcgtcggttatttttatgaaggggtttaggagatttatacgcgggttcggggtagggggttggtggtcgggaaaggcgagaagtcgcggcggttcggggattcgaggcgcgggttttttttttttcggttgttcggatgcggagtaagcggttttcggggaagttggcgcgtcggtcggttatcgcggcgagtatttaggaaggcgcggggtggttagtttatagttgttcgttttaagtggggggaggcgaattggagaggaggaggaggggaggaaaaagag

SEQ ID NO: 4582 - DNA, 876 bp, Artificial Sequence
  chemically treated genomic DNA (Homo sapiens) CpG-island No: 4582
ctctttttcctcccctcctcctcctctccaattcgcctccccccacttaaaacgaacaactataaactaaccaccccgcgccttcctaaatactcgccgcgataaccgaccgacgcgccaacttccccgaaaaccgcttactccgcatccgaacaaccgaaaaaaaaaaaacccgcgcctcgaatccccgaaccgccgcgacttctcgcctttcccgaccaccaaccccctaccccgaacccgcgtataaatctcctaaaccccttcataaaaataaccgacgaacaaaaaaaaaacctatccgacgcccccaaccccaccatatccgaaaactccgcgaactcgccctacccgtcgaactccgactcgaacaccgaaaacacgcgaccccaaaaaaacacgttccccaaaaacgaacccgatctaaaaaaaaaaaacgaaaaaaacaaattccccgtatacatccgcgaaacgatcaaccaaatactcaaaaactacgactaaacgctaatacccataccgatacgcgtcaacgactccaacaaaaacaaaccgcacgtcaaacgacccataaacgccttcataatataaacgcaaacgacgcgcaaaaaactcgcgaaccaatacccgcacttacacaacgccgaactcaacaaaacgctaaacaaactctaaaaataaaacccgacgaaaacgacgcgacaaaataaacatcgcgacgactaaaaacgctaatcaaaactaatttaccccgccccgcctcccatcgcccgaaaattaccgttccgaaaaccgacgaaataaaattaaaaataaaaataaaatataactataactcaaaatttaacaaaattcttaaactactcgcgaaaacgc

SEQ ID NO: 4583 - DNA, 876 bp, Artificial Sequence
  chemically treated genomic DNA (Homo sapiens) CpG-island No: 4583
tttttttttttttttttttttttttttttaattcgtttttttttatttggagcgggtagttgtgaattggttatttcgcgtttttttaagtgttcgtcgcggtagtcggtcgacgcgttagttttttcgggagtcgtttgtttcgtattcgggtagtcgaggggagaggagttcgcgtttcgagttttcgagtcgtcgcggtttttcgtttttttcggttattagttttttgtttcgggttcgcgtatgaattttttggatttttttatgaagatgatcgacgagtaggagaagggtttgttcggcgtttttagttttattatgttcgaggatttcgcgggttcgttttgttcgtcgggtttcggttcggatatcgagaatacgcggttttaggagaatacgttttttaagggcgagttcgatttgaagaaggagagcgaggaggataagtttttcgtgtgtattcgcgaggcggttagttaggtgtttaaaggttacgattggacgttggtgtttatgtcggtgcgcgttaacggttttagtaagaataagtcgtacgttaagcggtttatgaacgtttttatggtgtgggcgtaggcggcgcgtaggaagttcgcggattagtattcgtatttgtataacgtcgagtttagtaagacgttgggtaagttttggaggtaggattcggcgggggcggcgcggtagggtgggtatcgcggcggttgggggcgttggttagggttgatttgtttcgtttcgttttttatcgttcgggagttgtcgtttcgggagtcggcgggatggggttgggagtgggaatggggtgtaattgtggtttagagtttgataaagtttttgggttgttcgcggggacgt

SEQ ID NO: 4584 - DNA, 876 bp, Artificial Sequence
  chemically treated genomic DNA (Homo sapiens) CpG-island No: 4584
acgtccccgcgaacaacccaaaaactttatcaaactctaaaccacaattacaccccattcccactcccaaccccatcccgccgactcccgaaacgacaactcccgaacgataaaaaacgaaacgaaacaaatcaaccctaaccaacgcccccaaccgccgcgatacccaccctaccgcgccgcccccgccgaatcctacctccaaaacttacccaacgtcttactaaactcgacgttatacaaatacgaatactaatccgcgaacttcctacgcgccgcctacgcccacaccataaaaacgttcataaaccgcttaacgtacgacttattcttactaaaaccgttaacgcgcaccgacataaacaccaacgtccaatcgtaacctttaaacacctaactaaccgcctcgcgaatacacacgaaaaacttatcctcctcgctctccttcttcaaatcgaactcgcccttaaaaaacgtattctcctaaaaccgcgtattctcgatatccgaaccgaaacccgacgaacaaaacgaacccgcgaaatcctcgaacataataaaactaaaaacgccgaacaaacccttctcctactcgtcgatcatcttcataaaaaaatccaaaaaattcatacgcgaacccgaaacaaaaaactaataaccgaaaaaaacgaaaaaccgcgacgactcgaaaactcgaaacgcgaactcctctcccctcgactacccgaatacgaaacaaacgactcccgaaaaaactaacgcgtcgaccgactaccgcgacgaacacttaaaaaaacgcgaaataaccaattcacaactacccgctccaaataaaaaaaaacgaattaaaaaaaaaaaaaaaaaaaaaaaaaaaaa

SEQ ID NO: 4585 - DNA, 679 bp, Artificial Sequence
  chemically treated genomic DNA (Homo sapiens) CpG-island No: 4585
cggcgcgagggcgtagttcggagggttttgttgggtttaggggttttttggtcgttttttcgattcgatttttttttttatacgcgtttcgcgaacgtcggtcggattcgtaggggtcggaagcggcgcgttcggagagtcggcggagtcgggtagggttcgcgtttcgcggttcgtttcgagtagtcgcgagtttcgttagataaagaggcgcgtcgggtttcgggcgcgggtaagggacgtagaggcgcgggtagggcggcgcgttagtttcggttcgtagggggcgtcgttcgtggttttagtttcggtttttatttttgaggatcgagtagagtcgttttagggttatgttttcgagttgttcggcgtttcgcgaaaggttgaggtagcggcggcggtggttcggcgtttacggttcggcgcggaggcgacggttttatttcgtttttatcgtcggttattagttgcgtttttcgtttttttgaagagagtttaagtattgcggttcgttatggttcgagttttatagtgggttgttcgggcgggtcgagtatttcgacggggcgtcgttataagttgttcgggttttttttttattgatcgttcgaaggttatagaatgttgattttttgtattgtaatatgatgtaaatttatacgtgtttttggagtcggta

SEQ ID NO: 4586 - DNA, 679 bp, Artificial Sequence
  chemically treated genomic DNA (Homo sapiens) CpG-island No: 4586
taccgactccaaaaacacgtataaatttacatcatattacaatacaaaaaatcaacattctataaccttcgaacgatcaataaaaaaaaaacccgaacaacttataacgacgccccgtcgaaatactcgacccgcccgaacaacccactataaaactcgaaccataacgaaccgcaatacttaaactctcttcaaaaaaacgaaaaacgcaactaataaccgacgataaaaacgaaataaaaccgtcgcctccgcgccgaaccgtaaacgccgaaccaccgccgccgctacctcaacctttcgcgaaacgccgaacaactcgaaaacataaccctaaaacgactctactcgatcctcaaaaataaaaaccgaaactaaaaccacgaacgacgccccctacgaaccgaaactaacgcgccgccctacccgcgcctctacgtcccttacccgcgcccgaaacccgacgcgcctctttatctaacgaaactcgcgactactcgaaacgaaccgcgaaacgcgaaccctacccgactccgccgactctccgaacgcgccgcttccgacccctacgaatccgaccgacgttcgcgaaacgcgtataaaaaaaaaaatcgaatcgaaaaaacgaccaaaaaacccctaaacccaacaaaaccctccgaactacgccctcgcgccg

SEQ ID NO: 4587 - DNA, 679 bp, Artificial Sequence
  chemically treated genomic DNA (Homo sapiens) CpG-island No: 4587
tatcgattttagagatacgtatgaatttgtattatgttatagtataggggattagtattttatggttttcgggcggttaatggaaaggggattcgagtagtttgtgacggcgtttcgtcggggtgttcggttcgttcggatagtttattgtggggttcgggttatgacgggtcgtagtatttaagttttttttaggggagcggggagcgtagttgatggtcggcgatgggaacggagtggggtcgtcgttttcgcgtcgagtcgtgagcgtcgagttatcgtcgtcgttattttagtttttcgcgaagcgtcgggtagttcgggaatatggttttggagcggttttgttcggtttttaaaggtaaggatcggggttggggttacggacggcgttttttgcgggtcgaggttggcgcgtcgttttgttcgcgtttttgcgttttttattcgcgttcgggattcgacgcgtttttttgtttggcggggttcgcggttattcggagcggatcgcggggcgcgagttttgttcggtttcgtcggtttttcgggcgcgtcgttttcgatttttgcgagttcggtcgacgttcgcggggcgcgtgtgggaagagggatcgggtcgggaaggcggttaggaggtttttgggtttagtagggtttttcgggttgcgttttcgcgtcg

SEQ ID NO: 4588 - DNA, 679 bp, Artificial Sequence
  chemically treated genomic DNA (Homo sapiens) CpG-island No: 4588
cgacgcgaaaacgcaacccgaaaaaccctactaaacccaaaaacctcctaaccgccttcccgacccgatccctcttcccacacgcgccccgcgaacgtcgaccgaactcgcaaaaatcgaaaacgacgcgcccgaaaaaccgacgaaaccgaacaaaactcgcgccccgcgatccgctccgaataaccgcgaaccccgccaaacaaaaaaacgcgtcgaatcccgaacgcgaataaaaaacgcaaaaacgcgaacaaaacgacgcgccaacctcgacccgcaaaaaacgccgtccgtaaccccaaccccgatccttacctttaaaaaccgaacaaaaccgctccaaaaccatattcccgaactacccgacgcttcgcgaaaaactaaaataacgacgacgataactcgacgctcacgactcgacgcgaaaacgacgaccccactccgttcccatcgccgaccatcaactacgctccccgctcccctaaaaaaaacttaaatactacgacccgtcataacccgaaccccacaataaactatccgaacgaaccgaacaccccgacgaaacgccgtcacaaactactcgaatcccctttccattaaccgcccgaaaaccataaaatactaatcccctatactataacataatacaaattcatacgtatctctaaaatcgata

SEQ ID NO: 4589 - DNA, 591 bp, Artificial Sequence
  chemically treated genomic DNA (Homo sapiens) CpG-island No: 4589
gcgcgttttttttcgacgttttgcgtttatttaggttcgggggtacgaggcggtttttagttttttcgcgggttcggggcgggtatagcgggtcgggggcggtttggttgggttggtagagtacgtttcggcggtaaaatgagcgtcgggtatgttttcggatgaatttggtagatttagatatttagttttaattgcggcgagttcgggtcgttgtattcgcgcggggtagatgtgtttcggcgttgttcggtttaattgtttttatttatttcggtttcgttcgtttagttgggagcgcgcggtcggttcgggtcgttaggaaaagtttttgttattaattagaggcggcggggcggtcgcgatcgatggcggttttcgtattgaggttttcgtttttcgattaatcggtcgtttgtcgtgttttatcgcggtttgcggacgtcgcgttgggagagacgggtcgatgcgtttcggggcgtcggggtacgcggggacggcggttttcgcggggttttgtttttattttggtatcgttttgtcgggttcgggtgatgttggttcgtttagtagaggtttttaaggtagttt

SEQ ID NO: 4590 - DNA, 591 bp, Artificial Sequence
  chemically treated genomic DNA (Homo sapiens) CpG-island No: 4590
aaactaccttaaaaacctctactaaacgaaccaacatcacccgaacccgacaaaacgataccaaaataaaaacaaaaccccgcgaaaaccgccgtccccgcgtaccccgacgccccgaaacgcatcgacccgtctctcccaacgcgacgtccgcaaaccgcgataaaacacgacaaacgaccgattaatcgaaaaacgaaaacctcaatacgaaaaccgccatcgatcgcgaccgccccgccgcctctaattaataacaaaaacttttcctaacgacccgaaccgaccgcgcgctcccaactaaacgaacgaaaccgaaataaataaaaacaattaaaccgaacaacgccgaaacacatctaccccgcgcgaatacaacgacccgaactcgccgcaattaaaactaaatatctaaatctaccaaattcatccgaaaacatacccgacgctcattttaccgccgaaacgtactctaccaacccaaccaaaccgcccccgacccgctatacccgccccgaacccgcgaaaaaactaaaaaccgcctcgtacccccgaacctaaataaacgcaaaacgtcgaaaaaaaacgcgc

SEQ ID NO: 4591 - DNA, 591 bp, Artificial Sequence
  chemically treated genomic DNA (Homo sapiens) CpG-island No: 4591
aggttgttttgggagtttttgttggacgggttagtattattcgggttcggtaggacgatgttagggtgagggtagagtttcgcgaaggtcgtcgttttcgcgtgtttcggcgtttcgagacgtatcgattcgttttttttagcgcggcgttcgtaggtcgcggtggaatacggtaggcggtcgattgatcgggaggcgggggttttagtgcgggggtcgttatcgatcgcggtcgtttcgtcgtttttgattgatggtagaggttttttttggcggttcgagtcggtcgcgcgtttttaattgggcgggcgaggtcgggataaatgggagtaattgggtcgggtagcgtcgaggtatatttgtttcgcgcgggtgtagcggttcgagttcgtcgtaattagggttgagtgtttaaatttgttaagtttattcgagagtatgttcggcgtttattttgtcgtcgagacgtgttttgttagtttagttaggtcgttttcgattcgttgtgttcgtttcggattcgcggggaagttggaggtcgtttcgtgttttcgggtttgggtgggcgtagggcgtcgaggagggacgcgt

SEQ ID NO: 4592 - DNA, 591 bp, Artificial Sequence
  chemically treated genomic DNA (Homo sapiens) CpG-island No: 4592
acgcgtccctcctcgacgccctacgcccacccaaacccgaaaacacgaaacgacctccaacttccccgcgaatccgaaacgaacacaacgaatcgaaaacgacctaactaaactaacaaaacacgtctcgacgacaaaataaacgccgaacatactctcgaataaacttaacaaatttaaacactcaaccctaattacgacgaactcgaaccgctacacccgcgcgaaacaaatatacctcgacgctacccgacccaattactcccatttatcccgacctcgcccgcccaattaaaaacgcgcgaccgactcgaaccgccaaaaaaaacctctaccatcaatcaaaaacgacgaaacgaccgcgatcgataacgacccccgcactaaaacccccgcctcccgatcaatcgaccgcctaccgtattccaccgcgacctacgaacgccgcgctaaaaaaaacgaatcgatacgtctcgaaacgccgaaacacgcgaaaacgacgaccttcgcgaaactctaccctcaccctaacatcgtcctaccgaacccgaataatactaacccgtccaacaaaaactcccaaaacaacct

SEQ ID NO: 4593 - DNA, 631 bp, Artificial Sequence
  chemically treated genomic DNA (Homo sapiens) CpG-island No: 4593
  misc_feature (35)..(35): n is either a, c, g or t
  misc_feature (144)..(144): n is either a, c, g or t
  misc_feature (462)..(462): n is either a, c, g or t
  misc_feature (510)..(510): n is either a, c, g or t
  misc_feature (518)..(518): n is either a, c, g or t
  misc_feature (588)..(588): n is either a, c, g or t
gttatattcggtatagcgcgattaggtttattaanttgcgtttgcgcgaatcgagcgttttcgcgatattataggaaggttgagagaaagggtaggttttcgttgcgtggggttgggtttaaaggttcgtcgcgtttgcgtaanaggatttgacgacgtgttgcgtcgttatttttgaaacgtttggcggggaagtgttgttggagtcgttgtggttgttgttcgcggagtggaagcgcgtgtttttgtttgtgtttttggttatggcgttgtagttttttcgggagtagggaattattttgcgcgggagcgtcgaaatcgtggtcgagtttttttgtaagttttcgcgtaggttaatatatcggggggaacggagtcgtgacggtttagtaggtttatagttcggtttttgatattagagaagtaatttggggagaggcggttgtaggcgttttttttagnacgcgttgttaacgtggagttgtaggtttgcgtgttgttggggtttantttcgcgncgtagtttttttcggagcgtttttttttttaagtgtagattcgttttattttttattttttatttttcgnatataggatacggtgtgattggggtgggttttagtgtatgcgt

SEQ ID NO: 4594 - DNA, 631 bp, Artificial Sequence
  chemically treated genomic DNA (Homo sapiens) CpG-island No: 4594
  misc_feature (44)..(44): n is either a, c, g or t
  misc_feature (114)..(114): n is either a, c, g or t
  misc_feature (122)..(122): n is either a, c, g or t
  misc_feature (170)..(170): n is either a, c, g or t
  misc_feature (488)..(488): n is either a, c, g or t
  misc_feature (597)..(597): n is either a, c, g or t
acgcatacactaaaacccaccccaatcacaccgtatcctatatncgaaaaataaaaaataaaaaataaaacgaatctacacttaaaaaaaaaaacgctccgaaaaaaactacgncgcgaaantaaaccccaacaacacgcaaacctacaactccacgttaacaacgcgtnctaaaaaaaacgcctacaaccgcctctccccaaattacttctctaatatcaaaaaccgaactataaacctactaaaccgtcacgactccgttccccccgatatattaacctacgcgaaaacttacaaaaaaactcgaccacgatttcgacgctcccgcgcaaaataattccctactcccgaaaaaactacaacgccataaccaaaaacacaaacaaaaacacgcgcttccactccgcgaacaacaaccacaacgactccaacaacacttccccgccaaacgtttcaaaaataacgacgcaacacgtcgtcaaatcctnttacgcaaacgcgacgaacctttaaacccaaccccacgcaacgaaaacctaccctttctctcaaccttcctataatatcgcgaaaacgctcgattcgcgcaaacgcaanttaataaacctaatcgcgctataccgaatataac

SEQ ID NO: 4595 - DNA, 631 bp, Artificial Sequence
  chemically treated genomic DNA (Homo sapiens) CpG-island No: 4595
  misc_feature (44)..(44): n is either a, c, g or t
  misc_feature (114)..(114): n is either a, c, g or t
  misc_feature (122)..(122): n is either a, c, g or t
  misc_feature (170)..(170): n is either a, c, g or t
  misc_feature (488)..(488): n is either a, c, g or t
  misc_feature (597)..(597): n is either a, c, g or t
acgtatatattggggtttattttagttatatcgtgttttgtatncggaaagtaaggggtgggaggtgggacggatttgtatttaaaggaagaaacgtttcggaagaggttacgncgcgaggntaggttttagtagtacgtaggtttgtagttttacgttagtaacgcgtnttggaggaagcgtttgtagtcgtttttttttagattatttttttggtattagaggtcgagttgtgggtttattgagtcgttacgatttcgtttttttcgatatattggtttgcgcgagaatttatagaagaattcggttacgatttcggcgttttcgcgtagggtgattttttgttttcgggagagttgtagcgttatggttagggatataaataaaagtacgcgtttttatttcgcggatagtaattatagcggttttaatagtattttttcgttaagcgttttaaaagtaacgacgtagtacgtcgttaggttttnttgcgtaggcgcgacgagtttttaagtttagttttacgtagcggggatttgtttttttttttagtttttttgtgatgtcgcgggagcgttcggttcgcgtaggcgtagnttggtggatttggtcgcgttgtgtcgggtgtgat

SEQ ID NO: 4596 - DNA, 631 bp, Artificial Sequence
  chemically treated genomic DNA (Homo sapiens) CpG-island No: 4596
  misc_feature (35)..(35): n is either a, c, g or t
  misc_feature (144)..(144): n is either a, c, g or t
  misc_feature (462)..(462): n is either a, c, g or t
  misc_feature (510)..(510): n is either a, c, g or t
  misc_feature (518)..(518): n is either a, c, g or t
  misc_feature (588)..(588): n is either a, c, g or t
atcacacccgacacaacgcgaccaaatccaccaanctacgcctacgcgaaccgaacgctcccgcgacatcacaaaaaaactaaaaaaaaaaacaaatccccgctacgtaaaactaaacttaaaaactcgtcgcgcctacgcaanaaaacctaacgacgtactacgtcgttacttttaaaacgcttaacgaaaaaatactattaaaaccgctataattactatccgcgaaataaaaacgcgtacttttatttatatccctaaccataacgctacaactctcccgaaaacaaaaaatcaccctacgcgaaaacgccgaaatcgtaaccgaattcttctataaattctcgcgcaaaccaatatatcgaaaaaaacgaaatcgtaacgactcaataaacccacaactcgacctctaataccaaaaaaataatctaaaaaaaaacgactacaaacgcttcctccaanacgcgttactaacgtaaaactacaaacctacgtactactaaaacctancctcgcgncgtaacctcttccgaaacgtttcttcctttaaatacaaatccgtcccacctcccaccccttactttccgnatacaaaacacgatataactaaaataaaccccaatatatacgt

SEQ ID NO: 4597 - DNA, 643 bp, Artificial Sequence
  chemically treated genomic DNA (Homo sapiens) CpG-island No: 4597
ggcgcgagcggcggcggcggtagtagtagtagtagtagtacggttatcggcgggagcggtagtagtatcggtagtttcggcggcgcggtttcggtttcggtttcggtttcggtcggtatgtatcgtttcggggagcgtttgttgggtagttacgcgttgttcgcggagtagcgggattttttgtttttagagacgattaataataataataattattattagttcggggtttgggttcgtcgggcgggtttttcggcgttttcgtttttttcggcgttttcgttttcgtatttttcggtcgtcgttttcgtcgtcgatttagtcgattcggtttcgggtagtagtaataagaggaagcgcgataataaggttagtacgtatggatttaattatagtttgttgtagtttagcggagggcgggtcgcggggggcggtcgagtagacggcggcggggtcgtgtatagcgggatttcgtggaaacggaggaattataattagggagtcgtggggtgagtgttggttttgcggttcgatggtttggtcggtgcgaatgcgtagtcgggtatacgtttatagaggggggttgtgagggtttaggagcggttatttttacggtttgttttcgttgttgttgtacgggggt

SEQ ID NO: 4598 - DNA, 643 bp, Artificial Sequence
  chemically treated genomic DNA (Homo sapiens) CpG-island No: 4598
acccccgtacaacaacaacgaaaacaaaccgtaaaaataaccgctcctaaaccctcacaacccccctctataaacgtatacccgactacgcattcgcaccgaccaaaccatcgaaccgcaaaaccaacactcaccccacgactccctaattataattcctccgtttccacgaaatcccgctatacacgaccccgccgccgtctactcgaccgccccccgcgacccgccctccgctaaactacaacaaactataattaaatccatacgtactaaccttattatcgcgcttcctcttattactactacccgaaaccgaatcgactaaatcgacgacgaaaacgacgaccgaaaaatacgaaaacgaaaacgccgaaaaaaacgaaaacgccgaaaaacccgcccgacgaacccaaaccccgaactaataataattattattattattaatcgtctctaaaaacaaaaaatcccgctactccgcgaacaacgcgtaactacccaacaaacgctccccgaaacgatacataccgaccgaaaccgaaaccgaaaccgaaaccgcgccgccgaaactaccgatactactaccgctcccgccgataaccgtactactactactactactaccgccgccgccgctcgcgcc

SEQ ID NO: 4599 - DNA, 643 bp, Artificial Sequence
  chemically treated genomic DNA (Homo sapiens) CpG-island No: 4599
attttcgtgtaatagtagcgaaggtaggtcgtgggggtggtcgtttttagatttttataatttttttttgtgggcgtgtgttcggttgcgtattcgtatcggttaggttatcgggtcgtagagttagtatttattttacgattttttggttgtagttttttcgtttttacggggtttcgttgtatacgatttcgtcgtcgtttgttcggtcgtttttcgcggttcgtttttcgttgggttgtagtaggttgtagttgagtttatacgtgttggttttgttgtcgcgtttttttttgttgttgttgttcgaggtcgaatcggttggatcggcggcggggacggcggtcgaagggtgcggggacgaggacgtcgagggaggcgaggacgtcgaggagttcgttcggcgggtttaggtttcgggttggtggtggttgttgttgttgttggtcgtttttaggggtaggaagtttcgttgtttcgcgggtagcgcgtggttgtttagtaggcgtttttcggagcgatatatgtcggtcggggtcggggtcggggtcgaggtcgcgtcgtcggggttgtcggtgttgttgtcgttttcgtcggtggtcgtgttgttgttgttgttgttgtcgtcgtcgtcgttcgcgtt

SEQ ID NO: 4600 - DNA, 643 bp, Artificial Sequence
  chemically treated genomic DNA (Homo sapiens) CpG-island No: 4600
aacgcgaacgacgacgacgacaacaacaacaacaacaacacgaccaccgacgaaaacgacaacaacaccgacaaccccgacgacgcgacctcgaccccgaccccgaccccgaccgacatatatcgctccgaaaaacgcctactaaacaaccacgcgctacccgcgaaacaacgaaacttcctacccctaaaaacgaccaacaacaacaacaaccaccaccaacccgaaacctaaacccgccgaacgaactcctcgacgtcctcgcctccctcgacgtcctcgtccccgcacccttcgaccgccgtccccgccgccgatccaaccgattcgacctcgaacaacaacaacaaaaaaaaacgcgacaacaaaaccaacacgtataaactcaactacaacctactacaacccaacgaaaaacgaaccgcgaaaaacgaccgaacaaacgacgacgaaatcgtatacaacgaaaccccgtaaaaacgaaaaaactacaaccaaaaaatcgtaaaataaatactaactctacgacccgataacctaaccgatacgaatacgcaaccgaacacacgcccacaaaaaaaaattataaaaatctaaaaacgaccacccccacgacctaccttcgctactattacacgaaaat

SEQ ID NO: 4601 - DNA, 1289 bp, Artificial Sequence
  chemically treated genomic DNA (Homo sapiens) CpG-island No: 4601
  misc_feature (275)..(275): n is either a, c, g or t
  misc_feature (424)..(424): n is either a, c, g or t
  misc_feature (576)..(576): n is either a, c, g or t
  misc_feature (798)..(798): n is either a, c, g or t
  misc_feature (902)..(902): n is either a, c, g or t
  misc_feature (910)..(910): n is either a, c, g or t
  misc_feature (993)..(993): n is either a, c, g or t
  misc_feature (997)..(997): n is either a, c, g or t
  misc_feature (1016)..(1016): n is either a, c, g or t
  misc_feature (1031)..(1031): n is either a, c, g or t
  misc_feature (1109)..(1109): n is either a, c, g or t
  misc_feature (1111)..(1111): n is either a, c, g or t
ttttttttcgtatacgttttttcggtcgggggacgatatatcggtcgcggatttatattttcgttttttcgagatttcgcgttatcgacgggtaaatttcggtcgcgttttacgattttcgtcggttatagcgattatttatattcgtcgtttatatttttcgttcggtcgcgtcgggtcgtttttttcgtcggaataaaatgcgagatttcgttcggtttttaatcgttttaggtagatcggtcggtcgggtagatcgttcggttagacgtaancggcggttttcgtcgcgatatttcgttattatgtcggtaacgttcgttttcggtttttcgcgcgttttcggcgtaatcgcgtcgcgtcgttcgtttcgcgatcgttcgggtcgttttaaggttcgcgtttttaattatttattttatantcgcggcggttcgggtcgttttttttttattatcgattcggtcgtttcgtttatgtatcgcgtcggggtcgttcggcgttcggttcgttttcgtttttcgtcgtttaacgagttcgtacgatgtcgcgttcggcgtcgggtcgggcgttttnttattaaattcgcggggtcggcgtcggcgttcggttcggcgttcgcgaagggagtttttcgtcgcgttcggcgcgcgttttcggttcgtcgcgcgcggcgttcggcgtcgcgggttcggattcgggcggacgcgtcgcgcgttttcggttcgcgtcgtcggtttcggttttcgcggcgttcgcggttcgtcgcggcgtcgttttaaaagcggtcgttcggtncgtcgggtcgatgtttttaatttcgtcggcgtcggcgcgttcgcgttcgggcgggtcggttttcggggttttcgcggttcgcgtcgtcgcgggcggttcggggncgatcgtngtcgcgtcgtttatcgcggtcgcggtttcgttcggcgcgtcgcgaaaatcgcggaaattcgcggcgttcgtcgtttttcgcgntttncgcgcgcgcggcggttttngcgcgttttcgcggntttcggcgttttcgcgcgtttcgtcggcgttcgcggggtttcgggcgcgcgcgggggcgtcggcgcgtcgtcgcgcgntngttcgttcggcgaaaatgcgaattgtggtagaagcggtatgtgtagaaggtgaaattatttataatatgtttggcggcgcgacgttagattaggtttacgtcgttttgttggtagtcgattagtattttaaggttatagttaagtagaagtggaaatatttttttcgtaggttttaaa

SEQ ID NO: 4602 - DNA, 1289 bp, Artificial Sequence
  chemically treated genomic DNA (Homo sapiens) CpG-island No: 4602
  misc_feature (179)..(179): n is either a, c, g or t
  misc_feature (181)..(181): n is either a, c, g or t
  misc_feature (259)..(259): n is either a, c, g or t
  misc_feature (274)..(274): n is either a, c, g or t
  misc_feature (293)..(293): n is either a, c, g or t
  misc_feature (297)..(297): n is either a, c, g or t
  misc_feature (380)..(380): n is either a, c, g or t
  misc_feature (388)..(388): n is either a, c, g or t
  misc_feature (492)..(492): n is either a, c, g or t
  misc_feature (714)..(714): n is either a, c, g or t
  misc_feature (866)..(866): n is either a, c, g or t
  misc_feature (1015)..(1015): n is either a, c, g or t
tttaaaacctacgaaaaaaatatttccacttctacttaactataaccttaaaatactaatcgactaccaacaaaacgacgtaaacctaatctaacgtcgcgccgccaaacatattataaataatttcaccttctacacataccgcttctaccacaattcgcattttcgccgaacgaacnancgcgcgacgacgcgccgacgcccccgcgcgcgcccgaaaccccgcgaacgccgacgaaacgcgcgaaaacgccgaaanccgcgaaaacgcgcnaaaaccgccgcgcgcgcgnaaancgcgaaaaacgacgaacgccgcgaatttccgcgattttcgcgacgcgccgaacgaaaccgcgaccgcgataaacgacgcgacnacgatcgnccccgaaccgcccgcgacgacgcgaaccgcgaaaaccccgaaaaccgacccgcccgaacgcgaacgcgccgacgccgacgaaattaaaaacatcgacccgacgnaccgaacgaccgcttttaaaacgacgccgcgacgaaccgcgaacgccgcgaaaaccgaaaccgacgacgcgaaccgaaaacgcgcgacgcgtccgcccgaatccgaacccgcgacgccgaacgccgcgcgcgacgaaccgaaaacgcgcgccgaacgcgacgaaaaactcccttcgcgaacgccgaaccgaacgccgacgccgaccccgcgaatttaataanaaaacgcccgacccgacgccgaacgcgacatcgtacgaactcgttaaacgacgaaaaacgaaaacgaaccgaacgccgaacgaccccgacgcgatacataaacgaaacgaccgaatcgataataaaaaaaaaacgacccgaaccgccgcgantataaaataaataattaaaaacgcgaaccttaaaacgacccgaacgatcgcgaaacgaacgacgcgacgcgattacgccgaaaacgcgcgaaaaaccgaaaacgaacgttaccgacataataacgaaatatcgcgacgaaaaccgccgnttacgtctaaccgaacgatctacccgaccgaccgatctacctaaaacgattaaaaaccgaacgaaatctcgcattttattccgacgaaaaaaacgacccgacgcgaccgaacgaaaaatataaacgacgaatataaataatcgctataaccgacgaaaatcgtaaaacgcgaccgaaatttacccgtcgataacgcgaaatctcgaaaaaacgaaaatataaatccgcgaccgatatatcgtcccccgaccgaaaaaacgtatacgaaaaaaaa

SEQ ID NO: 4603 - DNA, 1289 bp, Artificial Sequence
  chemically treated genomic DNA (Homo sapiens) CpG-island No: 4603
  misc_feature (179)..(179): n is either a, c, g or t
  misc_feature (181)..(181): n is either a, c, g or t
  misc_feature (259)..(259): n is either a, c, g or t
  misc_feature (274)..(274): n is either a, c, g or t
  misc_feature (293)..(293): n is either a, c, g or t
  misc_feature (297)..(297): n is either a, c, g or t
  misc_feature (380)..(380): n is either a, c, g or t
  misc_feature (388)..(388): n is either a, c, g or t
  misc_feature (492)..(492): n is either a, c, g or t
  misc_feature (714)..(714): n is either a, c, g or t
  misc_feature (866)..(866): n is either a, c, g or t
  misc_feature (1015)..(1015): n is either a, c, g or t
tttgggatttacgaagagggtgtttttatttttgtttagttgtggttttggggtattggtcggttattagtagagcggcgtaaatttgatttggcgtcgcgtcgttaggtatgttgtgaatggttttattttttgtatatgtcgtttttgttataattcgtattttcgtcgggcgggtngncgcgcggcggcgcgtcggcgttttcgcgcgcgttcggggtttcgcgggcgtcggcggggcgcgcgggggcgtcggggntcgcgggggcgcgtnggggtcgtcgcgcgcgcgngggncgcggggggcggcgggcgtcgcggattttcgcggttttcgcggcgcgtcgggcggggtcgcggtcgcgataggcggcgcggtngcgatcgntttcgggtcgttcgcggcggcgcgggtcgcgggggtttcgggggtcggttcgttcgggcgcgggcgcgtcggcgtcggcgggattgggggtatcggttcggcgngtcgggcggtcgtttttggggcggcgtcgcggcgggtcgcgggcgtcgcgggggtcggggtcggcggcgcgggtcgggggcgcgcggcgcgttcgttcggattcgggttcgcggcgtcgggcgtcgcgcgcggcgggtcgggggcgcgcgtcgggcgcggcggggggtttttttcgcgggcgtcgggtcgggcgtcggcgtcggtttcgcgaatttgatggnggggcgttcggttcggcgtcgggcgcggtatcgtgcgggttcgttgggcggcggggggcgggggcgggtcgggcgtcgggcggtttcggcgcggtgtatgggcggggcggtcggatcgatgatggggggggggcggttcgggtcgtcgcggntatgggatggatggttgggggcgcgggttttggggcggttcgggcggtcgcggggcgggcggcgcggcgcggttgcgtcgggggcgcgcggggggtcgggggcgggcgttgtcggtatgatggcggggtatcgcggcgggggtcgtcgnttgcgtttggtcgggcgatttgttcggtcggtcgatttgtttggggcggttgggggtcgggcgggatttcgtattttgtttcggcggggggggcggttcggcgcggtcgggcgggggatgtgggcggcgggtatgggtggtcgttgtggtcggcgggggtcgtggggcgcggtcggggtttgttcgtcggtggcgcggggtttcgggggggcgggggtgtgggttcgcggtcggtgtgtcgtttttcggtcgggggggcgtatgcggggggggg

SEQ ID NO: 4604 - DNA, 1289 bp, Artificial Sequence
  chemically treated genomic DNA (Homo sapiens) CpG-island No: 4604
  misc_feature (275)..(275): n is either a, c, g or t
  misc_feature (424)..(424): n is either a, c, g or t
  misc_feature (576)..(576): n is either a, c, g or t
  misc_feature (798)..(798): n is either a, c, g or t
  misc_feature (902)..(902): n is either a, c, g or t
  misc_feature (910)..(910): n is either a, c, g or t
  misc_feature (993)..(993): n is either a, c, g or t
  misc_feature (997)..(997): n is either a, c, g or t
  misc_feature (1016)..(1016): n is either a, c, g or t
  misc_feature (1031)..(1031): n is either a, c, g or t
  misc_feature (1109)..(1109): n is either a, c, g or t
  misc_feature (1111)..(1111): n is either a, c, g or t
cccccccccgcatacgcccccccgaccgaaaaacgacacaccgaccgcgaacccacacccccgcccccccgaaaccccgcgccaccgacgaacaaaccccgaccgcgccccacgacccccgccgaccacaacgaccacccatacccgccgcccacatcccccgcccgaccgcgccgaaccgccccccccgccgaaacaaaatacgaaatcccgcccgacccccaaccgccccaaacaaatcgaccgaccgaacaaatcgcccgaccaaacgcaancgacgacccccgccgcgataccccgccatcataccgacaacgcccgcccccgaccccccgcgcgcccccgacgcaaccgcgccgcgccgcccgccccgcgaccgcccgaaccgccccaaaacccgcgcccccaaccatccatcccatanccgcgacgacccgaaccgccccccccccatcatcgatccgaccgccccgcccatacaccgcgccgaaaccgcccgacgcccgacccgcccccgccccccgccgcccaacgaacccgcacgataccgcgcccgacgccgaaccgaacgccccnccatcaaattcgcgaaaccgacgccgacgcccgacccgacgcccgcgaaaaaaaccccccgccgcgcccgacgcgcgcccccgacccgccgcgcgcgacgcccgacgccgcgaacccgaatccgaacgaacgcgccgcgcgcccccgacccgcgccgccgaccccgacccccgcgacgcccgcgacccgccgcgacgccgccccaaaaacgaccgcccgacncgccgaaccgatacccccaatcccgccgacgccgacgcgcccgcgcccgaacgaaccgacccccgaaacccccgcgacccgcgccgccgcgaacgacccgaaancgatcgcnaccgcgccgcctatcgcgaccgcgaccccgcccgacgcgccgcgaaaaccgcgaaaatccgcgacgcccgccgccccccgcgncccncgcgcgcgcgacgaccccnacgcgcccccgcganccccgacgcccccgcgcgccccgccgacgcccgcgaaaccccgaacgcgcgcgaaaacgccgacgcgccgccgcgcgncnacccgcccgacgaaaatacgaattataacaaaaacgacatatacaaaaaataaaaccattcacaacatacctaacgacgcgacgccaaatcaaatttacgccgctctactaataaccgaccaataccccaaaaccacaactaaacaaaaataaaaacaccctcttcgtaaatcccaaa

SEQ ID NO: 4605 - DNA, 1384 bp, Artificial Sequence
  chemically treated genomic DNA (Homo sapiens) CpG-island No: 4605
  misc_feature (292)..(292): n is either a, c, g or t
  misc_feature (318)..(318): n is either a, c, g or t
  misc_feature (399)..(399): n is either a, c, g or t
  misc_feature (592)..(592): n is either a, c, g or t
  misc_feature (908)..(908): n is either a, c, g or t
  misc_feature (966)..(966): n is either a, c, g or t
  misc_feature (975)..(975): n is either a, c, g or t
  misc_feature (997)..(997): n is either a, c, g or t
  misc_feature (1052)..(1052): n is either a, c, g or t
  misc_feature (1062)..(1062): n is either a, c, g or t
  misc_feature (1165)..(1165): n is either a, c, g or t
  misc_feature (1174)..(1174): n is either a, c, g or t
  misc_feature (1184)..(1185): n is either a, c, g or t
  misc_feature (1209)..(1209): n is either a, c, g or t
ggttttcgcgtttcgttatatatttcgcgcggcgttcggggcggggggatggattatatcgtcgcgtcgtcgattatatagcgtttcgcgtttcggcgtatattcgcgtttttcggatttcgatcgtcgcgatatacgttttcgtcgttcggttcgtattttacgttttcgtcgttcggaaatatggcgtatcgatcgttatatcgttcgtttttcgagtattcgcggcggcgttcgttttttttttcggtttcgttttcgcgttcgtttcgattataatatgtttatgatntttcggcgtcgttcgttttaattttngttatatggtattatgtcgcgtcgcgtcgcgggttagtatcgcgtcgtcgtttatgatgcggaatcgttcggtcgtcggtnttttcggataatttttttttattatcgtttttcgatgttttcgtcgcgtcgttcgcgttttcgcgtcgttttttttcgatacggttttcgggtttttttcgcgttcgtcgatcgttttcgttttttttcgggatttcgtcggtttcggggaattattcgatgtcgatagtcgcgcgcgcgttttttttcgttntcgcgtcgcgaatatttatgtttcgttcgcgtttcggcgtaatttacgtttcgcggttcggtcggcggtttttcgtttcgcgttcggtttcgggcgcgcgcgttaacgattttcgtatggaatcgtcgttcgcgttcggtttttcgtttcgtttttcgatcgatattttcggcgcgttcgtcgcgggcgtcgtcgcggttttttttcgagcgagcgtcgcggttttcgtcggcgcggttcgtcgcggcgcgttttcgtcggtcgttcgggcgtcgggttcgatgcggcgggaagcgcgtcgtcgcgtttcgttcgngcgtcgcgcgcggtttcggtttcgcgcgtttttcgcgcgcgcgtcgcgttatagtcgngtcgttcgnttcgttttcgggatcgtcgaangttcgtcgtttcgttcgttcggtcgcgtcggcgtcgtcgcggttcggcggttcgncggttcgttngcgtcgggttttttaaatatcgtttcgcgcgggatacgcggttcggcggttcggtcgttcgcggatacgtcgagaattcgcgcggttcgcgcggtttcgtcgngcgcgcgtntttcggtttnntcgttttcggttttttcgcggggntttcgtcgtcgttcgggcgttcgcgcgcgttttcggcgggttcggcggcgttttcggcggttttcgttaggtttggggtatgtcgtaaatgggttttaaagagagtattacgggtttttttagtatcgcgtttatcggagatagtaaattataagttgaaaatttattacgtttg

SEQ ID NO: 4606 - DNA, 1384 bp, Artificial Sequence
  chemically treated genomic DNA (Homo sapiens) CpG-island No: 4606
  misc_feature (176)..(176): n is either a, c, g or t
  misc_feature (200)..(201): n is either a, c, g or t
  misc_feature (211)..(211): n is either a, c, g or t
  misc_feature (220)..(220): n is either a, c, g or t
  misc_feature (323)..(323): n is either a, c, g or t
  misc_feature (333)..(333): n is either a, c, g or t
  misc_feature (388)..(388): n is either a, c, g or t
  misc_feature (410)..(410): n is either a, c, g or t
  misc_feature (419)..(419): n is either a, c, g or t
  misc_feature (477)..(477): n is either a, c, g or t
  misc_feature (793)..(793): n is either a, c, g or t
  misc_feature (986)..(986): n is either a, c, g or t
  misc_feature (1067)..(1067): n is either a, c, g or t
  misc_feature (1093)..(1093): n is either a, c, g or t
caaacgtaataaattttcaacttataatttactatctccgataaacgcgatactaaaaaaacccgtaatactctctttaaaacccatttacgacataccccaaacctaacgaaaaccgccgaaaacgccgccgaacccgccgaaaacgcgcgcgaacgcccgaacgacgacgaaanccccgcgaaaaaaccgaaaacgannaaaccgaaanacgcgcgcncgacgaaaccgcgcgaaccgcgcgaattctcgacgtatccgcgaacgaccgaaccgccgaaccgcgtatcccgcgcgaaacgatatttaaaaaacccgacgcnaacgaaccgncgaaccgccgaaccgcgacgacgccgacgcgaccgaacgaacgaaacgacgaacnttcgacgatcccgaaaacgaancgaacgacncgactataacgcgacgcgcgcgcgaaaaacgcgcgaaaccgaaaccgcgcgcgacgcncgaacgaaacgcgacgacgcgcttcccgccgcatcgaacccgacgcccgaacgaccgacgaaaacgcgccgcgacgaaccgcgccgacgaaaaccgcgacgctcgctcgaaaaaaaaccgcgacgacgcccgcgacgaacgcgccgaaaatatcgatcgaaaaacgaaacgaaaaaccgaacgcgaacgacgattccatacgaaaatcgttaacgcgcgcgcccgaaaccgaacgcgaaacgaaaaaccgccgaccgaaccgcgaaacgtaaattacgccgaaacgcgaacgaaacataaatattcgcgacgcganaacgaaaaaaaacgcgcgcgcgactatcgacatcgaataattccccgaaaccgacgaaatcccgaaaaaaaacgaaaacgatcgacgaacgcgaaaaaaacccgaaaaccgtatcgaaaaaaaacgacgcgaaaacgcgaacgacgcgacgaaaacatcgaaaaacgataataaaaaaaaattatccgaaaanaccgacgaccgaacgattccgcatcataaacgacgacgcgatactaacccgcgacgcgacgcgacataataccatataacnaaaattaaaacgaacgacgccgaaanatcataaacatattataatcgaaacgaacgcgaaaacgaaaccgaaaaaaaaaacgaacgccgccgcgaatactcgaaaaacgaacgatataacgatcgatacgccatatttccgaacgacgaaaacgtaaaatacgaaccgaacgacgaaaacgtatatcgcgacgatcgaaatccgaaaaacgcgaatatacgccgaaacgcgaaacgctatataatcgacgacgcgacgatataatccatccccccgccccgaacgccgcgcgaaatatataacgaaacgcgaaaacc

SEQ ID NO: 4607 - DNA, 1384 bp, Artificial Sequence
  chemically treated genomic DNA (Homo sapiens) CpG-island No: 4607
  misc_feature (176)..(176): n is either a, c, g or t
  misc_feature (200)..(201): n is either a, c, g or t
  misc_feature (211)..(211): n is either a, c, g or t
  misc_feature (220)..(220): n is either a, c, g or t
  misc_feature (323)..(323): n is either a, c, g or t
  misc_feature (333)..(333): n is either a, c, g or t
  misc_feature (388)..(388): n is either a, c, g or t
  misc_feature (410)..(410): n is either a, c, g or t
  misc_feature (419)..(419): n is either a, c, g or t
  misc_feature (477)..(477): n is either a, c, g or t
  misc_feature (793)..(793): n is either a, c, g or t
  misc_feature (986)..(986): n is either a, c, g or t
  misc_feature (1067)..(1067): n is either a, c, g or t
  misc_feature (1093)..(1093): n is either a, c, g or t
taaacgtagtgaatttttagtttgtaatttgttgttttcggtgagcgcggtgttgagaagattcgtgatgttttttttgaagtttatttgcggtatgttttaggtttggcgggggtcgtcgggggcgtcgtcgggttcgtcgggggcgcgcgcgggcgttcgggcggcggcggggntttcgcgggggggtcgggggcggnngggtcggggngcgcgcgtncggcggggtcgcgcgggtcgcgcgggttttcggcgtattcgcgggcggtcgggtcgtcgggtcgcgtatttcgcgcggggcggtatttggggggttcggcgtnggcgggtcgncgggtcgtcgggtcgcggcggcgtcggcgcggtcgggcgggcggggcggcgggtnttcggcgatttcgggggcgggncgggcggtncgattatggcgcggcgcgcgcgcggggggcgcgcggggtcggggtcgcgcgcggcgtncgggcggggcgcggcggcgcgtttttcgtcgtatcgggttcggcgttcgggcggtcggcgggggcgcgtcgcggcgggtcgcgtcggcgggggtcgcggcgttcgttcgggggggggtcgcggcggcgttcgcggcgggcgcgtcggaaatgtcggtcggggggcggggcggggggtcgggcgcgggcggcggttttatgcgggggtcgttggcgcgcgcgttcggggtcgggcgcggggcggggggtcgtcggtcgggtcgcggggcgtgggttgcgtcggggcgcgggcggggtatgggtgttcgcggcgcggnggcgggggggggcgcgcgcgcggttatcggtatcggatggtttttcggggtcggcgggatttcgggggggggcgggggcgatcggcgggcgcggggggggttcgggggtcgtatcgggggggggcggcgcgggggcgcgggcggcgcggcgggggtatcggggggcggtgatgggggggggttattcgggggngtcggcggtcgggcgatttcgtattatgggcggcggcgcgatgttggttcgcggcgcggcgcggtatgatgttatatggtngggattggggcgggcggcgtcggggnattatgggtatgttataatcggggcgggcgcgggggcggggtcgggggggggggcgggcgtcgtcgcgggtgttcggggggcgggcggtatggcgatcgatgcgttatgttttcgggcggcgggggcgtgggatgcgggtcgggcggcgggggcgtatgtcgcggcggtcggggttcggggggcgcggatatgcgtcggggcgcggggcgttatgtggtcggcggcgcggcgatatggtttattttttcgtttcgggcgtcgcgcggggtatatggcggggcgcggggatt

SEQ ID NO: 4608 - DNA, 1384 bp, Artificial Sequence
  chemically treated genomic DNA (Homo sapiens) CpG-island No: 4608
  misc_feature (292)..(292): n is either a, c, g or t
  misc_feature (318)..(318): n is either a, c, g or t
  misc_feature (399)..(399): n is either a, c, g or t
  misc_feature (592)..(592): n is either a, c, g or t
  misc_feature (908)..(908): n is either a, c, g or t
  misc_feature (966)..(966): n is either a, c, g or t
  misc_feature (975)..(975): n is either a, c, g or t
  misc_feature (997)..(997): n is either a, c, g or t
  misc_feature (1052)..(1052): n is either a, c, g or t
  misc_feature (1062)..(1062): n is either a, c, g or t
  misc_feature (1165)..(1165): n is either a, c, g or t
  misc_feature (1174)..(1174): n is either a, c, g or t
  misc_feature (1184)..(1185): n is either a, c, g or t
  misc_feature (1209)..(1209): n is either a, c, g or t
aatccccgcgccccgccatataccccgcgcgacgcccgaaacgaaaaaataaaccatatcgccgcgccgccgaccacataacgccccgcgccccgacgcatatccgcgccccccgaaccccgaccgccgcgacatacgcccccgccgcccgacccgcatcccacgcccccgccgcccgaaaacataacgcatcgatcgccataccgcccgccccccgaacacccgcgacgacgcccgcccccccccccgaccccgcccccgcgcccgccccgattataacatacccataatnccccgacgccgcccgccccaatcccnaccatataacatcataccgcgccgcgccgcgaaccaacatcgcgccgccgcccataatacgaaatcgcccgaccgccgacncccccgaataacccccccccatcaccgccccccgatacccccgccgcgccgcccgcgcccccgcgccgcccccccccgatacgacccccgaaccccccccgcgcccgccgatcgcccccgcccccccccgaaatcccgccgaccccgaaaaaccatccgataccgataaccgcgcgcgcgcccccccccgccnccgcgccgcgaacacccataccccgcccgcgccccgacgcaacccacgccccgcgacccgaccgacgaccccccgccccgcgcccgaccccgaacgcgcgcgccaacgacccccgcataaaaccgccgcccgcgcccgaccccccgccccgccccccgaccgacatttccgacgcgcccgccgcgaacgccgccgcgacccccccccgaacgaacgccgcgacccccgccgacgcgacccgccgcgacgcgcccccgccgaccgcccgaacgccgaacccgatacgacgaaaaacgcgccgccgcgccccgcccgnacgccgcgcgcgaccccgaccccgcgcgccccccgcgcgcgcgccgcgccataatcgnaccgcccgncccgcccccgaaatcgccgaanacccgccgccccgcccgcccgaccgcgccgacgccgccgcgacccgacgacccgncgacccgccnacgccgaaccccccaaataccgccccgcgcgaaatacgcgacccgacgacccgaccgcccgcgaatacgccgaaaacccgcgcgacccgcgcgaccccgccgnacgcgcgcnccccgacccnnccgcccccgacccccccgcgaaanccccgccgccgcccgaacgcccgcgcgcgcccccgacgaacccgacgacgcccccgacgacccccgccaaacctaaaacataccgcaaataaacttcaaaaaaaacatcacgaatcttctcaacaccgcgctcaccgaaaacaacaaattacaaactaaaaattcactacgttta

SEQ ID NO: 4609 - DNA, 502 bp, Artificial Sequence
  chemically treated genomic DNA (Homo sapiens) CpG-island No: 4609
ttcggtgttatagttcgttacgttaagtgttcgtttcgataggtattttttttagattcgtgcgataatattataggtttgtttcgacgaggcgggcgataatttggttgcgtttcgttatgtagttgagtagtaatagttgtcgtaagtggtttggttggcggaatatttggcggtataattggaagttatcgcgcgtgaagttttcgtttggttattgcgcgagtgggatagtgtattatcgaaaattgttcgttggtagcgtaaacgtatttagtattaggattttgagcggcggttacgtgagatggttgtcgaacgtagagttcgtttggcgcgggtgatcgatttcgtggaatagtaaacgttgtatcgtgaagtggaagtttatgaagcgcgtttggtacgttgtcgttatgcgttggaaaaaatcgaaaataggttagcgcgtttaattcgttagtaatggagagaatatgttattggaaaatgtttttgacga

SEQ ID NO: 4610 - DNA, 502 bp, Artificial Sequence
  chemically treated genomic DNA (Homo sapiens) CpG-island No: 4610
tcgtcaaaaacattttccaataacatattctctccattactaacgaattaaacgcgctaacctattttcgattttttccaacgcataacgacaacgtaccaaacgcgcttcataaacttccacttcacgatacaacgtttactattccacgaaatcgatcacccgcgccaaacgaactctacgttcgacaaccatctcacgtaaccgccgctcaaaatcctaatactaaatacgtttacgctaccaacgaacaattttcgataatacactatcccactcgcgcaataaccaaacgaaaacttcacgcgcgataacttccaattataccgccaaatattccgccaaccaaaccacttacgacaactattactactcaactacataacgaaacgcaaccaaattatcgcccgcctcgtcgaaacaaacctataatattatcgcacgaatctaaaaaaaatacctatcgaaacgaacacttaacgtaacgaactataacaccgaa

SEQ ID NO: 4611 - DNA, 502 bp, Artificial Sequence
  chemically treated genomic DNA (Homo sapiens) CpG-island No: 4611
tcgttaggggtattttttagtgatatattttttttattgttagcgggttaaacgcgttaatttgttttcgattttttttagcgtatggcggtagcgtgttaggcgcgttttataggtttttattttacgatgtagcgtttgttgttttacgagatcggttattcgcgttagacgggttttgcgttcggtaattattttacgtagtcgtcgtttaaaattttgatgttgaatacgtttacgttgttagcgggtaattttcggtggtgtattgttttattcgcgtaatgattaggcggaggttttacgcgcgatggtttttagttgtgtcgttagatgtttcgttagttaggttatttgcggtagttgttgttgtttaattgtatgacgaagcgtagttagattatcgttcgtttcgtcgagataagtttgtagtgttgtcgtacgagtttgaaaaagatgtttgtcgaaacgagtatttagcgtggcgaattgtgatatcggg

SEQ ID NO: 4612 - DNA, 502 bp, Artificial Sequence
  chemically treated genomic DNA (Homo sapiens) CpG-island No: 4612
cccgatatcacaattcgccacgctaaatactcgtttcgacaaacatctttttcaaactcgtacgacaacactacaaacttatctcgacgaaacgaacgataatctaactacgcttcgtcatacaattaaacaacaacaactaccgcaaataacctaactaacgaaacatctaacgacacaactaaaaaccatcgcgcgtaaaacctccgcctaatcattacgcgaataaaacaatacaccaccgaaaattacccgctaacaacgtaaacgtattcaacatcaaaattttaaacgacgactacgtaaaataattaccgaacgcaaaacccgtctaacgcgaataaccgatctcgtaaaacaacaaacgctacatcgtaaaataaaaacctataaaacgcgcctaacacgctaccgccatacgctaaaaaaaatcgaaaacaaattaacgcgtttaacccgctaacaataaaaaaaatatatcactaaaaaatacccctaacga

SEQ ID NO: 4613 - DNA, 664 bp, Artificial Sequence
  chemically treated genomic DNA (Homo sapiens) CpG-island No: 4613
cgtagtacgaagagattcgtttgtttgtcggagttgaggttttcgaaagtcgtaagggtgttttaggtttcggttttaaagagttcggtcgtgacgttgtgtagcgttcgcgttgggatcggttcgatttttagtagtgtaagttttgcgaggagcggcgagaagagggtttaggagttcgggagtcggttcgtcgtcgttatggtagttttttagttttcgttcgtcggtttaacgtcgcgtttgacgatagtcgtaaagtatcgcgttatcggtcgagagagtggcgcgtagtttcgggacgcgtaagagtcgttgtcggttttttttttttttttttattagggttgttttttcgacgttaaaaaagtagtggagttagggtgaaagtcgtttttacgtttattttcggtaggcgcgtttttcgatagtgtcgtgcggggggcgtggttcggtattgttgataggcggtttcgggggcggtggttaaggcggcgatcggagcgcgatggcgggggcggcgggatttacggtagaagtgagttggaaggttttggagcgaagagttcggattaagcgtttaggtttggttggttggggcgtcgttttttattcgagtattttgggtggtgtttcgttttaagcgttttggcgggaggtaggt

SEQ ID NO: 4614 - DNA, 664 bp, Artificial Sequence
  chemically treated genomic DNA (Homo sapiens) CpG-island No: 4614
acctacctcccgccaaaacgcttaaaacgaaacaccacccaaaatactcgaataaaaaacgacgccccaaccaaccaaacctaaacgcttaatccgaactcttcgctccaaaaccttccaactcacttctaccgtaaatcccgccgcccccgccatcgcgctccgatcgccgccttaaccaccgcccccgaaaccgcctatcaacaataccgaaccacgccccccgcacgacactatcgaaaaacgcgcctaccgaaaataaacgtaaaaacgactttcaccctaactccactacttttttaacgtcgaaaaaacaaccctaataaaaaaaaaaaaaaaaaaccgacaacgactcttacgcgtcccgaaactacgcgccactctctcgaccgataacgcgatactttacgactatcgtcaaacgcgacgttaaaccgacgaacgaaaactaaaaaactaccataacgacgacgaaccgactcccgaactcctaaaccctcttctcgccgctcctcgcaaaacttacactactaaaaatcgaaccgatcccaacgcgaacgctacacaacgtcacgaccgaactctttaaaaccgaaacctaaaacacccttacgactttcgaaaacctcaactccgacaaacaaacgaatctcttcgtactacg

SEQ ID NO: 4615 - DNA, 664 bp, Artificial Sequence
  chemically treated genomic DNA (Homo sapiens) CpG-island No: 4615
atttgtttttcgttaaggcgtttgaggcgaagtattatttaaggtattcgggtggggggcggcgttttagttagttaaatttgagcgtttggttcgagtttttcgttttaagattttttagtttatttttgtcgtgagtttcgtcgttttcgttatcgcgtttcggtcgtcgttttggttatcgttttcggggtcgtttgttagtaatgtcgggttacgtttttcgtacgatattgtcgggaggcgcgtttgtcggaagtgagcgtgagggcggtttttattttagttttattgtttttttagcgtcggaagggtagttttagtgggagagagaaaaaggagtcggtagcggtttttacgcgtttcggggttgcgcgttattttttcggtcggtaacgcggtgttttgcggttgtcgttaagcgcggcgttgggtcggcgggcgggggttgaggggttgttatggcggcggcgggtcggttttcgagtttttgggtttttttttcgtcgtttttcgtagggtttgtattattgggagtcgggtcggttttagcgcgggcgttgtataacgttacggtcgagttttttggggtcgaggtttggggtatttttgcggttttcggggattttaatttcgataagtagacggattttttcgtgttgcg

SEQ ID NO: 4616 - DNA, 664 bp, Artificial Sequence
  chemically treated genomic DNA (Homo sapiens) CpG-island No: 4616
cgcaacacgaaaaaatccgtctacttatcgaaattaaaatccccgaaaaccgcaaaaataccccaaacctcgaccccaaaaaactcgaccgtaacgttatacaacgcccgcgctaaaaccgacccgactcccaataatacaaaccctacgaaaaacgacgaaaaaaaaacccaaaaactcgaaaaccgacccgccgccgccataacaacccctcaacccccgcccgccgacccaacgccgcgcttaacgacaaccgcaaaacaccgcgttaccgaccgaaaaaataacgcgcaaccccgaaacgcgtaaaaaccgctaccgactcctttttctctctcccactaaaactacccttccgacgctaaaaaaacaataaaactaaaataaaaaccgccctcacgctcacttccgacaaacgcgcctcccgacaatatcgtacgaaaaacgtaacccgacattactaacaaacgaccccgaaaacgataaccaaaacgacgaccgaaacgcgataacgaaaacgacgaaactcacgacaaaaataaactaaaaaatcttaaaacgaaaaactcgaaccaaacgctcaaatttaactaactaaaacgccgccccccacccgaataccttaaataatacttcgcctcaaacgccttaacgaaaaacaaat

SEQ ID NO: 4617 - DNA, 536 bp, Artificial Sequence
  chemically treated genomic DNA (Homo sapiens) CpG-island No: 4617
  misc_feature (176)..(176): n is either a, c, g or t
gtcgcgaaggtcgtttcgaattgagtttcgcgtttaaggtaggtcgtggtttgggtataggttttcggagaaggtcgcgtcgttcgtcgtcgtcgcgggggtagttaggtttatttgtgtagcgacggtaggttttgcgtgtcgttggcggggttaggcgtgttggggatgacgtntaggatggtgttttgtagcgacgtgttttttagaaggcggtttcgtattagttgtaggttgcgggtcgagtttacgttggtgcgtatggtggagtcgggtagtaggacgttttcgtgggtgagtagtagcgggaggcgtttggggatttggatggggtttattgattgatgagagattcgttttaacgttttcgatttcggtacgcgttacgttcgttttcgggtttaaaagttatgcgtatgcgttgttttttaggagagtttttcggtaagatttgagcgttttatttatgcggaaagacgtgtatttaagcgtgtagcgattttcgttttatttatagagtatatttggaaggatga

SEQ ID NO: 4618 - DNA, 536 bp, Artificial Sequence
  chemically treated genomic DNA (Homo sapiens) CpG-island No: 4618
  misc_feature (361)..(361): n is either a, c, g or t
tcatccttccaaatatactctataaataaaacgaaaatcgctacacgcttaaatacacgtctttccgcataaataaaacgctcaaatcttaccgaaaaactctcctaaaaaacaacgcatacgcataacttttaaacccgaaaacgaacgtaacgcgtaccgaaatcgaaaacgttaaaacgaatctctcatcaatcaataaaccccatccaaatccccaaacgcctcccgctactactcacccacgaaaacgtcctactacccgactccaccatacgcaccaacgtaaactcgacccgcaacctacaactaatacgaaaccgccttctaaaaaacacgtcgctacaaaacaccatcctanacgtcatccccaacacgcctaaccccgccaacgacacgcaaaacctaccgtcgctacacaaataaacctaactacccccgcgacgacgacgaacgacgcgaccttctccgaaaacctatacccaaaccacgacctaccttaaacgcgaaactcaattcgaaacgaccttcgcgac

SEQ ID NO: 4619 - DNA, 536 bp, Artificial Sequence
  chemically treated genomic DNA (Homo sapiens) CpG-island No: 4619
  misc_feature (361)..(361): n is either a, c, g or t
ttatttttttaaatatattttgtaagtgaggcgaaggtcgttgtacgtttgagtgtacgttttttcgtataggtaggacgtttaagttttatcgggaggtttttttagagagtagcgtatacgtatggtttttgggttcggggacggacgtagcgcgtatcggaatcggaagcgttgaggcgggttttttattaattagtgagttttatttagatttttagacgtttttcgttgttgtttatttacgagggcgttttgttgttcggttttattatgcgtattagcgtggattcggttcgtaatttgtagttggtgcggagtcgttttttgaagggtacgtcgttgtaaagtattattttgngcgttatttttaatacgtttgatttcgttagcgatacgtaagatttgtcgtcgttgtataggtaggtttggttgttttcgcggcggcggcgggcggcgcggtttttttcggggatttgtgtttaggttacggtttgttttgagcgcgaggtttagttcggggcggttttcgcggt

SEQ ID NO: 4620 - DNA, 536 bp, Artificial Sequence
  chemically treated genomic DNA (Homo sapiens) CpG-island No: 4620
  misc_feature (176)..(176): n is either a, c, g or t
accgcgaaaaccgccccgaactaaacctcgcgctcaaaacaaaccgtaacctaaacacaaatccccgaaaaaaaccgcgccgcccgccgccgccgcgaaaacaaccaaacctacctatacaacgacgacaaatcttacgtatcgctaacgaaatcaaacgtattaaaaataacgcncaaaataatactttacaacgacgtacccttcaaaaaacgactccgcaccaactacaaattacgaaccgaatccacgctaatacgcataataaaaccgaacaacaaaacgccctcgtaaataaacaacaacgaaaaacgtctaaaaatctaaataaaactcactaattaataaaaaacccgcctcaacgcttccgattccgatacgcgctacgtccgtccccgaacccaaaaaccatacgtatacgctactctctaaaaaaacctcccgataaaacttaaacgtcctacctatacgaaaaaacgtacactcaaacgtacaacgaccttcgcctcacttacaaaatatatttaaaaaaataa

SEQ ID NO: 4621 - DNA, 637 bp, Artificial Sequence
  chemically treated genomic DNA (Homo sapiens) CpG-island No: 4621
attattcgttagttattttattggagacgacggaagatcgttgtcgaagcggcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcgggtatttatttagttatcgggtcgtttgagaatgacgtgtaattgtgtacgcgatattcggagataacggttgatttagttttattttttattttcgggtaataaaggcgcgtgcgttttttattttttttgttcgtttatattttaacgggttttttgaaga

SEQ ID NO: 4622 - DNA, 637 bp, Artificial Sequence
  chemically treated genomic DNA (Homo sapiens) CpG-island No: 4622
tcttcaaaaaacccgttaaaatataaacgaacaaaaaaaataaaaaacgcacgcgcctttattacccgaaaataaaaaataaaactaaatcaaccgttatctccgaatatcgcgtacacaattacacgtcattctcaaacgacccgataactaaataaatacccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgccgcttcgacaacgatcttccgtcgtctccaataaaataactaacgaataat

SEQ ID NO: 4623 - DNA, 637 bp, Artificial Sequence
  chemically treated genomic DNA (Homo sapiens) CpG-island No: 4623
tttttaaagaattcgttgaaatatggacgggtaaaaaaagtggaaagcgtacgcgtttttattgttcggggatggggagtaaagttaagttagtcgttgttttcgggtgtcgcgtgtatagttgtacgttatttttagacgattcgatgattggatgaatgttcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagattgcgtgttacgttcgcgttggattgttgtgatcgtgaggtattgtattgggcggttattatcggcggttttaatagtgaaatagtataggacgttatgttgggagcggtggaacgtcgtttcggtaacgatttttcgtcgtttttagtggagtggttgacggataat

SEQ ID NO: 4624 - DNA, 637 bp, Artificial Sequence
  chemically treated genomic DNA (Homo sapiens) CpG-island No: 4624
attatccgtcaaccactccactaaaaacgacgaaaaatcgttaccgaaacgacgttccaccgctcccaacataacgtcctatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaacattcatccaatcatcgaatcgtctaaaaataacgtacaactatacacgcgacacccgaaaacaacgactaacttaactttactccccatccccgaacaataaaaacgcgtacgctttccactttttttacccgtccatatttcaacgaattctttaaaaa

SEQ ID NO: 4625 - DNA, 566 bp, Artificial Sequence
  chemically treated genomic DNA (Homo sapiens) CpG-island No: 4625
ggcgggggtgaaaagcgtgtagtaggttcgtattcgtgtcgtttagtcgttgggtgttagtcgtgcgtaggtgttgtggtttgttattttgttcggtgcgttgtcggaaatttttatcggattacgtattggtttgggggtgggttggtttacgttggtggcggcggagttgattgtcgcgacgcgcggtttaggatttatggtttagttagcgggtgaatttttcgtaattgacgtggtgttggcggggatcgcggtgattgcgattatcggtttttttttagattgggtttgcgcgcgttataacgttcgttgacgttttggtatggagaagtataatgagtgaacgttttgaatattatttcgttggggtcggatttcgcgtataaatttcggtgtcgattgcgcgttcgtaagcgatattagtttgatagttttatatgcggtgttggttatatagggggggttttattcgaataaatttttacgtcggaatataaatcgcgtttggtcgacgttttggttaattgttatttattttgtttttttttatgtttaaagggttg

SEQ ID NO: 4626 - DNA, 566 bp, Artificial Sequence
  chemically treated genomic DNA (Homo sapiens) CpG-island No: 4626
caaccctttaaacataaaaaaaaacaaaataaataacaattaaccaaaacgtcgaccaaacgcgatttatattccgacgtaaaaatttattcgaataaaaccccccctatataaccaacaccgcatataaaactatcaaactaatatcgcttacgaacgcgcaatcgacaccgaaatttatacgcgaaatccgaccccaacgaaataatattcaaaacgttcactcattatacttctccataccaaaacgtcaacgaacgttataacgcgcgcaaacccaatctaaaaaaaaaccgataatcgcaatcaccgcgatccccgccaacaccacgtcaattacgaaaaattcacccgctaactaaaccataaatcctaaaccgcgcgtcgcgacaatcaactccgccgccaccaacgtaaaccaacccacccccaaaccaatacgtaatccgataaaaatttccgacaacgcaccgaacaaaataacaaaccacaacacctacgcacgactaacacccaacgactaaacgacacgaatacgaacctactacacgcttttcacccccgcc

SEQ ID NO: 4627 - DNA, 566 bp, Artificial Sequence
  chemically treated genomic DNA (Homo sapiens) CpG-island No: 4627
taattttttgggtatggggggaaatagggtaaataataattggttaaaacgtcggttaagcgcggtttgtgtttcggcgtaaaagtttgttcgggtaaaattttttttatatggttagtatcgtatgtaaagttgttaaattgatatcgtttacgggcgcgtagtcggtatcgaaatttgtgcgcgaaattcggttttagcggggtaatgtttaagacgtttatttattgtatttttttatgttagggcgttagcgggcgttgtaacgcgcgtagatttagtttaaaagaaagtcgataatcgtaattatcgcgattttcgttagtattacgttagttgcgagaaatttattcgttgattgaattataaattttaaatcgcgcgtcgcggtaattagtttcgtcgttattagcgtagattagtttatttttagattaatacgtaattcggtgaggattttcggtagcgtatcgggtaaaatgataaattatagtatttgcgtacggttggtatttagcgattgggcggtacgaatgcgaatttgttgtacgttttttattttcgtt

SEQ ID NO: 4628 - DNA, 566 bp, Artificial Sequence
  chemically treated genomic DNA (Homo sapiens) CpG-island No: 4628
aacgaaaataaaaaacgtacaacaaattcgcattcgtaccgcccaatcgctaaataccaaccgtacgcaaatactataatttatcattttacccgatacgctaccgaaaatcctcaccgaattacgtattaatctaaaaataaactaatctacgctaataacgacgaaactaattaccgcgacgcgcgatttaaaatttataattcaatcaacgaataaatttctcgcaactaacgtaatactaacgaaaatcgcgataattacgattatcgactttcttttaaactaaatctacgcgcgttacaacgcccgctaacgccctaacataaaaaaatacaataaataaacgtcttaaacattaccccgctaaaaccgaatttcgcgcacaaatttcgataccgactacgcgcccgtaaacgatatcaatttaacaactttacatacgatactaaccatataaaaaaaattttacccgaacaaacttttacgccgaaacacaaaccgcgcttaaccgacgttttaaccaattattatttaccctatttccccccatacccaaaaaatta

SEQ ID NO: 4629 - DNA, 854 bp, Artificial Sequence
  chemically treated genomic DNA (Homo sapiens) CpG-island No: 4629
gttttcgttgataagcgttagcggtagttttcggtggtcgtagtgataaagatgagtttttcgcgtcggtgtgtatttcggttttatttgtttggttagttgttttatcgttagttcgtattgcgtaagttacgttcggtttttattgtttacgcggtttgttcggatttttttttttagtttgtttagtagtcgtattagtttagtcgggaatattacgtcgtggtcgtttttattttttttttgttggagcgtttttgttaggttgcgtcgttgcgttttttttcgttcgtcgttttttgtttcgattcggatgagcggcgtgaagtttttcggttcgtatatcgtttggatacgtgtggtgttagtttgtatcgtcgttagtttgttttcgttttagttatattacgttattttcggtttacgcgatagcgatatttatttcgttaggttacgttttcgtcgttagattcgttttgttattcgtcgttttaatcggtcgtagaggtagcggttttcgattaatggttcgttatgttgtattcgcgtgtagaatattaggcggtgttggttgtcgtaatggtagtggtgggttttttcgtcgtttcgtttttttatatttcgtcggaatgtcggttcgttttttcgttaatttggcgtatttattcggggcggtagatataatgggttttttttttcgatgtcggtatttcgttttattttgaatggtatggttcgggggtaaatttcgggtttcggaaatcggttgtttcgtcgggttttcggggttatcgggatgtcgggaagttttagtttggttttaagggggtttttgatttttatattttggttgt

SEQ ID NO: 4630 - DNA, 854 bp, Artificial Sequence
  chemically treated genomic DNA (Homo sapiens) CpG-island No: 4630
acaaccaaaatataaaaatcaaaaacccccttaaaaccaaactaaaacttcccgacatcccgataaccccgaaaacccgacgaaacaaccgatttccgaaacccgaaatttacccccgaaccataccattcaaaataaaacgaaataccgacatcgaaaaaaaaaacccattatatctaccgccccgaataaatacgccaaattaacgaaaaaacgaaccgacattccgacgaaatataaaaaaacgaaacgacgaaaaaacccaccactaccattacgacaaccaacaccgcctaatattctacacgcgaatacaacataacgaaccattaatcgaaaaccgctacctctacgaccgattaaaacgacgaataacaaaacgaatctaacgacgaaaacgtaacctaacgaaataaatatcgctatcgcgtaaaccgaaaataacgtaatataactaaaacgaaaacaaactaacgacgatacaaactaacaccacacgtatccaaacgatatacgaaccgaaaaacttcacgccgctcatccgaatcgaaacaaaaaacgacgaacgaaaaaaaacgcaacgacgcaacctaacaaaaacgctccaacaaaaaaaaaataaaaacgaccacgacgtaatattcccgactaaactaatacgactactaaacaaactaaaaaaaaaaatccgaacaaaccgcgtaaacaataaaaaccgaacgtaacttacgcaatacgaactaacgataaaacaactaaccaaacaaataaaaccgaaatacacaccgacgcgaaaaactcatctttatcactacgaccaccgaaaactaccgctaacgcttatcaacgaaaac

SEQ ID NO: 4631 - DNA, 854 bp, Artificial Sequence
  chemically treated genomic DNA (Homo sapiens) CpG-island No: 4631
atagttagggtgtggaaattaggggtttttttggaattaaattgggatttttcgatatttcggtaatttcgggaattcggcggggtaatcggttttcggaattcggaatttgttttcggattatattatttaaagtggggcgaaatatcggtatcggggaggaaggtttattatgtttatcgtttcgaatgaatacgttaggttaacgaagaaacggatcggtatttcggcggggtgtgaaaggacgggacgacgaggggatttattattattattacgatagttagtatcgtttggtgttttatacgcgaatatagtatggcgagttattggtcgagagtcgttatttttacgatcggttgggacggcgaatggtaaaacgggtttggcggcgggagcgtgatttgacggggtggatgtcgttgtcgcgtaaatcggaggtgacgtggtatggttgggacggagataggttgacgacggtgtagattgatattatacgtatttagacggtatacgagtcgggaagttttacgtcgtttattcgggtcgagatagagaacggcgagcgggaaaaagcgtagcggcgtagtttggtagagacgttttagtaggaagggagtgagaacggttacggcgtggtgttttcggttgaattggtgcggttgttggataggttggaggaagaaattcgggtagatcgcgtgagtagtgaaagtcgggcgtggtttgcgtagtgcgggttgacggtggagtaattggttagataggtggagtcggaatatatatcggcgcgaaaagtttatttttattattgcgattatcggggattgtcgttggcgtttattagcgaagat

SEQ ID NO: 4632 - DNA, 854 bp, Artificial Sequence
  chemically treated genomic DNA (Homo sapiens) CpG-island No: 4632
atcttcgctaataaacgccaacgacaatccccgataatcgcaataataaaaataaacttttcgcgccgatatatattccgactccacctatctaaccaattactccaccgtcaacccgcactacgcaaaccacgcccgactttcactactcacgcgatctacccgaatttcttcctccaacctatccaacaaccgcaccaattcaaccgaaaacaccacgccgtaaccgttctcactcccttcctactaaaacgtctctaccaaactacgccgctacgctttttcccgctcgccgttctctatctcgacccgaataaacgacgtaaaacttcccgactcgtataccgtctaaatacgtataatatcaatctacaccgtcgtcaacctatctccgtcccaaccataccacgtcacctccgatttacgcgacaacgacatccaccccgtcaaatcacgctcccgccgccaaacccgttttaccattcgccgtcccaaccgatcgtaaaaataacgactctcgaccaataactcgccatactatattcgcgtataaaacaccaaacgatactaactatcgtaataataataataaatcccctcgtcgtcccgtcctttcacaccccgccgaaataccgatccgtttcttcgttaacctaacgtattcattcgaaacgataaacataataaaccttcctccccgataccgatatttcgccccactttaaataatataatccgaaaacaaattccgaattccgaaaaccgattaccccgccgaattcccgaaattaccgaaatatcgaaaaatcccaatttaattccaaaaaaacccctaatttccacaccctaactat

SEQ ID NO: 4633 - DNA, 1015 bp, Artificial Sequence
  chemically treated genomic DNA (Homo sapiens) CpG-island No: 4633
ttcgtttggtaggtcgtttattagatttaagataatattaatagggaagagagacgaaatttcgattattatcgaagagaaacgtacgaatgcgcggtttcgaggaggggagggacgaaaaataagtgagatttaacgttaagagttcgtcgatttgaataattttgacgatagatagtacgggaggcgacgcgataggggtattcgtttttcggcggtgtggttgatgtacgattcggtatattcggagagtttgttcgttgcgttattggtgcggtatacgtatacggaagtcggtgaattgttggcggtatatgatcgtagtaatacgtaggtgcgcgtttttacgtatgacgcgtagtattcgggtcggatggtggcgtatcgttacgcgggaaggtcggagatgcgttatcgttacgacgatacggggcgggtggtggagtaattgaattcggtagggttaagttatcgttatttttatgagtaggatcgtattatcgttatcgatagtttgaatcggcgtgaggtgttgtatatagaaagcggggtcgggttgaaacgggtggtgaaaaaagaattggcggacggtagcgttacgcgtagcgggtatgacgcggtaagaaggtttacggcgtaaattgacgcggcgggacggaggatagagtacggtttgaatgtggtgttcggcgatattacggatattattatatcggacgggcgggagacgaaattttattataacgacgggaattaattgacggcgggggtgtttttcgacgggttggagagttttcgggaatatgaagaatcgggtaggttggtatcggagatatcgcgtatcggggagaaaggacgttatcgttattatgacgcgtatagtgaattatcggcgacgataacggatgcgacgggtaggatttcggtaaatgattggaatttttttcggtagttttttggttttatcgaatggttgggtttataaaatcggtttgaatataatcgttttggtaaa

SEQ ID NO: 4634 - DNA, 1015 bp, Artificial Sequence
  chemically treated genomic DNA (Homo sapiens) CpG-island No: 4634
tttaccaaaacgattatattcaaaccgattttataaacccaaccattcgataaaaccaaaaaactaccgaaaaaaattccaatcatttaccgaaatcctacccgtcgcatccgttatcgtcgccgataattcactatacgcgtcataataacgataacgtcctttctccccgatacgcgatatctccgataccaacctacccgattcttcatattcccgaaaactctccaacccgtcgaaaaacacccccgccgtcaattaattcccgtcgttataataaaatttcgtctcccgcccgtccgatataataatatccgtaatatcgccgaacaccacattcaaaccgtactctatcctccgtcccgccgcgtcaatttacgccgtaaaccttcttaccgcgtcatacccgctacgcgtaacgctaccgtccgccaattcttttttcaccacccgtttcaacccgaccccgctttctatatacaacacctcacgccgattcaaactatcgataacgataatacgatcctactcataaaaataacgataacttaaccctaccgaattcaattactccaccacccgccccgtatcgtcgtaacgataacgcatctccgaccttcccgcgtaacgatacgccaccatccgacccgaatactacgcgtcatacgtaaaaacgcgcacctacgtattactacgatcatataccgccaacaattcaccgacttccgtatacgtataccgcaccaataacgcaacgaacaaactctccgaatataccgaatcgtacatcaaccacaccgccgaaaaacgaatacccctatcgcgtcgcctcccgtactatctatcgtcaaaattattcaaatcgacgaactcttaacgttaaatctcacttatttttcgtccctcccctcctcgaaaccgcgcattcgtacgtttctcttcgataataatcgaaatttcgtctctcttccctattaatattatcttaaatctaataaacgacctaccaaacgaa

SEQ ID NO: 4635 - DNA, 1015 bp, Artificial Sequence
  chemically treated genomic DNA (Homo sapiens) CpG-island No: 4635
tttgttaaagcggttgtatttaaatcggttttgtaagtttaattattcggtaaagttaagaaattgtcggaaggggttttagttatttgtcggggttttgttcgtcgtattcgttgtcgtcgtcggtaatttattgtgcgcgttatggtagcggtagcgtttttttttttcggtgcgcgatgttttcgatattagtttgttcggttttttatattttcgggggttttttagttcgtcgggggatattttcgtcgttagttggttttcgtcgttatagtaaaatttcgtttttcgttcgttcggtgtggtaatgttcgtgatatcgtcggatattatatttagatcgtattttgtttttcgtttcgtcgcgttagtttgcgtcgtgagtttttttgtcgcgttatattcgttgcgcgtgacgttgtcgttcgttagttttttttttattattcgttttagttcggtttcgttttttgtatgtagtattttacgtcggtttaggttgtcggtgacggtgatgcggttttgtttataaagatagcggtagtttaattttgtcgggtttagttgttttattattcgtttcgtatcgtcgtagcggtagcgtattttcggttttttcgcgtaacggtgcgttattattcggttcgggtgttgcgcgttatacgtgaaagcgcgtatttgcgtattgttgcggttatatatcgttagtagtttatcggttttcgtatacgtgtatcgtattagtggcgtagcgggtaggtttttcgggtatgtcgggtcgtgtattagttatatcgtcgaaaggcggatatttttgtcgcgtcgtttttcgtgttgtttgtcgttagagttgtttaggtcgacgagtttttagcgttgggttttatttatttttcgtttttttttttttcgagatcgcgtattcgtacgttttttttcggtggtggtcgaagtttcgttttttttttttattggtgttgttttgggtttgatgagcgatttattaggcggg

SEQ ID NO: 4636 - DNA, 1015 bp, Artificial Sequence
  chemically treated genomic DNA (Homo sapiens) CpG-island No: 4636
cccgcctaataaatcgctcatcaaacccaaaacaacaccaataaaaaaaaaaaacgaaacttcgaccaccaccgaaaaaaaacgtacgaatacgcgatctcgaaaaaaaaaaaaacgaaaaataaataaaacccaacgctaaaaactcgtcgacctaaacaactctaacgacaaacaacacgaaaaacgacgcgacaaaaatatccgcctttcgacgatataactaatacacgacccgacatacccgaaaaacctacccgctacgccactaatacgatacacgtatacgaaaaccgataaactactaacgatatataaccgcaacaatacgcaaatacgcgctttcacgtataacgcgcaacacccgaaccgaataataacgcaccgttacgcgaaaaaaccgaaaatacgctaccgctacgacgatacgaaacgaataataaaacaactaaacccgacaaaattaaactaccgctatctttataaacaaaaccgcatcaccgtcaccgacaacctaaaccgacgtaaaatactacatacaaaaaacgaaaccgaactaaaacgaataataaaaaaaaaactaacgaacgacaacgtcacgcgcaacgaatataacgcgacaaaaaaactcacgacgcaaactaacgcgacgaaacgaaaaacaaaatacgatctaaatataatatccgacgatatcacgaacattaccacaccgaacgaacgaaaaacgaaattttactataacgacgaaaaccaactaacgacgaaaatatcccccgacgaactaaaaaacccccgaaaatataaaaaaccgaacaaactaatatcgaaaacatcgcgcaccgaaaaaaaaaaacgctaccgctaccataacgcgcacaataaattaccgacgacgacaacgaatacgacgaacaaaaccccgacaaataactaaaaccccttccgacaatttcttaactttaccgaataattaaacttacaaaaccgatttaaatacaaccgctttaacaaa

SEQ ID NO: 4637 - DNA, 587 bp, Artificial Sequence
  chemically treated genomic DNA (Homo sapiens) CpG-island No: 4637
tcggcgcgtttcggagttaggagaacggagcgggtgtacggcgcggcgttgggggttattaatttttcggatcgataagttgttatttggagaggggagggttacgttttttcggagacgagttatttagggtaattttttacggaaaaattcgttgttcgtcgagaatagcgtcggggtcggtcgggtcgcggcgttcgttttacgtagggtgttcgcgtttcgtcgttttttagtttgtcggttagtcgggttcggtttcgtttagttttgttcgcggtttcgcggggttttgttcgttaatttcgtgttgggttgattgtcgaggtagatgttattacgtatttttcgcggttggggagcgcgagttggaggatgcgtagcgttttgaggtaggggggttaggcgcgcgcgttttaggtagttttagaggtagagtcgggtgacgggttaaacgcgacgtttagttggatattttgatagcggtagcgggcgagcgaggttttttagaggggcggaggttaggatcgagacgttttttaattagatttaagttttgagggtcgtttttttttaggttagcgtta

SEQ ID NO: 4638 - DNA, 587 bp, Artificial Sequence
  chemically treated genomic DNA (Homo sapiens) CpG-island No: 4638
taacgctaacctaaaaaaaaacgaccctcaaaacttaaatctaattaaaaaacgtctcgatcctaacctccgcccctctaaaaaacctcgctcgcccgctaccgctatcaaaatatccaactaaacgtcgcgtttaacccgtcacccgactctacctctaaaactacctaaaacgcgcgcgcctaacccccctacctcaaaacgctacgcatcctccaactcgcgctccccaaccgcgaaaaatacgtaataacatctacctcgacaatcaacccaacacgaaattaacgaacaaaaccccgcgaaaccgcgaacaaaactaaacgaaaccgaacccgactaaccgacaaactaaaaaacgacgaaacgcgaacaccctacgtaaaacgaacgccgcgacccgaccgaccccgacgctattctcgacgaacaacgaatttttccgtaaaaaattaccctaaataactcgtctccgaaaaaacgtaaccctcccctctccaaataacaacttatcgatccgaaaaattaataacccccaacgccgcgccgtacacccgctccgttctcctaactccgaaacgcgccga

SEQ ID NO: 4639 - DNA, 587 bp, Artificial Sequence
  chemically treated genomic DNA (Homo sapiens) CpG-island No: 4639
tagcgttaatttggggaggggcggtttttaaggtttaggtttagttaggggacgtttcggttttggttttcgtttttttggggagtttcgttcgttcgttgtcgttgttagggtgtttagttaggcgtcgcgtttagttcgttattcgattttatttttgagattgtttagggcgcgcgcgtttggtttttttgttttaagacgttgcgtattttttagttcgcgttttttaatcgcggggggtgcgtggtggtatttatttcggtaattagtttagtacggggttggcgagtagggtttcgcgggatcgcggatagagttgagcggggtcgggttcggttggtcggtaggttggggagcggcggggcgcgggtattttgcgtggggcgggcgtcgcggttcggtcggtttcggcgttgttttcggcgggtagcgggttttttcgtgaaaggttgttttgggtaattcgttttcgaggggacgtagtttttttttttttaagtggtaatttatcgattcgagagattgataatttttagcgtcgcgtcgtgtattcgtttcgtttttttggtttcggggcgcgtcgg

SEQ ID NO: 4640 - DNA, 587 bp, Artificial Sequence
  chemically treated genomic DNA (Homo sapiens) CpG-island No: 4640
ccgacgcgccccgaaaccaaaaaaacgaaacgaatacacgacgcgacgctaaaaattatcaatctctcgaatcgataaattaccacttaaaaaaaaaaaaactacgtcccctcgaaaacgaattacccaaaacaacctttcacgaaaaaacccgctacccgccgaaaacaacgccgaaaccgaccgaaccgcgacgcccgccccacgcaaaatacccgcgccccgccgctccccaacctaccgaccaaccgaacccgaccccgctcaactctatccgcgatcccgcgaaaccctactcgccaaccccgtactaaactaattaccgaaataaataccaccacgcaccccccgcgattaaaaaacgcgaactaaaaaatacgcaacgtcttaaaacaaaaaaaccaaacgcgcgcgccctaaacaatctcaaaaataaaatcgaataacgaactaaacgcgacgcctaactaaacaccctaacaacgacaacgaacgaacgaaactccccaaaaaaacgaaaaccaaaaccgaaacgtcccctaactaaacctaaaccttaaaaaccgcccctccccaaattaacgcta

SEQ ID NO: 4641 - DNA, 699 bp, Artificial Sequence
  chemically treated genomic DNA (Homo sapiens) CpG-island No: 4641
aaaatacgtttgcggttcgtttttttttttaaagtacgattatttcgttcgggtttttcgaggatttatttaagtttacgacgggttcgttttttcggtggtttgattatcggttggtggagtgggttttggggtcgttaggcgattaaggcgtatgcgggggcggatagtttattgtgaagggcgtcggggtatagtgcggggttcgttttatttttaggtgtttttttttcgttttcgtttcgtaggtatcgtatcgggttcgggaatcggttcggatttggcggtgggcgttgggaagaggatttatttttacgtggttcgtttcgtttcgggggcgtagttagttttcggcgtttattgttttttttttttcggttttcgtttttttttgcgtaggcgtcgtttcgtttcggttttaggggtgttttcgtggtcggcggttgttgggtttcgcgtcggggttcgagttttacgaagtttcggttcgagtcgtcggatgttcgcgcgtagcggggtttaggtgagcgagcgtatcgttcgtttcgcggaatagacgcgtttatttttaggcgtagtagcgagcgcggtcgcgggagcgggagcggggggtgtagtttcgcgtacggaaagttatcggtatatagtttagtattagtgtttcgtgtttttaagaaatttataatatcgattgtgtaa

SEQ ID NO: 4642 - DNA, 699 bp, Artificial Sequence
  chemically treated genomic DNA (Homo sapiens) CpG-island No: 4642
ttacacaatcgatattataaatttcttaaaaacacgaaacactaatactaaactatataccgataactttccgtacgcgaaactacaccccccgctcccgctcccgcgaccgcgctcgctactacgcctaaaaataaacgcgtctattccgcgaaacgaacgatacgctcgctcacctaaaccccgctacgcgcgaacatccgacgactcgaaccgaaacttcgtaaaactcgaaccccgacgcgaaacccaacaaccgccgaccacgaaaacacccctaaaaccgaaacgaaacgacgcctacgcaaaaaaaaacgaaaaccgaaaaaaaaaaaacaataaacgccgaaaactaactacgcccccgaaacgaaacgaaccacgtaaaaataaatcctcttcccaacgcccaccgccaaatccgaaccgattcccgaacccgatacgatacctacgaaacgaaaacgaaaaaaaaacacctaaaaataaaacgaaccccgcactataccccgacgcccttcacaataaactatccgcccccgcatacgccttaatcgcctaacgaccccaaaacccactccaccaaccgataatcaaaccaccgaaaaaacgaacccgtcgtaaacttaaataaatcctcgaaaaacccgaacgaaataatcgtactttaaaaaaaaaaacgaaccgcaaacgtatttt

SEQ ID NO: 4643 - DNA, 699 bp, Artificial Sequence
  chemically treated genomic DNA (Homo sapiens) CpG-island No: 4643
ttgtatagtcgatattataggttttttaaaagtacggaatattggtgttaaattatatgtcggtgatttttcgtgcgcgggattatatttttcgttttcgttttcgcggtcgcgttcgttgttgcgtttgggggtgggcgcgtttgtttcgcggggcgggcgatgcgttcgtttatttgggtttcgttgcgcgcgggtattcggcggttcgggtcggggtttcgtgggattcggatttcggcgcggagtttagtagtcgtcgattacggaagtatttttaggatcggggcggagcggcgtttgcgtagaaggggacggaagtcgggagagggggggtagtgagcgtcgggaattggttgcgttttcggggcggggcgggttacgtggaggtggattttttttttagcgtttatcgttaggttcggatcgattttcgggttcgatgcggtgtttgcgaggcgagagcggggaaggggtatttgggggtggggcgagtttcgtattgtgtttcggcgttttttataatgagttgttcgttttcgtatgcgttttggtcgtttggcggttttagagtttattttattagtcggtggttagattatcgagaggacgggttcgtcgtgaatttgagtggattttcgaggggttcgggcggagtggtcgtgttttgggggagggggcgggtcgtagacgtgtttt

SEQ ID NO: 4644 - DNA, 699 bp, Artificial Sequence
  chemically treated genomic DNA (Homo sapiens) CpG-island No: 4644
aaaacacgtctacgacccgccccctcccccaaaacacgaccactccgcccgaacccctcgaaaatccactcaaattcacgacgaacccgtcctctcgataatctaaccaccgactaataaaataaactctaaaaccgccaaacgaccaaaacgcatacgaaaacgaacaactcattataaaaaacgccgaaacacaatacgaaactcgccccacccccaaataccccttccccgctctcgcctcgcaaacaccgcatcgaacccgaaaatcgatccgaacctaacgataaacgctaaaaaaaaaatccacctccacgtaacccgccccgccccgaaaacgcaaccaattcccgacgctcactaccccccctctcccgacttccgtccccttctacgcaaacgccgctccgccccgatcctaaaaatacttccgtaatcgacgactactaaactccgcgccgaaatccgaatcccacgaaaccccgacccgaaccgccgaatacccgcgcgcaacgaaacccaaataaacgaacgcatcgcccgccccgcgaaacaaacgcgcccacccccaaacgcaacaacgaacgcgaccgcgaaaacgaaaacgaaaaatataatcccgcgcacgaaaaatcaccgacatataatttaacaccaatattccgtacttttaaaaaacctataatatcgactatacaa

SEQ ID NO: 4645 - DNA, 549 bp, Artificial Sequence
  chemically treated genomic DNA (Homo sapiens) CpG-island No: 4645
tatgtgtcgaagggggcggttgggttcggagcggtaagacgtttgtttcgagatatcggggtttcgcgatttatttcgtgttttttgggttcgatttttttttttttttcgtttttttcggttttagttattcgtttttcggttcgggttttatcggttggagtgattttttcgtcgcggtttgggcgggataagttttaggagttcgggatttcgattttgcggtcgagtttattgtagaggcggggatggagttgcgcgttaggcgttaatttttttttcgtagtttcggttttatttggtagagcgtcgtttacggaagtttagcgtcggaggatttttggttgtagtcgttaatttcgacgtgtcggtcgaaatttttttttcggcgtagttggttttttttggatttcgcgggattcggcgtcgttttcgggtttgttcgttttaggtacgtgtatagtgagtttgtgtaaatttagttagattaaaatgagcgaggtggagagttttttaatcggatgttacgggtgatgattgggaggagga

SEQ ID NO: 4646 - DNA, 549 bp, Artificial Sequence
  chemically treated genomic DNA (Homo sapiens) CpG-island No: 4646
tcctcctcccaatcatcacccgtaacatccgattaaaaaactctccacctcgctcattttaatctaactaaatttacacaaactcactatacacgtacctaaaacgaacaaacccgaaaacgacgccgaatcccgcgaaatccaaaaaaaaccaactacgccgaaaaaaaaatttcgaccgacacgtcgaaattaacgactacaaccaaaaatcctccgacgctaaacttccgtaaacgacgctctaccaaataaaaccgaaactacgaaaaaaaaattaacgcctaacgcgcaactccatccccgcctctacaataaactcgaccgcaaaatcgaaatcccgaactcctaaaacttatcccgcccaaaccgcgacgaaaaaatcactccaaccgataaaacccgaaccgaaaaacgaataactaaaaccgaaaaaaacgaaaaaaaaaaaaaaatcgaacccaaaaaacacgaaataaatcgcgaaaccccgatatctcgaaacaaacgtcttaccgctccgaacccaaccgcccccttcgacacata

SEQ ID NO: 4647 - DNA, 549 bp, Artificial Sequence
  chemically treated genomic DNA (Homo sapiens) CpG-island No: 4647
ttttttttttagttattattcgtagtattcggttaagaggttttttatttcgtttattttggtttaattggatttatataaatttattgtgtacgtgtttggggcgggtaaattcggaaacgacgtcgagtttcgcgggatttaggaggagttaattgcgtcggaggaggggtttcggtcgatacgtcgggattggcggttgtagttaggggtttttcgacgttgggttttcgtgagcggcgttttgttaggtggggtcggagttgcggggagggagttggcgtttagcgcgtagttttattttcgtttttgtagtggattcggtcgtagaatcggggtttcgggtttttggaatttgtttcgtttaggtcgcggcgaggaggttattttagtcggtgggattcgggtcggggggcgggtgattggaatcgggggaggcgggaaggaggaggggatcgggtttaagggatacgaggtgggtcgcgggatttcgatatttcgggataggcgttttgtcgtttcgggtttagtcgtttttttcgatatata

SEQ ID NO: 4648 - DNA, 549 bp, Artificial Sequence
  chemically treated genomic DNA (Homo sapiens) CpG-island No: 4648
tatatatcgaaaaaaacgactaaacccgaaacgacaaaacgcctatcccgaaatatcgaaatcccgcgacccacctcgtatcccttaaacccgatcccctcctccttcccgcctcccccgattccaatcacccgccccccgacccgaatcccaccgactaaaataacctcctcgccgcgacctaaacgaaacaaattccaaaaacccgaaaccccgattctacgaccgaatccactacaaaaacgaaaataaaactacgcgctaaacgccaactccctccccgcaactccgaccccacctaacaaaacgccgctcacgaaaacccaacgtcgaaaaacccctaactacaaccgccaatcccgacgtatcgaccgaaacccctcctccgacgcaattaactcctcctaaatcccgcgaaactcgacgtcgtttccgaatttacccgccccaaacacgtacacaataaatttatataaatccaattaaaccaaaataaacgaaataaaaaacctcttaaccgaatactacgaataataactaaaaaaaaaa

SEQ ID NO: 4649 - DNA, 570 bp, Artificial Sequence
  chemically treated genomic DNA (Homo sapiens) CpG-island No: 4649
cggcgttatttcgatttcgcgaagttttagaaagcgttgttgaagacgtttagggaggagatcgaagacgtggagttttttaggaagtatttgattgggaatttcgttgaggagatgatttgtgagcgtcggcgcgttttgtaggagtatttgggtttgttttacgttattcgttgcgtgcgtcgttttcgggagtttttggatttttttacgcggtcggagttgcgcgaggttttcggttgtttgcgggtcggttagtattcgcgcgttttggagttgttgttgcgcgtgttgtcgttgtaggagaagtttatcgtttattgttttgcggtcgtcgtttcggttttgtgcgtcgtgttgttgtgttatcgcgatttcgatcgtttcgtcgaggttttcgcggtcggagagagggttttgtagcgtttgtaggttcgggagggttatcgttattatgcgtttttgttggacgttatggttcgtttggtttacgcgttgggtaaggatttcgtgattttgtaggagaggttggaggagagttagtttcggaggtttacgtttcgaggtatt

SEQ ID NO: 4650 - DNA, 570 bp, Artificial Sequence
  chemically treated genomic DNA (Homo sapiens) CpG-island No: 4650
aatacctcgaaacgtaaacctccgaaactaactctcctccaacctctcctacaaaatcacgaaatccttacccaacgcgtaaaccaaacgaaccataacgtccaacaaaaacgcataataacgataaccctcccgaacctacaaacgctacaaaaccctctctccgaccgcgaaaacctcgacgaaacgatcgaaatcgcgataacacaacaacacgacgcacaaaaccgaaacgacgaccgcaaaacaataaacgataaacttctcctacaacgacaacacgcgcaacaacaactccaaaacgcgcgaatactaaccgacccgcaaacaaccgaaaacctcgcgcaactccgaccgcgtaaaaaaatccaaaaactcccgaaaacgacgcacgcaacgaataacgtaaaacaaacccaaatactcctacaaaacgcgccgacgctcacaaatcatctcctcaacgaaattcccaatcaaatacttcctaaaaaactccacgtcttcgatctcctccctaaacgtcttcaacaacgctttctaaaacttcgcgaaatcgaaataacgccg

SEQ ID NO: 4651 - DNA, 570 bp, Artificial Sequence
  chemically treated genomic DNA (Homo sapiens) CpG-island No: 4651
gatgtttcggggcgtgggttttcggagttggtttttttttagttttttttgtagagttacgaagtttttgtttagcgcgtaggttaggcggattatggcgtttagtagaggcgtatagtagcgatggttttttcgggtttgtaggcgttgtagggtttttttttcggtcgcgaaggtttcggcggggcggtcgaggtcgcggtggtatagtagtacggcgtatagggtcgggacggcggtcgtagggtagtgggcggtgagttttttttgtagcggtagtacgcgtagtagtagttttagggcgcgcgggtattggtcggttcgtaggtagtcgaaagtttcgcgtagtttcggtcgcgtgaggaagtttaggaattttcgggagcggcgtacgtagcggatggcgtagagtaggtttaggtatttttgtagggcgcgtcgacgtttatagattatttttttagcgaagtttttagttaggtgttttttgggaaattttacgttttcgattttttttttgaacgtttttagtagcgttttttggagtttcgcgaagtcggaatagcgtcg

SEQ ID NO: 4652 - DNA, 570 bp, Artificial Sequence
  chemically treated genomic DNA (Homo sapiens) CpG-island No: 4652
cgacgctattccgacttcgcgaaactccaaaaaacgctactaaaaacgttcaaaaaaaaaatcgaaaacgtaaaatttcccaaaaaacacctaactaaaaacttcgctaaaaaaataatctataaacgtcgacgcgccctacaaaaatacctaaacctactctacgccatccgctacgtacgccgctcccgaaaattcctaaacttcctcacgcgaccgaaactacgcgaaactttcgactacctacgaaccgaccaatacccgcgcgccctaaaactactactacgcgtactaccgctacaaaaaaaactcaccgcccactaccctacgaccgccgtcccgaccctatacgccgtactactataccaccgcgacctcgaccgccccgccgaaaccttcgcgaccgaaaaaaaaaccctacaacgcctacaaacccgaaaaaaccatcgctactatacgcctctactaaacgccataatccgcctaacctacgcgctaaacaaaaacttcgtaactctacaaaaaaaactaaaaaaaaaccaactccgaaaacccacgccccgaaacatc

SEQ ID NO: 4653 - DNA, 736 bp, Artificial Sequence
  chemically treated genomic DNA (Homo sapiens) CpG-island No: 4653
tgtatgcgtggcgggttagagtgcgtgtgtagcgggtagttcgtaggagtaagatagtgtatgcgtggcgggttagagtgcgtgtgtagcgggtatttcgtaggagtaagatagtgtatgcgtggcgggttagagtgcgtgtgtagcgggtagttcgtaggattaagatagtgtatgcgtggcgggttagagtgcgtgtgtagtgggtatttcgtaggagtaagatagtgtatgcgtggcgggttagagtgcgtgtgtagcgggtagttcgtaggattaagatagtgtatgcgtggcgggttagagtgcgtgtgtagcgggtagttcgtaggattaagatagtgtatgtgtggttggttagagtgcgtgtgtagcgggtagttcgtaggagtaagatagtgtatgcgtggtgggttagagtgcgtgtgtagcgggtagttcgtaggagtaagatagggtatgcgtggcgggttagagtgcgtgtgtagcgggtagttagtaggagtaagatagtgtatgcgtggcgggttagagtgcgtgtgtagcgggtagtttgtaggagtaagatagtgtatgtgtggttggttagagtgcgtgtgttgcgggtagttcgtaggagtaagatagtgtatgtgtggcgggttagagtggtagcgggtagttcgtgggattgagagaatgtatgtgtagtaggttagagtgcgtgtatagtgggtagtttgtgggattgagagag

SEQ ID NO: 4654 - DNA, 736 bp, Artificial Sequence
  chemically treated genomic DNA (Homo sapiens) CpG-island No: 4654
ctctctcaatcccacaaactacccactatacacgcactctaacctactacacatacattctctcaatcccacgaactacccgctaccactctaacccgccacacatacactatcttactcctacgaactacccgcaacacacgcactctaaccaaccacacatacactatcttactcctacaaactacccgctacacacgcactctaacccgccacgcatacactatcttactcctactaactacccgctacacacgcactctaacccgccacgcataccctatcttactcctacgaactacccgctacacacgcactctaacccaccacgcatacactatcttactcctacgaactacccgctacacacgcactctaaccaaccacacatacactatcttaatcctacgaactacccgctacacacgcactctaacccgccacgcatacactatcttaatcctacgaactacccgctacacacgcactctaacccgccacgcatacactatcttactcctacgaaatacccactacacacgcactctaacccgccacgcatacactatcttaatcctacgaactacccgctacacacgcactctaacccgccacgcatacactatcttactcctacgaaatacccgctacacacgcactctaacccgccacgcatacactatcttactcctacgaactacccgctacacacgcactctaacccgccacgcataca

SEQ ID NO: 4655 - DNA, 736 bp, Artificial Sequence
  chemically treated genomic DNA (Homo sapiens) CpG-island No: 4655
tttttttagttttataggttgtttattatatacgtattttaatttgttatatatgtatttttttagttttacgggttattcgttattattttaattcgttatatatgtattgttttatttttgcgggttattcgtaatatacgtattttaattagttatatatgtattgttttatttttgtaggttattcgttatatacgtattttaattcgttacgtatgtattgttttatttttgttggttattcgttatatacgtattttaattcgttacgtatgttttgttttatttttgcgggttattcgttatatacgtattttaatttattacgtatgtattgttttatttttgcgggttattcgttatatacgtattttaattagttatatatgtattgttttagttttgcgggttattcgttatatacgtattttaattcgttacgtatgtattgttttagttttgcgggttattcgttatatacgtattttaattcgttacgtatgtattgttttatttttgcggggtatttattatatacgtattttaattcgttacgtatgtattgttttagttttgcgggttattcgttatatacgtattttaattcgttacgtatgtattgttttatttttgcggggtattcgttatatacgtattttaattcgttacgtatgtattgttttatttttgcgggttattcgttatatacgtattttaattcgttacgtatgta

SEQ ID NO: 4656 - DNA, 736 bp, Artificial Sequence
  chemically treated genomic DNA (Homo sapiens) CpG-island No: 4656
tacatacgtaacgaattaaaatacgtatataacgaataacccgcaaaaataaaacaatacatacgtaacgaattaaaatacgtatataacgaataccccgcaaaaataaaacaatacatacgtaacgaattaaaatacgtatataacgaataacccgcaaaactaaaacaatacatacgtaacgaattaaaatacgtatataataaataccccgcaaaaataaaacaatacatacgtaacgaattaaaatacgtatataacgaataacccgcaaaactaaaacaatacatacgtaacgaattaaaatacgtatataacgaataacccgcaaaactaaaacaatacatatataactaattaaaatacgtatataacgaataacccgcaaaaataaaacaatacatacgtaataaattaaaatacgtatataacgaataacccgcaaaaataaaacaaaacatacgtaacgaattaaaatacgtatataacgaataaccaacaaaaataaaacaatacatacgtaacgaattaaaatacgtatataacgaataacctacaaaaataaaacaatacatatataactaattaaaatacgtatattacgaataacccgcaaaaataaaacaatacatatataacgaattaaaataataacgaataacccgtaaaactaaaaaaatacatatataacaaattaaaatacgtatataataaacaacctataaaactaaaaaaa

SEQ ID NO: 4657 - DNA, 637 bp, Artificial Sequence
  chemically treated genomic DNA (Homo sapiens) CpG-island No: 4657
gtgaaatacgtagcgtagttttcgtaattgttagtatcgtaatttagtaggttattgttaggtcgagtatcgttatcgttataattttgttttcgaatagttacggtaatagtagcgatagtattagcgtagagatgaaggcgataattaataaattgcggattttacgcgggcgatttcgtttttagcgtattagaggatcgatattaagtagtagcgtaaacggtattattagttaggtaaatatggtgttgaagaacggttcgttaatcgaaatattgtttagttttagttgtttatgtattaacggtagtagcgtttttagtaatattattagtatcgtagcgattagtaaaatattgttcgttaatagtaaagattttcgcgattatagcgtattgtttacgcgtgagcgaattttgtgtttacgcgcggtaaatagtagtagcgaattcgttaattattagtattataaaggcgaagattaatatatcgcgcgttcgattagacgtaaacgcgtgtatcgatattaatacgtcggaacgtacgaagaaaagttttaatagatataatcgagaaggtattgaatgttaatagttaatgtttacgttttgaagtttgtttcgttgtttaatga

SEQ ID NO: 4658 - DNA, 637 bp, Artificial Sequence
  chemically treated genomic DNA (Homo sapiens) CpG-island No: 4658
tcattaaacaacgaaacaaacttcaaaacgtaaacattaactattaacattcaataccttctcgattatatctattaaaacttttcttcgtacgttccgacgtattaatatcgatacacgcgtttacgtctaatcgaacgcgcgatatattaatcttcgcctttataatactaataattaacgaattcgctactactatttaccgcgcgtaaacacaaaattcgctcacgcgtaaacaatacgctataatcgcgaaaatctttactattaacgaacaatattttactaatcgctacgatactaataatattactaaaaacgctactaccgttaatacataaacaactaaaactaaacaatatttcgattaacgaaccgttcttcaacaccatatttacctaactaataataccgtttacgctactacttaatatcgatcctctaatacgctaaaaacgaaatcgcccgcgtaaaatccgcaatttattaattatcgccttcatctctacgctaatactatcgctactattaccgtaactattcgaaaacaaaattataacgataacgatactcgacctaacaataacctactaaattacgatactaacaattacgaaaactacgctacgtatttcac

SEQ ID NO: 4659 - DNA, 637 bp, Artificial Sequence
  chemically treated genomic DNA (Homo sapiens) CpG-island No: 4659
ttattgaataacggggtaagttttaaagcgtggatattaattgttggtatttagtgttttttcggttgtgtttgttgggattttttttcgtgcgtttcggcgtgttggtatcggtatacgcgtttgcgtttgatcgggcgcgcggtatgttaattttcgtttttatggtgttggtgattggcgggttcgttgttgttgtttgtcgcgcgtggatataaagttcgtttacgcgtaaataatgcgttgtggtcgcgggaatttttgttgttagcgaataatgttttgttggtcgttgcgatgttggtggtgttgttggggacgttgttgtcgttggtgtataagtaattgggattgggtagtatttcgattggcgaatcgttttttaatattatgtttatttggttgatggtgtcgtttgcgttattgtttggtgtcggttttttggtgcgttgggggcgggatcgttcgcgtaagattcgtaatttattgattatcgtttttatttttacgttggtgttgtcgttgttgttgtcgtggttgttcgaaagtaaagttgtggcgatgacggtgttcggtttggtaatggtttgttggattgcggtgttggtaattgcggaagttgcgttacgtattttat

SEQ ID NO: 4660 - DNA, 637 bp, Artificial Sequence
  chemically treated genomic DNA (Homo sapiens) CpG-island No: 4660
ataaaatacgtaacgcaacttccgcaattaccaacaccgcaatccaacaaaccattaccaaaccgaacaccgtcatcgccacaactttactttcgaacaaccacgacaacaacaacgacaacaccaacgtaaaaataaaaacgataatcaataaattacgaatcttacgcgaacgatcccgcccccaacgcaccaaaaaaccgacaccaaacaataacgcaaacgacaccatcaaccaaataaacataatattaaaaaacgattcgccaatcgaaatactacccaatcccaattacttatacaccaacgacaacaacgtccccaacaacaccaccaacatcgcaacgaccaacaaaacattattcgctaacaacaaaaattcccgcgaccacaacgcattatttacgcgtaaacgaactttatatccacgcgcgacaaacaacaacaacgaacccgccaatcaccaacaccataaaaacgaaaattaacataccgcgcgcccgatcaaacgcaaacgcgtataccgataccaacacgccgaaacgcacgaaaaaaaatcccaacaaacacaaccgaaaaaacactaaataccaacaattaatatccacgctttaaaacttaccccgttattcaataa

SEQ ID NO: 4661 - DNA, 571 bp, Artificial Sequence
  chemically treated genomic DNA (Homo sapiens) CpG-island No: 4661
gcgtttggttaggtacggtcgtttacgcgtttttaagtttcgggtttttagttttattttttgcggttttttttcggggcgggggtttttacgacgtcggttttttcggagtatcgttagttttcgaggggagacgggggacgggttcgggcggtttattttatttttcgtttgttttagcgagtttatgtcgggcggtagttcgggttatcgtcgttgttttgttcgtatcgtagttttcgcggttttcgttcggttcgtagcgttaatttttatttttaatcgtttttcgttgttttttttcgtcgtatcgttttttgtttagattcgttacgtttattggatttttttattagatttttaattaagatagttttttattggttgttttttgtatcggtttcggcgtttagcgttggacggttagtcggagggattaagaattgtcggcggttaggcgggcgtaacgttggcgtcgtttgttgtttcggggaggaattgtagtttttcggagttagttcgtttatttatttatttttcgtttttcgtttggtttttttattcgttaaat

SEQ ID NO: 4662 - DNA, 571 bp, Artificial Sequence
  chemically treated genomic DNA (Homo sapiens) CpG-island No: 4662
atttaacgaataaaaaaaccaaacgaaaaacgaaaaataaataaataaacgaactaactccgaaaaactacaattcctccccgaaacaacaaacgacgccaacgttacgcccgcctaaccgccgacaattcttaatccctccgactaaccgtccaacgctaaacgccgaaaccgatacaaaaaacaaccaataaaaaactatcttaattaaaaatctaataaaaaaatccaataaacgtaacgaatctaaacaaaaaacgatacgacgaaaaaaaacaacgaaaaacgattaaaaataaaaattaacgctacgaaccgaacgaaaaccgcgaaaactacgatacgaacaaaacaacgacgataacccgaactaccgcccgacataaactcgctaaaacaaacgaaaaataaaataaaccgcccgaacccgtcccccgtctcccctcgaaaactaacgatactccgaaaaaaccgacgtcgtaaaaacccccgccccgaaaaaaaaccgcaaaaaataaaactaaaaacccgaaacttaaaaacgcgtaaacgaccgtacctaaccaaacgc

SEQ ID NO: 4663 - DNA, 571 bp, Artificial Sequence
  chemically treated genomic DNA (Homo sapiens) CpG-island No: 4663
atttgacgaatgaaagaattaagcggggaacgggggataaatgaatgaacgaattggtttcggagggttgtagttttttttcggggtagtaggcgacgttagcgttacgttcgtttggtcgtcggtagtttttggttttttcggttgatcgtttaacgttaggcgtcgaggtcggtgtaagagatagttaatagaaagttgttttagttggaggtttagtagaggaatttaatgagcgtagcgggtttaggtaaggggcggtgcgacggggaggggtagcggggagcggttagaggtgggagttggcgttgcgggtcgggcgggggtcgcggaagttgcgatgcggatagggtagcggcggtgattcgagttgtcgttcgatatgaattcgttggagtaggcggaaggtagggtgggtcgttcgggttcgtttttcgttttttttcggaagttggcggtgtttcggaggagtcggcgtcgtgaagattttcgtttcgggaggaggtcgtagaggatggagttaggggttcggagtttgggggcgcgtaggcggtcgtatttggttagacgt

SEQ ID NO: 4664 - DNA, 571 bp, Artificial Sequence
  chemically treated genomic DNA (Homo sapiens) CpG-island No: 4664
acgtctaaccaaatacgaccgcctacgcgcccccaaactccgaacccctaactccatcctctacgacctcctcccgaaacgaaaatcttcacgacgccgactcctccgaaacaccgccaacttccgaaaaaaaacgaaaaacgaacccgaacgacccaccctaccttccgcctactccaacgaattcatatcgaacgacaactcgaatcaccgccgctaccctatccgcatcgcaacttccgcgacccccgcccgacccgcaacgccaactcccacctctaaccgctccccgctacccctccccgtcgcaccgccccttacctaaacccgctacgctcattaaattcctctactaaacctccaactaaaacaactttctattaactatctcttacaccgacctcgacgcctaacgttaaacgatcaaccgaaaaaaccaaaaactaccgacgaccaaacgaacgtaacgctaacgtcgcctactaccccgaaaaaaaactacaaccctccgaaaccaattcgttcattcatttatcccccgttccccgcttaattctttcattcgtcaaat

SEQ ID NO: 4665 - DNA, 663 bp, Artificial Sequence
  chemically treated genomic DNA (Homo sapiens) CpG-island No: 4665
attcgtatcggttaggttatcgggtcgtagagttagtatttattttacgattttttggttgtagttttttcgtttttacggggtttcgttgtatacgatttcgtcgtcgtttgttcggtcgtttttcgcggttcgtttttcgttgggttgtagtaggttgtagttgagtttatacgtgttggttttgttgtcgcgtttttttttgttgttgttgttcgaggtcgaatcggttggatcggcggcggggacggcggtcgaagggtgcggggacgaggacgtcgagggaggcgaggacgtcgaggagttcgttcggcgggtttaggtttcgggttggtggtggttgttgttgttgttggtcgtttttaggggtaggaagtttcgttgtttcgcgggtagcgcgtggttgtttagtaggcgtttttcggagcgatatatgtcggtcggggtcggggtcggggtcgaggtcgcgtcgtcggggttgtcggtgttgttgtcgttttcgtcggtggtcgtgttgttgttgttgttgttgtcgtcgtcgtcgttcgcgtcgtcgttgttgtgatagtggtggttgaagtagaggttttttagtttttgggtcgttttttagatttagtttgaaggtgtttcgcgtttttttttttatcgggttcgtggttt

SEQ ID NO: 4666 - DNA, 663 bp, Artificial Sequence
  chemically treated genomic DNA (Homo sapiens) CpG-island No: 4666
aaaccacgaacccgataaaaaaaaaaacgcgaaacaccttcaaactaaatctaaaaaacgacccaaaaactaaaaaacctctacttcaaccaccactatcacaacaacgacgacgcgaacgacgacgacgacaacaacaacaacaacaacacgaccaccgacgaaaacgacaacaacaccgacaaccccgacgacgcgacctcgaccccgaccccgaccccgaccgacatatatcgctccgaaaaacgcctactaaacaaccacgcgctacccgcgaaacaacgaaacttcctacccctaaaaacgaccaacaacaacaacaaccaccaccaacccgaaacctaaacccgccgaacgaactcctcgacgtcctcgcctccctcgacgtcctcgtccccgcacccttcgaccgccgtccccgccgccgatccaaccgattcgacctcgaacaacaacaacaaaaaaaaacgcgacaacaaaaccaacacgtataaactcaactacaacctactacaacccaacgaaaaacgaaccgcgaaaaacgaccgaacaaacgacgacgaaatcgtatacaacgaaaccccgtaaaaacgaaaaaactacaaccaaaaaatcgtaaaataaatactaactctacgacccgataacctaaccgatacgaat

SEQ ID NO: 4667 - DNA, 663 bp, Artificial Sequence
  chemically treated genomic DNA (Homo sapiens) CpG-island No: 4667
aaattacgaattcggtaaaaaaaaaaacgcggagtatttttaaattagatttgggagacgatttaggggttgaggaatttttattttaattattattgttatagtagcggcggcgcgagcggcggcggcggtagtagtagtagtagtagtacggttatcggcgggagcggtagtagtatcggtagtttcggcggcgcggtttcggtttcggtttcggtttcggtcggtatgtatcgtttcggggagcgtttgttgggtagttacgcgttgttcgcggagtagcgggattttttgtttttagagacgattaataataataataattattattagttcggggtttgggttcgtcgggcgggtttttcggcgttttcgtttttttcggcgttttcgttttcgtatttttcggtcgtcgttttcgtcgtcgatttagtcgattcggtttcgggtagtagtaataagaggaagcgcgataataaggttagtacgtatggatttaattatagtttgttgtagtttagcggagggcgggtcgcggggggcggtcgagtagacggcggcggggtcgtgtatagcgggatttcgtggaaacggaggaattataattagggagtcgtggggtgagtgttggttttgcggttcgatggtttggtcggtgcgaat

SEQ ID NO: 4668 - DNA, 663 bp, Artificial Sequence
  chemically treated genomic DNA (Homo sapiens) CpG-island No: 4668
attcgcaccgaccaaaccatcgaaccgcaaaaccaacactcaccccacgactccctaattataattcctccgtttccacgaaatcccgctatacacgaccccgccgccgtctactcgaccgccccccgcgacccgccctccgctaaactacaacaaactataattaaatccatacgtactaaccttattatcgcgcttcctcttattactactacccgaaaccgaatcgactaaatcgacgacgaaaacgacgaccgaaaaatacgaaaacgaaaacgccgaaaaaaacgaaaacgccgaaaaacccgcccgacgaacccaaaccccgaactaataataattattattattattaatcgtctctaaaaacaaaaaatcccgctactccgcgaacaacgcgtaactacccaacaaacgctccccgaaacgatacataccgaccgaaaccgaaaccgaaaccgaaaccgcgccgccgaaactaccgatactactaccgctcccgccgataaccgtactactactactactactaccgccgccgccgctcgcgccgccgctactataacaataataattaaaataaaaattcctcaacccctaaatcgtctcccaaatctaatttaaaaatactccgcgtttttttttttaccgaattcgtaattt

SEQ ID NO: 4669 - DNA, 1270 bp, Artificial Sequence
  chemically treated genomic DNA (Homo sapiens) CpG-island No: 4669
tgttcgcgggtcgggttcgttagttacgtagtttttagtagtagtagttttaggacgtttagtatcgcgtcgtcggcgtttatttcgttttttatttttagggttgttcgcgttagtcgtttttttcgttttagtttcgtttcgaagttttttttttagtttcgtgcgtagtttcgtcgtcgtcgttttggatattatatttttttttcgtatttcggggattagcgtttttttcgcgattagcgtttttttcgcgttgtgttttcggagtttttttcgggttttaggggtgtcgcggttgtttagtcgtatttggatgtatagtcgttgttgttcggtttcgttgttgtcgtcgttttttgttcgtattcgtcgttgtcgtcgtcgtcgtcgttttgaattattgatgtagtcggcgttgtagtcggagcgggcggagagcgcgcgtcgggtataaaggcgcggatttcggtttggtttcgttttcgtcgtttttcggttcgttttttttcgaggttttgttttcgtttcggtcgagattacgttttttagttaattttgacgcgtcgcgttttttatcgagttaatggcggcgttgttcgcgttcggttatttgatttcgggcgtcgttgttattaggcgcggcgaggcgggtggcgcgcggtagtagggttgggttttcgtcgtgagtcgacgaagggagcgcgggcgcgcgttcgcgttcgcgtattgagagtcgttttagtcgttcgttttttcgattttcgtttcgcgtttcgattttgtttcgtttttttcggtttttttgttcgtttttattcgtcggtttttaggtaggaggcggcgcgtttcggggtcgggagtggaatcgttggaggttgcgagtcgtttgttcgtttgtgggcgcgttcgttgggaggggagcgttttttagcgggcgcgggcgcgagggtagtcggcgcgttgggcgagtttggtttagggtttcggcggtcggggtgtagggcgcgtgcgcgcgcggcggggcggggtttgcgcggttttggcgggcgtacgtggtgttcgggagttgttgggcgggtatttatcgcggggattcggtgcggagtcggggcgtcgagtgttttcgtgtttttttgttttagtcggcggtcgcgatggtggagtttggtttttcgttttttttcgtttttttagcgattgttttgtcggtcgcggaggtcggatcgagcggttatttatttatttgttaattcgtttatttatttag

SEQ ID NO: 4670 - DNA, 1270 bp, Artificial Sequence
  chemically treated genomic DNA (Homo sapiens) CpG-island No: 4670
ctaaataaataaacgaattaacaaataaataaataaccgctcgatccgacctccgcgaccgacaaaacaatcgctaaaaaaacgaaaaaaaacgaaaaaccaaactccaccatcgcgaccgccgactaaaacaaaaaaacacgaaaacactcgacgccccgactccgcaccgaatccccgcgataaatacccgcccaacaactcccgaacaccacgtacgcccgccaaaaccgcgcaaaccccgccccgccgcgcgcgcacgcgccctacaccccgaccgccgaaaccctaaaccaaactcgcccaacgcgccgactaccctcgcgcccgcgcccgctaaaaaacgctcccctcccaacgaacgcgcccacaaacgaacaaacgactcgcaacctccaacgattccactcccgaccccgaaacgcgccgcctcctacctaaaaaccgacgaataaaaacgaacaaaaaaaccgaaaaaaacgaaacaaaatcgaaacgcgaaacgaaaatcgaaaaaacgaacgactaaaacgactctcaatacgcgaacgcgaacgcgcgcccgcgctcccttcgtcgactcacgacgaaaacccaaccctactaccgcgcgccacccgcctcgccgcgcctaataacaacgacgcccgaaatcaaataaccgaacgcgaacaacgccgccattaactcgataaaaaacgcgacgcgtcaaaattaactaaaaaacgtaatctcgaccgaaacgaaaacaaaacctcgaaaaaaaacgaaccgaaaaacgacgaaaacgaaaccaaaccgaaatccgcgcctttatacccgacgcgcgctctccgcccgctccgactacaacgccgactacatcaataattcaaaacgacgacgacgacgacaacgacgaatacgaacaaaaaacgacgacaacaacgaaaccgaacaacaacgactatacatccaaatacgactaaacaaccgcgacacccctaaaacccgaaaaaaactccgaaaacacaacgcgaaaaaaacgctaatcgcgaaaaaaacgctaatccccgaaatacgaaaaaaaaatataatatccaaaacgacgacgacgaaactacgcacgaaactaaaaaaaaaacttcgaaacgaaactaaaacgaaaaaaacgactaacgcgaacaaccctaaaaataaaaaacgaaataaacgccgacgacgcgatactaaacgtcctaaaactactactactaaaaactacgtaactaacgaacccgacccgcgaaca

SEQ ID NO: 4671 - DNA, 1270 bp, Artificial Sequence
  chemically treated genomic DNA (Homo sapiens) CpG-island No: 4671
ttgaataagtgaacgaattaataaatgaatgaatgatcgttcgattcgattttcgcggtcggtagagtagtcgttggagaggcgggagagagcgagaggttaagttttattatcgcggtcgtcggttggggtagagggatacggagatattcggcgtttcggtttcgtatcgagttttcgcggtgagtgttcgtttagtagttttcgggtattacgtgcgttcgttagagtcgcgtaggtttcgtttcgtcgcgcgcgtacgcgttttgtatttcggtcgtcgggattttgagttaggttcgtttagcgcgtcggttgttttcgcgttcgcgttcgttggggggcgttttttttttaacgggcgcgtttataggcgggtaggcgattcgtagtttttagcgattttattttcgatttcggggcgcgtcgttttttatttgagggtcgacgagtgggggcgggtaggagggtcgagggaggcggaataggatcgaggcgcgaggcgggagtcgagaaagcgagcggttgaggcgatttttagtgcgcggacgcgggcgcgcgttcgcgtttttttcgtcgatttacggcgagagtttaattttgttgtcgcgcgttattcgtttcgtcgcgtttaataataacggcgttcggggttaggtggtcgagcgcggatagcgtcgttattggttcggtggggagcgcggcgcgttaggattggttggggggcgtggtttcggtcggggcgggggtagggtttcggagggaggcgggtcgggaggcggcgggggcggggttaggtcgaggttcgcgtttttgtgttcggcgcgcgtttttcgttcgtttcggttgtagcgtcggttgtattaataatttagagcggcggcggcggcggtagcggcgggtgcgggtaggaggcggcggtagtagcgggatcgagtagtagcggttatgtatttaagtgcggttgggtagtcgcggtatttttgaggttcgggaggggtttcgggaatatagcgcggaggggacgttagtcgcggaggggacgttagttttcggagtgcgaggaaaaggtgtagtgtttagagcggcggcggcggagttgcgtacggagttgaggagggggtttcggagcgggattgggacggggggggcggttggcgcgagtagttttgggggtggggggcggggtgggcgtcggcggcgcgatgttgggcgttttggagttgttgttgttgggggttgcgtggttggcgggttcggttcgcgggta

SEQ ID NO: 4672 - DNA, 1270 bp, Artificial Sequence
  chemically treated genomic DNA (Homo sapiens) CpG-island No: 4672
tacccgcgaaccgaacccgccaaccacgcaacccccaacaacaacaactccaaaacgcccaacatcgcgccgccgacgcccaccccgccccccacccccaaaactactcgcgccaaccgccccccccgtcccaatcccgctccgaaaccccctcctcaactccgtacgcaactccgccgccgccgctctaaacactacaccttttcctcgcactccgaaaactaacgtcccctccgcgactaacgtcccctccgcgctatattcccgaaacccctcccgaacctcaaaaataccgcgactacccaaccgcacttaaatacataaccgctactactcgatcccgctactaccgccgcctcctacccgcacccgccgctaccgccgccgccgccgctctaaattattaatacaaccgacgctacaaccgaaacgaacgaaaaacgcgcgccgaacacaaaaacgcgaacctcgacctaaccccgcccccgccgcctcccgacccgcctccctccgaaaccctacccccgccccgaccgaaaccacgccccccaaccaatcctaacgcgccgcgctccccaccgaaccaataacgacgctatccgcgctcgaccacctaaccccgaacgccgttattattaaacgcgacgaaacgaataacgcgcgacaacaaaattaaactctcgccgtaaatcgacgaaaaaaacgcgaacgcgcgcccgcgtccgcgcactaaaaatcgcctcaaccgctcgctttctcgactcccgcctcgcgcctcgatcctattccgcctccctcgaccctcctacccgcccccactcgtcgaccctcaaataaaaaacgacgcgccccgaaatcgaaaataaaatcgctaaaaactacgaatcgcctacccgcctataaacgcgcccgttaaaaaaaaaacgccccccaacgaacgcgaacgcgaaaacaaccgacgcgctaaacgaacctaactcaaaatcccgacgaccgaaatacaaaacgcgtacgcgcgcgacgaaacgaaacctacgcgactctaacgaacgcacgtaatacccgaaaactactaaacgaacactcaccgcgaaaactcgatacgaaaccgaaacgccgaatatctccgtatccctctaccccaaccgacgaccgcgataataaaacttaacctctcgctctctcccgcctctccaacgactactctaccgaccgcgaaaatcgaatcgaacgatcattcattcatttattaattcgttcacttattcaa

SEQ ID NO: 4673 - DNA, 604 bp, Artificial Sequence
  chemically treated genomic DNA (Homo sapiens) CpG-island No: 4673
  misc_feature (537)..(537): n is either a, c, g or t
  misc_feature (564)..(564): n is either a, c, g or t
  misc_feature (566)..(566): n is either a, c, g or t
acgatcggatgatcgaagattacgtcggtgttatggttgatattattcgttaatacggcgtatacggtttggtgttgttgttaaatattcgtcgcggtaaattattggcggtaaaaattgggttatcgttttaaagcggcggtgtttaacgatgttagtatcgttagcgtataggcgggtaaagcgatagtgaaatatatggtttacggtggtttggcgattggcgaagaacgtattgttacgcggtatgcggtattgattattagtagcggtacgttcgatgcggtttagttagacgcgttacgtattggcgaaacgtatatcgtggagtggtaggtttcggttgtggcgattattcgtacggtaatttaggcgcgttagagtaatagcgtcgatttcgataaagttcgtatggtggttagcgtcggtcgcggtattggtagtaaagagaatattgcgttggtagaatagttttgtaaggcgataggtgcgtagttggtttgttatcgttcggtggcggaaatcgatatattgttntgggagttttatatcgttatttagtgntnttttatgggtttataaaggtcgttgatattcgatagta

SEQ ID NO: 4674 - DNA, 604 bp, Artificial Sequence
  chemically treated genomic DNA (Homo sapiens) CpG-island No: 4674
  misc_feature (39)..(39): n is either a, c, g or t
  misc_feature (41)..(41): n is either a, c, g or t
  misc_feature (68)..(68): n is either a, c, g or t
tactatcgaatatcaacgacctttataaacccataaaanancactaaataacgatataaaactcccanaacaatatatcgatttccgccaccgaacgataacaaaccaactacgcacctatcgccttacaaaactattctaccaacgcaatattctctttactaccaataccgcgaccgacgctaaccaccatacgaactttatcgaaatcgacgctattactctaacgcgcctaaattaccgtacgaataatcgccacaaccgaaacctaccactccacgatatacgtttcgccaatacgtaacgcgtctaactaaaccgcatcgaacgtaccgctactaataatcaataccgcataccgcgtaacaatacgttcttcgccaatcgccaaaccaccgtaaaccatatatttcactatcgctttacccgcctatacgctaacgatactaacatcgttaaacaccgccgctttaaaacgataacccaatttttaccgccaataatttaccgcgacgaatatttaacaacaacaccaaaccgtatacgccgtattaacgaataatatcaaccataacaccgacgtaatcttcgatcatccgatcgt

SEQ ID NO: 4675 - DNA, 604 bp, Artificial Sequence
  chemically treated genomic DNA (Homo sapiens) CpG-island No: 4675
  misc_feature (39)..(39): n is either a, c, g or t
  misc_feature (41)..(41): n is either a, c, g or t
  misc_feature (68)..(68): n is either a, c, g or t
tattatcgaatattagcgatttttgtaggtttatagganantattgagtggcgatgtgaagtttttanggtaatatgtcggttttcgttatcggacgataataggttaattacgtatttatcgttttgtaaagttgttttgttagcgtaatgttttttttgttgttaatatcgcgatcgacgttgattattatacgggttttgtcgagatcgacgttgttgttttggcgcgtttgggttgtcgtgcgggtaatcgttatagtcggagtttgttattttacggtgtgcgtttcgttagtgcgtgacgcgtttggttgagtcgtatcgaacgtgtcgttgttgatggttagtatcgtatatcgcgtggtaatgcgtttttcgttaatcgttagattatcgtaaattatgtgttttattgtcgttttattcgtttgtacgttgacggtgttggtatcgttagatatcgtcgttttaaggcgataatttagtttttgtcgttagtaatttgtcgcgacgggtgtttggtagtagtattaagtcgtatgcgtcgtgttggcgaatagtgttagttatgatatcggcgtaattttcgattattcgatcgt

SEQ ID NO: 4676 - DNA, 604 bp, Artificial Sequence
  chemically treated genomic DNA (Homo sapiens) CpG-island No: 4676
  misc_feature (537)..(537): n is either a, c, g or t
  misc_feature (564)..(564): n is either a, c, g or t
  misc_feature (566)..(566): n is either a, c, g or t
acgatcgaataatcgaaaattacgccgatatcataactaacactattcgccaacacgacgcatacgacttaatactactaccaaacacccgtcgcgacaaattactaacgacaaaaactaaattatcgccttaaaacgacgatatctaacgataccaacaccgtcaacgtacaaacgaataaaacgacaataaaacacataatttacgataatctaacgattaacgaaaaacgcattaccacgcgatatacgatactaaccatcaacaacgacacgttcgatacgactcaaccaaacgcgtcacgcactaacgaaacgcacaccgtaaaataacaaactccgactataacgattacccgcacgacaacccaaacgcgccaaaacaacaacgtcgatctcgacaaaacccgtataataatcaacgtcgatcgcgatattaacaacaaaaaaaacattacgctaacaaaacaactttacaaaacgataaatacgtaattaacctattatcgtccgataacgaaaaccgacatattaccntaaaaacttcacatcgccactcaatantntcctataaacctacaaaaatcgctaatattcgataata

SEQ ID NO: 4677 - DNA, 535 bp, Artificial Sequence
  chemically treated genomic DNA (Homo sapiens) CpG-island No: 4677
acgggttagtagggtgttaatttcgtcgtagcgatgttggttttgtattagttacgtttgtaataatattaattgcggattttttagtaagttgttttacggtagggttttaagcgatttttttagtagcgatagttcgttatggttgaatagattttaggcgtgattaagtagaatatcgcgtagtattagcgtatcgtttgtcgttagcgtatgatgaattgtttcgttgggaaatttttgggttatttagttttttgcggcggtacggtggattttcggtagtttcgtcgttagtttttattggtagcgttggcgtaggaagttattaaatagcgggtgatagtagaattattcgtcggtattatttattcgttgtaaaaatagtttttgacgtttaattttttcgaggcgtatttgttcgtttttttcgtcggttatacgggtgatgagggtatcgtttattgagcgtaaaatggcgttttttaatagaaaatggcgcgttgcgagatcgacgttatttaaaattttatcg

SEQ ID NO: 4678 - DNA, 535 bp, Artificial Sequence
  chemically treated genomic DNA (Homo sapiens) CpG-island No: 4678
cgataaaattttaaataacgtcgatctcgcaacgcgccattttctattaaaaaacgccattttacgctcaataaacgataccctcatcacccgtataaccgacgaaaaaaacgaacaaatacgcctcgaaaaaattaaacgtcaaaaactatttttacaacgaataaataataccgacgaataattctactatcacccgctatttaataacttcctacgccaacgctaccaataaaaactaacgacgaaactaccgaaaatccaccgtaccgccgcaaaaaactaaataacccaaaaatttcccaacgaaacaattcatcatacgctaacgacaaacgatacgctaatactacgcgatattctacttaatcacgcctaaaatctattcaaccataacgaactatcgctactaaaaaaatcgcttaaaaccctaccgtaaaacaacttactaaaaaatccgcaattaatattattacaaacgtaactaatacaaaaccaacatcgctacgacgaaattaacaccctactaacccgt

SEQ ID NO: 4679 - DNA, 535 bp, Artificial Sequence
  chemically treated genomic DNA (Homo sapiens) CpG-island No: 4679
cgatgaggttttggataacgtcgatttcgtaacgcgttattttttgttgaaaagcgttattttgcgtttaatgaacgatgtttttattattcgtgtgatcggcgaagaaaacgggtaaatgcgtttcgaagagattgagcgttaggggttgtttttatagcggatggatgatatcggcgagtggttttgttattattcgttgtttggtaattttttgcgttagcgttgttagtgggaattggcggcggagttgtcggaaatttatcgtgtcgtcgtagaaagttggatggtttagggattttttagcgaagtaatttattatgcgttggcggtaggcgatgcgttgatgttgcgcgatattttgtttaattacgtttggagtttgtttaattatagcgaattgtcgttgttggaagagtcgtttaaggttttgtcgtgggatagtttgttggaaaattcgtagttggtgttattgtaggcgtggttgatgtaaagttaatatcgttacggcgaagttaatattttgttagttcgt

SEQ ID NO: 4680 - DNA, 535 bp, Artificial Sequence
  chemically treated genomic DNA (Homo sapiens) CpG-island No: 4680
acgaactaacaaaatattaacttcgccgtaacgatattaactttacatcaaccacgcctacaataacaccaactacgaattttccaacaaactatcccacgacaaaaccttaaacgactcttccaacaacgacaattcgctataattaaacaaactccaaacgtaattaaacaaaatatcgcgcaacatcaacgcatcgcctaccgccaacgcataataaattacttcgctaaaaaatccctaaaccatccaactttctacgacgacacgataaatttccgacaactccgccgccaattcccactaacaacgctaacgcaaaaaattaccaaacaacgaataataacaaaaccactcgccgatatcatccatccgctataaaaacaacccctaacgctcaatctcttcgaaacgcatttacccgttttcttcgccgatcacacgaataataaaaacatcgttcattaaacgcaaaataacgcttttcaacaaaaaataacgcgttacgaaatcgacgttatccaaaacctcatcg

SEQ ID NO: 4681 - DNA, 582 bp, Artificial Sequence
  chemically treated genomic DNA (Homo sapiens) CpG-island No: 4681
  misc_feature (514)..(514): n is either a, c, g or t
ttgttgtcgtcgtagaagacgtgtttttggcgtagggcgacgatgcgttcgtagtagcgtagggcgtaatttatttgatgtagcgtgacgattacggtgatgtcgtcgttttggttgatgtcgcgtagggtgtttattacgatgcgcgttgattttgggtttagcgaggcgatgggtttatcggttagaattattttcgtttgttgtattagcgtacgggtaatcgttatacgttgttgttggtcgtcggaaagggtggaaacgcgttgatgggtaaaatgtattatgttaacgcgggttagcgtttgtaacgcgcgttggttttgttcgtcggtgaattaattaaaataggtgcgttagaacggcgtgttgtcgagcgcgttaattagtacgttttttagtacgtttaagcggtttattaggttgaattgttggaatatgtattcggtatgggcgcggtttttgcggatatcgcgggtttaggcggttttttttttggattgtgcgggtttantagtttgatatggttatcggtaaaattttttgtcgggaaattaaatcgtttaaatgattttaaagggg

SEQ ID NO: 4682 - DNA, 582 bp, Artificial Sequence
  chemically treated genomic DNA (Homo sapiens) CpG-island No: 4682
  misc_feature (69)..(69): n is either a, c, g or t
cccctttaaaatcatttaaacgatttaatttcccgacaaaaaattttaccgataaccatatcaaactantaaacccgcacaatccaaaaaaaaaaccgcctaaacccgcgatatccgcaaaaaccgcgcccataccgaatacatattccaacaattcaacctaataaaccgcttaaacgtactaaaaaacgtactaattaacgcgctcgacaacacgccgttctaacgcacctattttaattaattcaccgacgaacaaaaccaacgcgcgttacaaacgctaacccgcgttaacataatacattttacccatcaacgcgtttccaccctttccgacgaccaacaacaacgtataacgattacccgtacgctaatacaacaaacgaaaataattctaaccgataaacccatcgcctcgctaaacccaaaatcaacgcgcatcgtaataaacaccctacgcgacatcaaccaaaacgacgacatcaccgtaatcgtcacgctacatcaaataaattacgccctacgctactacgaacgcatcgtcgccctacgccaaaaacacgtcttctacgacgacaacaa

SEQ ID NO: 4683 - DNA, 582 bp, Artificial Sequence
  chemically treated genomic DNA (Homo sapiens) CpG-island No: 4683
  misc_feature (69)..(69): n is either a, c, g or t
tttttttaaggttatttaagcggtttgatttttcggtaaaaaattttgtcggtagttatattaagttgntgggttcgtatagtttagggggaaagtcgtttgggttcgcgatattcgtaaaagtcgcgtttatatcgggtatatattttaataatttaatttggtgaatcgtttgagcgtattggagaacgtgttgattggcgcgttcggtagtacgtcgttttggcgtatttgttttagttggtttatcggcgagtagaattagcgcgcgttataggcgttgattcgcgttggtatggtgtattttgtttattagcgcgtttttatttttttcggcggttagtagtaacgtgtggcgattgttcgtgcgttgatgtagtaggcgaaagtgattttggtcgatgaatttatcgtttcgttggatttagaattagcgcgtatcgtgatggatattttgcgcgatattaattagaacgacggtattatcgtggtcgttacgttgtattaggtggattacgttttgcgttattgcgaacgtatcgtcgttttgcgttaggggtacgttttttacgacggtagtag

SEQ ID NO: 4684 - DNA, 582 bp, Artificial Sequence
  chemically treated genomic DNA (Homo sapiens) CpG-island No: 4684
  misc_feature (514)..(514): n is either a, c, g or t
ctactaccgtcgtaaaaaacgtacccctaacgcaaaacgacgatacgttcgcaataacgcaaaacgtaatccacctaatacaacgtaacgaccacgataataccgtcgttctaattaatatcgcgcaaaatatccatcacgatacgcgctaattctaaatccaacgaaacgataaattcatcgaccaaaatcactttcgcctactacatcaacgcacgaacaatcgccacacgttactactaaccgccgaaaaaaataaaaacgcgctaataaacaaaatacaccataccaacgcgaatcaacgcctataacgcgcgctaattctactcgccgataaaccaactaaaacaaatacgccaaaacgacgtactaccgaacgcgccaatcaacacgttctccaatacgctcaaacgattcaccaaattaaattattaaaatatatacccgatataaacgcgacttttacgaatatcgcgaacccaaacgactttccccctaaactatacgaacccancaacttaatataactaccgacaaaattttttaccgaaaaatcaaaccgcttaaataaccttaaaaaaa

SEQ ID NO: 4685 - DNA, 647 bp, Artificial Sequence
  chemically treated genomic DNA (Homo sapiens) CpG-island No: 4685
tttaattttcgtcgtatatttttttttttagggtattagcgggaagcgatttttcgttttttacgttattcgttgttcgtgggcggttgatgagatttttttaagtagagttgacgtttatttaacgtattatttacgttattttatacgtcgtttattttgggacggttatagtatataggtcgtgtcgtgacggtatgatcggcggcgttttatagttttattcggatacgtttacgtcggcgattttttttgttataacgattttttttttttatttgcgttcgttttttcgtattttgtttcgatgtttttttcgttaatttcgttgtagcgtatagttacggcgtttttatattaattattgttcgtcgcgatttttttttcgatagttatatttttgtatacgtcgtcgtgcgtgcgttattcgcgttatttattagatagcgtttaagtgtttgtatttaacgattacgttttgagtgtcgtagttttcggtttatattttattttcgttttttcgttcgatgtagtgacggtattatattgttgtttagattacgtgttcgtttgcgtaacggattcgatgttttttttacgacgtgagttacgcgttattttcgttcgtatttcgtattttatatata

SEQ ID NO: 4686 - DNA, 647 bp, Artificial Sequence
  chemically treated genomic DNA (Homo sapiens) CpG-island No: 4686
tatatataaaatacgaaatacgaacgaaaataacgcgtaactcacgtcgtaaaaaaaacatcgaatccgttacgcaaacgaacacgtaatctaaacaacaatataataccgtcactacatcgaacgaaaaaacgaaaataaaatataaaccgaaaactacgacactcaaaacgtaatcgttaaatacaaacacttaaacgctatctaataaataacgcgaataacgcacgcacgacgacgtatacaaaaatataactatcgaaaaaaaaatcgcgacgaacaataattaatataaaaacgccgtaactatacgctacaacgaaattaacgaaaaaaacatcgaaacaaaatacgaaaaaacgaacgcaaataaaaaaaaaaaatcgttataacaaaaaaaatcgccgacgtaaacgtatccgaataaaactataaaacgccgccgatcataccgtcacgacacgacctatatactataaccgtcccaaaataaacgacgtataaaataacgtaaataatacgttaaataaacgtcaactctacttaaaaaaatctcatcaaccgcccacgaacaacgaataacgtaaaaaacgaaaaatcgcttcccgctaataccctaaaaaaaaaaatatacgacgaaaattaaa

SEQ ID NO: 4687 - DNA, 647 bp, Artificial Sequence
  chemically treated genomic DNA (Homo sapiens) CpG-island No: 4687
tatatgtggggtgcggagtgcggacgaaagtggcgcgtaatttacgtcgtgagggagatatcgagttcgttgcgtaggcgagtacgtgatttgggtaatagtgtggtgtcgttattatatcgggcgagaggacgggagtggagtatagatcgggagttgcggtatttagagcgtagtcgttggatgtaagtatttgagcgttgtttagtgaatggcgcgagtgacgtacgtacggcggcgtgtatagagatgtggttgtcggggagagagtcgcggcgagtaatgattggtgtagggacgtcgtagttgtgcgttataacgagattagcggaggggatatcgggatagggtacgggagagcgagcgtagataggagaagaggatcgttgtgataggagaagtcgtcgacgtagacgtgttcgagtgaagttgtggagcgtcgtcgattatgtcgttacggtacggtttgtgtgttatagtcgttttaggataagcggcgtgtagggtggcgtaagtggtacgttaagtgagcgttagttttatttggagagattttattagtcgtttacgagtagcgggtgacgtagaagacgggaggtcgtttttcgttagtgttttaggaggaggggtgtacggcgaaggttggg

SEQ ID NO: 4688 - DNA, 647 bp, Artificial Sequence
  chemically treated genomic DNA (Homo sapiens) CpG-island No: 4688
cccaaccttcgccgtacacccctcctcctaaaacactaacgaaaaacgacctcccgtcttctacgtcacccgctactcgtaaacgactaataaaatctctccaaataaaactaacgctcacttaacgtaccacttacgccaccctacacgccgcttatcctaaaacgactataacacacaaaccgtaccgtaacgacataatcgacgacgctccacaacttcactcgaacacgtctacgtcgacgacttctcctatcacaacgatcctcttctcctatctacgctcgctctcccgtaccctatcccgatatcccctccgctaatctcgttataacgcacaactacgacgtccctacaccaatcattactcgccgcgactctctccccgacaaccacatctctatacacgccgccgtacgtacgtcactcgcgccattcactaaacaacgctcaaatacttacatccaacgactacgctctaaataccgcaactcccgatctatactccactcccgtcctctcgcccgatataataacgacaccacactattacccaaatcacgtactcgcctacgcaacgaactcgatatctccctcacgacgtaaattacgcgccactttcgtccgcactccgcaccccacatata

SEQ ID NO: 4689 - DNA, 558 bp, Artificial Sequence
  chemically treated genomic DNA (Homo sapiens) CpG-island No: 4689
  misc_feature (5)..(5): n is either a, c, g or t
  misc_feature (128)..(129): n is either a, c, g or t
  misc_feature (132)..(132): n is either a, c, g or t
  misc_feature (154)..(154): n is either a, c, g or t
  misc_feature (186)..(186): n is either a, c, g or t
  misc_feature (438)..(438): n is either a, c, g or t
  misc_feature (490)..(490): n is either a, c, g or t
taatnatttcgtttttaattattttttttaattttcgtttttttttttattttttatttaattttattttatttttttttttatttacgttttattttttaggcgttattttcgttaattttatcgtnngantataatttatttatattttttnttaacgcgtttttcgttttattttattttttntgtttttatttttcgttttatttttattttttgttttttatttttttttttttacgatatgattttttatttattcgtatcggttgtatattattttatttttttattatttatattttttttttatttatgttttatttatatcgattttatttttttttgtttatttacgcgtatttttcgtttttatttttatcgtatttttatattattatttttttacgttatattatatacgtagtttaatttatngttatttttattttatttatatttttatcgtagttttttttatttttatttntagtttatttcgtatttgtatattttttttattttttttattataatatttttattaattgtagttta

SEQ ID NO: 4690 - DNA, 558 bp, Artificial Sequence
  chemically treated genomic DNA (Homo sapiens) CpG-island No: 4690
  misc_feature (69)..(69): n is either a, c, g or t
  misc_feature (121)..(121): n is either a, c, g or t
  misc_feature (373)..(373): n is either a, c, g or t
  misc_feature (405)..(405): n is either a, c, g or t
  misc_feature (427)..(427): n is either a, c, g or t
  misc_feature (430)..(431): n is either a, c, g or t
  misc_feature (554)..(554): n is either a, c, g or t
taaactacaattaataaaaatattataataaaaaaaataaaaaaaatatacaaatacgaaataaactanaaataaaaataaaaaaaactacgataaaaatataaataaaataaaaataacnataaattaaactacgtatataatataacgtaaaaaaataataatataaaaatacgataaaaataaaaacgaaaaatacgcgtaaataaacaaaaaaaaataaaatcgatataaataaaacataaataaaaaaaaaatataaataataaaaaaataaaataatatacaaccgatacgaataaataaaaaatcatatcgtaaaaaaaaaaaaataaaaaacaaaaaataaaaataaaacgaaaaataaaaacanaaaaaataaaataaaacgaaaaacgcgttaanaaaaaatataaataaattatantcnnacgataaaattaacgaaaataacgcctaaaaaataaaacgtaaataaaaaaaaaaataaaataaaattaaataaaaaataaaaaaaaaaacgaaaattaaaaaaaataattaaaaacgaaatnatta

SEQ ID NO: 4691 - DNA, 558 bp, Artificial Sequence
  chemically treated genomic DNA (Homo sapiens) CpG-island No: 4691
  misc_feature (69)..(69): n is either a, c, g or t
  misc_feature (121)..(121): n is either a, c, g or t
  misc_feature (373)..(373): n is either a, c, g or t
  misc_feature (405)..(405): n is either a, c, g or t
  misc_feature (427)..(427): n is either a, c, g or t
  misc_feature (430)..(431): n is either a, c, g or t
  misc_feature (554)..(554): n is either a, c, g or t
tggattatagttggtagggatgttgtggtagaagaagtagaggaagtgtataggtacggggtgagttgngaatgggggtgggaaggattacggtgggagtataggtggagtgagggtgatngtgggttggattgcgtgtgtaatgtgacgtgagggagtagtagtgtggaggtgcggtagagatagggacggggagtacgcgtgaatgagtaaggagaagtagagtcggtgtgaatggagtatggatgagagagggatgtgagtgatgggaaggtgaggtgatgtatagtcgatgcgggtgggtgaagaattatgtcgtggggggaagggagtgaggagtagagggtaagggtgaggcgaggagtggggatanagggagtagggtgagacgagaggcgcgttggngggggatataggtagattatgnttnnacgatggagttggcgggagtggcgtttggaggatagagcgtgggtgaggggagaagtggaataggattggatggggggtgaaagagaaagcgagagttgaggggggtaattaggggcgaaatnatta

SEQ ID NO: 4692 - DNA, 558 bp, Artificial Sequence
  chemically treated genomic DNA (Homo sapiens) CpG-island No: 4692
  misc_feature (5)..(5): n is either a, c, g or t
  misc_feature (128)..(129): n is either a, c, g or t
  misc_feature (132)..(132): n is either a, c, g or t
  misc_feature (154)..(154): n is either a, c, g or t
  misc_feature (186)..(186): n is either a, c, g or t
  misc_feature (438)..(438): n is either a, c, g or t
  misc_feature (490)..(490): n is either a, c, g or t
taatnatttcgcccctaattacccccctcaactctcgctttctctttcaccccccatccaatcctattccacttctcccctcacccacgctctatcctccaaacgccactcccgccaactccatcgtnnaancataatctacctatatcccccnccaacgcgcctctcgtctcaccctactccctntatccccactcctcgcctcacccttaccctctactcctcactcccttccccccacgacataattcttcacccacccgcatcgactatacatcacctcaccttcccatcactcacatccctctctcatccatactccattcacaccgactctacttctccttactcattcacgcgtactccccgtccctatctctaccgcacctccacactactactccctcacgtcacattacacacgcaatccaacccacnatcaccctcactccacctatactcccaccgtaatccttcccacccccattcncaactcaccccgtacctatacacttcctctacttcttctaccacaacatccctaccaactataatcca

SEQ ID NO: 4693 - DNA, 773 bp, Artificial Sequence
  chemically treated genomic DNA (Homo sapiens) CpG-island No: 4693
gtagtgcgttttgattacgagtgataatggtatagcgtagggttcgtgttttgtagttgtaggttatagagtaattcggcgaggtcgtcgtttataatgatagtattaaagcgtatttttttgttttttttttagattatataatttttgataaatttacggggtaaatttcgttttcgcgtagtgtatttttttagtcgaaggggttgtacgtttttttaacggtcgttaaaggaaggggggaaagttgttcgatagattgcgcggacgtcgtgacgtttaaacgttgtagtagttcggtagcgcggtaggcgtagagttcgttttggtaggtgtttatttttatacgggtacgacggcgtaaatttagtaggttattaacgtttaaattttttatcgcgtattgtattttattcgtagttatcgtttcgtatttatatattaggttacggtgtagacggttttcgtttagttaggtaggcgtgcgatcgttatgacgataaatcgtagaatcgcgtagcggggtaggtagggagatgattttacgtaaggtaattttagcgggtttttgtgaattagaaagaagttagatcggtagtcgtataggggcgcgtgttgtttagtttgcggtatatcgcgtcggtagtttatttagttattagtcgataggttattagtttgttatcggtgatggtgataaattcgtttagattatcgcgtttagtatggtcgagtagtacgatgttacggttgacgttacgttcgttcgggtt

SEQ ID NO: 4694 - DNA, 773 bp, Artificial Sequence
  chemically treated genomic DNA (Homo sapiens) CpG-island No: 4694
aacccgaacgaacgtaacgtcaaccgtaacatcgtactactcgaccatactaaacgcgataatctaaacgaatttatcaccatcaccgataacaaactaataacctatcgactaataactaaataaactaccgacgcgatataccgcaaactaaacaacacgcgcccctatacgactaccgatctaacttctttctaattcacaaaaacccgctaaaattaccttacgtaaaatcatctccctacctaccccgctacgcgattctacgatttatcgtcataacgatcgcacgcctacctaactaaacgaaaaccgtctacaccgtaacctaatatataaatacgaaacgataactacgaataaaatacaatacgcgataaaaaatttaaacgttaataacctactaaatttacgccgtcgtacccgtataaaaataaacacctaccaaaacgaactctacgcctaccgcgctaccgaactactacaacgtttaaacgtcacgacgtccgcgcaatctatcgaacaactttccccccttcctttaacgaccgttaaaaaaacgtacaaccccttcgactaaaaaaatacactacgcgaaaacgaaatttaccccgtaaatttatcaaaaattatataatctaaaaaaaaaacaaaaaaatacgctttaatactatcattataaacgacgacctcgccgaattactctataacctacaactacaaaacacgaaccctacgctataccattatcactcgtaatcaaaacgcactac

SEQ ID NO: 4695 - DNA, 773 bp, Artificial Sequence
  chemically treated genomic DNA (Homo sapiens) CpG-island No: 4695
gattcgagcggacgtaacgttagtcgtggtatcgtgttgttcgattatgttgaacgcgatggtttggacggatttattattattatcggtggtaaattgatgatttatcggttgatggttgaatgggttatcgacgcggtatgtcgtaaattgggtaatacgcgtttttgtacgattgtcgatttggtttttttttggtttataagaattcgttgaagttattttgcgtaaagttatttttttgtttgtttcgttgcgcggttttgcggtttatcgttatggcgatcgtacgtttgtttggttgagcgaaggtcgtttgtatcgtagtttggtatgtgagtgcgaagcggtaattgcgggtgaagtgtagtacgcggtagaaaatttaaacgttaatagtttgttggatttacgtcgtcgtattcgtgtggggatgggtatttgttagggcgaattttgcgtttgtcgcgttgtcggattgttgtaacgtttaaacgttacgacgttcgcgtaatttatcgagtaatttttttttttttttttaacgatcgttggaaaggcgtgtaattttttcggttggggagatgtattgcgcgaaagcggaatttatttcgtgggtttattagggattgtgtggtttggagaaggagtagaaagatgcgttttgatattgttattatgggcggcggtttcgtcggattattttgtggtttgtaattgtaaaatacgggttttgcgttgtgttattgttattcgtggttaaagcgtattgt

SEQ ID NO: 4696 - DNA, 773 bp, Artificial Sequence
  chemically treated genomic DNA (Homo sapiens) CpG-island No: 4696
acaatacgctttaaccacgaataacaataacacaacgcaaaacccgtattttacaattacaaaccacaaaataatccgacgaaaccgccgcccataataacaatatcaaaacgcatctttctactccttctccaaaccacacaatccctaataaacccacgaaataaattccgctttcgcgcaatacatctccccaaccgaaaaaattacacgcctttccaacgatcgttaaaaaaaaaaaaaaaaattactcgataaattacgcgaacgtcgtaacgtttaaacgttacaacaatccgacaacgcgacaaacgcaaaattcgccctaacaaatacccatccccacacgaatacgacgacgtaaatccaacaaactattaacgtttaaattttctaccgcgtactacacttcacccgcaattaccgcttcgcactcacataccaaactacgatacaaacgaccttcgctcaaccaaacaaacgtacgatcgccataacgataaaccgcaaaaccgcgcaacgaaacaaacaaaaaaataactttacgcaaaataacttcaacgaattcttataaaccaaaaaaaaaccaaatcgacaatcgtacaaaaacgcgtattacccaatttacgacataccgcgtcgataacccattcaaccatcaaccgataaatcatcaatttaccaccgataataataataaatccgtccaaaccatcgcgttcaacataatcgaacaacacgataccacgactaacgttacgtccgctcgaatc

SEQ ID NO: 4697 - DNA, 695 bp, Artificial Sequence
  chemically treated genomic DNA (Homo sapiens) CpG-island No: 4697
gatagtgtgtttgtattagcgaggtcgtcgttcgcgtttgttcgaaggtttcggttattattagcgtaatggtttgatgatagtgtttaatagtggggtcgtttaatagtttggcggtgtttttgtcgtttttgtttagtgtttcggcgttattggcggtaatgatagttagtacgttcggcgttttttgcgcggcgttcgtattaagggcggtgaggcgttttttggtaatggcggaatcgacgatatagttataggcggcgttgggggtttttttatgttattcgtaggcgtagcgtgtcgtgtcggtagtttttagcggttcgtcgatgcggttatggggacgatcgataatttttagttgatcgatcgggtttttttttgcgggtttattaaattttatgtttgtgttttcgttttagttagtacggaggtaagcgttcgtttcgttaataggagtttaaaggtgtttttagcggtgggatgggcgttggcgaatagcgtgttatatacggtttgcgttttttgggatagttgagtattcgtagtttttatgcgttagggtttatgtgttatttcgtttagcgcgacgcgttcgttgtcgttaggttgaataaatcgcgcgatcgatattagggtaaaggcgtaggaggcgcgatcgcgtattttacggtagatatgtttttcgtcgagcg

SEQ ID NO: 4698 - DNA, 695 bp, Artificial Sequence
  chemically treated genomic DNA (Homo sapiens) CpG-island No: 4698
cgctcgacgaaaaacatatctaccgtaaaatacgcgatcgcgcctcctacgcctttaccctaatatcgatcgcgcgatttattcaacctaacgacaacgaacgcgtcgcgctaaacgaaataacacataaaccctaacgcataaaaactacgaatactcaactatcccaaaaaacgcaaaccgtatataacacgctattcgccaacgcccatcccaccgctaaaaacacctttaaactcctattaacgaaacgaacgcttacctccgtactaactaaaacgaaaacacaaacataaaatttaataaacccgcaaaaaaaaacccgatcgatcaactaaaaattatcgatcgtccccataaccgcatcgacgaaccgctaaaaactaccgacacgacacgctacgcctacgaataacataaaaaaacccccaacgccgcctataactatatcgtcgattccgccattaccaaaaaacgcctcaccgcccttaatacgaacgccgcgcaaaaaacgccgaacgtactaactatcattaccgccaataacgccgaaacactaaacaaaaacgacaaaaacaccgccaaactattaaacgaccccactattaaacactatcatcaaaccattacgctaataataaccgaaaccttcgaacaaacgcgaacgacgacctcgctaatacaaacacactatc

SEQ ID NO: 4699 - DNA, 695 bp, Artificial Sequence
  chemically treated genomic DNA (Homo sapiens) CpG-island No: 4699
cgttcggcggaaaatatatttatcgtaaggtgcgcgatcgcgttttttacgtttttgttttggtatcggtcgcgcgatttatttagtttgacggtagcgggcgcgtcgcgttgggcggagtagtatataagttttggcgtatggaggttgcggatgtttagttattttagggggcgtaggtcgtatatgatacgttgttcgttagcgtttattttatcgttgaaaatatttttaaatttttgttggcgaagcgaacgtttgttttcgtattggttgaagcgagggtataggtatgaaatttgataaattcgtaggggaaaattcgatcgattagttgaaggttgtcggtcgtttttatgatcgtatcgacggatcgttgaaaattatcggtacggtacgttacgtttacgaatggtatgaagaagtttttaacgtcgtttatggttatatcgtcggtttcgttattgttaaaggacgttttatcgtttttgatacggacgtcgcgtaaaaagcgtcgggcgtattggttgttattatcgttagtaacgtcggggtattagataaaggcgataaaaatatcgttaggttgttaggcggttttattattgagtattattattaggttattgcgttggtagtggtcgagattttcgaataggcgcgagcggcggtttcgttggtgtaggtatattatt

SEQ ID NO: 4700 - DNA, 695 bp, Artificial Sequence
  chemically treated genomic DNA (Homo sapiens) CpG-island No: 4700
aataatatacctacaccaacgaaaccgccgctcgcgcctattcgaaaatctcgaccactaccaacgcaataacctaataataatactcaataataaaaccgcctaacaacctaacgatatttttatcgcctttatctaataccccgacgttactaacgataataacaaccaatacgcccgacgctttttacgcgacgtccgtatcaaaaacgataaaacgtcctttaacaataacgaaaccgacgatataaccataaacgacgttaaaaacttcttcataccattcgtaaacgtaacgtaccgtaccgataattttcaacgatccgtcgatacgatcataaaaacgaccgacaaccttcaactaatcgatcgaattttcccctacgaatttatcaaatttcatacctataccctcgcttcaaccaatacgaaaacaaacgttcgcttcgccaacaaaaatttaaaaatattttcaacgataaaataaacgctaacgaacaacgtatcatatacgacctacgccccctaaaataactaaacatccgcaacctccatacgccaaaacttatatactactccgcccaacgcgacgcgcccgctaccgtcaaactaaataaatcgcgcgaccgataccaaaacaaaaacgtaaaaaacgcgatcgcgcaccttacgataaatatattttccgccgaacg

SEQ ID NO: 4701 - DNA, 730 bp, Artificial Sequence
  chemically treated genomic DNA (Homo sapiens) CpG-island No: 4701
cgcggcgttcgtttttttcgtttttcgttcgggttgcgcgcgtttcgagggtttgcgcgttttcggtacgttttcgtcgggttcgcgcgtttcgtgtttcgcgtttcgcgtttttagttacgttttcgtttcggtttcggcgcgtcgcggagttggttgttgggaggtgcgggattgggtgtggtcggcggttttggtttcggttgtgagttgcgttttttacgtcggtttcgcgttttaggggttgttgagcgtttagcggatatcggtagcgcgcggtcgacgcgggtttgagttttttttaggtaggcggcgagttcgcgagcggcggttcgtcggtgcgtttcgcgaagcgatttcgggtttttcgtagggacgtggggcgtcgcgagttatttttgcggaacggggttcgggtgacggcgcggggcggggcgggttttttcgggttcgggcggtcgacgttgttcgggagggacgaggagggcgcgtttgtgtcgcgtttagttgttacgcgggaattggttttacgatcgtcggcgtaggtatttttcgggcggtttagatcgttcgtttcggggagcgaggaacggtcggcggtttaagttttgtagatttttttggtttttcgttatttttcgaggtttttttttaggaatttagagtacgagttcgtgcgtgtttttaaaataacgggtattcgggattgtttagtagggttgttgggtgg

SEQ ID NO: 4702 - DNA, 730 bp, Artificial Sequence
  chemically treated genomic DNA (Homo sapiens) CpG-island No: 4702
ccacccaacaaccctactaaacaatcccgaatacccgttattttaaaaacacgcacgaactcgtactctaaattcctaaaaaaaaacctcgaaaaataacgaaaaaccaaaaaaatctacaaaacttaaaccgccgaccgttcctcgctccccgaaacgaacgatctaaaccgcccgaaaaatacctacgccgacgatcgtaaaaccaattcccgcgtaacaactaaacgcgacacaaacgcgccctcctcgtccctcccgaacaacgtcgaccgcccgaacccgaaaaaacccgccccgccccgcgccgtcacccgaaccccgttccgcaaaaataactcgcgacgccccacgtccctacgaaaaacccgaaatcgcttcgcgaaacgcaccgacgaaccgccgctcgcgaactcgccgcctacctaaaaaaaactcaaacccgcgtcgaccgcgcgctaccgatatccgctaaacgctcaacaacccctaaaacgcgaaaccgacgtaaaaaacgcaactcacaaccgaaaccaaaaccgccgaccacacccaatcccgcacctcccaacaaccaactccgcgacgcgccgaaaccgaaacgaaaacgtaactaaaaacgcgaaacgcgaaacacgaaacgcgcgaacccgacgaaaacgtaccgaaaacgcgcaaaccctcgaaacgcgcgcaacccgaacgaaaaacgaaaaaaacgaacgccgcg

SEQ ID NO: 4703 - DNA, 730 bp, Artificial Sequence
  chemically treated genomic DNA (Homo sapiens) CpG-island No: 4703
ttatttaatagttttgttgggtagtttcgaatattcgttattttgggggtacgtacgggttcgtgttttgagtttttggaaggaggtttcggggagtgacgagaaattaggggggtttgtaggatttggatcgtcgatcgtttttcgtttttcggggcgagcggtttggatcgttcgggaagtgtttgcgtcggcggtcgtggggttagttttcgcgtggtagttgggcgcgatataggcgcgtttttttcgtttttttcgggtagcgtcggtcgttcgagttcggggagattcgtttcgtttcgcgtcgttattcgggtttcgtttcgtaggggtggttcgcggcgttttacgtttttgcgagaagttcgggatcgtttcgcggggcgtatcgacgagtcgtcgttcgcgagttcgtcgtttatttggagggagtttaggttcgcgtcgatcgcgcgttgtcggtgttcgttgggcgtttagtagtttttggagcgcggagtcggcgtggagagcgtagtttatagtcgagattagagtcgtcggttatatttagtttcgtattttttagtagttaatttcgcggcgcgtcggagtcggggcggggacgtggttggaggcgcgaggcgcgaggtacgaggcgcgcgggttcggcggggacgtgtcggggacgcgtagattttcggagcgcgcgtagttcgggcggggggcgaagggagcgggcgtcgcg

SEQ ID NO: 4704 - DNA, 730 bp, Artificial Sequence
  chemically treated genomic DNA (Homo sapiens) CpG-island No: 4704
cgcgacgcccgctcccttcgccccccgcccgaactacgcgcgctccgaaaatctacgcgtccccgacacgtccccgccgaacccgcgcgcctcgtacctcgcgcctcgcgcctccaaccacgtccccgccccgactccgacgcgccgcgaaattaactactaaaaaatacgaaactaaatataaccgacgactctaatctcgactataaactacgctctccacgccgactccgcgctccaaaaactactaaacgcccaacgaacaccgacaacgcgcgatcgacgcgaacctaaactccctccaaataaacgacgaactcgcgaacgacgactcgtcgatacgccccgcgaaacgatcccgaacttctcgcaaaaacgtaaaacgccgcgaaccacccctacgaaacgaaacccgaataacgacgcgaaacgaaacgaatctccccgaactcgaacgaccgacgctacccgaaaaaaacgaaaaaaacgcgcctatatcgcgcccaactaccacgcgaaaactaaccccacgaccgccgacgcaaacacttcccgaacgatccaaaccgctcgccccgaaaaacgaaaaacgatcgacgatccaaatcctacaaacccccctaatttctcgtcactccccgaaacctccttccaaaaactcaaaacacgaacccgtacgtacccccaaaataacgaatattcgaaactacccaacaaaactattaaataa

SEQ ID NO: 4705 - DNA, 564 bp, Artificial Sequence
  chemically treated genomic DNA (Homo sapiens) CpG-island No: 4705
ttttaagtcgtaggagcgggttttttcgtttttttttcgggtcggggggcggggttttttaattcggaattgaaggttttgcgtagcggtatcgtttatttgcgtttcggaaggagcgagtttgcggagcgtgaattagtgagtgaaagcggcgtcgttcgtcggtcgtaggtgcggtaaagttagtgttatttgtcggtttttttagggttttcggaaagaaggagggttagtcgcgtgcgttcgcgtcgcgtttttttgcgtttttgttttttaaatagggtttttttttttttcgtcgtttaggtttttgcgtgggttggacgcgttagttttatatattagtttcgttgcggcgtttagattttgttttgttttttcgtttcggtttttggtttttgttttgtcgttcgtcgtcggagcggtgatcgttcggttcgtcgtttttttgttgttatcgttgtcggtattatgggtagtgagtagagtttcgaggtcgagagtcgatttaacgatttgaattttttaggtcggtgttttaattttttatttttttttagttcg

SEQ ID NO: 4706 - DNA, 564 bp, Artificial Sequence
  chemically treated genomic DNA (Homo sapiens) CpG-island No: 4706
cgaactaaaaaaaaataaaaaattaaaacaccgacctaaaaaattcaaatcgttaaatcgactctcgacctcgaaactctactcactacccataataccgacaacgataacaacaaaaaaacgacgaaccgaacgatcaccgctccgacgacgaacgacaaaacaaaaaccaaaaaccgaaacgaaaaaacaaaacaaaatctaaacgccgcaacgaaactaatatataaaactaacgcgtccaacccacgcaaaaacctaaacgacgaaaaaaaaaaaaaccctatttaaaaaacaaaaacgcaaaaaaacgcgacgcgaacgcacgcgactaaccctccttctttccgaaaaccctaaaaaaaccgacaaataacactaactttaccgcacctacgaccgacgaacgacgccgctttcactcactaattcacgctccgcaaactcgctccttccgaaacgcaaataaacgataccgctacgcaaaaccttcaattccgaattaaaaaaccccgccccccgacccgaaaaaaaaacgaaaaaacccgctcctacgacttaaaa

SEQ ID NO: 4707 - DNA, 564 bp, Artificial Sequence
  chemically treated genomic DNA (Homo sapiens) CpG-island No: 4707
cgggttggaggagggtgggaggttaggatatcgatttgaggagtttagatcgttgggtcggttttcggtttcggagttttgtttattgtttatggtgtcgatagcggtggtagtagaagaacggcgggtcgggcggttatcgtttcggcggcgggcgatagggtaggggttagggatcgggacggggaggtaaagtagagtttgggcgtcgtagcgaggttaatgtgtggggttgacgcgtttagtttacgtaggggtttgggcggcgggagaaggagaggttttatttggggaatagaaacgtaaggaggcgcggcgcgaacgtacgcggttagtttttttttttttcgggagttttaagagaatcggtagatgatattggttttgtcgtatttgcggtcggcgggcggcgtcgtttttatttattggtttacgtttcgtaagttcgtttttttcgggacgtagatgggcggtgtcgttacgtaagatttttagtttcggattaggaggtttcgtttttcggttcgagggaggggcggagagattcgtttttgcgatttaggg

SEQ ID NO: 4708 - DNA, 564 bp, Artificial Sequence
  chemically treated genomic DNA (Homo sapiens) CpG-island No: 4708
ccctaaatcgcaaaaacgaatctctccgcccctccctcgaaccgaaaaacgaaacctcctaatccgaaactaaaaatcttacgtaacgacaccgcccatctacgtcccgaaaaaaacgaacttacgaaacgtaaaccaataaataaaaacgacgccgcccgccgaccgcaaatacgacaaaaccaatatcatctaccgattctcttaaaactcccgaaaaaaaaaaaaactaaccgcgtacgttcgcgccgcgcctccttacgtttctattccccaaataaaacctctccttctcccgccgcccaaacccctacgtaaactaaacgcgtcaaccccacacattaacctcgctacgacgcccaaactctactttacctccccgtcccgatccctaacccctaccctatcgcccgccgccgaaacgataaccgcccgacccgccgttcttctactaccaccgctatcgacaccataaacaataaacaaaactccgaaaccgaaaaccgacccaacgatctaaactcctcaaatcgatatcctaacctcccaccctcctccaacccg

SEQ ID NO: 4709 - DNA, 660 bp, Artificial Sequence
  chemically treated genomic DNA (Homo sapiens) CpG-island No: 4709
  misc_feature (103)..(103): n is either a, c, g or t
cgttcgatttgattggatggtggcgggaagaagcggggagatttcggatgagggcgcgtaggcggtcgggggttttacggatgcgttagggggcgaagggcgngacgggtttcggagcgtcgcgcgtgcgtaattgggattagcgggttgggattgttgggagggcgggatttttcgagaacgggttgggcgtttgtacggtgggcgcgggaatgggttcgggttgtacgagcgcgcgtgcgttcggaattggagttgcgggaggtgcgggattgaggaggcggcggagggggcgggtcgcgtcgggcgttacgttcgtagttagaggttttcgtttttattatcgtcgttatagttttttagttttatattttgagaaggacgtttttggagtcgcgattgttcggggttgtgtcggtcgtagttgtcgtttaggtcgttttagtttttttttgcgacggttcgtttatttcgttcggttttagttttagcgtttggcgcgatttcggcggtgagtgagtcgggatgttagggtaggggcgtattacggttttttgtattttttcgtcgttttttgtcgtcggcgtttttgttttttattttttagtgtacggtttggttgtttagcggggttttggcgaggttttagcgggaaagggg

SEQ ID NO: 4710 - DNA, 660 bp, Artificial Sequence
  chemically treated genomic DNA (Homo sapiens) CpG-island No: 4710
  misc_feature (558)..(558): n is either a, c, g or t
cccctttcccgctaaaacctcgccaaaaccccgctaaacaaccaaaccgtacactaaaaaataaaaaacaaaaacgccgacgacaaaaaacgacgaaaaaatacaaaaaaccgtaatacgcccctaccctaacatcccgactcactcaccgccgaaatcgcgccaaacgctaaaactaaaaccgaacgaaataaacgaaccgtcgcaaaaaaaaactaaaacgacctaaacgacaactacgaccgacacaaccccgaacaatcgcgactccaaaaacgtccttctcaaaatataaaactaaaaaactataacgacgataataaaaacgaaaacctctaactacgaacgtaacgcccgacgcgacccgccccctccgccgcctcctcaatcccgcacctcccgcaactccaattccgaacgcacgcgcgctcgtacaacccgaacccattcccgcgcccaccgtacaaacgcccaacccgttctcgaaaaatcccgccctcccaacaatcccaacccgctaatcccaattacgcacgcgcgacgctccgaaacccgtcncgcccttcgccccctaacgcatccgtaaaacccccgaccgcctacgcgccctcatccgaaatctccccgcttcttcccgccaccatccaatcaaatcgaacg

SEQ ID NO: 4711 - DNA, 660 bp, Artificial Sequence
  chemically treated genomic DNA (Homo sapiens) CpG-island No: 4711
  misc_feature (558)..(558): n is either a, c, g or t
tttttttttcgttggggtttcgttaaggtttcgttgggtagttaggtcgtgtattgggaggtgaggggtaggggcgtcgacggtagagggcgacggaggagtgtaggaagtcgtgatgcgtttttgttttagtatttcgatttatttatcgtcggggtcgcgttaagcgttagggttggggtcgggcggagtgagcgggtcgtcgtagaggagagttgaggcggtttgagcggtagttgcggtcggtataatttcgggtagtcgcggttttagaggcgttttttttaggatgtggagttggaagattgtagcggcggtggtggaggcggaggtttttggttgcggacgtggcgttcgacgcgattcgtttttttcgtcgtttttttagtttcgtatttttcgtagttttagtttcgagcgtacgcgcgttcgtgtagttcgggtttattttcgcgtttatcgtgtaaacgtttaattcgttttcggagggtttcgtttttttagtagttttagttcgttggttttaattgcgtacgcgcgacgtttcgaggttcgttncgtttttcgttttttgacgtattcgtggaattttcggtcgtttgcgcgtttttattcggggttttttcgttttttttcgttattatttaattaaatcgggcg

SEQ ID NO: 4712 - DNA, 660 bp, Artificial Sequence
  chemically treated genomic DNA (Homo sapiens) CpG-island No: 4712
  misc_feature (103)..(103): n is either a, c, g or t
cgcccgatttaattaaataataacgaaaaaaaacgaaaaaaccccgaataaaaacgcgcaaacgaccgaaaattccacgaatacgtcaaaaaacgaaaaacgnaacgaacctcgaaacgtcgcgcgtacgcaattaaaaccaacgaactaaaactactaaaaaaacgaaaccctccgaaaacgaattaaacgtttacacgataaacgcgaaaataaacccgaactacacgaacgcgcgtacgctcgaaactaaaactacgaaaaatacgaaactaaaaaaacgacgaaaaaaacgaatcgcgtcgaacgccacgtccgcaaccaaaaacctccgcctccaccaccgccgctacaatcttccaactccacatcctaaaaaaaacgcctctaaaaccgcgactacccgaaattataccgaccgcaactaccgctcaaaccgcctcaactctcctctacgacgacccgctcactccgcccgaccccaaccctaacgcttaacgcgaccccgacgataaataaatcgaaatactaaaacaaaaacgcatcacgacttcctacactcctccgtcgccctctaccgtcgacgcccctacccctcacctcccaatacacgacctaactacccaacgaaaccttaacgaaaccccaacgaaaaaaaaa

SEQ ID NO: 4713 - DNA, 574 bp, Artificial Sequence
  chemically treated genomic DNA (Homo sapiens) CpG-island No: 4713
tgtggattagttcgttcgcggttcgtaggtcgggtcgtcgcgtttcgtttcgtttcggtcgggttcgcgcgtagtttatttgttagttgcgttgggggcgtacgcgtttgttttattgttttgttttttattcgggtagagttcgtttcggggttttgttcgttcgttcggtttttttatttcgggggtcgttgttttaacgtttttcgtttcgttcggtttttttcggttcgcggttttttttgggtcgtattttttgcggcgcgttttcggatttttagttatttttagcgttcgtcgtttcgtttttcgtgcgtgcgtttttttcgtcgcggttcgtaagcggcgttcgcgtatcgcgtcgttttttttttagtttaggttttttcgcgcgtgcgtacggtagaggtattggtcgcgagaggttcggtcgggagtttcgcgtttttattcggtcgggtagaatcgagcgtcgagcgatcggtttatggttgttaggcgattagggttgttgtttttgtagggattgagttttgaattttttaaatttcgtagatttaggatttcgttttta

SEQ ID NO: 4714 - DNA, 574 bp, Artificial Sequence
  chemically treated genomic DNA (Homo sapiens) CpG-island No: 4714
taaaaacgaaatcctaaatctacgaaatttaaaaaattcaaaactcaatccctacaaaaacaacaaccctaatcgcctaacaaccataaaccgatcgctcgacgctcgattctacccgaccgaataaaaacgcgaaactcccgaccgaacctctcgcgaccaatacctctaccgtacgcacgcgcgaaaaaacctaaactaaaaaaaaaacgacgcgatacgcgaacgccgcttacgaaccgcgacgaaaaaaacgcacgcacgaaaaacgaaacgacgaacgctaaaaataactaaaaatccgaaaacgcgccgcaaaaaatacgacccaaaaaaaaccgcgaaccgaaaaaaaccgaacgaaacgaaaaacgttaaaacaacgacccccgaaataaaaaaaccgaacgaacgaacaaaaccccgaaacgaactctacccgaataaaaaacaaaacaataaaacaaacgcgtacgcccccaacgcaactaacaaataaactacgcgcgaacccgaccgaaacgaaacgaaacgcgacgacccgacctacgaaccgcgaacgaactaatccaca

SEQ ID NO: 4715 - DNA, 574 bp, Artificial Sequence
  chemically treated genomic DNA (Homo sapiens) CpG-island No: 4715
tgaagacgaaattttgagtttgcgggatttaggggatttaaaatttaatttttgtaggaatagtagttttggtcgtttagtaattatgggtcgatcgttcggcgttcgattttattcggtcggatggagacgcggaattttcggtcgagtttttcgcggttagtgtttttgtcgtgcgtacgcgcggaggggtttgggttgggagaagggcgacgcggtgcgcgggcgtcgtttgcgggtcgcggcggggagggcgtacgtacgaggggcggagcggcgggcgttgagagtggttgaggattcggaaacgcgtcgtagagggtgcggtttagaggaggtcgcgggtcgggaagggtcgggcgggacgggaaacgttagggtagcggttttcggggtgagggggtcgagcggacgggtagggtttcgaggcgaattttgttcggatgaggaataaagtagtggggtaggcgcgtgcgtttttagcgtagttggtaggtgggttgcgcgcgggttcggtcggagcggggcggggcgcggcggttcggtttgcgggtcgcgggcgggttaatttata

SEQ ID NO: 4716 - DNA, 574 bp, Artificial Sequence
  chemically treated genomic DNA (Homo sapiens) CpG-island No: 4716
tataaattaacccgcccgcgacccgcaaaccgaaccgccgcgccccgccccgctccgaccgaacccgcgcgcaacccacctaccaactacgctaaaaacgcacgcgcctaccccactactttattcctcatccgaacaaaattcgcctcgaaaccctacccgtccgctcgaccccctcaccccgaaaaccgctaccctaacgtttcccgtcccgcccgacccttcccgacccgcgacctcctctaaaccgcaccctctacgacgcgtttccgaatcctcaaccactctcaacgcccgccgctccgcccctcgtacgtacgccctccccgccgcgacccgcaaacgacgcccgcgcaccgcgtcgcccttctcccaacccaaacccctccgcgcgtacgcacgacaaaaacactaaccgcgaaaaactcgaccgaaaattccgcgtctccatccgaccgaataaaatcgaacgccgaacgatcgacccataattactaaacgaccaaaactactattcctacaaaaattaaattttaaatcccctaaatcccgcaaactcaaaatttcgtcttca

SEQ ID NO: 4717 - DNA, 617 bp, Artificial Sequence
  chemically treated genomic DNA (Homo sapiens) CpG-island No: 4717
gttatattcgttgcgtatcgcgtttttgggcgtttcggggattttgttcggattttcgcggagggatttttttagggtcgttttgcgtttggacgtcgcgtgttgggagtgggcgcgtagcggttgcgtacggggatggtagtatttgttcgtgtcgttggatagcgttttcgagttcgttttttttcgtaagcgtaacgagcgcgagcggtagcgggtgcgttgcgtgaacgagggttatgcgcgttttcgagattatttgtttcgggagttggtagataagcgttttagtaaagtggagacgtttcgcgttgttatcgattatattaagtatttgtaggagttgttggagcgttaggtttgggggttcgagggcgcggtcggcgtcgttttttagcgtagggcggaatgtaatagcgacggggagtttaaggttttttcggcgttttcgtttagtagcgagttcgaggaggggggtagttagcgagcgttcgaattggttaggattttcgcgttcgtcgtatagcgcgtagtcgggcgtttaatttaaggtttttttcgaaggtggtttgtatttttaatttggtattttttttaggtttaaattttaagaaaaa

SEQ ID NO: 4718 - DNA, 617 bp, Artificial Sequence
  chemically treated genomic DNA (Homo sapiens) CpG-island No: 4718
tttttcttaaaatttaaacctaaaaaaaataccaaattaaaaatacaaaccaccttcgaaaaaaaccttaaattaaacgcccgactacgcgctatacgacgaacgcgaaaatcctaaccaattcgaacgctcgctaactacccccctcctcgaactcgctactaaacgaaaacgccgaaaaaaccttaaactccccgtcgctattacattccgccctacgctaaaaaacgacgccgaccgcgccctcgaacccccaaacctaacgctccaacaactcctacaaatacttaatataatcgataacaacgcgaaacgtctccactttactaaaacgcttatctaccaactcccgaaacaaataatctcgaaaacgcgcataaccctcgttcacgcaacgcacccgctaccgctcgcgctcgttacgcttacgaaaaaaaacgaactcgaaaacgctatccaacgacacgaacaaatactaccatccccgtacgcaaccgctacgcgcccactcccaacacgcgacgtccaaacgcaaaacgaccctaaaaaaatccctccgcgaaaatccgaacaaaatccccgaaacgcccaaaaacgcgatacgcaacgaatataac

SEQ ID NO: 4719 - DNA, 617 bp, Artificial Sequence
  chemically treated genomic DNA (Homo sapiens) CpG-island No: 4719
ttttttttaagatttaggtttggagaagatgttagattaagaatgtaaattattttcgaagaggattttaggttgagcgttcggttgcgcgttgtgcggcgggcgcgggggttttggttagttcgggcgttcgttagttgttttttttttcgggttcgttgttgggcgaaggcgtcgaagaggttttggatttttcgtcgttgttgtatttcgttttgcgttgggggacggcgtcggtcgcgttttcgagtttttaggtttggcgttttagtagtttttgtaggtgtttgatgtagtcgatggtagcgcggagcgtttttattttgttgaggcgtttgtttgttagttttcggggtaggtggtttcggaggcgcgtatagttttcgtttacgtagcgtattcgttgtcgttcgcgttcgttgcgtttgcggaggaaggcgggttcgaaggcgttgtttagcggtacgggtaagtattgttattttcgtgcgtagtcgttgcgcgtttatttttagtacgcggcgtttagacgtagggcgattttgagggggttttttcgcgggagttcgggtagggttttcggaacgtttaggggcgcggtgcgtagcgagtatggt

SEQ ID NO: 4720 - DNA, 617 bp, Artificial Sequence
  chemically treated genomic DNA (Homo sapiens) CpG-island No: 4720
accatactcgctacgcaccgcgcccctaaacgttccgaaaaccctacccgaactcccgcgaaaaaaccccctcaaaatcgccctacgtctaaacgccgcgtactaaaaataaacgcgcaacgactacgcacgaaaataacaatacttacccgtaccgctaaacaacgccttcgaacccgccttcctccgcaaacgcaacgaacgcgaacgacaacgaatacgctacgtaaacgaaaactatacgcgcctccgaaaccacctaccccgaaaactaacaaacaaacgcctcaacaaaataaaaacgctccgcgctaccatcgactacatcaaacacctacaaaaactactaaaacgccaaacctaaaaactcgaaaacgcgaccgacgccgtcccccaacgcaaaacgaaatacaacaacgacgaaaaatccaaaacctcttcgacgccttcgcccaacaacgaacccgaaaaaaaaaacaactaacgaacgcccgaactaaccaaaacccccgcgcccgccgcacaacgcgcaaccgaacgctcaacctaaaatcctcttcgaaaataatttacattcttaatctaacatcttctccaaacctaaatcttaaaaaaaa

SEQ ID NO: 4721 - DNA, 759 bp, Artificial Sequence
  chemically treated genomic DNA (Homo sapiens) CpG-island No: 4721
agcggcggcggcggcggtagcgggcgacgtaagttcggatgtagtttcgggggtttcggcgttgagaaatagtcgattttagtggcgtaggacggatacgaggacggttcgggggattgtgtatcgggtgtgcgagttcgtaagtcgtagtaggggtcgcgcgcgttgggtttttacgcgtttatggtttcgggcggcgcgcgggggttttcggggtcgtagtttcgcgtcgtttggcgcgcgtcggcgtttcgtttggttttaggttcgggtgtcgcgcgtcgcgttttataggcgtcgggttcggttgttcgtttttttcggtcggcgcgcgtagttttttcgcggagtagtcggttaggtagttttgttcgttgttcggttttggttcgattgataggcgcgagcgtcggtagtagttttcgcgtttcgtttttcgttcgtttttcgcggtttagtttaattagcggcggttgagaggcggttattagggtgacgcggtatcgcgttttgcgaggggcggagtcgggggtcgttacgcgcgtttttcgcggtaaaatttaaaggtcggtagggcggttttttaatttttttttttaagtagggacgaggcggaatttgtttcgcgaggattgtaattttcggtatgttgcgcgtcggcgtcgggtggaggggtttcgattgggggcgtagggcgtgttggtttttgtagttttattaggggtggtaaaattagtgttatttattgattatatattt

SEQ ID NO: 4722 - DNA, 759 bp, Artificial Sequence
  chemically treated genomic DNA (Homo sapiens) CpG-island No: 4722
aaatatataatcaataaataacactaattttaccacccctaataaaactacaaaaaccaacacgccctacgcccccaatcgaaacccctccacccgacgccgacgcgcaacataccgaaaattacaatcctcgcgaaacaaattccgcctcgtccctacttaaaaaaaaaaattaaaaaaccgccctaccgacctttaaattttaccgcgaaaaacgcgcgtaacgacccccgactccgcccctcgcaaaacgcgataccgcgtcaccctaataaccgcctctcaaccgccgctaattaaactaaaccgcgaaaaacgaacgaaaaacgaaacgcgaaaactactaccgacgctcgcgcctatcaatcgaaccaaaaccgaacaacgaacaaaactacctaaccgactactccgcgaaaaaactacgcgcgccgaccgaaaaaaacgaacaaccgaacccgacgcctataaaacgcgacgcgcgacacccgaacctaaaaccaaacgaaacgccgacgcgcgccaaacgacgcgaaactacgaccccgaaaacccccgcgcgccgcccgaaaccataaacgcgtaaaaacccaacgcgcgcgacccctactacgacttacgaactcgcacacccgatacacaatcccccgaaccgtcctcgtatccgtcctacgccactaaaatcgactatttctcaacgccgaaacccccgaaactacatccgaacttacgtcgcccgctaccgccgccgccgccgct

SEQ ID NO: 4723 - DNA, 759 bp, Artificial Sequence
  chemically treated genomic DNA (Homo sapiens) CpG-island No: 4723
aaatatgtgattagtaaatgatattggttttgttatttttagtgggattataaaaattagtacgttttgcgtttttagtcggggtttttttattcggcgtcggcgcgtagtatgtcgggagttgtagttttcgcgaggtaagtttcgtttcgtttttgtttgggggaggaggttggagagtcgttttgtcggtttttgaattttgtcgcgaaaagcgcgcgtggcggttttcggtttcgtttttcgtaggacgcggtgtcgcgttattttggtaatcgttttttagtcgtcgttgattgggttgggtcgcggggggcgggcgggggacgagacgcgggggttgttgtcggcgttcgcgtttgttagtcgggttagagtcgagtagcgggtaggattgtttggtcggttgtttcgcggagaggttgcgcgcgtcggtcgggggaggcggatagtcgggttcggcgtttgtggggcgcggcgcgcggtattcgggtttgagattaggcgaggcgtcggcgcgcgttagacggcgcgaggttgcggtttcgggagttttcgcgcgtcgttcggggttatgggcgcgtgagagtttagcgcgcgcggtttttgttgcggtttgcgagttcgtatattcggtgtatagtttttcgggtcgttttcgtgttcgttttgcgttattgggatcggttgttttttagcgtcgaggttttcgaggttgtattcgagtttgcgtcgttcgttgtcgtcgtcgtcgtcgtt

SEQ ID NO: 4724 - DNA, 759 bp, Artificial Sequence
  chemically treated genomic DNA (Homo sapiens) CpG-island No: 4724
aacgacgacgacgacgacaacgaacgacgcaaactcgaatacaacctcgaaaacctcgacgctaaaaaacaaccgatcccaataacgcaaaacgaacacgaaaacgacccgaaaaactatacaccgaatatacgaactcgcaaaccgcaacaaaaaccgcgcgcgctaaactctcacgcgcccataaccccgaacgacgcgcgaaaactcccgaaaccgcaacctcgcgccgtctaacgcgcgccgacgcctcgcctaatctcaaacccgaataccgcgcgccgcgccccacaaacgccgaacccgactatccgcctcccccgaccgacgcgcgcaacctctccgcgaaacaaccgaccaaacaatcctacccgctactcgactctaacccgactaacaaacgcgaacgccgacaacaacccccgcgtctcgtcccccgcccgccccccgcgacccaacccaatcaacgacgactaaaaaacgattaccaaaataacgcgacaccgcgtcctacgaaaaacgaaaccgaaaaccgccacgcgcgcttttcgcgacaaaattcaaaaaccgacaaaacgactctccaacctcctcccccaaacaaaaacgaaacgaaacttacctcgcgaaaactacaactcccgacatactacgcgccgacgccgaataaaaaaaccccgactaaaaacgcaaaacgtactaatttttataatcccactaaaaataacaaaaccaatatcatttactaatcacatattt

SEQ ID NO: 4725 - DNA, 680 bp, Artificial Sequence
  chemically treated genomic DNA (Homo sapiens) CpG-island No: 4725
tttcgtttcggtttttagtgagatcgattttttttttaatttattcgcgtcggacgtagttagtttacgtttttttttcgcgtcgattgtaacgtcgtttattttttgttagtttttattatttattttcggttttttcgtcgttttttttatttttatgttttttttcggtaggcgttgttaagtatatttcgttttttatttggtcgtatttgttggtagtcgtacgtagttttgttttatcggtgttaataaatatggtatttttattcgatcgttatcgtatatgcgtacgtattacgatattcgtttgttttttcgagcgtttgtcgattttagcggtatagtttattacgattcgttttagttacgtattcgttattcgacgcgtatatatgtattggacgtttatcgtattttgttattgtttttatcgtagttttcgtatatgtgttgttgtattttgttcgtagttagttcgatcggacgattttttatacgtattgcgtacgtttgcgtaacgttatgtacgtcgggaggtacgggagatttttgttggttattttgtttttatttgtacgttcgttttatttttatagtagtatttgtatattcgacgagtttatgcgtttttatgtttattaatttttgtagatttttatatatagtcgttttgattg

SEQ ID NO: 4726 - DNA, 680 bp, Artificial Sequence
  chemically treated genomic DNA (Homo sapiens) CpG-island No: 4726
caatcaaaacgactatatataaaaatctacaaaaattaataaacataaaaacgcataaactcgtcgaatatacaaatactactataaaaataaaacgaacgtacaaataaaaacaaaataaccaacaaaaatctcccgtacctcccgacgtacataacgttacgcaaacgtacgcaatacgtataaaaaatcgtccgatcgaactaactacgaacaaaatacaacaacacatatacgaaaactacgataaaaacaataacaaaatacgataaacgtccaatacatatatacgcgtcgaataacgaatacgtaactaaaacgaatcgtaataaactataccgctaaaatcgacaaacgctcgaaaaaacaaacgaatatcgtaatacgtacgcatatacgataacgatcgaataaaaataccatatttattaacaccgataaaacaaaactacgtacgactaccaacaaatacgaccaaataaaaaacgaaatatacttaacaacgcctaccgaaaaaaaacataaaaataaaaaaaacgacgaaaaaaccgaaaataaataataaaaactaacaaaaaataaacgacgttacaatcgacgcgaaaaaaaaacgtaaactaactacgtccgacgcgaataaattaaaaaaaaaatcgatctcactaaaaaccgaaacgaaa

SEQ ID NO: 4727 - DNA, 680 bp, Artificial Sequence
  chemically treated genomic DNA (Homo sapiens) CpG-island No: 4727
tagttaaggcgattgtatgtaggggtttgtaaaggttaatgggtataagagcgtatgagttcgtcgagtatgtaagtattgttgtggaaataaggcgggcgtataagtaggagtagagtagttagtaggaatttttcgtatttttcgacgtgtatgacgttgcgtagacgtgcgtagtacgtatgagaggtcgttcgatcggattagttacgagtagagtgtagtagtatatgtacgagagttgcgatagaggtagtgatagaatgcgatgagcgtttagtatatatatacgcgtcgagtggcgagtgcgtagttagagcgagtcgtgatagattatgtcgttagagtcgataggcgttcgagaagatagacgagtatcgtagtacgtgcgtatatgcggtagcgatcggatgaggatattatgtttgttgatatcgatggagtagagttgcgtacgattattagtagatgcgattagatagaagacgagatgtatttggtagcgtttgtcgagaggaagtatgggagtgaggggagcgacgggagagtcggggatggatagtggaaattagtaagaagtaaacggcgttgtaatcgacgcgagaaggaggcgtaagttagttacgttcgacgcggataaattggagagggagtcgattttattgagaatcgaagcggag

SEQ ID NO: 4728 - DNA, 680 bp, Artificial Sequence
  chemically treated genomic DNA (Homo sapiens) CpG-island No: 4728
ctccgcttcgattctcaataaaatcgactccctctccaatttatccgcgtcgaacgtaactaacttacgcctccttctcgcgtcgattacaacgccgtttacttcttactaatttccactatccatccccgactctcccgtcgctcccctcactcccatacttcctctcgacaaacgctaccaaatacatctcgtcttctatctaatcgcatctactaataatcgtacgcaactctactccatcgatatcaacaaacataatatcctcatccgatcgctaccgcatatacgcacgtactacgatactcgtctatcttctcgaacgcctatcgactctaacgacataatctatcacgactcgctctaactacgcactcgccactcgacgcgtatatatatactaaacgctcatcgcattctatcactacctctatcgcaactctcgtacatatactactacactctactcgtaactaatccgatcgaacgacctctcatacgtactacgcacgtctacgcaacgtcatacacgtcgaaaaatacgaaaaattcctactaactactctactcctacttatacgcccgccttatttccacaacaatacttacatactcgacgaactcatacgctcttatacccattaacctttacaaacccctacatacaatcgccttaacta

SEQ ID NO: 4729 - DNA, 590 bp, Artificial Sequence
  chemically treated genomic DNA (Homo sapiens) CpG-island No: 4729
  misc_feature (29)..(29): n is either a, c, g or t
  misc_feature (46)..(46): n is either a, c, g or t
  misc_feature (49)..(49): n is either a, c, g or t
  misc_feature (107)..(107): n is either a, c, g or t
  misc_feature (130)..(130): n is either a, c, g or t
  misc_feature (134)..(134): n is either a, c, g or t
  misc_feature (184)..(184): n is either a, c, g or t
  misc_feature (194)..(194): n is either a, c, g or t
  misc_feature (203)..(203): n is either a, c, g or t
  misc_feature (239)..(240): n is either a, c, g or t
  misc_feature (347)..(347): n is either a, c, g or t
  misc_feature (391)..(391): n is either a, c, g or t
  misc_feature (413)..(413): n is either a, c, g or t
  misc_feature (428)..(428): n is either a, c, g or t
  misc_feature (434)..(434): n is either a, c, g or t
  misc_feature (549)..(549): n is either a, c, g or t
  misc_feature (568)..(568): n is either a, c, g or t
  misc_feature (581)..(581): n is either a, c, g or t
gtttttataacgtcggaagatgcgttttngggcggtttaataacgnttnaggcggtttataagaatattttaggcgcgggaggggggttttttttaacgacggtaantttgttaaattacgaaataattnttangtacgatacgggtgcggcgtttaatttttatagcggggataaaaaaattngggtgttatntcgtttcgntttttttttaataacgattatcggtcgcggttagtnngttttttcgaggcgaggagaatatttattttatttaaagttggggcgacgggggggagcgggaggtgttgtttttttaatcgacgatcgttgtagtaaatagttttnatataattacgacgaattaatttcgggcggtttgtttttttttnttttaggcggatattaatattnggcggggcgtagttngcgtantatcgtttaataaattttatatattttcgcgttacgggggtacggtagcgttttttttaagcgagcggagggttgtgcgtaataatatttagttttggcggcgtgcgagaatagnagttaataatttgtttcgnggtaagaatgtantttgtttat

SEQ ID NO: 4730 - DNA, 590 bp, Artificial Sequence
  chemically treated genomic DNA (Homo sapiens) CpG-island No: 4730
  misc_feature (10)..(10): n is either a, c, g or t
  misc_feature (23)..(23): n is either a, c, g or t
  misc_feature (42)..(42): n is either a, c, g or t
  misc_feature (157)..(157): n is either a, c, g or t
  misc_feature (163)..(163): n is either a, c, g or t
  misc_feature (178)..(178): n is either a, c, g or t
  misc_feature (200)..(200): n is either a, c, g or t
  misc_feature (244)..(244): n is either a, c, g or t
  misc_feature (351)..(352): n is either a, c, g or t
  misc_feature (388)..(388): n is either a, c, g or t
  misc_feature (397)..(397): n is either a, c, g or t
  misc_feature (407)..(407): n is either a, c, g or t
  misc_feature (457)..(457): n is either a, c, g or t
  misc_feature (461)..(461): n is either a, c, g or t
  misc_feature (484)..(484): n is either a, c, g or t
  misc_feature (542)..(542): n is either a, c, g or t
  misc_feature (545)..(545): n is either a, c, g or t
  misc_feature (562)..(562): n is either a, c, g or t
ataaacaaantacattcttaccncgaaacaaattattaactnctattctcgcacgccgccaaaactaaatattattacgcacaaccctccgctcgcttaaaaaaaacgctaccgtacccccgtaacgcgaaaatatataaaatttattaaacgatantacgcnaactacgccccgccnaatattaatatccgcctaaaanaaaaaaaaacaaaccgcccgaaattaattcgtcgtaattatatnaaaactatttactacaacgatcgtcgattaaaaaaacaacacctcccgctcccccccgtcgccccaactttaaataaaataaatattctcctcgcctcgaaaaaacnnactaaccgcgaccgataatcgttattaaaaaaaaancgaaacganataacacccnaatttttttatccccgctataaaaattaaacgccgcacccgtatcgtacntaanaattatttcgtaatttaacaaanttaccgtcgttaaaaaaaacccccctcccgcgcctaaaatattcttataaaccgcctnaancgttattaaaccgcccnaaaacgcatcttccgacgttataaaaac

SEQ ID NO: 4731 - DNA, 590 bp, Artificial Sequence
  chemically treated genomic DNA (Homo sapiens) CpG-island No: 4731
  misc_feature (10)..(10): n is either a, c, g or t
  misc_feature (23)..(23): n is either a, c, g or t
  misc_feature (42)..(42): n is either a, c, g or t
  misc_feature (157)..(157): n is either a, c, g or t
  misc_feature (163)..(163): n is either a, c, g or t
  misc_feature (178)..(178): n is either a, c, g or t
  misc_feature (200)..(200): n is either a, c, g or t
  misc_feature (244)..(244): n is either a, c, g or t
  misc_feature (351)..(352): n is either a, c, g or t
  misc_feature (388)..(388): n is either a, c, g or t
  misc_feature (397)..(397): n is either a, c, g or t
  misc_feature (407)..(407): n is either a, c, g or t
  misc_feature (457)..(457): n is either a, c, g or t
  misc_feature (461)..(461): n is either a, c, g or t
  misc_feature (484)..(484): n is either a, c, g or t
  misc_feature (542)..(542): n is either a, c, g or t
  misc_feature (545)..(545): n is either a, c, g or t
  misc_feature (562)..(562): n is either a, c, g or t
gtggataggntgtatttttgttncggagtaggttgttgattnttgttttcgtacgtcgttaagattaggtgttgttgcgtataatttttcgttcgtttggggaagacgttgtcgtgttttcgtagcgcgaagatgtataaggtttgttggacggtgntgcgtnggttgcgtttcgttngatgttggtgttcgtttgagangaagaaaggtagatcgttcgagattggttcgtcgtggttgtgtnggggttgtttgttgtagcggtcgtcggttaaggagatagtatttttcgttttttttcgtcgttttagttttagatgaagtgagtatttttttcgtttcgggaaggtnngttggtcgcgatcgatggtcgttgttggagaaggancgagacgangtggtatttngatttttttgttttcgttgtgggggttgaacgtcgtattcgtatcgtgtntggnagttgtttcgtggtttgataganttgtcgtcgttgagaagagtttttttttcgcgtttagagtgtttttgtagatcgtttnggncgttgttgaatcgtttnagaacgtatttttcgacgttgtgaaagt

SEQ ID NO: 4732 - DNA, 590 bp, Artificial Sequence
  chemically treated genomic DNA (Homo sapiens) CpG-island No: 4732
  misc_feature (29)..(29): n is either a, c, g or t
  misc_feature (46)..(46): n is either a, c, g or t
  misc_feature (49)..(49): n is either a, c, g or t
  misc_feature (107)..(107): n is either a, c, g or t
  misc_feature (130)..(130): n is either a, c, g or t
  misc_feature (134)..(134): n is either a, c, g or t
  misc_feature (184)..(184): n is either a, c, g or t
  misc_feature (194)..(194): n is either a, c, g or t
  misc_feature (203)..(203): n is either a, c, g or t
  misc_feature (239)..(240): n is either a, c, g or t
  misc_feature (347)..(347): n is either a, c, g or t
  misc_feature (391)..(391): n is either a, c, g or t
  misc_feature (413)..(413): n is either a, c, g or t
  misc_feature (428)..(428): n is either a, c, g or t
  misc_feature (434)..(434): n is either a, c, g or t
  misc_feature (549)..(549): n is either a, c, g or t
  misc_feature (568)..(568): n is either a, c, g or t
  misc_feature (581)..(581): n is either a, c, g or t
actttcacaacgtcgaaaaatacgttctnaaacgattcaacaacgnccnaaacgatctacaaaaacactctaaacgcgaaaaaaaaactcttctcaacgacgacaantctatcaaaccacgaaacaactnccanacacgatacgaatacgacgttcaacccccacaacgaaaacaaaaaaatcnaaataccacntcgtctcgntccttctccaacaacgaccatcgatcgcgaccaacnnaccttcccgaaacgaaaaaaatactcacttcatctaaaactaaaacgacgaaaaaaaacgaaaaatactatctccttaaccgacgaccgctacaacaaacaaccccnacacaaccacgacgaaccaatctcgaacgatctacctttcttcntctcaaacgaacaccaacatcnaacgaaacgcaaccnacgcancaccgtccaacaaaccttatacatcttcgcgctacgaaaacacgacaacgtcttccccaaacgaacgaaaaattatacgcaacaacacctaatcttaacgacgtacgaaaacaanaatcaacaacctactccgnaacaaaaatacancctatccac

SEQ ID NO: 4733 - DNA, 714 bp, Artificial Sequence
  chemically treated genomic DNA (Homo sapiens) CpG-island No: 4733
gttcgtgcggtaattttgttttattagtgtgtttatttttttatttatttatatatagagttggtttttcgttcgtattatatagtattattcgggcgcggtatgacgagcgaaggggatattggtggatgttgtaacgggggggtaatcgtgtaggtcggtcggtcgacgttagagtgggttcgtagggagagggataggtataggggaaagaaggaggagggtatagcggcgaacgaatttcgaagagttaggcgattcggcgggacgaagaaaacgcgggaggggtagcgggaatataacggtttagaaaaagaagataggggcgagtcgttcgagggggtagggggatagtacgagggggagttcggtcggcggcggtacgataagcgggataagcggagtttaggaaggagaattcgaggcggaaaaggcgagaagaggaagcgaggagagagcgaggagagaggacgaggagaggacgagaagacgagttcggaggacgggaagacgacgggagtagtacgggatcggtaagagggggaaagatagaaagaaagggagcggggaagcgaatcgaatagggaaggcgggcgaggttttatagaaaagtcgaaggttaacgaaaaggttaggaaatagagacgtaggggaggaaaaagaggggggaaaggaataaggggaagaacgttaaaagagagagaaaagaagtaa

SEQ ID NO: 4734 - DNA, 714 bp, Artificial Sequence
  chemically treated genomic DNA (Homo sapiens) CpG-island No: 4734
ttacttcttttctctctcttttaacgttcttccccttattcctttcccccctctttttcctcccctacgtctctatttcctaaccttttcgttaaccttcgacttttctataaaacctcgcccgccttccctattcgattcgcttccccgctccctttctttctatctttccccctcttaccgatcccgtactactcccgtcgtcttcccgtcctccgaactcgtcttctcgtcctctcctcgtcctctctcctcgctctctcctcgcttcctcttctcgccttttccgcctcgaattctccttcctaaactccgcttatcccgcttatcgtaccgccgccgaccgaactccccctcgtactatccccctaccccctcgaacgactcgcccctatcttctttttctaaaccgttatattcccgctacccctcccgcgttttcttcgtcccgccgaatcgcctaactcttcgaaattcgttcgccgctataccctcctccttctttcccctatacctatccctctccctacgaacccactctaacgtcgaccgaccgacctacacgattacccccccgttacaacatccaccaatatccccttcgctcgtcataccgcgcccgaataatactatataatacgaacgaaaaaccaactctatatataaataaataaaaaaataaacacactaataaaacaaaattaccgcacgaac

SEQ ID NO: 4735 - DNA, 714 bp, Artificial Sequence
  chemically treated genomic DNA (Homo sapiens) CpG-island No: 4735
ttgtttttttttttttttttttggcgtttttttttttgttttttttttttttttttttttttttttgcgtttttgttttttggttttttcgttggttttcggtttttttgtggggtttcgttcgttttttttgttcggttcgttttttcgttttttttttttttgttttttttttttttgtcggtttcgtgttgttttcgtcgttttttcgtttttcgggttcgttttttcgtttttttttcgtttttttttttcgtttttttttcgtttttttttttcgtttttttcgtttcgggtttttttttttgggtttcgtttgtttcgtttgtcgtgtcgtcgtcggtcgggttttttttcgtgttgtttttttgttttttcgggcggttcgtttttgttttttttttttgggtcgttgtgttttcgttgtttttttcgcgtttttttcgtttcgtcgggtcgtttggtttttcggggttcgttcgtcgttgtgttttttttttttttttttttgtgtttgtttttttttttgcgggtttattttagcgtcgatcggtcggtttgtacggttgttttttcgttgtagtatttattagtgtttttttcgttcgttatatcgcgttcgagtaatattatataatacgagcgaggggttagttttgtatatagatgggtgaaggagtaggtatattgatggggtaagattatcgtacggat

SEQ ID NO: 4736 - DNA, 714 bp, Artificial Sequence
  chemically treated genomic DNA (Homo sapiens) CpG-island No: 4736
atccgtacgataatcttaccccatcaatatacctactccttcacccatctatatacaaaactaacccctcgctcgtattatataatattactcgaacgcgatataacgaacgaaaaaaacactaataaatactacaacgaaaaaacaaccgtacaaaccgaccgatcgacgctaaaataaacccgcaaaaaaaaaaacaaacacaaaaaaaaaaaaaaaaaaaacacaacgacgaacgaaccccgaaaaaccaaacgacccgacgaaacgaaaaaaacgcgaaaaaaacaacgaaaacacaacgacccaaaaaaaaaaaacaaaaacgaaccgcccgaaaaaacaaaaaaacaacacgaaaaaaaacccgaccgacgacgacacgacaaacgaaacaaacgaaacccaaaaaaaaaaacccgaaacgaaaaaaacgaaaaaaaaaaacgaaaaaaaaacgaaaaaaaaaaacgaaaaaaaaacgaaaaaacgaacccgaaaaacgaaaaaacgacgaaaacaacacgaaaccgacaaaaaaaaaaaaaacaaaaaaaaaaaaaacgaaaaaacgaaccgaacaaaaaaaacgaacgaaaccccacaaaaaaaccgaaaaccaacgaaaaaaccaaaaaacaaaaacgcaaaaaaaaaaaaaaaaaaaaaaaaaaaacaaaaaaaaaaacgccaaaaaaaaaaaaaaaaaaacaa

SEQ ID NO: 4737 - DNA, 800 bp, Artificial Sequence
  chemically treated genomic DNA (Homo sapiens) CpG-island No: 4737
atatgcgtattgggttttttatcgtttttcgtttttagtaaagtttttcgttcggagtatgcgcgggtcgtttggcgttaattgttgatcgttatagttatagttagggttagtttcgtcggttttcgggtggcgcgcgttcgttgtttttttagttttaggatgatcggttagaagacgttttattttttttttttttttagtttcgttaggaagcgatacgtttttagtttcgagtcggtcgtttaggggatcggcgtggttggggtgtttgaggaaagcggagatgcggcggtgaggcgcggtttgggtcggggttagggggtgaagggggaggaaggcggtgggtttcgtttgacggagggcgtgtaggatcgcgtttttgattcggtaaattcgggtttcgttttttaaatagtttttacgtgtttaaaatagtcgtcgttgttttttatgggtcgttatgttaaagggttagttaatgggaacgcgtttcggggtttatggcgttaattcgcgcgtcgtaggtttttttggttcggtgcgttgtttaattagaggggagagggggcgggatttagagggaggttttttgtcgcgaaaagattacgtggggacgcggtggggcgggtttggcgggggcggggtatttttgtgtagggtttttagttatcgcgacgtttttcgggaagttatagggcgttttttagttcgttttttcgttttagtttagaatttaatttttaattttcggatcgggtttagttttgggtttttattgttcgtttttgttgggattt

SEQ ID NO: 4738 - DNA, 800 bp, Artificial Sequence
  chemically treated genomic DNA (Homo sapiens) CpG-island No: 4738
aaatcccaacaaaaacgaacaataaaaacccaaaactaaacccgatccgaaaattaaaaattaaattctaaactaaaacgaaaaaacgaactaaaaaacgccctataacttcccgaaaaacgtcgcgataactaaaaaccctacacaaaaataccccgcccccgccaaacccgccccaccgcgtccccacgtaatcttttcgcgacaaaaaacctccctctaaatcccgccccctctcccctctaattaaacaacgcaccgaaccaaaaaaacctacgacgcgcgaattaacgccataaaccccgaaacgcgttcccattaactaaccctttaacataacgacccataaaaaacaacgacgactattttaaacacgtaaaaactatttaaaaaacgaaacccgaatttaccgaatcaaaaacgcgatcctacacgccctccgtcaaacgaaacccaccgccttcctcccccttcaccccctaaccccgacccaaaccgcgcctcaccgccgcatctccgctttcctcaaacaccccaaccacgccgatcccctaaacgaccgactcgaaactaaaaacgtatcgcttcctaacgaaactaaaaaaaaaaaaaaaataaaacgtcttctaaccgatcatcctaaaactaaaaaaacaacgaacgcgcgccacccgaaaaccgacgaaactaaccctaactataactataacgatcaacaattaacgccaaacgacccgcgcatactccgaacgaaaaactttactaaaaacgaaaaacgataaaaaacccaatacgcatat

SEQ ID NO: 4739 - DNA, 800 bp, Artificial Sequence
  chemically treated genomic DNA (Homo sapiens) CpG-island No: 4739
aggttttagtaaaagcggatagtaagagtttagggttgggttcggttcgggaattgggaattaggttttaaattggagcggggagacgggttgggaggcgttttatggtttttcgaggagcgtcgcggtgattgggaattttgtatagaggtgtttcgttttcgttagattcgttttatcgcgtttttacgtggttttttcgcggtaaaaaatttttttttgggtttcgtttttttttttttttgattggatagcgtatcgagttaggagggtttgcggcgcgcggattggcgttatgggtttcgagacgcgtttttattggttggttttttagtatggcggtttatgggggatagcggcggttattttgaatacgtggaggttatttggaaagcggagttcgggtttatcgagttagaggcgcgattttgtacgtttttcgttaggcggggtttatcgtttttttttttttttattttttagtttcggtttaagtcgcgttttatcgtcgtattttcgttttttttaggtattttagttacgtcggttttttggacggtcggttcggggttgggggcgtgtcgttttttggcggggttgggggagaaaaaggagtagagcgttttttggtcgattattttggagttgaggaggtagcgaacgcgcgttattcgggaatcggcgaggttagttttggttgtggttgtggcggttagtaattggcgttaagcggttcgcgtatgtttcgagcggggggttttgttgggggcggggggcggtggaaggtttagtgcgtatgt

SEQ ID NO: 4740 - DNA, 800 bp, Artificial Sequence
  chemically treated genomic DNA (Homo sapiens) CpG-island No: 4740
acatacgcactaaaccttccaccgccccccgcccccaacaaaaccccccgctcgaaacatacgcgaaccgcttaacgccaattactaaccgccacaaccacaaccaaaactaacctcgccgattcccgaataacgcgcgttcgctacctcctcaactccaaaataatcgaccaaaaaacgctctactcctttttctcccccaaccccgccaaaaaacgacacgcccccaaccccgaaccgaccgtccaaaaaaccgacgtaactaaaatacctaaaaaaaacgaaaatacgacgataaaacgcgacttaaaccgaaactaaaaaataaaaaaaaaaaaaaacgataaaccccgcctaacgaaaaacgtacaaaatcgcgcctctaactcgataaacccgaactccgctttccaaataacctccacgtattcaaaataaccgccgctatcccccataaaccgccatactaaaaaaccaaccaataaaaacgcgtctcgaaacccataacgccaatccgcgcgccgcaaaccctcctaactcgatacgctatccaatcaaaaaaaaaaaaaaacgaaacccaaaaaaaaattttttaccgcgaaaaaaccacgtaaaaacgcgataaaacgaatctaacgaaaacgaaacacctctatacaaaattcccaatcaccgcgacgctcctcgaaaaaccataaaacgcctcccaacccgtctccccgctccaatttaaaacctaattcccaattcccgaaccgaacccaaccctaaactcttactatccgcttttactaaaacct

SEQ ID NO: 4741 - DNA, 582 bp, Artificial Sequence
  chemically treated genomic DNA (Homo sapiens) CpG-island No: 4741
ggacgtagttcggtgttaggtgttagcgatttgagttcgttttcgggttttatttatttttagttcggtttttagatatttttcgaggcgtttttttttgttcgttcgatttttgagcggagcgtttcggggtgtgaggagaatcggtaaattttcgcgggcgttgggcgtcgtagagtcgtcgcgcgtttagtttcgttacgttggttgtcgagcgtatttcggttgcgttcggcggggaggcgtcgagggtagttaaggggagtaggttacgtgagaggaggagtttgatttattttttaggcggtaggcgtatgcgtattttttatttgcgtttcggtcgggaggtttacgtggaatcgtacgtgtttggttttgtagttaggggtttttggttcggggcgcgtaggggcgggttcgtagtgggattcgcggagaggggcgcggcggggcggagcgtttggagatttagtttgcgggtttcgtaattattattcgtgataattatagtttttggagagttgtttaggttttttgcggggttttttacgaatttattatatttaatattcgtgaatttag

SEQ ID NO: 4742 - DNA, 582 bp, Artificial Sequence
  chemically treated genomic DNA (Homo sapiens) CpG-island No: 4742
ctaaattcacgaatattaaatataataaattcgtaaaaaaccccgcaaaaaacctaaacaactctccaaaaactataattatcacgaataataattacgaaacccgcaaactaaatctccaaacgctccgccccgccgcgcccctctccgcgaatcccactacgaacccgcccctacgcgccccgaaccaaaaacccctaactacaaaaccaaacacgtacgattccacgtaaacctcccgaccgaaacgcaaataaaaaatacgcatacgcctaccgcctaaaaaataaatcaaactcctcctctcacgtaacctactccccttaactaccctcgacgcctccccgccgaacgcaaccgaaatacgctcgacaaccaacgtaacgaaactaaacgcgcgacgactctacgacgcccaacgcccgcgaaaatttaccgattctcctcacaccccgaaacgctccgctcaaaaatcgaacgaacaaaaaaaaacgcctcgaaaaatatctaaaaaccgaactaaaaataaataaaacccgaaaacgaactcaaatcgctaacacctaacaccgaactacgtcc

SEQ ID NO: 4743 - DNA, 582 bp, Artificial Sequence
  chemically treated genomic DNA (Homo sapiens) CpG-island No: 4743
ttgaatttacgaatgttgaatgtgatgaattcgtgggaagtttcgtagggagtttaagtagttttttagaggttgtggttgttacggatgatgattgcgggattcgtagattgagtttttaagcgtttcgtttcgtcgcgttttttttcgcgggttttattgcggattcgtttttgcgcgtttcgggttaggagtttttagttgtaggattaggtacgtgcgattttacgtgagtttttcggtcggagcgtagatgggaagtgcgtatgcgtttatcgtttggaaagtaggttagatttttttttttacgtgatttgttttttttagttattttcggcgttttttcgtcgggcgtagtcgggatgcgttcggtagttaacgtgacggggttgggcgcgcggcggttttgcgacgtttagcgttcgcgaggatttgtcggttttttttatatttcgaagcgtttcgtttagaagtcgggcgggtaaaagggagcgtttcgggaagtatttgggagtcgggttggaaatgaatggggttcggaagcgagtttaaatcgttgatatttggtatcgggttgcgttt

SEQ ID NO: 4744 - DNA, 582 bp, Artificial Sequence
  chemically treated genomic DNA (Homo sapiens) CpG-island No: 4744
aaacgcaacccgataccaaatatcaacgatttaaactcgcttccgaaccccattcatttccaacccgactcccaaatacttcccgaaacgctcccttttacccgcccgacttctaaacgaaacgcttcgaaatataaaaaaaaccgacaaatcctcgcgaacgctaaacgtcgcaaaaccgccgcgcgcccaaccccgtcacgttaactaccgaacgcatcccgactacgcccgacgaaaaaacgccgaaaataactaaaaaaaacaaatcacgtaaaaaaaaaaatctaacctactttccaaacgataaacgcatacgcacttcccatctacgctccgaccgaaaaactcacgtaaaatcgcacgtacctaatcctacaactaaaaactcctaacccgaaacgcgcaaaaacgaatccgcaataaaacccgcgaaaaaaaacgcgacgaaacgaaacgcttaaaaactcaatctacgaatcccgcaatcatcatccgtaacaaccacaacctctaaaaaactacttaaactccctacgaaacttcccacgaattcatcacattcaacattcgtaaattcaa

SEQ ID NO: 4745 - DNA, 509 bp, Artificial Sequence
  chemically treated genomic DNA (Homo sapiens) CpG-island No: 4745
  misc_feature (49)..(49): n is either a, c, g or t
  misc_feature (56)..(56): n is either a, c, g or t
  misc_feature (62)..(62): n is either a, c, g or t
  misc_feature (70)..(70): n is either a, c, g or t
  misc_feature (72)..(72): n is either a, c, g or t
  misc_feature (82)..(82): n is either a, c, g or t
  misc_feature (93)..(93): n is either a, c, g or t
  misc_feature (95)..(95): n is either a, c, g or t
  misc_feature (104)..(104): n is either a, c, g or t
  misc_feature (280)..(280): n is either a, c, g or t
gtttcgttcgtagttttagttgttggtcgcgcgaaggcggtattttttnttggttngtagtnaggtttantntaacgcgttncggggggttgntngttgcgttnatattgcggtcgagtttttttttttggtcgtttttttttttttttcggcggtcgcggttttatgcggttttttgttatttgcggagaatgtttgtgcgaggtttgtgttgttatacggtcgattgtgagcgtgttaaggcgggtgaatggggaggttttagagcgtcgcgttattngtggggtcgggtttcgttgaaaggcggtttcgggtcgggaaggtgcggaaagaatggttttttattggagtttcgaataaaaggtgtggtaggaaggcgaggttttttgcgcgaataaaaattttagcgcgtcggattgacgtttttaaagagttttatattgttttttagagcgggggttttgtgtagtagtttgtttaatagagggacggagaaatgtgcgggggtt

SEQ ID NO: 4746 - DNA, 509 bp, Artificial Sequence
  chemically treated genomic DNA (Homo sapiens) CpG-island No: 4746
  misc_feature (230)..(230): n is either a, c, g or t
  misc_feature (406)..(406): n is either a, c, g or t
  misc_feature (415)..(415): n is either a, c, g or t
  misc_feature (417)..(417): n is either a, c, g or t
  misc_feature (428)..(428): n is either a, c, g or t
  misc_feature (438)..(438): n is either a, c, g or t
  misc_feature (440)..(440): n is either a, c, g or t
  misc_feature (448)..(448): n is either a, c, g or t
  misc_feature (454)..(454): n is either a, c, g or t
  misc_feature (461)..(461): n is either a, c, g or t
aacccccgcacatttctccgtccctctattaaacaaactactacacaaaacccccgctctaaaaaacaatataaaactctttaaaaacgtcaatccgacgcgctaaaatttttattcgcgcaaaaaacctcgccttcctaccacaccttttattcgaaactccaataaaaaaccattctttccgcaccttcccgacccgaaaccgcctttcaacgaaacccgaccccacnaataacgcgacgctctaaaacctccccattcacccgccttaacacgctcacaatcgaccgtataacaacacaaacctcgcacaaacattctccgcaaataacaaaaaaccgcataaaaccgcgaccgccgaaaaaaaaaaaaaaacgaccaaaaaaaaaaactcgaccgcaatatnaacgcaacnancaaccccccgnaacgcgttanantaaacctnactacnaaccaanaaaaaataccgccttcgcgcgaccaacaactaaaactacgaacgaaac

SEQ ID NO: 4747 - DNA, 509 bp, Artificial Sequence
  chemically treated genomic DNA (Homo sapiens) CpG-island No: 4747
  misc_feature (230)..(230): n is either a, c, g or t
  misc_feature (406)..(406): n is either a, c, g or t
  misc_feature (415)..(415): n is either a, c, g or t
  misc_feature (417)..(417): n is either a, c, g or t
  misc_feature (428)..(428): n is either a, c, g or t
  misc_feature (438)..(438): n is either a, c, g or t
  misc_feature (440)..(440): n is either a, c, g or t
  misc_feature (448)..(448): n is either a, c, g or t
  misc_feature (454)..(454): n is either a, c, g or t
  misc_feature (461)..(461): n is either a, c, g or t
aattttcgtatattttttcgtttttttgttgagtagattgttgtataaagttttcgttttgagaagtaatgtggagttttttggggacgttaattcgacgcgttggggtttttgttcgcgtaggggatttcgtttttttattatattttttgttcgggattttaataaaaagttatttttttcgtattttttcggttcggagtcgttttttagcgaggttcggttttatnaatggcgcggcgttttgaggtttttttatttattcgttttggtacgtttataatcggtcgtgtggtagtataggtttcgtataggtatttttcgtaagtgataaggagtcgtataaagtcgcggtcgtcgggggagaagggagggcggttaagggggagagttcggtcgtagtgtnggcgtagtngntagtttttcgnggcgcgttgngntaggtttngttgtnagttagnggaaggtgtcgttttcgcgcggttaatagttgggattgcgagcgaggt

SEQ ID NO: 4748 - DNA, 509 bp, Artificial Sequence
  chemically treated genomic DNA (Homo sapiens) CpG-island No: 4748
  misc_feature (49)..(49): n is either a, c, g or t
  misc_feature (56)..(56): n is either a, c, g or t
  misc_feature (62)..(62): n is either a, c, g or t
  misc_feature (70)..(70): n is either a, c, g or t
  misc_feature (72)..(72): n is either a, c, g or t
  misc_feature (82)..(82): n is either a, c, g or t
  misc_feature (93)..(93): n is either a, c, g or t
  misc_feature (95)..(95): n is either a, c, g or t
  misc_feature (104)..(104): n is either a, c, g or t
  misc_feature (280)..(280): n is either a, c, g or t
acctcgctcgcaatcccaactattaaccgcgcgaaaacgacaccttccnctaactnacaacnaaacctancncaacgcgccncgaaaaactancnactacgccnacactacgaccgaactctcccccttaaccgccctcccttctcccccgacgaccgcgactttatacgactccttatcacttacgaaaaatacctatacgaaacctatactaccacacgaccgattataaacgtaccaaaacgaataaataaaaaaacctcaaaacgccgcgccattnataaaaccgaacctcgctaaaaaacgactccgaaccgaaaaaatacgaaaaaaataactttttattaaaatcccgaacaaaaaatataataaaaaaacgaaatcccctacgcgaacaaaaaccccaacgcgtcgaattaacgtccccaaaaaactccacattacttctcaaaacgaaaactttatacaacaatctactcaacaaaaaaacgaaaaaatatacgaaaatt

SEQ ID NO: 4749 - DNA, 607 bp, Artificial Sequence
  chemically treated genomic DNA (Homo sapiens) CpG-island No: 4749
  misc_feature (314)..(314): n is either a, c, g or t
aatttaattatcggagttattttgttttaggagcggtcgtggagaaagtaattagtcgagagttcgcgttttagagaaggtaagcggtaatagggtcgtatagcgttatttatttgatgagttttttcgcgggttttgatagcggagtttaggtacgacgattttttaattgggcgcgatttaaagtatcggggcgggtattagagttcgagcgttttaggggattggttatattggcggacgtacgtgttgttgattaagttggttcgttttcgggttcggttcgtggagagtcggttttttcgtgagttttnttgttagttattggtattttgcggtttttttggggacgaggcggtttcgtcgatcggatttttttttcggttgggtaaggggtcgcggggagtagttcgggattgaatcgagaggtgtcgaaggaatcggcgggtcgtttgatttcgtgagtgtgggcgcgagagggttgtgggattcggagggacggggagaggaagcgggatttatatttcgttatttggggacgatcggtttttagaggatagagttggtttacgagaacgtttcgtttttaggatgttcgggtagggtt

SEQ ID NO: 4750 - DNA, 607 bp, Artificial Sequence
  chemically treated genomic DNA (Homo sapiens) CpG-island No: 4750
  misc_feature (294)..(294): n is either a, c, g or t
aaccctacccgaacatcctaaaaacgaaacgttctcgtaaaccaactctatcctctaaaaaccgatcgtccccaaataacgaaatataaatcccgcttcctctccccgtccctccgaatcccacaaccctctcgcgcccacactcacgaaatcaaacgacccgccgattccttcgacacctctcgattcaatcccgaactactccccgcgaccccttacccaaccgaaaaaaaaatccgatcgacgaaaccgcctcgtccccaaaaaaaccgcaaaataccaataactaacaanaaaactcacgaaaaaaccgactctccacgaaccgaacccgaaaacgaaccaacttaatcaacaacacgtacgtccgccaatataaccaatcccctaaaacgctcgaactctaatacccgccccgatactttaaatcgcgcccaattaaaaaatcgtcgtacctaaactccgctatcaaaacccgcgaaaaaactcatcaaataaataacgctatacgaccctattaccgcttaccttctctaaaacgcgaactctcgactaattactttctccacgaccgctcctaaaacaaaataactccgataattaaatt

SEQ ID NO: 4751 - DNA, 607 bp, Artificial Sequence
  chemically treated genomic DNA (Homo sapiens) CpG-island No: 4751
  misc_feature (294)..(294): n is either a, c, g or t
gattttattcgggtattttgggagcggggcgttttcgtgggttagttttgttttttaggaatcggtcgtttttaggtggcggggtgtgggtttcgtttttttttttcgttttttcgggttttatagttttttcgcgtttatatttacgggattaagcggttcgtcggttttttcggtatttttcggtttagtttcgagttgtttttcgcggttttttgtttagtcggaaagagggttcggtcggcggggtcgtttcgtttttaaggaaatcgtaggatgttaatgattgatagnaagatttacggaggggtcggttttttacgagtcgaattcgggggcgaattagtttggttagtagtacgtgcgttcgttagtgtggttaattttttagagcgttcgggttttgatgttcgtttcggtattttgagtcgcgtttaattggaaagtcgtcgtatttaggtttcgttgttagggttcgcggaagagtttattaggtgagtggcgttgtgcggttttgttgtcgtttattttttttggggcgcgaattttcggttggttgttttttttacggtcgtttttgggatagagtagtttcggtagttgggtt

SEQ ID NO: 4752 - DNA, 607 bp, Artificial Sequence
  chemically treated genomic DNA (Homo sapiens) CpG-island No: 4752
  misc_feature (314)..(314): n is either a, c, g or t
aacccaactaccgaaactactctatcccaaaaacgaccgtaaaaaaaacaaccaaccgaaaattcgcgccccaaaaaaaataaacgacaacaaaaccgcacaacgccactcacctaataaactcttccgcgaaccctaacaacgaaacctaaatacgacgactttccaattaaacgcgactcaaaataccgaaacgaacatcaaaacccgaacgctctaaaaaattaaccacactaacgaacgcacgtactactaaccaaactaattcgcccccgaattcgactcgtaaaaaaccgacccctccgtaaatcttnctatcaatcattaacatcctacgatttccttaaaaacgaaacgaccccgccgaccgaaccctctttccgactaaacaaaaaaccgcgaaaaacaactcgaaactaaaccgaaaaataccgaaaaaaccgacgaaccgcttaatcccgtaaatataaacgcgaaaaaactataaaacccgaaaaaacgaaaaaaaaaaacgaaacccacaccccgccacctaaaaacgaccgattcctaaaaaacaaaactaacccacgaaaacgccccgctcccaaaatacccgaataaaatc

SEQ ID NO: 4753 - DNA, 584 bp, Artificial Sequence
  chemically treated genomic DNA (Homo sapiens) CpG-island No: 4753
  misc_feature (22)..(22): n is either a, c, g or t
  misc_feature (50)..(50): n is either a, c, g or t
  misc_feature (63)..(63): n is either a, c, g or t
  misc_feature (77)..(77): n is either a, c, g or t
  misc_feature (93)..(93): n is either a, c, g or t
  misc_feature (176)..(176): n is either a, c, g or t
  misc_feature (183)..(183): n is either a, c, g or t
  misc_feature (362)..(362): n is either a, c, g or t
  misc_feature (380)..(380): n is either a, c, g or t
  misc_feature (430)..(430): n is either a, c, g or t
  misc_feature (556)..(556): n is either a, c, g or t
agtgtcgggcgttggggtttgnaggagtatcgagttcggttagagggttnaatattttagatntcgattagagtttnagcgggtcgtcgcggnttttttttggaggtgaggcggtttttagttcgtatgtcgtaacggtttttcggataggttgcgggtcgcgttagttagggatngatcggntttagggcggtttcgttttacgttcgcgacgagatttcgcgggaatacggtttttcggggttagggtcgttcgttttttagttacgcgttttagaatttgaggagcgtacgggagcgcgggtcgtaacggcgttcgttagtagtttgacgttgaaggtttgtcgtcgtttcgttttcgnacgcgatttcgcgtatangggatcgtagttttgtaggcgttagtgaggggttcgaagtcggtttttangagtttttgggcgcgtcgttttttttgtagttaatcggggatcgacgtggtgcgggttaatggtcgcggttaaagtattaagagtggttgagtttattaaagtttagttttaagtttttttcgttntttttaaaagttagaggcgggttgatcg

SEQ ID NO: 4754 - DNA, 584 bp, Artificial Sequence
  chemically treated genomic DNA (Homo sapiens) CpG-island No: 4754
  misc_feature (29)..(29): n is either a, c, g or t
  misc_feature (155)..(155): n is either a, c, g or t
  misc_feature (205)..(205): n is either a, c, g or t
  misc_feature (223)..(223): n is either a, c, g or t
  misc_feature (402)..(402): n is either a, c, g or t
  misc_feature (409)..(409): n is either a, c, g or t
  misc_feature (492)..(492): n is either a, c, g or t
  misc_feature (508)..(508): n is either a, c, g or t
  misc_feature (522)..(522): n is either a, c, g or t
  misc_feature (535)..(535): n is either a, c, g or t
  misc_feature (563)..(563): n is either a, c, g or t
cgatcaacccgcctctaacttttaaaaanaacgaaaaaaacttaaaactaaactttaataaactcaaccactcttaatactttaaccgcgaccattaacccgcaccacgtcgatccccgattaactacaaaaaaaacgacgcgcccaaaaactcntaaaaaccgacttcgaacccctcactaacgcctacaaaactacgatcccntatacgcgaaatcgcgtncgaaaacgaaacgacgacaaaccttcaacgtcaaactactaacgaacgccgttacgacccgcgctcccgtacgctcctcaaattctaaaacgcgtaactaaaaaacgaacgaccctaaccccgaaaaaccgtattcccgcgaaatctcgtcgcgaacgtaaaacgaaaccgccctaaanccgatcnatccctaactaacgcgacccgcaacctatccgaaaaaccgttacgacatacgaactaaaaaccgcctcacctccaaaaaaaanccgcgacgacccgctnaaactctaatcganatctaaaatattnaaccctctaaccgaactcgatactcctncaaaccccaacgcccgacact

SEQ ID NO: 4755 - DNA, 584 bp, Artificial Sequence
  chemically treated genomic DNA (Homo sapiens) CpG-island No: 4755
  misc_feature (29)..(29): n is either a, c, g or t
  misc_feature (155)..(155): n is either a, c, g or t
  misc_feature (205)..(205): n is either a, c, g or t
  misc_feature (223)..(223): n is either a, c, g or t
  misc_feature (402)..(402): n is either a, c, g or t
  misc_feature (409)..(409): n is either a, c, g or t
  misc_feature (492)..(492): n is either a, c, g or t
  misc_feature (508)..(508): n is either a, c, g or t
  misc_feature (522)..(522): n is either a, c, g or t
  misc_feature (535)..(535): n is either a, c, g or t
  misc_feature (563)..(563): n is either a, c, g or t
cgattaattcgtttttgatttttagaagnggcgggagaaatttaaggttgaattttgataggtttaattatttttgatattttgatcgcggttattggttcgtattacgtcggttttcgattggttatagaaagagcgacgcgtttagggatttntaggggtcgatttcgggttttttattagcgtttgtagagttgcggttttntgtgcgcgggatcgcgtncgggggcggggcggcgataggtttttaacgttaaattgttgacgggcgtcgttacgattcgcgttttcgtgcgttttttaaattttgagacgcgtggttggagagcgggcggttttggtttcggagagtcgtgttttcgcgggatttcgtcgcgggcgtgaggcggggtcgttttgggntcggttnatttttggttggcgcgattcgtagtttgttcgggaagtcgttgcgatatgcgggttgggaatcgttttatttttaggggggantcgcggcggttcgttnagattttggtcggngtttggagtattnggttttttggtcggattcggtgtttttntaggttttagcgttcggtatt

SEQ ID NO: 4756 - DNA, 584 bp, Artificial Sequence
  chemically treated genomic DNA (Homo sapiens) CpG-island No: 4756
  misc_feature (22)..(22): n is either a, c, g or t
  misc_feature (50)..(50): n is either a, c, g or t
  misc_feature (63)..(63): n is either a, c, g or t
  misc_feature (77)..(77): n is either a, c, g or t
  misc_feature (93)..(93): n is either a, c, g or t
  misc_feature (176)..(176): n is either a, c, g or t
  misc_feature (183)..(183): n is either a, c, g or t
  misc_feature (362)..(362): n is either a, c, g or t
  misc_feature (380)..(380): n is either a, c, g or t
  misc_feature (430)..(430): n is either a, c, g or t
  misc_feature (556)..(556): n is either a, c, g or t
aataccgaacgctaaaacctanaaaaacaccgaatccgaccaaaaaaccnaatactccaaacnccgaccaaaatctnaacgaaccgccgcgantcccccctaaaaataaaacgattcccaacccgcatatcgcaacgacttcccgaacaaactacgaatcgcgccaaccaaaaatnaaccgancccaaaacgaccccgcctcacgcccgcgacgaaatcccgcgaaaacacgactctccgaaaccaaaaccgcccgctctccaaccacgcgtctcaaaatttaaaaaacgcacgaaaacgcgaatcgtaacgacgcccgtcaacaatttaacgttaaaaacctatcgccgccccgcccccgnacgcgatcccgcgcacanaaaaccgcaactctacaaacgctaataaaaaacccgaaatcgacccctanaaatccctaaacgcgtcgctctttctataaccaatcgaaaaccgacgtaatacgaaccaataaccgcgatcaaaatatcaaaaataattaaacctatcaaaattcaaccttaaatttctcccgccncttctaaaaatcaaaaacgaattaatcg

SEQ ID NO: 4757 - DNA, 623 bp, Artificial Sequence
  chemically treated genomic DNA (Homo sapiens) CpG-island No: 4757
  misc_feature (2)..(2): n is either a, c, g or t
  misc_feature (9)..(9): n is either a, c, g or t
  misc_feature (25)..(25): n is either a, c, g or t
  misc_feature (69)..(69): n is either a, c, g or t
  misc_feature (99)..(99): n is either a, c, g or t
  misc_feature (109)..(110): n is either a, c, g or t
  misc_feature (119)..(119): n is either a, c, g or t
  misc_feature (131)..(131): n is either a, c, g or t
  misc_feature (273)..(273): n is either a, c, g or t
  misc_feature (358)..(358): n is either a, c, g or t
  misc_feature (472)..(472): n is either a, c, g or t
  misc_feature (493)..(493): n is either a, c, g or t
tnatcggtntgatttttcgaacgtnaaggaaaggggtgggtttaatttggcgtttttattaatggtttntttggggggtttgttcgcggggttaagtanggattcggannatttcgaantttcgggttcgnttcggaggcgaatattacggggtcggggggcggcggcggtagtggtggtaggggtagcgagggtgggcgataaagttggttcgggtggatggagatagaaggatagggggttggcggtagggcgggggcgttagtcgaaganattagttaagttttaacgagatcgcgttattagacgcgtgattgaagcgcggagtggatcgaagggtcggcgatagaatagaagncgttgtaggttttcggtacgataagattcggatttcggttcggattacgagcgttgtcgttggagttattgttattacgtatatggtggtaggcgtcgtggtagggattttggnagtattgcgtgatgtattttnatcgattgcgttaaggtgagatttgtattcggtttcgaattcgatttggggttgattcgatttttgggttttgttcggagttaggaatttcgttgagagtcggagtcgatatgggtttttttttggtttt

SEQ ID NO: 4758 - DNA, 623 bp, Artificial Sequence
  chemically treated genomic DNA (Homo sapiens) CpG-island No: 4758
  misc_feature (131)..(131): n is either a, c, g or t
  misc_feature (152)..(152): n is either a, c, g or t
  misc_feature (266)..(266): n is either a, c, g or t
  misc_feature (351)..(351): n is either a, c, g or t
  misc_feature (493)..(493): n is either a, c, g or t
  misc_feature (505)..(505): n is either a, c, g or t
  misc_feature (514)..(515): n is either a, c, g or t
  misc_feature (525)..(525): n is either a, c, g or t
  misc_feature (555)..(555): n is either a, c, g or t
  misc_feature (599)..(599): n is either a, c, g or t
  misc_feature (615)..(615): n is either a, c, g or t
  misc_feature (622)..(622): n is either a, c, g or t
aaaaccaaaaaaaaacccatatcgactccgactctcaacgaaattcctaactccgaacaaaacccaaaaatcgaatcaaccccaaatcgaattcgaaaccgaatacaaatctcaccttaacgcaatcgatnaaaatacatcacgcaatactnccaaaatccctaccacgacgcctaccaccatatacgtaataacaataactccaacgacaacgctcgtaatccgaaccgaaatccgaatcttatcgtaccgaaaacctacaacgncttctattctatcgccgacccttcgatccactccgcgcttcaatcacgcgtctaataacgcgatctcgttaaaacttaactaatntcttcgactaacgcccccgccctaccgccaaccccctatccttctatctccatccacccgaaccaactttatcgcccaccctcgctacccctaccaccactaccgccgccgccccccgaccccgtaatattcgcctccgaancgaacccgaaanttcgaaatnntccgaatccntacttaaccccgcgaacaaaccccccaaanaaaccattaataaaaacgccaaattaaacccacccctttccttnacgttcgaaaaatcanaccgatna

SEQ ID NO: 4759 - DNA, 623 bp, Artificial Sequence
  chemically treated genomic DNA (Homo sapiens) CpG-island No: 4759
  misc_feature (131)..(131): n is either a, c, g or t
  misc_feature (152)..(152): n is either a, c, g or t
  misc_feature (266)..(266): n is either a, c, g or t
  misc_feature (351)..(351): n is either a, c, g or t
  misc_feature (493)..(493): n is either a, c, g or t
  misc_feature (505)..(505): n is either a, c, g or t
  misc_feature (514)..(515): n is either a, c, g or t
  misc_feature (525)..(525): n is either a, c, g or t
  misc_feature (555)..(555): n is either a, c, g or t
  misc_feature (599)..(599): n is either a, c, g or t
  misc_feature (615)..(615): n is either a, c, g or t
  misc_feature (622)..(622): n is either a, c, g or t
ggagttaggaaggaatttatgtcggtttcggtttttagcgggatttttggtttcggataagatttaggggtcgggttagttttaggtcgggttcgaagtcgggtgtaggttttattttgacgtagtcgatnggggtatattacgtagtgttnttaggatttttgttacggcgtttgttattatgtgcgtggtgatagtggttttagcggtagcgttcgtagttcgggtcggagttcggattttgtcgtatcgggggtttgtagcgntttttattttgtcgtcggtttttcggtttatttcgcgttttagttacgcgtttagtagcgcggtttcgttggggtttagttgatnttttcggttggcgttttcgttttatcgttagttttttgtttttttatttttatttattcgggttagttttgtcgtttattttcgttgtttttgttattattgtcgtcgtcgtttttcggtttcgtagtgttcgttttcgggncgggttcgaganttcggggtnnttcggatttntgtttggtttcgcggataggttttttaagnggattattggtggagacgttaagttagatttatttttttttttnacgttcgaaaaattangtcggtna

SEQ ID NO: 4760 - DNA, 623 bp, Artificial Sequence
  chemically treated genomic DNA (Homo sapiens) CpG-island No: 4760
  misc_feature (2)..(2): n is either a, c, g or t
  misc_feature (9)..(9): n is either a, c, g or t
  misc_feature (25)..(25): n is either a, c, g or t
  misc_feature (69)..(69): n is either a, c, g or t
  misc_feature (99)..(99): n is either a, c, g or t
  misc_feature (109)..(110): n is either a, c, g or t
  misc_feature (119)..(119): n is either a, c, g or t
  misc_feature (131)..(131): n is either a, c, g or t
  misc_feature (273)..(273): n is either a, c, g or t
  misc_feature (358)..(358): n is either a, c, g or t
  misc_feature (472)..(472): n is either a, c, g or t
  misc_feature (493)..(493): n is either a, c, g or t
tnaccgacntaatttttcgaacgtnaaaaaaaaaaataaatctaacttaacgtctccaccaataatccncttaaaaaacctatccgcgaaaccaaacanaaatccgaannaccccgaantctcgaacccgncccgaaaacgaacactacgaaaccgaaaaacgacgacgacaataataacaaaaacaacgaaaataaacgacaaaactaacccgaataaataaaaataaaaaaacaaaaaactaacgataaaacgaaaacgccaaccgaaaanatcaactaaaccccaacgaaaccgcgctactaaacgcgtaactaaaacgcgaaataaaccgaaaaaccgacgacaaaataaaaancgctacaaacccccgatacgacaaaatccgaactccgacccgaactacgaacgctaccgctaaaaccactatcaccacgcacataataacaaacgccgtaacaaaaatcctaanaacactacgtaatataccccnatcgactacgtcaaaataaaacctacacccgacttcgaacccgacctaaaactaacccgacccctaaatcttatccgaaaccaaaaatcccgctaaaaaccgaaaccgacataaattccttcctaactcc

SEQ ID NO: 4761 - DNA, 568 bp, Artificial Sequence
  chemically treated genomic DNA (Homo sapiens) CpG-island No: 4761
  misc_feature (337)..(337): n is either a, c, g or t
  misc_feature (444)..(444): n is either a, c, g or t
aacgcgtcggggttggataacgcgttgtcggggtttggcggtatagcgaaagggttggtgaaagtacgcggtacggtggaagcgttataattattggtagatattatcgcgcgcggtttgcgttggtaggaatttttcgtggcgtaggttcgcgtggaaggcgatattaaatttatcgattagatcgtcgggaaattcgacgtacgcgttgagtaaatttcgtagtcggatgtaaatattaatttcgttattttgaatgttaaaggtagcgaaaagtagtacgagttatagttgcggatttagggggagtttgttttcgggtagtttaatttggtangaagttttgatcgtaaagaagaaacgttggagggaatttttagtatattcgtttttagaacgtcgttggtcgggtcgttgatcgcgatatgcgttgattatcgatangagtaaaatagatcgttaattgtgttatcgatgcgattgttgcgaatatatcgggcgaagcggcgggattacgtgatttatgtacgttcgatatagtagattacgaaggtttgaattagagtcg

SEQ ID NO: 4762 - DNA, 568 bp, Artificial Sequence
  chemically treated genomic DNA (Homo sapiens) CpG-island No: 4762
  misc_feature (125)..(125): n is either a, c, g or t
  misc_feature (232)..(232): n is either a, c, g or t
cgactctaattcaaaccttcgtaatctactatatcgaacgtacataaatcacgtaatcccgccgcttcgcccgatatattcgcaacaatcgcatcgataacacaattaacgatctattttactcntatcgataatcaacgcatatcgcgatcaacgacccgaccaacgacgttctaaaaacgaatatactaaaaattccctccaacgtttcttctttacgatcaaaacttcntaccaaattaaactacccgaaaacaaactccccctaaatccgcaactataactcgtactacttttcgctacctttaacattcaaaataacgaaattaatatttacatccgactacgaaatttactcaacgcgtacgtcgaatttcccgacgatctaatcgataaatttaatatcgccttccacgcgaacctacgccacgaaaaattcctaccaacgcaaaccgcgcgcgataatatctaccaataattataacgcttccaccgtaccgcgtactttcaccaaccctttcgctataccgccaaaccccgacaacgcgttatccaaccccgacgcgtt

SEQ ID NO: 4763 - DNA, 568 bp, Artificial Sequence
  chemically treated genomic DNA (Homo sapiens) CpG-island No: 4763
  misc_feature (125)..(125): n is either a, c, g or t
  misc_feature (232)..(232): n is either a, c, g or t
cgattttggtttagattttcgtaatttgttatgtcgaacgtatatgagttacgtaatttcgtcgtttcgttcgatatgttcgtagtagtcgtatcggtagtatagttggcgatttattttgtttntatcggtaattagcgtatatcgcggttagcgattcggttaacggcgttttggaagcgggtatgttaagagttttttttagcgttttttttttgcgattaaaattttntgttagattaagttgttcggagataggttttttttgaattcgtaattgtagttcgtgttgtttttcgttgtttttggtatttagggtgacgaggttgatatttatattcggttgcgaaatttgtttaacgcgtacgtcgagtttttcggcgatttgatcggtggatttgatatcgttttttacgcgaatttgcgttacggaaagtttttgttagcgtaggtcgcgcgcggtgatatttgttagtagttgtggcgtttttatcgtgtcgcgtatttttattagttttttcgttgtatcgttaagtttcggtagcgcgttatttagtttcggcgcgtt

SEQ ID NO: 4764 - DNA, 568 bp, Artificial Sequence
  chemically treated genomic DNA (Homo sapiens) CpG-island No: 4764
  misc_feature (337)..(337): n is either a, c, g or t
  misc_feature (444)..(444): n is either a, c, g or t
aacgcgccgaaactaaataacgcgctaccgaaacttaacgatacaacgaaaaaactaataaaaatacgcgacacgataaaaacgccacaactactaacaaatatcaccgcgcgcgacctacgctaacaaaaactttccgtaacgcaaattcgcgtaaaaaacgatatcaaatccaccgatcaaatcgccgaaaaactcgacgtacgcgttaaacaaatttcgcaaccgaatataaatatcaacctcgtcaccctaaataccaaaaacaacgaaaaacaacacgaactacaattacgaattcaaaaaaaacctatctccgaacaacttaatctaacanaaaattttaatcgcaaaaaaaaaacgctaaaaaaaactcttaacatacccgcttccaaaacgccgttaaccgaatcgctaaccgcgatatacgctaattaccgatanaaacaaaataaatcgccaactatactaccgatacgactactacgaacatatcgaacgaaacgacgaaattacgtaactcatatacgttcgacataacaaattacgaaaatctaaaccaaaatcg

SEQ ID NO: 4765 - DNA, 661 bp, Artificial Sequence
  chemically treated genomic DNA (Homo sapiens) CpG-island No: 4765
cgggtagaagtttcgcgtttcggttgtatttcgcgtatttgttcgtggcgcgttagtagcgcgggttaggcgtagaagcgtagtattagtaggttgcgcgttagtttttaggttcgttagttgtagtacgttttttacgcgttgtcgaagtttacggcgggtattagcggtcgtattgttttggtcgatttacgttttggtacggtttttgggttcgcggcgggttgttcgttggcggtcggcgtcgtggatagcggcgcgaagcggggaatgtaggggcgtagcgcgggtaagacgcgtcgtaaagttatggcgggacgtcggtattcgttcgggtcgtttaagtatgcgttattggtttcgtttcgttttttttcgtttcgtatgttttttagtcgcgttttttttttagaagttttacgtttcgagtcgcgtttatttttcgggagatatcgttttattttaggggtttcgtttttttttagtatttgtattcgttttttttgaggtttcgtttcgttcgtcgtagggtttacgttttttttacgtgagtttttcgtttcgcgttttaagtagttttttttttttagtagacgtcggtttattttacgattttagtttttatttttggagaatttatttcgaagttttaattttattt

SEQ ID NO: 4766 - DNA, 661 bp, Artificial Sequence
  chemically treated genomic DNA (Homo sapiens) CpG-island No: 4766
aaataaaattaaaacttcgaaataaattctccaaaaataaaaactaaaatcgtaaaataaaccgacgtctactaaaaaaaaaaaactacttaaaacgcgaaacgaaaaactcacgtaaaaaaaacgtaaaccctacgacgaacgaaacgaaacctcaaaaaaaacgaatacaaatactaaaaaaaaacgaaacccctaaaataaaacgatatctcccgaaaaataaacgcgactcgaaacgtaaaacttctaaaaaaaaaacgcgactaaaaaacatacgaaacgaaaaaaaacgaaacgaaaccaataacgcatacttaaacgacccgaacgaataccgacgtcccgccataactttacgacgcgtcttacccgcgctacgcccctacattccccgcttcgcgccgctatccacgacgccgaccgccaacgaacaacccgccgcgaacccaaaaaccgtaccaaaacgtaaatcgaccaaaacaatacgaccgctaatacccgccgtaaacttcgacaacgcgtaaaaaacgtactacaactaacgaacctaaaaactaacgcgcaacctactaatactacgcttctacgcctaacccgcgctactaacgcgccacgaacaaatacgcgaaatacaaccgaaacgcgaaacttctacccg

SEQ ID NO: 4767 - DNA, 661 bp, Artificial Sequence
  chemically treated genomic DNA (Homo sapiens) CpG-island No: 4767
gggtggggttgggatttcgggatgggttttttagaggtgagagttggggtcgtagggtggatcggcgtttgttgaggaaagggagttgtttggagcgcggggcgagggatttacgtggagaaggcgtgggttttacggcgggcggggcggggttttaagaagagcgggtgtagatgttagggaggggcggggtttttgggatggggcggtgtttttcgaggagtgggcgcggttcggagcgtgggatttttaaggagagagcgcggttagggggtatgcggggcggggaggggcggggcgggattaatagcgtatatttaagcggttcgggcgggtatcggcgtttcgttatggttttgcggcgcgttttgttcgcgttgcgtttttatatttttcgtttcgcgtcgttgtttacggcgtcggtcgttagcgagtagttcgtcgcgggtttaggggtcgtgttaggacgtgggtcggttagggtagtgcggtcgttggtgttcgtcgtggatttcggtaacgcgtaggaggcgtattgtagttggcgaatttgggagttggcgcgtagtttgttggtgttgcgtttttgcgtttggttcgcgttgttggcgcgttacgagtaggtgcgcggggtgtagtcggggcgcggggtttttgttcg

SEQ ID NO: 4768 - DNA, 661 bp, Artificial Sequence
  chemically treated genomic DNA (Homo sapiens) CpG-island No: 4768
cgaacaaaaaccccgcgccccgactacaccccgcgcacctactcgtaacgcgccaacaacgcgaaccaaacgcaaaaacgcaacaccaacaaactacgcgccaactcccaaattcgccaactacaatacgcctcctacgcgttaccgaaatccacgacgaacaccaacgaccgcactaccctaaccgacccacgtcctaacacgacccctaaacccgcgacgaactactcgctaacgaccgacgccgtaaacaacgacgcgaaacgaaaaatataaaaacgcaacgcgaacaaaacgcgccgcaaaaccataacgaaacgccgatacccgcccgaaccgcttaaatatacgctattaatcccgccccgcccctccccgccccgcataccccctaaccgcgctctctccttaaaaatcccacgctccgaaccgcgcccactcctcgaaaaacaccgccccatcccaaaaaccccgcccctccctaacatctacacccgctcttcttaaaaccccgccccgcccgccgtaaaacccacgccttctccacgtaaatccctcgccccgcgctccaaacaactccctttcctcaacaaacgccgatccaccctacgaccccaactctcacctctaaaaaacccatcccgaaatcccaaccccaccc

SEQ ID NO: 4769 - DNA, 751 bp, Artificial Sequence
  chemically treated genomic DNA (Homo sapiens) CpG-island No: 4769
cgtttttgtaaaaattcgttcgttaattttttggtggtcggggcgtttcgaggtcgggtttcgtttttttagtttacggttttcgttttcgatttggtttagtatcggggattttcggatcgttattttcggttttgtcgaagtcgttaattttttcgggaagcggtaattttttttgtcgttttcggtttcgttttttcggggtcggggcgttagcggttttagtttggcgcggtattgcggtggttttttttgtcgttcggttacgtttttttcgtttcggtagttcgggacgggttttgcggtttcggggagggggcgagtcgttttttttcgcgtttcgtcgcggtcgggttcgggtgtagcgcggatatttatttttagcggacgttttttttatcgtaggggttgggcggggcgcgtcggagattgaaagtcgtttcggggcgggcgttcgttttttcgcggtcgggttcgtatataggcgttcgcgttataggtcggtttcggttcggtcgtaggattaggattcgcgcgttacgtttttttcggtttcggttagttttcggttcgtcgatgtttaggtttattagggataatattgaaggtagtatagggttaacgtgcgcggtattattttttcggttattttcgcggttcgcggtttaatagatatagttcgttacggcgtataagcgagggtttttttttcgcggtttcgtcgattacggtcgtttttgggggtaatttt

SEQ ID NO: 4770 - DNA, 751 bp, Artificial Sequence
  chemically treated genomic DNA (Homo sapiens) CpG-island No: 4770
aaaattacccccaaaaacgaccgtaatcgacgaaaccgcgaaaaaaaaaccctcgcttatacgccgtaacgaactatatctattaaaccgcgaaccgcgaaaataaccgaaaaaataataccgcgcacgttaaccctatactaccttcaatattatccctaataaacctaaacatcgacgaaccgaaaactaaccgaaaccgaaaaaaacgtaacgcgcgaatcctaatcctacgaccgaaccgaaaccgacctataacgcgaacgcctatatacgaacccgaccgcgaaaaaacgaacgcccgccccgaaacgactttcaatctccgacgcgccccgcccaacccctacgataaaaaaaacgtccgctaaaaataaatatccgcgctacacccgaacccgaccgcgacgaaacgcgaaaaaaaacgactcgccccctccccgaaaccgcaaaacccgtcccgaactaccgaaacgaaaaaaacgtaaccgaacgacaaaaaaaaccaccgcaataccgcgccaaactaaaaccgctaacgccccgaccccgaaaaaacgaaaccgaaaacgacaaaaaaaattaccgcttcccgaaaaaattaacgacttcgacaaaaccgaaaataacgatccgaaaatccccgatactaaaccaaatcgaaaacgaaaaccgtaaactaaaaaaacgaaacccgacctcgaaacgccccgaccaccaaaaaattaacgaacgaatttttacaaaaacg

SEQ ID NO: 4771 - DNA, 751 bp, Artificial Sequence
  chemically treated genomic DNA (Homo sapiens) CpG-island No: 4771
ggggttgtttttaaaagcggtcgtaatcgacggggtcgcggggggggggttttcgtttgtacgtcgtggcggattgtgtttattgggtcgcgggtcgcgggggtggtcgggaggatagtgtcgcgtacgttggttttgtgttgtttttaatattatttttgatgggtttgggtatcggcgaatcgagggttggtcggagtcgggggaagcgtagcgcgcggattttagttttgcgatcgggtcggggtcggtttgtaacgcgggcgtttgtatgcggattcggtcgcggggagacgggcgttcgtttcgaaacgatttttagttttcggcgcgtttcgtttaatttttacgatgaagagggcgttcgttggaggtgagtgttcgcgttgtattcgagttcggtcgcggcggggcgcggaggggggcggttcgtttttttttcggagtcgtagggttcgtttcgggttgtcgaggcgagggaagcgtagtcgggcggtagggaaagttatcgtagtgtcgcgttaggttggggtcgttggcgtttcggtttcgggagggcggagtcggaggcggtaggaaaagttgtcgtttttcgggaaagttgacggtttcggtagggtcgagggtggcggttcgagggttttcgatgttgggttaagtcgagggcgggggtcgtgggttggaagggcggggttcggtttcggagcgtttcggttattaaggggttaacgagcgggtttttgtagaaacg

SEQ ID NO: 4772 - DNA, 751 bp, Artificial Sequence
  chemically treated genomic DNA (Homo sapiens) CpG-island No: 4772
cgtttctacaaaaacccgctcgttaaccccttaataaccgaaacgctccgaaaccgaaccccgcccttccaacccacgacccccgccctcgacttaacccaacatcgaaaaccctcgaaccgccaccctcgaccctaccgaaaccgtcaactttcccgaaaaacgacaacttttcctaccgcctccgactccgccctcccgaaaccgaaacgccaacgaccccaacctaacgcgacactacgataactttccctaccgcccgactacgcttccctcgcctcgacaacccgaaacgaaccctacgactccgaaaaaaaaacgaaccgcccccctccgcgccccgccgcgaccgaactcgaatacaacgcgaacactcacctccaacgaacgccctcttcatcgtaaaaattaaacgaaacgcgccgaaaactaaaaatcgtttcgaaacgaacgcccgtctccccgcgaccgaatccgcatacaaacgcccgcgttacaaaccgaccccgacccgatcgcaaaactaaaatccgcgcgctacgcttcccccgactccgaccaaccctcgattcgccgatacccaaacccatcaaaaataatattaaaaacaacacaaaaccaacgtacgcgacactatcctcccgaccacccccgcgacccgcgacccaataaacacaatccgccacgacgtacaaacgaaaaccccccccccgcgaccccgtcgattacgaccgcttttaaaaacaacccc

SEQ ID NO: 4773 - DNA, 874 bp, Artificial Sequence
  chemically treated genomic DNA (Homo sapiens) CpG-island No: 4773
ggcgcgtcggcgcggagttcggatttcggttcgtaatgatttagtaagggtcggtgggatttttcgtggttttgcgatatttagacggcggagtttcgtttttaatgtcgcgcggggagtaggtaggtgcgagtttgggttgagtaaaattttttttggagttttcgtagaggagcggggcgcgttttttgaataagtaggcggcggggcgcggggtagggcggggtaggcggttaggttttttcgggattgtcgtaaaagggggcggagcgcgtcgcgcgtgggataatcgtaaaaggggcgggacgcgtcgcgttcgggatgtcgtgaagttgggggagttcgtcgtcgtcgtcggcggttagcgggcgttcgcgttatggagcgttacgcggtcgttttggaggaggtggcggacggtgttcggtagtaggagcgatattattagttgttgtcggcgttatagagtttggtgaaggagttgtttaggtacgtaggcggggcgggcggaggtttgcggaggcggtttcgtttttcgtcggggtttatcgcgtttttttattcgtagttttttttagtagcgtttgttttatattacgtttagcgatttggttttggcgtttttcgacggtatcgtgttcgaaatcgtgtaggggttattggagatttagtattttatcgaaaagagtttgtataattagcgtttgcgtttatagaacgagtatcgaggtgcgcgggggtagcgggatgaggtgtcgtttttttcgggtcggcgttttcgggtagtttttggtatttgtgtagattagttttttttttggaagtgttcggaagaggtttttaagattgataaaattaacgggcgtagagattg

SEQ ID NO: 4774 - DNA, 874 bp, Artificial Sequence
  chemically treated genomic DNA (Homo sapiens) CpG-island No: 4774
caatctctacgcccgttaattttatcaatcttaaaaacctcttccgaacacttccaaaaaaaaaactaatctacacaaataccaaaaactacccgaaaacgccgacccgaaaaaaacgacacctcatcccgctacccccgcgcacctcgatactcgttctataaacgcaaacgctaattatacaaactcttttcgataaaatactaaatctccaataacccctacacgatttcgaacacgataccgtcgaaaaacgccaaaaccaaatcgctaaacgtaatataaaacaaacgctactaaaaaaaactacgaataaaaaaacgcgataaaccccgacgaaaaacgaaaccgcctccgcaaacctccgcccgccccgcctacgtacctaaacaactccttcaccaaactctataacgccgacaacaactaataatatcgctcctactaccgaacaccgtccgccacctcctccaaaacgaccgcgtaacgctccataacgcgaacgcccgctaaccgccgacgacgacgacgaactcccccaacttcacgacatcccgaacgcgacgcgtcccgccccttttacgattatcccacgcgcgacgcgctccgcccccttttacgacaatcccgaaaaaacctaaccgcctaccccgccctaccccgcgccccgccgcctacttattcaaaaaacgcgccccgctcctctacgaaaactccaaaaaaaattttactcaacccaaactcgcacctacctactccccgcgcgacattaaaaacgaaactccgccgtctaaatatcgcaaaaccacgaaaaatcccaccgacccttactaaatcattacgaaccgaaatccgaactccgcgccgacgcgcc

SEQ ID NO: 4775 - DNA, 874 bp, Artificial Sequence
  chemically treated genomic DNA (Homo sapiens) CpG-island No: 4775
tagtttttgcgttcgttgattttgttaattttagagatttttttcgaatatttttaaggaaggagttgatttgtatagatattaagagttgttcggaggcgtcgattcggaggaggcggtattttatttcgttgttttcgcgtatttcggtgttcgttttgtaggcgtaggcgttggttgtataggtttttttcggtgaggtgttggatttttagtagtttttgtacgatttcgaatacggtgtcgtcgagaagcgttagggttaggtcgttgagcgtggtgtaggataggcgttgttggaaagagttgcgggtaggggggcgcggtgagtttcggcgggaaacgaagtcgttttcgtaggttttcgttcgtttcgtttgcgtatttgggtaatttttttattaggttttgtagcgtcgatagtaattggtagtgtcgtttttgttgtcgggtatcgttcgttattttttttaaggcggtcgcgtagcgttttatggcgcggacgttcgttagtcgtcggcggcggcgacgagtttttttagttttacgatatttcgagcgcggcgcgtttcgttttttttacgattgttttacgcgcggcgcgtttcgtttttttttacgatagtttcgagagggtttggtcgtttgtttcgttttgtttcgcgtttcgtcgtttgtttatttaggaggcgcgtttcgtttttttgcggagattttaaggagggttttgtttagtttaggttcgtatttgtttgtttttcgcgcgatattaaaggcgagatttcgtcgtttggatatcgtaggattacggagaattttatcggtttttgttgagttattgcgggtcgaggttcgggtttcgcgtcggcgcgtt

SEQ ID NO: 4776 - DNA, 874 bp, Artificial Sequence
  chemically treated genomic DNA (Homo sapiens) CpG-island No: 4776
aacgcgccgacgcgaaacccgaacctcgacccgcaataactcaacaaaaaccgataaaattctccgtaatcctacgatatccaaacgacgaaatctcgcctttaatatcgcgcgaaaaacaaacaaatacgaacctaaactaaacaaaaccctccttaaaatctccgcaaaaaaacgaaacgcgcctcctaaataaacaaacgacgaaacgcgaaacaaaacgaaacaaacgaccaaaccctctcgaaactatcgtaaaaaaaaacgaaacgcgccgcgcgtaaaacaatcgtaaaaaaaacgaaacgcgccgcgctcgaaatatcgtaaaactaaaaaaactcgtcgccgccgccgacgactaacgaacgtccgcgccataaaacgctacgcgaccgccttaaaaaaaataacgaacgatacccgacaacaaaaacgacactaccaattactatcgacgctacaaaacctaataaaaaaattacccaaatacgcaaacgaaacgaacgaaaacctacgaaaacgacttcgtttcccgccgaaactcaccgcgcccccctacccgcaactctttccaacaacgcctatcctacaccacgctcaacgacctaaccctaacgcttctcgacgacaccgtattcgaaatcgtacaaaaactactaaaaatccaacacctcaccgaaaaaaacctatacaaccaacgcctacgcctacaaaacgaacaccgaaatacgcgaaaacaacgaaataaaataccgcctcctccgaatcgacgcctccgaacaactcttaatatctatacaaatcaactccttccttaaaaatattcgaaaaaaatctctaaaattaacaaaatcaacgaacgcaaaaacta

SEQ ID NO: 4777 - DNA, 524 bp, Artificial Sequence
  chemically treated genomic DNA (Homo sapiens) CpG-island No: 4777
  misc_feature (136)..(136): n is either a, c, g or t
  misc_feature (157)..(157): n is either a, c, g or t
  misc_feature (396)..(396): n is either a, c, g or t
tatattataattagattttttatgcggtttttatatattttgttatattcgtagttagaattttttcggatggatttttgtaaatttttagttttatttcgggattcgtgcgttttttatagttattatttgggtntagcgtttaggacgtttaagncgtaatttttttattttaaatcgttaggaattagtggttggatttatcgcgttataaaagtataaattgtgattcgatgagttcgcgtattcggaaaataagagaacgtttttacgttttcgggcgtagtttgtgttagcgattattaggttagggggcgtagttgagagaatttaagtaattttttcgtaatcggtttcgtcgcgtttgtgggttggtagttcggaatatattttttnagaggttttcgcggtcgacgtgtttcgcgtaggaacgtagtcgtttttcgattggaggacgcggtagaggagttgtttaaagcgaggtgtttagttttgggaggtttagggttgttcgaggggtttag

SEQ ID NO: 4778 - DNA, 524 bp, Artificial Sequence
  chemically treated genomic DNA (Homo sapiens) CpG-island No: 4778
  misc_feature (129)..(129): n is either a, c, g or t
  misc_feature (368)..(368): n is either a, c, g or t
  misc_feature (389)..(389): n is either a, c, g or t
ctaaacccctcgaacaaccctaaacctcccaaaactaaacacctcgctttaaacaactcctctaccgcgtcctccaatcgaaaaacgactacgttcctacgcgaaacacgtcgaccgcgaaaacctctnaaaaaatatattccgaactaccaacccacaaacgcgacgaaaccgattacgaaaaaattacttaaattctctcaactacgccccctaacctaataatcgctaacacaaactacgcccgaaaacgtaaaaacgttctcttattttccgaatacgcgaactcatcgaatcacaatttatacttttataacgcgataaatccaaccactaattcctaacgatttaaaataaaaaaattacgncttaaacgtcctaaacgctanacccaaataataactataaaaaacgcacgaatcccgaaataaaactaaaaatttacaaaaatccatccgaaaaaattctaactacgaatataacaaaatatataaaaaccgcataaaaaatctaattataatata

SEQ ID NO: 4779 - DNA, 524 bp, Artificial Sequence
  chemically treated genomic DNA (Homo sapiens) CpG-island No: 4779
  misc_feature (129)..(129): n is either a, c, g or t
  misc_feature (368)..(368): n is either a, c, g or t
  misc_feature (389)..(389): n is either a, c, g or t
ttaagtttttcgggtagttttgagttttttagggttgagtatttcgttttgagtagtttttttatcgcgttttttagtcgggaggcggttgcgtttttgcgcgaagtacgtcggtcgcgaaggtttttngggaaatgtatttcgggttattagtttataaacgcggcggaatcggttgcggggaggttgtttgaatttttttagttgcgttttttgatttagtagtcgttggtataagttgcgttcggagacgtgggagcgtttttttgtttttcgagtgcgcggatttatcgggttatagtttatgtttttatgacgcggtgagtttagttattgatttttaacggtttagagtggggaggttacgntttgggcgttttggacgttgngtttaagtggtggttgtagaagacgtacggatttcgggatggggttggaggtttgtaagagtttattcgaggggattttggttgcgagtgtgatagagtatatgaaagtcgtatggaggatttgattgtagtgtg

SEQ ID NO: 4780 - DNA, 524 bp, Artificial Sequence
  chemically treated genomic DNA (Homo sapiens) CpG-island No: 4780
  misc_feature (136)..(136): n is either a, c, g or t
  misc_feature (157)..(157): n is either a, c, g or t
  misc_feature (396)..(396): n is either a, c, g or t
cacactacaatcaaatcctccatacgactttcatatactctatcacactcgcaaccaaaatcccctcgaataaactcttacaaacctccaaccccatcccgaaatccgtacgtcttctacaaccaccacttaaacncaacgtccaaaacgcccaaancgtaacctccccactctaaaccgttaaaaatcaataactaaactcaccgcgtcataaaaacataaactataacccgataaatccgcgcactcgaaaaacaaaaaaacgctcccacgtctccgaacgcaacttataccaacgactactaaatcaaaaaacgcaactaaaaaaattcaaacaacctccccgcaaccgattccgccgcgtttataaactaataacccgaaatacatttcccnaaaaaccttcgcgaccgacgtacttcgcgcaaaaacgcaaccgcctcccgactaaaaaacgcgataaaaaaactactcaaaacgaaatactcaaccctaaaaaactcaaaactacccgaaaaacttaa

SEQ ID NO: 4781 - DNA, 828 bp, Artificial Sequence
  chemically treated genomic DNA (Homo sapiens) CpG-island No: 4781
cgagtttcgtttaggtttcggttttcgtgggtcgggcgtcgggttttattttggttgtagtttttgtcgcggaagtcggttcgcgagtagtcgtatacggtttggtcgtttattacggagtatatattttcgttgaggtatatttcgttttcgtttttttcgttcgtttcgtacgggtttttttcgtcgttgttgggcggtttatcgtttagttttatttcgtcgttgtttacgggtaggatttgcgaggagttgatttttacgttacgaatttattttttgaagggttttcgtttttttatcgaggttagggtgagtttgagcgtcgcggcgcgtagtttcgggggtagtttttcgacgaaaaggtcgttgaatatcgttatgtttttgcgtttggatttgatttttatttatttggtttttatttggtcgatgaagagcgtggtgttgcggaattggcggcggatgcgtacgttgtgttaggcgtcgtcgttaatcggcgtgtcggttaggagcgtcgtaggtttagcgtagaagatggagaagttgagttgtaggcggtcgtcgcgcgttagaattagttttaggaagtcgtagaagttttcgtcgtcgaagtagagtacgaggtcgcgggcgttgcgagttttgagttggaagtttatttcgttttcgtagtaggcgttttatttggggaagcgcgtttattggttttcggcgttcggaaattttagttcgttgtttagtttcgtttagtagtttaggagtagtagcgagaggtatagaagaaaatagttttcgcgttggagtagcgtcgtttttatgttcggg

SEQ ID NO: 4782 - DNA, 828 bp, Artificial Sequence
  chemically treated genomic DNA (Homo sapiens) CpG-island No: 4782
cccgaacataaaaacgacgctactccaacgcgaaaactattttcttctatacctctcgctactactcctaaactactaaacgaaactaaacaacgaactaaaatttccgaacgccgaaaaccaataaacgcgcttccccaaataaaacgcctactacgaaaacgaaataaacttccaactcaaaactcgcaacgcccgcgacctcgtactctacttcgacgacgaaaacttctacgacttcctaaaactaattctaacgcgcgacgaccgcctacaactcaacttctccatcttctacgctaaacctacgacgctcctaaccgacacgccgattaacgacgacgcctaacacaacgtacgcatccgccgccaattccgcaacaccacgctcttcatcgaccaaataaaaaccaaataaataaaaatcaaatccaaacgcaaaaacataacgatattcaacgaccttttcgtcgaaaaactacccccgaaactacgcgccgcgacgctcaaactcaccctaacctcgataaaaaaacgaaaacccttcaaaaaataaattcgtaacgtaaaaatcaactcctcgcaaatcctacccgtaaacaacgacgaaataaaactaaacgataaaccgcccaacaacgacgaaaaaaacccgtacgaaacgaacgaaaaaaacgaaaacgaaatatacctcaacgaaaatatatactccgtaataaacgaccaaaccgtatacgactactcgcgaaccgacttccgcgacaaaaactacaaccaaaataaaacccgacgcccgacccacgaaaaccgaaacctaaacgaaactcg

SEQ ID NO: 4783 - DNA, 828 bp, Artificial Sequence
  chemically treated genomic DNA (Homo sapiens) CpG-island No: 4783
ttcgagtatggggacggcgttgttttagcgcgggggttgtttttttttgtgtttttcgttgttgtttttgggttgttgggcggagttgggtagcgggttggagttttcgggcgtcgagggttaatggacgcgtttttttaagtggaacgtttgttgcgagagcgagatgagtttttagtttaagattcgtagcgttcgcggtttcgtgttttatttcgacgacgagggtttttgcgattttttggagttgattttgacgcgcggcggtcgtttgtagtttagtttttttattttttgcgttgagtttgcgacgtttttggtcgatacgtcggttaacgacggcgtttggtatagcgtgcgtattcgtcgttagtttcgtaatattacgttttttatcgattaggtggaggttaagtgggtggaggttaagtttaagcgtagggatatgacggtgtttagcggttttttcgtcggggggttgttttcggaattgcgcgtcgcggcgtttaagtttattttggtttcggtgagggagcgggagttttttaaggggtggattcgtgacgtgagggttaatttttcgtaggttttgttcgtggatagcggcgaggtgaagttggacgatgagtcgtttaatagcggcgggggaagttcgtgcgaggcgggcgaggagggcgagggcggggtgtgttttaacggaggtgtgtgtttcgtggtggacgattaggtcgtgtgcgattgttcgcgaatcggttttcgcggtaaggattgtagttaaggtaaggttcgacgttcgatttacgggggtcggggtttgggcggggttcg

SEQ ID NO: 4784 - DNA, 828 bp, Artificial Sequence
  chemically treated genomic DNA (Homo sapiens) CpG-island No: 4784
cgaaccccgcccaaaccccgacccccgtaaatcgaacgtcgaaccttaccttaactacaatccttaccgcgaaaaccgattcgcgaacaatcgcacacgacctaatcgtccaccacgaaacacacacctccgttaaaacacaccccgccctcgccctcctcgcccgcctcgcacgaacttcccccgccgctattaaacgactcatcgtccaacttcacctcgccgctatccacgaacaaaacctacgaaaaattaaccctcacgtcacgaatccaccccttaaaaaactcccgctccctcaccgaaaccaaaataaacttaaacgccgcgacgcgcaattccgaaaacaaccccccgacgaaaaaaccgctaaacaccgtcatatccctacgcttaaacttaacctccacccacttaacctccacctaatcgataaaaaacgtaatattacgaaactaacgacgaatacgcacgctataccaaacgccgtcgttaaccgacgtatcgaccaaaaacgtcgcaaactcaacgcaaaaaataaaaaaactaaactacaaacgaccgccgcgcgtcaaaatcaactccaaaaaatcgcaaaaaccctcgtcgtcgaaataaaacacgaaaccgcgaacgctacgaatcttaaactaaaaactcatctcgctctcgcaacaaacgttccacttaaaaaaacgcgtccattaaccctcgacgcccgaaaactccaacccgctacccaactccgcccaacaacccaaaaacaacaacgaaaaacacaaaaaaaaacaacccccgcgctaaaacaacgccgtccccatactcgaa

SEQ ID NO: 4785 - DNA, 870 bp, Artificial Sequence
  chemically treated genomic DNA (Homo sapiens) CpG-island No: 4785
gtcggggcgggggcggagcgcgcgcgaagcgacgtttttagttcgcggtcgggttagggcggggagaggcgcggttacgtttaggcggttttcgttcgttttaatagcgcgtacgcggttatcgagttggaggaggcggcgggcgcgagattcggaatgcgtaggttttcgtttcgttttttttagttcgggtcgcggtttcgtttttttcgtagtcgtttcgtattcggtgttcgtttttcgaggtcggcggttgtttttattcggggtcgttgttgtttgtgtcgtgagcgtcgtttagttattgttttcgtcgtttcgttagtcgcgtcggatcgcgtattaggaggcgagagcgcgtatggggagtttttgttgatgtcgtcgtcgcgtcgtttttcgaggttgcgtttcgggaagttcggtttttcgagcgtttcggtttggttcggtgtttcggatttgagtgcgtttttatggaggcgttcgggttggtttaggcggtcgcggcggagagcgattttcgtaaggtggcggaggagattttcgacggggcgttcgcgttttgttttagttttgaggcgttgtcgtcggagtcgtttgtgtatagtttgtaggattttgatacgttggttatcgtgggtgagtgagtgcgggcggggattcggtttataggggcgcgcggcgtggtcgggacgttgtagtaggataaagggttttgggtgtcgattttttggggagggttttgattcgttatttcggttcggagttttcgtgcggggttgtatttgcgtttcgggttttttcgggtggagcgtattttttagttttttagtttaggtaagtattttcgatcggtcgggtgtttaa

SEQ ID NO: 4786 - DNA, 870 bp, Artificial Sequence
  chemically treated genomic DNA (Homo sapiens) CpG-island No: 4786
ttaaacacccgaccgatcgaaaatacttacctaaactaaaaaactaaaaaatacgctccacccgaaaaaacccgaaacgcaaatacaaccccgcacgaaaactccgaaccgaaataacgaatcaaaaccctccccaaaaaatcgacacccaaaaccctttatcctactacaacgtcccgaccacgccgcgcgcccctataaaccgaatccccgcccgcactcactcacccacgataaccaacgtatcaaaatcctacaaactatacacaaacgactccgacgacaacgcctcaaaactaaaacaaaacgcgaacgccccgtcgaaaatctcctccgccaccttacgaaaatcgctctccgccgcgaccgcctaaaccaacccgaacgcctccataaaaacgcactcaaatccgaaacaccgaaccaaaccgaaacgctcgaaaaaccgaacttcccgaaacgcaacctcgaaaaacgacgcgacgacgacatcaacaaaaactccccatacgcgctctcgcctcctaatacgcgatccgacgcgactaacgaaacgacgaaaacaataactaaacgacgctcacgacacaaacaacaacgaccccgaataaaaacaaccgccgacctcgaaaaacgaacaccgaatacgaaacgactacgaaaaaaacgaaaccgcgacccgaactaaaaaaaacgaaacgaaaacctacgcattccgaatctcgcgcccgccgcctcctccaactcgataaccgcgtacgcgctattaaaacgaacgaaaaccgcctaaacgtaaccgcgcctctccccgccctaacccgaccgcgaactaaaaacgtcgcttcgcgcgcgctccgcccccgccccgac

SEQ ID NO: 4787 - DNA, 870 bp, Artificial Sequence
  chemically treated genomic DNA (Homo sapiens) CpG-island No: 4787
ttaggtattcggtcggtcgggggtatttgtttgggttggggggttggggagtgcgttttattcgggaagattcggggcgtaggtgtagtttcgtacggggatttcgagtcgaagtagcgggttagggttttttttaggaggtcggtatttagggttttttgttttattataacgtttcggttacgtcgcgcgtttttgtgggtcgagttttcgttcgtatttatttatttacggtggttagcgtgttaaagttttgtaggttgtatataggcggtttcggcgatagcgttttagggttggggtagagcgcgggcgtttcgtcgggggtttttttcgttattttgcgggagtcgtttttcgtcgcggtcgtttgggttagttcgggcgtttttatggggacgtatttaggttcggggtatcgggttaggtcggagcgttcggggagtcgggtttttcgggacgtagtttcggagggcggcgcggcggcggtattaatagaggttttttatgcgcgttttcgttttttggtgcgcggttcggcgcggttgacggagcgacggggataatggttgggcggcgtttacggtataagtagtaacggtttcgagtgggagtagtcgtcggtttcggggggcgggtatcgagtgcgggacgattgcggggaaggcggggtcgcggttcgggttggggggggcgaggcgggggtttgcgtatttcgggtttcgcgttcgtcgttttttttagttcggtagtcgcgtgcgcgttgttggggcgggcggaagtcgtttgggcgtgatcgcgttttttttcgttttaattcggtcgcgggttgggggcgtcgtttcgcgcgcgtttcgttttcgtttcgat

SEQ ID NO: 4788 - DNA, 870 bp, Artificial Sequence
  chemically treated genomic DNA (Homo sapiens) CpG-island No: 4788
atcgaaacgaaaacgaaacgcgcgcgaaacgacgcccccaacccgcgaccgaattaaaacgaaaaaaaacgcgatcacgcccaaacgacttccgcccgccccaacaacgcgcacgcgactaccgaactaaaaaaaacgacgaacgcgaaacccgaaatacgcaaacccccgcctcgccccccccaacccgaaccgcgaccccgccttccccgcaatcgtcccgcactcgatacccgccccccgaaaccgacgactactcccactcgaaaccgttactacttataccgtaaacgccgcccaaccattatccccgtcgctccgtcaaccgcgccgaaccgcgcaccaaaaaacgaaaacgcgcataaaaaacctctattaataccgccgccgcgccgccctccgaaactacgtcccgaaaaacccgactccccgaacgctccgacctaacccgataccccgaacctaaatacgtccccataaaaacgcccgaactaacccaaacgaccgcgacgaaaaacgactcccgcaaaataacgaaaaaaacccccgacgaaacgcccgcgctctaccccaaccctaaaacgctatcgccgaaaccgcctatatacaacctacaaaactttaacacgctaaccaccgtaaataaataaatacgaacgaaaactcgacccacaaaaacgcgcgacgtaaccgaaacgttataataaaacaaaaaaccctaaataccgacctcctaaaaaaaaccctaacccgctacttcgactcgaaatccccgtacgaaactacacctacgccccgaatcttcccgaataaaacgcactccccaaccccccaacccaaacaaatacccccgaccgaccgaatacctaa

SEQ ID NO: 4789 - DNA, 619 bp, Artificial Sequence
  chemically treated genomic DNA (Homo sapiens) CpG-island No: 4789
gggacggtttgaggttcgcggtcgggttttttttttagatattcgcggaaagttcgaaaggaggcggaatacggtttagcggttcgttacggcgggtttattttttgtttagtcgtttcgtattttcgttttatcgtattgttgtattgttgtattgttgttttgttgttcgtttttcgtattattgattcgtttttttttcgttttttcgtttcgtcgtttcgtttttttttttcgtttttttatttcgtcgtttcgtttttttgttttatcgtcgggttgaattgtcgtttcgttttttagttacgttttttggtttttgtttttagtttcgtttttcgtttcgtcgtttcgtcgtttcgtcgttttgtcgttttgttattttgtcgttttgtcgttttgtcgttttgtcgttttgtcgtcggtggtcgttgttcgtggtgtttcgtcgttttcgttattttacgttttttcgtgcgtcgggagcgtttcggttataatatgttgggtatgattaagaattcgttgttcggaagcgtagagacgtggttttggtaggttttaagtaaaggggataaggtaggttcgtagggttgtcgaggatttgaaggattgttgt

SEQ ID NO: 4790 - DNA, 619 bp, Artificial Sequence
  chemically treated genomic DNA (Homo sapiens) CpG-island No: 4790
acaacaatccttcaaatcctcgacaaccctacgaacctaccttatcccctttacttaaaacctaccaaaaccacgtctctacgcttccgaacaacgaattcttaatcatacccaacatattataaccgaaacgctcccgacgcacgaaaaaacgtaaaataacgaaaacgacgaaacaccacgaacaacgaccaccgacgacaaaacgacaaaacgacaaaacgacaaaacgacaaaataacaaaacgacaaaacgacgaaacgacgaaacgacgaaacgaaaaacgaaactaaaaacaaaaaccaaaaaacgtaactaaaaaacgaaacgacaattcaacccgacgataaaacaaaaaaacgaaacgacgaaataaaaaaacgaaaaaaaaaaacgaaacgacgaaacgaaaaaacgaaaaaaaaacgaatcaataatacgaaaaacgaacaacaaaacaacaatacaacaatacaacaatacgataaaacgaaaatacgaaacgactaaacaaaaaataaacccgccgtaacgaaccgctaaaccgtattccgcctcctttcgaactttccgcgaatatctaaaaaaaaaacccgaccgcgaacctcaaaccgtccc

SEQ ID NO: 4791 - DNA, 619 bp, Artificial Sequence
  chemically treated genomic DNA (Homo sapiens) CpG-island No: 4791
gtagtaattttttaggttttcggtagttttgcgggtttattttgttttttttgtttaggatttgttaaggttacgtttttacgttttcgaatagcgagtttttgattatgtttaatatgttgtagtcgagacgttttcgacgtacgggaggacgtgaggtggcgggggcgacggagtattacgggtagcgattatcggcggtagggcggtagggcggtagggcggtagggcggtagggtggtagggcggtaaggcggcgggacggcgaggcggcgaggcgagaggcggggttagaggtaggggttagagggcgtggttagagggcggggcggtaatttagttcggcggtgaggtaagggggcgggacggcgaggtgaaggggcggagagagagggcggggcggcgaggcgagggggcggagagagggcgggttagtgatgcgaagggcgggtagtagggtagtagtgtagtagtgtagtagtgcggtgaggcgagggtgcgaggcggttaagtaagggatgggttcgtcgtggcgagtcgttgggtcgtgtttcgttttttttcgggtttttcgcgggtgtttggggagggaattcggtcgcgggttttaggtcgtttt

SEQ ID NO: 4792 - DNA, 619 bp, Artificial Sequence
  chemically treated genomic DNA (Homo sapiens) CpG-island No: 4792
aaaacgacctaaaacccgcgaccgaattccctccccaaacacccgcgaaaaacccgaaaaaaaacgaaacacgacccaacgactcgccacgacgaacccatcccttacttaaccgcctcgcaccctcgcctcaccgcactactacactactacactactaccctactacccgcccttcgcatcactaacccgccctctctccgccccctcgcctcgccgccccgccctctctctccgccccttcacctcgccgtcccgcccccttacctcaccgccgaactaaattaccgccccgccctctaaccacgccctctaacccctacctctaaccccgcctctcgcctcgccgcctcgccgtcccgccgccttaccgccctaccaccctaccgccctaccgccctaccgccctaccgccctaccgccgataatcgctacccgtaatactccgtcgcccccgccacctcacgtcctcccgtacgtcgaaaacgtctcgactacaacatattaaacataatcaaaaactcgctattcgaaaacgtaaaaacgtaaccttaacaaatcctaaacaaaaaaaacaaaataaacccgcaaaactaccgaaaacctaaaaaattactac

SEQ ID NO: 4793 - DNA, 501 bp, Artificial Sequence
  chemically treated genomic DNA (Homo sapiens) CpG-island No: 4793
gggacgatcgttttatttttattttttttggcgtaggtggtagcgttttgtcgtttcggttgttttttacgcgcgtttgagcggggtttttatagttaagttgcgtcgtttacgtgtttttcgtcgcgtggtttcggaatttttttgggagcggattttcgcgggtagttttttcgaggtttttaagggttttaggggtttttttgtttttattaaggcgtatttatcggttgttttgttcgtttgatagttttcgggttcgtcggtcgttaggttgttggagtttcgcgcgttcgggtgcgtatttgggtcgggcgggagggtgtgggttttttggagcgttttttagcgtaacgttacgtaaagtgtaggtggtcgtggattgggatcggggtgcgagaaatcggagttggttgtgggtagtagttttttgtgtgcgttttagtcgttttttaaagttagtgtaacgcgtaggttagttttatttgaagttgatttagg

SEQ ID NO: 4794 - DNA, 501 bp, Artificial Sequence
  chemically treated genomic DNA (Homo sapiens) CpG-island No: 4794
cctaaatcaacttcaaataaaactaacctacgcgttacactaactttaaaaaacgactaaaacgcacacaaaaaactactacccacaaccaactccgatttctcgcaccccgatcccaatccacgaccacctacactttacgtaacgttacgctaaaaaacgctccaaaaaacccacaccctcccgcccgacccaaatacgcacccgaacgcgcgaaactccaacaacctaacgaccgacgaacccgaaaactatcaaacgaacaaaacaaccgataaatacgccttaataaaaacaaaaaaacccctaaaacccttaaaaacctcgaaaaaactacccgcgaaaatccgctcccaaaaaaattccgaaaccacgcgacgaaaaacacgtaaacgacgcaacttaactataaaaaccccgctcaaacgcgcgtaaaaaacaaccgaaacgacaaaacgctaccacctacgccaaaaaaaataaaaataaaacgatcgtccc

SEQ ID NO: 4795 - DNA, 501 bp, Artificial Sequence
  chemically treated genomic DNA (Homo sapiens) CpG-island No: 4795
tttggattaattttaggtggagttgatttacgcgttgtattgattttgaagagcggttgaagcgtatataagaagttgttgtttatagttagtttcgatttttcgtatttcggttttaatttacggttatttgtattttgcgtaacgttgcgttggggggcgttttagagaatttatattttttcgttcggtttaggtgcgtattcgaacgcgcggggttttagtaatttggcggtcgacgggttcgggagttgttaggcgagtagaatagtcggtgagtgcgttttgatgggagtagaaaggtttttaggatttttggaggtttcggaggaattattcgcggagattcgtttttagaaaggtttcgggattacgcggcgaggagtacgtgaacggcgtagtttggttataaaaatttcgtttaagcgcgcgtggggagtaatcggagcggtaggacgttgttatttgcgttaggagagatagggatgaagcgatcgtttt

SEQ ID NO: 4796 - DNA, 501 bp, Artificial Sequence
  chemically treated genomic DNA (Homo sapiens) CpG-island No: 4796
aaaacgatcgcttcatccctatctctcctaacgcaaataacaacgtcctaccgctccgattactccccacgcgcgcttaaacgaaatttttataaccaaactacgccgttcacgtactcctcgccgcgtaatcccgaaacctttctaaaaacgaatctccgcgaataattcctccgaaacctccaaaaatcctaaaaacctttctactcccatcaaaacgcactcaccgactattctactcgcctaacaactcccgaacccgtcgaccgccaaattactaaaaccccgcgcgttcgaatacgcacctaaaccgaacgaaaaaatataaattctctaaaacgccccccaacgcaacgttacgcaaaatacaaataaccgtaaattaaaaccgaaatacgaaaaatcgaaactaactataaacaacaacttcttatatacgcttcaaccgctcttcaaaatcaatacaacgcgtaaatcaactccacctaaaattaatccaaa

SEQ ID NO: 4797 - DNA, 557 bp, Artificial Sequence
  chemically treated genomic DNA (Homo sapiens) CpG-island No: 4797
ttagttgacgttttttttgttaaagtaagaaaattataagtcgttataggagagcggattcggttatataaagcgaggcgttcgattagagggatttttagaggacgtttttcgttttcgggttcgttttcgtttagtttttgttcggcgtttcgcgtttattagtttttttttttttttttttagtttgataggcgttttagttcgtcgggtcgtagcggttttatttcgtttagtaagtcgttttcgttcgtcgttagtaaggaggtggcgtttcgtagtttttcgttattcgttcgtttcgggttcgattcgggttcgtcgttcgatttggcgttgaggtttaaggggaagtttcgaggagacgtcgcgtcggaggagggaatggacgcgtcggttcgaatcgggttgtcgggtttaagggagtcggcgttttgtacggttttcgagcggttttttagttgttcgttttgtttttttagtttttttattagtttttgtagttttcgtattttttggttcgcgtttacgttggagttatttttttttatttcggt

SEQ ID NO: 4798 - DNA, 557 bp, Artificial Sequence
  chemically treated genomic DNA (Homo sapiens) CpG-island No: 4798
accgaaataaaaaaaaataactccaacgtaaacgcgaaccaaaaaatacgaaaactacaaaaactaataaaaaaactaaaaaaacaaaacgaacaactaaaaaaccgctcgaaaaccgtacaaaacgccgactcccttaaacccgacaacccgattcgaaccgacgcgtccattccctcctccgacgcgacgtctcctcgaaacttccccttaaacctcaacgccaaatcgaacgacgaacccgaatcgaacccgaaacgaacgaataacgaaaaactacgaaacgccacctccttactaacgacgaacgaaaacgacttactaaacgaaataaaaccgctacgacccgacgaactaaaacgcctatcaaactaaaaaaaaaaaaaaaaaaactaataaacgcgaaacgccgaacaaaaactaaacgaaaacgaacccgaaaacgaaaaacgtcctctaaaaatccctctaatcgaacgcctcgctttatataaccgaatccgctctcctataacgacttataattttcttactttaacaaaaaaaacgtcaactaa

SEQ ID NO: 4799 - DNA, 557 bp, Artificial Sequence
  chemically treated genomic DNA (Homo sapiens) CpG-island No: 4799
gtcgggatggagaagagtgattttaacgtgaacgcggattagaaggtgcggaagttgtaggagttggtgaagaagttggagaagtagaacgaatagttgaggagtcgttcgggggtcgtgtagggcgtcggtttttttgggttcggtagttcggttcgggtcggcgcgtttattttttttttcggcgcggcgttttttcggggtttttttttgggttttagcgttaagtcgggcggcgggttcgggtcgggttcgaggcggacgagtagcgaagagttgcgggacgttatttttttgttagcggcgggcgagggcggtttgttggacgaggtggagtcgttgcggttcgacgagttggagcgtttgttaggttgggaggaggaggaggagagttggtgagcgcgaggcgtcgggtaggagttgggcggggacgggttcgggggcggagagcgttttttgagggtttttttggtcgggcgtttcgttttgtgtagtcgggttcgtttttttgtggcgatttgtggtttttttgttttggtagagggaacgttagttgg

SEQ ID NO: 4800 - DNA, 557 bp, Artificial Sequence
  chemically treated genomic DNA (Homo sapiens) CpG-island No: 4800
ccaactaacgttccctctaccaaaacaaaaaaaccacaaatcgccacaaaaaaacgaacccgactacacaaaacgaaacgcccgaccaaaaaaaccctcaaaaaacgctctccgcccccgaacccgtccccgcccaactcctacccgacgcctcgcgctcaccaactctcctcctcctcctcccaacctaacaaacgctccaactcgtcgaaccgcaacgactccacctcgtccaacaaaccgccctcgcccgccgctaacaaaaaaataacgtcccgcaactcttcgctactcgtccgcctcgaacccgacccgaacccgccgcccgacttaacgctaaaacccaaaaaaaaaccccgaaaaaacgccgcgccgaaaaaaaaaataaacgcgccgacccgaaccgaactaccgaacccaaaaaaaccgacgccctacacgacccccgaacgactcctcaactattcgttctacttctccaacttcttcaccaactcctacaacttccgcaccttctaatccgcgttcacgttaaaatcactcttctccatcccgac

SEQ ID NO: 4801 - DNA, 758 bp, Artificial Sequence
  chemically treated genomic DNA (Homo sapiens) CpG-island No: 4801
ggcgatgtcgtgggcggcgttttttttggcgatgttttgggcggcgttttcgttggcgatgttttgggcggcgttttcgttggcgatgttttgggcggcgttttttttggcgatgtcgtgggcggcgttttcgttggcgatgttttgggcggcgttttcgttggcgatgttttgggcggtattttcgttggcgatgtttttgtcggcggtttcgttagcgatgttttgggcggcgttttttttggcgatgttttgggcggcgttttttttggcgatgttttgggcggcgttttcgttggcgatgttttgggcggcgttttttttggcgatgttttgggcggcgttttcgttggcgatgttttgggcggcgttttcgttggcgatgtcgtggacggcgtattttttggcgatgttttggatggcgttttcgttggcgatgttttgggcggcgttttcgttggcgatgtcgtgggcggcgttttttttggcgatgtcgtgggcggcgtttttattggcgatgtcgtgggcggcgttttcgttggcgatgtcgtgggcggcgttttcgttggcgatgtcgtgggcggcgttttcgttggcgatgtttttgtcggcggtttcgttagcgatgtcgtgtatagtattttcgttagcgatgtcgtgtgtggcgttttcgttagtgatgtcgtgtacggtgtttttatggggagttagaaaaatatagagttaaggttagtgttttggtggtggagattgtgaat

SEQ ID NO: 4802 - DNA, 758 bp, Artificial Sequence
  chemically treated genomic DNA (Homo sapiens) CpG-island No: 4802
attcacaatctccaccaccaaaacactaaccttaactctatatttttctaactccccataaaaacaccgtacacgacatcactaacgaaaacgccacacacgacatcgctaacgaaaatactatacacgacatcgctaacgaaaccgccgacaaaaacatcgccaacgaaaacgccgcccacgacatcgccaacgaaaacgccgcccacgacatcgccaacgaaaacgccgcccacgacatcgccaataaaaacgccgcccacgacatcgccaaaaaaaacgccgcccacgacatcgccaacgaaaacgccgcccaaaacatcgccaacgaaaacgccatccaaaacatcgccaaaaaatacgccgtccacgacatcgccaacgaaaacgccgcccaaaacatcgccaacgaaaacgccgcccaaaacatcgccaaaaaaaacgccgcccaaaacatcgccaacgaaaacgccgcccaaaacatcgccaaaaaaaacgccgcccaaaacatcgccaaaaaaaacgccgcccaaaacatcgctaacgaaaccgccgacaaaaacatcgccaacgaaaataccgcccaaaacatcgccaacgaaaacgccgcccaaaacatcgccaacgaaaacgccgcccacgacatcgccaaaaaaaacgccgcccaaaacatcgccaacgaaaacgccgcccaaaacatcgccaacgaaaacgccgcccaaaacatcgccaaaaaaaacgccgcccacgacatcgcc

SEQ ID NO: 4803 - DNA, 758 bp, Artificial Sequence
  chemically treated genomic DNA (Homo sapiens) CpG-island No: 4803
atttatagtttttattattagggtattgattttaattttgtgtttttttagttttttatgaggatatcgtatacgatattattaacgaggacgttatatacgatatcgttaacgaggatattgtatacgatatcgttaacgaggtcgtcgataagggtatcgttaacgaggacgtcgtttacggtatcgttaacgaggacgtcgtttacggtatcgttagcgaggacgtcgtttacggtatcgttagtgaggacgtcgtttacggtatcgttagagaggacgtcgtttacggtatcgttagcgaggacgtcgtttagggtatcgttaacgaggacgttatttagggtatcgttaaggagtacgtcgtttacggtatcgttaacgaggacgtcgtttagggtatcgttaacgaggacgtcgtttagggtatcgttaaggaggacgtcgtttagggtatcgttaacgaggacgtcgtttagggtatcgttaaagaggacgtcgtttagggtatcgttaaggaggacgtcgtttagggtatcgttaacgaggtcgtcgataagggtatcgttaacgaggatgtcgtttagggtatcgttagcgaggacgtcgtttagggtatcgttagcgaggacgtcgtttacggtatcgttaaagaggacgtcgtttagggtatcgttaacgaggacgtcgtttagggtatcgttaacgaggacgtcgtttagggtatcgttaaagaggacgtcgtttacggtatcgtt

SEQ ID NO: 4804 - DNA, 758 bp, Artificial Sequence
  chemically treated genomic DNA (Homo sapiens) CpG-island No: 4804
aacgataccgtaaacgacgtcctctttaacgataccctaaacgacgtcctcgttaacgataccctaaacgacgtcctcgttaacgataccctaaacgacgtcctctttaacgataccgtaaacgacgtcctcgctaacgataccctaaacgacgtcctcgctaacgataccctaaacgacatcctcgttaacgatacccttatcgacgacctcgttaacgataccctaaacgacgtcctccttaacgataccctaaacgacgtcctctttaacgataccctaaacgacgtcctcgttaacgataccctaaacgacgtcctccttaacgataccctaaacgacgtcctcgttaacgataccctaaacgacgtcctcgttaacgataccgtaaacgacgtactccttaacgataccctaaataacgtcctcgttaacgataccctaaacgacgtcctcgctaacgataccgtaaacgacgtcctctctaacgataccgtaaacgacgtcctcactaacgataccgtaaacgacgtcctcgctaacgataccgtaaacgacgtcctcgttaacgataccgtaaacgacgtcctcgttaacgatacccttatcgacgacctcgttaacgatatcgtatacaatatcctcgttaacgatatcgtatataacgtcctcgttaataatatcgtatacgatatcctcataaaaaactaaaaaaacacaaaattaaaatcaataccctaataataaaaactataaat

SEQ ID NO: 4805 - DNA, 685 bp, Artificial Sequence
  chemically treated genomic DNA (Homo sapiens) CpG-island No: 4805
  misc_feature (577)..(577): n is either a, c, g or t
gtttattttaaagcgggaaaatcggtttttgcggttgttttagttcggagttcgtagtttcgtttcgatttgttcggaaaggttttttttttttttttcgtttcgggagttcggattttgttcggttcgttttagtttaatttatttgcgttttcgggatttatttgcgttttcgggatttatttgttcggtttttggggacgttttcgttttgtagtagtcgggattatttgatcggttgcgggtgagcgtgattaggtagttggagaaaaatttttcgtaggcggcgtcgtcgaagtttttaggtcgttcgaattcgtacgggtcgattttgtaaaatcgagagaaggaggtcggcgttttcgaagttttttttggggggatcgcgggttcgtcggggatcgtagtcgtcggggacgttcgtatttcgcgttatatatttggggatacgcgagcgttcggcgggttgtatgcggggagggaggcgcgtatcgagcgaggttagcgggttttaaagttacgtttcggtttcggggcgtttaagtttcgcgggtagaatcgggggcgtttttcgtangaattttcgcggtttggattcgggtgagaggagttttttttgcgatttttttaaattttagtgtttggtcgattcgattttgatatttgatttttatttttattttat

SEQ ID NO: 4806 - DNA, 685 bp, Artificial Sequence
  chemically treated genomic DNA (Homo sapiens) CpG-island No: 4806
  misc_feature (109)..(109): n is either a, c, g or t
ataaaataaaaataaaaatcaaatatcaaaatcgaatcgaccaaacactaaaatttaaaaaaatcgcaaaaaaaactcctctcacccgaatccaaaccgcgaaaattcntacgaaaaacgcccccgattctacccgcgaaacttaaacgccccgaaaccgaaacgtaactttaaaacccgctaacctcgctcgatacgcgcctccctccccgcatacaacccgccgaacgctcgcgtatccccaaatatataacgcgaaatacgaacgtccccgacgactacgatccccgacgaacccgcgatccccccaaaaaaaacttcgaaaacgccgacctccttctctcgattttacaaaatcgacccgtacgaattcgaacgacctaaaaacttcgacgacgccgcctacgaaaaatttttctccaactacctaatcacgctcacccgcaaccgatcaaataatcccgactactacaaaacgaaaacgtccccaaaaaccgaacaaataaatcccgaaaacgcaaataaatcccgaaaacgcaaataaattaaactaaaacgaaccgaacaaaatccgaactcccgaaacgaaaaaaaaaaaaaaaacctttccgaacaaatcgaaacgaaactacgaactccgaactaaaacaaccgcaaaaaccgattttcccgctttaaaataaac

SEQ ID NO: 4807 - DNA, 685 bp, Artificial Sequence
  chemically treated genomic DNA (Homo sapiens) CpG-island No: 4807
  misc_feature (109)..(109): n is either a, c, g or t
ataaaataaaaataggagttaggtgttagagtcgggtcggttaggtattgaggtttgaaggaatcgtagaagaagttttttttattcgggtttaggtcgcgggggtttntgcgggaggcgttttcgattttgttcgcgggatttaagcgtttcggagtcgggacgtaattttgggattcgttggtttcgttcggtgcgcgttttttttttcgtatgtagttcgtcgagcgttcgcgtgtttttaggtgtgtggcgcggggtgcgggcgttttcggcggttgcggttttcggcgggttcgcgatttttttagaggaaatttcggggacgtcggtttttttttttcggttttgtaggatcgattcgtacggattcgagcggtttgaggatttcgacgacgtcgtttacgagaagtttttttttagttatttggttacgtttattcgtagtcgattaaatggtttcggttgttgtagggcgggggcgtttttaggagtcggataggtgggtttcgggggcgtaggtgggtttcgagggcgtaggtgggttgggttgggacgggtcgggtaaagttcgggttttcggagcggagggagggggaggaattttttcgggtaggtcgggacgaagttgcgggtttcgagttagggtagtcgtagggatcggttttttcgttttgagatgggt

SEQ ID NO: 4808 - DNA, 685 bp, Artificial Sequence
  chemically treated genomic DNA (Homo sapiens) CpG-island No: 4808
  misc_feature (577)..(577): n is either a, c, g or t
acccatctcaaaacgaaaaaaccgatccctacgactaccctaactcgaaacccgcaacttcgtcccgacctacccgaaaaaattcctccccctccctccgctccgaaaacccgaactttacccgacccgtcccaacccaacccacctacgccctcgaaacccacctacgcccccgaaacccacctatccgactcctaaaaacgcccccgccctacaacaaccgaaaccatttaatcgactacgaataaacgtaaccaaataactaaaaaaaaacttctcgtaaacgacgtcgtcgaaatcctcaaaccgctcgaatccgtacgaatcgatcctacaaaaccgaaaaaaaaaaaccgacgtccccgaaatttcctctaaaaaaatcgcgaacccgccgaaaaccgcaaccgccgaaaacgcccgcaccccgcgccacacacctaaaaacacgcgaacgctcgacgaactacatacgaaaaaaaaaacgcgcaccgaacgaaaccaacgaatcccaaaattacgtcccgactccgaaacgcttaaatcccgcgaacaaaatcgaaaacgcctcccgcanaaacccccgcgacctaaacccgaataaaaaaaacttcttctacgattccttcaaacctcaatacctaaccgacccgactctaacacctaactcctatttttattttat

SEQ ID NO: 4809 - DNA, 732 bp, Artificial Sequence
  chemically treated genomic DNA (Homo sapiens) CpG-island No: 4809
taaaatcgatcggtacgtacgtttcgcggcgcggtcggtaggaatttaacgggtcggcgtcgagggttcgatggtcgtcgcggcggtttcggacgttttgaggttaggcggttgcgtcgaggggattcggtcgttcgtcggtcgttagtcgttcgtttatttattaatttcgggcggcggggcgtcgtttttcgtttcggttttttagttcgcgtttcgggtcggtttcgggtttttatatttatcgttttagtatttattttcgacgcgcggttttcgcgtagttaaatttgttatttgggttcgtttttatttgtttcgttttcgaatcgtatagggaagagggagggagcgggggcggagggggtagtcgtcgcgttagttaatcgtaggtcgagttgcgtttttgagcgggtcgtgattgggtttttttgtgatagatttttttttaatggttgttagttcggcgtcggtcgaagggatttttcgttttgttaagttcggtggaattaaagggaaagcgaaggggcggggtagagaagagcggcggatggaggcgggaagtttaagttgattgggcgaaaggttgtgggtgtcgcgttattattggttgatgttggagtcggggcggggcgttgcgttgttattagtttcgtttttcgtgttttcgttttagttgttaaaattgtagacgtttaggtttgggttgggttaagagtttagatgaaggtt

SEQ ID NO: 4810 - DNA, 732 bp, Artificial Sequence
  chemically treated genomic DNA (Homo sapiens) CpG-island No: 4810
aaccttcatctaaactcttaacccaacccaaacctaaacgtctacaattttaacaactaaaacgaaaacacgaaaaacgaaactaataacaacgcaacgccccgccccgactccaacatcaaccaataataacgcgacacccacaacctttcgcccaatcaacttaaacttcccgcctccatccgccgctcttctctaccccgccccttcgctttccctttaattccaccgaacttaacaaaacgaaaaatcccttcgaccgacgccgaactaacaaccattaaaaaaaaatctatcacaaaaaaacccaatcacgacccgctcaaaaacgcaactcgacctacgattaactaacgcgacgactaccccctccgcccccgctccctccctcttccctatacgattcgaaaacgaaacaaataaaaacgaacccaaataacaaatttaactacgcgaaaaccgcgcgtcgaaaataaatactaaaacgataaatataaaaacccgaaaccgacccgaaacgcgaactaaaaaaccgaaacgaaaaacgacgccccgccgcccgaaattaataaataaacgaacgactaacgaccgacgaacgaccgaatcccctcgacgcaaccgcctaacctcaaaacgtccgaaaccgccgcgacgaccatcgaaccctcgacgccgacccgttaaattcctaccgaccgcgccgcgaaacgtacgtaccgatcgatttta

SEQ ID NO: 4811 - DNA, 732 bp, Artificial Sequence
  chemically treated genomic DNA (Homo sapiens) CpG-island No: 4811
aatttttatttggatttttaatttagtttaaatttaagcgtttatagttttgatagttgaggcgggagtacgggaggcggagttggtggtagcgtagcgtttcgtttcggttttagtattagttaatggtgacgcggtatttatagtttttcgtttaattagtttgagtttttcgtttttattcgtcgtttttttttgtttcgttttttcgttttttttttggttttatcgagtttgatagagcggaaagttttttcggtcggcgtcgggttggtagttattggaggaaggtttgttatagggaggtttaattacggttcgtttaggagcgtagttcggtttacgattggttagcgcggcggttgtttttttcgttttcgtttttttttttttttttgtgcggttcggaggcggggtaggtgggggcgggtttaggtagtaggtttggttgcgcgggggtcgcgcgtcggaggtaaatattagggcggtgggtgtggggattcggggtcggttcgggacgcgggttggggagtcggggcgaggggcgacgtttcgtcgttcgaggttagtgaatgagcgggcggttggcggtcggcgggcggtcggattttttcggcgtagtcgtttggttttagggcgttcggagtcgtcgcggcgattatcgggttttcggcgtcggttcgttagatttttatcgatcgcgtcgcggggcgtacgtatcgatcgattttg

SEQ ID NO: 4812 - DNA, 732 bp, Artificial Sequence
  chemically treated genomic DNA (Homo sapiens) CpG-island No: 4812
caaaatcgatcgatacgtacgccccgcgacgcgatcgataaaaatctaacgaaccgacgccgaaaacccgataatcgccgcgacgactccgaacgccctaaaaccaaacgactacgccgaaaaaatccgaccgcccgccgaccgccaaccgcccgctcattcactaacctcgaacgacgaaacgtcgcccctcgccccgactccccaacccgcgtcccgaaccgaccccgaatccccacacccaccgccctaatatttacctccgacgcgcgacccccgcgcaaccaaacctactacctaaacccgcccccacctaccccgcctccgaaccgcacaaaaaaaaaaaaaaaaacgaaaacgaaaaaaacaaccgccgcgctaaccaatcgtaaaccgaactacgctcctaaacgaaccgtaattaaacctccctataacaaaccttcctccaataactaccaacccgacgccgaccgaaaaaactttccgctctatcaaactcgataaaaccaaaaaaaaaacgaaaaaacgaaacaaaaaaaaacgacgaataaaaacgaaaaactcaaactaattaaacgaaaaactataaataccgcgtcaccattaactaatactaaaaccgaaacgaaacgctacgctaccaccaactccgcctcccgtactcccgcctcaactatcaaaactataaacgcttaaatttaaactaaattaaaaatccaaataaaaatt

SEQ ID NO: 4813 - DNA, 1200 bp, Artificial Sequence
  chemically treated genomic DNA (Homo sapiens) CpG-island No: 4813
atgagcggggagggagatagtgaggaagggtaggaggaagtgagtcgaggaatgagggtaggatcgaggtaaggaaagagttaatggatttagacggggcgattttcggtaaattcgtttattcgttggttcggtttcgttaagtgttaggtgtcgcgttagtgcggggatttattgagttttggcgatcgttgttgtttttcgtagagcgtcggagtggagtcgttttttgttttttcgttttagggtcgttttcgcgttgttattcggttaggtcgggaattttcgggtttacgtttggttcgttcggcgtttgcgcggcgtatttacgtgacggtttaggttttcgtttcgtcggtttttttcgtttagtttttcgtttcgcgtttttcgtttttcgtttttcgtttttttttagttgcgagtgcggtttcggttggcggcggtattaggttagttgcgaggcgtgagtcgaacgggtcgggcggtagcgaacgcgggggtcgggcggtaagtaggtatcgttgggtcggggataagttagcggcgcggagttcgaggggcgcgggggcgggcgcgggtcggaggttcgggggcggcgatttgaggagagttcgcggtttgacgtggcggggacgcggtcggcgggattttcgggcgcgggcgcgtaggggtcgggatttggcgttcggttaggggttagggtgcgaggtttttttagcgcggttgttggcgcgtcggttttttggtattcgggcgggttttgttgtttgcggtaggttcgaatgcggtttttttggtcgcgatttttcgcgttggagcgggcggttttgtaataggcgggcgatttggggtcggtttgacgagttttagttttttcgatcgggttcggggattgtagtcgtaggagtttagttttgttagttttttcggttttttgagaggagtcggagatcgcgttgttagtgtaaaattattagagcgcgaagcgtcggttgttagttttgattattttagattcggtgcgggtcgagtcgagtggatttggggcgggtagcggggtatcgttatttttcgtttgggttttttattgggcgttttcgtttcggtttttcgcggggtcgagtgtttttaagacggttttttgggagatttttttagagcgtattttttggaaggttgtttcgttgggaattagta

SEQ ID NO: 4814 - DNA, 1200 bp, Artificial Sequence
  chemically treated genomic DNA (Homo sapiens) CpG-island No: 4814
tactaattcccaacgaaacaaccttccaaaaaatacgctctaaaaaaatctcccaaaaaaccgtcttaaaaacactcgaccccgcgaaaaaccgaaacgaaaacgcccaataaaaaacccaaacgaaaaataacgataccccgctacccgccccaaatccactcgactcgacccgcaccgaatctaaaataatcaaaactaacaaccgacgcttcgcgctctaataattttacactaacaacgcgatctccgactcctctcaaaaaaccgaaaaaactaacaaaactaaactcctacgactacaatccccgaacccgatcgaaaaaactaaaactcgtcaaaccgaccccaaatcgcccgcctattacaaaaccgcccgctccaacgcgaaaaatcgcgaccaaaaaaaccgcattcgaacctaccgcaaacaacaaaacccgcccgaataccaaaaaaccgacgcgccaacaaccgcgctaaaaaaacctcgcaccctaacccctaaccgaacgccaaatcccgacccctacgcgcccgcgcccgaaaatcccgccgaccgcgtccccgccacgtcaaaccgcgaactctcctcaaatcgccgcccccgaacctccgacccgcgcccgcccccgcgcccctcgaactccgcgccgctaacttatccccgacccaacgatacctacttaccgcccgacccccgcgttcgctaccgcccgacccgttcgactcacgcctcgcaactaacctaataccgccgccaaccgaaaccgcactcgcaactaaaaaaaaacgaaaaacgaaaaacgaaaaacgcgaaacgaaaaactaaacgaaaaaaaccgacgaaacgaaaacctaaaccgtcacgtaaatacgccgcgcaaacgccgaacgaaccaaacgtaaacccgaaaattcccgacctaaccgaataacaacgcgaaaacgaccctaaaacgaaaaaacaaaaaacgactccactccgacgctctacgaaaaacaacaacgatcgccaaaactcaataaatccccgcactaacgcgacacctaacacttaacgaaaccgaaccaacgaataaacgaatttaccgaaaatcgccccgtctaaatccattaactctttccttacctcgatcctaccctcattcctcgactcacttcctcctacccttcctcactatctccctccccgctcat

SEQ ID NO: 4815 - DNA, 1200 bp, Artificial Sequence
  chemically treated genomic DNA (Homo sapiens) CpG-island No: 4815
tgttgatttttagcggggtagttttttaaagggtgcgttttggaagaattttttagggagtcgttttggaggtattcggtttcgcggagggtcggagcgagggcgtttagtgaggagtttaggcggaaggtggcggtgtttcgttgttcgttttagatttattcggttcggttcgtatcggatttaaaatggttagaattggtagtcgacgtttcgcgttttggtgattttgtattgatagcgcgattttcggttttttttaggaaatcgggagagttggtaaggttgggtttttacggttgtagttttcgggttcgatcgagggaattgaggttcgttaggtcggttttaaatcgttcgtttgttgtaaggtcgttcgttttagcgcggagggtcgcggttaggaaggtcgtattcggatttgtcgtaggtaatagggttcgttcgggtgttaggaggtcggcgcgttagtagtcgcgttgaggaggtttcgtattttggtttttggtcgagcgttagatttcggtttttacgcgttcgcgttcggggatttcgtcggtcgcgttttcgttacgttaggtcgcgggttttttttaggtcgtcgttttcgagttttcggttcgcgttcgttttcgcgtttttcggatttcgcgtcgttagtttgttttcggtttagcgatgtttgtttgtcgttcgattttcgcgttcgttgtcgttcggttcgttcggtttacgtttcgtagttgatttggtgtcgtcgttagtcgaggtcgtattcgtagttggagggaggcgggaggcgggaggcgggaggcgcgaggcgggaggttgggcgagaggagtcggcggggcgggggtttgggtcgttacgtgggtgcgtcgcgtaggcgtcgggcgggttagacgtaggttcgggggttttcggtttggtcgggtagtagcgcgggggcggttttggggcggggagatagggggcggttttatttcggcgttttgcggaggatagtagcgatcgttaaggtttagtgagttttcgtattagcgcggtatttggtatttggcggggtcgaattaacgaatgagcgaatttgtcgagagtcgtttcgtttgaatttattgattttttttttgtttcggttttatttttatttttcgatttatttttttttgtttttttttattattttttttttcgtttat

SEQ ID NO: 4816 - DNA, 1200 bp, Artificial Sequence
  chemically treated genomic DNA (Homo sapiens) CpG-island No: 4816
ataaacgaaaaaaaaaataataaaaaaaaacaaaaaaaaataaatcgaaaaataaaaataaaaccgaaacaaaaaaaaaatcaataaattcaaacgaaacgactctcgacaaattcgctcattcgttaattcgaccccgccaaataccaaataccgcgctaatacgaaaactcactaaaccttaacgatcgctactatcctccgcaaaacgccgaaataaaaccgccccctatctccccgccccaaaaccgcccccgcgctactacccgaccaaaccgaaaacccccgaacctacgtctaacccgcccgacgcctacgcgacgcacccacgtaacgacccaaacccccgccccgccgactcctctcgcccaacctcccgcctcgcgcctcccgcctcccgcctcccgcctccctccaactacgaatacgacctcgactaacgacgacaccaaatcaactacgaaacgtaaaccgaacgaaccgaacgacaacgaacgcgaaaatcgaacgacaaacaaacatcgctaaaccgaaaacaaactaacgacgcgaaatccgaaaaacgcgaaaacgaacgcgaaccgaaaactcgaaaacgacgacctaaaaaaaacccgcgacctaacgtaacgaaaacgcgaccgacgaaatccccgaacgcgaacgcgtaaaaaccgaaatctaacgctcgaccaaaaaccaaaatacgaaacctcctcaacgcgactactaacgcgccgacctcctaacacccgaacgaaccctattacctacgacaaatccgaatacgaccttcctaaccgcgaccctccgcgctaaaacgaacgaccttacaacaaacgaacgatttaaaaccgacctaacgaacctcaattccctcgatcgaacccgaaaactacaaccgtaaaaacccaaccttaccaactctcccgatttcctaaaaaaaaccgaaaatcgcgctatcaatacaaaatcaccaaaacgcgaaacgtcgactaccaattctaaccattttaaatccgatacgaaccgaaccgaataaatctaaaacgaacaacgaaacaccgccaccttccgcctaaactcctcactaaacgccctcgctccgaccctccgcgaaaccgaatacctccaaaacgactccctaaaaaattcttccaaaacgcaccctttaaaaaactaccccgctaaaaatcaaca

SEQ ID NO: 4817 - DNA, 814 bp, Artificial Sequence
  chemically treated genomic DNA (Homo sapiens) CpG-island No: 4817
cggtttcgaggcgttgggagcgggggtgggtttgcggagtcgcgttcgtgttttcgattcgttttttcgtttcgggtttggtttacgtagtgggcgcgtaggggcggttgtttcggtagatgtttagggagcggagggaaaggcgcgggaatcggggatttttcgggcggattttttttttattagcgttcggcgggttttttttaagttcgtttttaagtttgcgagcggttaaatgggggcgggggttgcgcggaggggcggtggttaggtcggagggtggggtttggagcgcggggcgggcgttgtcgtttggtcggtcgcggttggttcgggattagggagtcgatgtggaattttttgttcggttcggcgttttttttgtcgtttttcgttcggtttcgtatttcgttttcggtcgttttcgttgcggtcgtattcgcgttcgtgttcgtttcgcgtttgtttcgcgttttatggagggcgtagggtttcggggggtcgggtcggcgcggcgtcggggagtcggggggtcgtcgttatcgttgttgtcgtcgttgttgttgttgttgttgttttggatgttgtcggatatcgtggcgttttaggaattgaattttcgcggtcgtaacgtgtgtcgtgttttcgggtaggagtcggtttggttgggggagggggcgagagggacgttttgggtagtggtgtggcggcgtcgggtattgggagggggttatcggaatttttttacgttaagtgtgggttttttcggttttttagttagcgcggtttcgttttaggtttagtttcggttatg

SEQ ID NO: 4818 - DNA, 814 bp, Artificial Sequence
  chemically treated genomic DNA (Homo sapiens) CpG-island No: 4818
cataaccgaaactaaacctaaaacgaaaccgcgctaactaaaaaaccgaaaaaacccacacttaacgtaaaaaaattccgataaccccctcccaatacccgacgccgccacaccactacccaaaacgtccctctcgccccctcccccaaccaaaccgactcctacccgaaaacacgacacacgttacgaccgcgaaaattcaattcctaaaacgccacgatatccgacaacatccaaaacaacaacaacaacaacaacgacgacaacaacgataacgacgaccccccgactccccgacgccgcgccgacccgaccccccgaaaccctacgccctccataaaacgcgaaacaaacgcgaaacgaacacgaacgcgaatacgaccgcaacgaaaacgaccgaaaacgaaatacgaaaccgaacgaaaaacgacaaaaaaaacgccgaaccgaacaaaaaattccacatcgactccctaatcccgaaccaaccgcgaccgaccaaacgacaacgcccgccccgcgctccaaaccccaccctccgacctaaccaccgcccctccgcgcaacccccgcccccatttaaccgctcgcaaacttaaaaacgaacttaaaaaaaacccgccgaacgctaataaaaaaaaaatccgcccgaaaaatccccgattcccgcgcctttccctccgctccctaaacatctaccgaaacaaccgcccctacgcgcccactacgtaaaccaaacccgaaacgaaaaaacgaatcgaaaacacgaacgcgactccgcaaacccacccccgctcccaacgcctcgaaaccg

SEQ ID NO: 4819 - DNA, 814 bp, Artificial Sequence
  chemically treated genomic DNA (Homo sapiens) CpG-island No: 4819
tatggtcgaggttgggtttggaacggagtcgcgttggttagggagtcgaaggggtttatatttggcgtaggaaggtttcggtagtttttttttaatgttcggcgtcgttatattattgtttagagcgtttttttcgtttttttttttagttaggtcggtttttattcgggagtacggtatacgttgcggtcgcgagggtttagtttttgaggcgttacggtgttcggtagtatttagagtagtagtagtagtagtagcgacggtagtagcggtgacggcggtttttcggtttttcggcgtcgcgtcggttcggtttttcggggttttgcgttttttatgaggcgcggggtaggcgcggggcgggtacgggcgcgggtgcggtcgtagcgagagcggtcggaagcggagtgcgaggtcgggcggggggcggtaggaggggcgtcgagtcgggtaggaaattttatatcggttttttgatttcgggttagtcgcggtcggttaggcggtagcgttcgtttcgcgttttagattttatttttcggtttagttatcgttttttcgcgtagttttcgtttttatttggtcgttcgtaaatttgggggcgaatttggaggaggttcgtcgagcgttggtggagggagggttcgttcgaggaattttcggttttcgcgttttttttttcgttttttagatatttatcgaagtagtcgtttttgcgcgtttattgcgtaggttaggttcgggacgggaaggcggatcggggatacggacgcgatttcgtaagtttattttcgtttttagcgtttcggaatcg

SEQ ID NO: 4820 - DNA, 814 bp, Artificial Sequence
  chemically treated genomic DNA (Homo sapiens) CpG-island No: 4820
cgattccgaaacgctaaaaacgaaaataaacttacgaaatcgcgtccgtatccccgatccgccttcccgtcccgaacctaacctacgcaataaacgcgcaaaaacgactacttcgataaatatctaaaaaacgaaaaaaaaaacgcgaaaaccgaaaattcctcgaacgaaccctccctccaccaacgctcgacgaacctcctccaaattcgcccccaaatttacgaacgaccaaataaaaacgaaaactacgcgaaaaaacgataactaaaccgaaaaataaaatctaaaacgcgaaacgaacgctaccgcctaaccgaccgcgactaacccgaaatcaaaaaaccgatataaaatttcctacccgactcgacgcccctcctaccgccccccgcccgacctcgcactccgcttccgaccgctctcgctacgaccgcacccgcgcccgtacccgccccgcgcctaccccgcgcctcataaaaaacgcaaaaccccgaaaaaccgaaccgacgcgacgccgaaaaaccgaaaaaccgccgtcaccgctactaccgtcgctactactactactactactctaaatactaccgaacaccgtaacgcctcaaaaactaaaccctcgcgaccgcaacgtataccgtactcccgaataaaaaccgacctaactaaaaaaaaaaacgaaaaaaacgctctaaacaataatataacgacgccgaacattaaaaaaaaactaccgaaaccttcctacgccaaatataaaccccttcgactccctaaccaacgcgactccgttccaaacccaacctcgaccata

SEQ ID NO: 4821 - DNA, 526 bp, Artificial Sequence
  chemically treated genomic DNA (Homo sapiens) CpG-island No: 4821
tgttacgcgcggcgttggggcgcgcgttgcgagtatgcgtgttagtgttagtacggtacgtgttattcgcggagcggcgcgtgtcgttgtgagttcggttggtggggcgcgtagtgcgttagcgcgtgttattgtagcgttacgtcgcgttgcgatttatagatcggcgtttgtttgtgttacgtaggttggtggggtcgtagttgtaataattagtgcgtttgtaattcgtttttttgcgagtagtagagcggtcgttgttagtgtcgcgagcgtacgttcggcgcgcgttgcgatcgttattgttagtgttttcgcggtcgttgttattttgtggacggtacgtgtgtttgcgagtcgggttatcgcggtaagtattgtcgcgagtcgtgtttcgtcggtttttacggtttgggttgtcgtcgtcggtaagcgcggtttttcggttagggagggaggaggtggaagggcgggtcgtcgatggggataggggtgaggcgggttttagttttttttagttttcgat

SEQ ID NO: 4822 - DNA, 526 bp, Artificial Sequence
  chemically treated genomic DNA (Homo sapiens) CpG-island No: 4822
atcgaaaactaaaaaaaactaaaacccgcctcacccctatccccatcgacgacccgcccttccacctcctccctccctaaccgaaaaaccgcgcttaccgacgacgacaacccaaaccgtaaaaaccgacgaaacacgactcgcgacaatacttaccgcgataacccgactcgcaaacacacgtaccgtccacaaaataacaacgaccgcgaaaacactaacaataacgatcgcaacgcgcgccgaacgtacgctcgcgacactaacaacgaccgctctactactcgcaaaaaaacgaattacaaacgcactaattattacaactacgaccccaccaacctacgtaacacaaacaaacgccgatctataaatcgcaacgcgacgtaacgctacaataacacgcgctaacgcactacgcgccccaccaaccgaactcacaacgacacgcgccgctccgcgaataacacgtaccgtactaacactaacacgcatactcgcaacgcgcgccccaacgccgcgcgtaaca

SEQ ID NO: 4823 - DNA, 526 bp, Artificial Sequence
  chemically treated genomic DNA (Homo sapiens) CpG-island No: 4823
gtcggaggttagggaaggttgggattcgttttatttttgtttttatcggcggttcgtttttttattttttttttttttggtcgagagatcgcgtttatcggcggcgatagtttaagtcgtagaagtcggcggggtacggttcgcgatagtatttgtcgcggtagttcggttcgtaggtatacgtgtcgtttatagggtggtagcggtcgcggaagtattggtagtagcgatcgtagcgcgcgtcgaacgtacgttcgcggtattgatagcggtcgttttgttgttcgtagggagacgagttgtaggcgtattggttgttgtagttgcggttttattagtttgcgtggtataggtaggcgtcggtttgtgggtcgtagcgcgacgtggcgttgtagtagtacgcgttggcgtattgcgcgttttattagtcgggtttatagcggtacgcgtcgtttcgcgggtggtacgtgtcgtgttggtattggtacgtatgttcgtagcgcgcgttttagcgtcgcgcgtgata

SEQ ID NO: 4824 - DNA, 526 bp, Artificial Sequence
  chemically treated genomic DNA (Homo sapiens) CpG-island No: 4824
tatcacgcgcgacgctaaaacgcgcgctacgaacatacgtaccaataccaacacgacacgtaccacccgcgaaacgacgcgtaccgctataaacccgactaataaaacgcgcaatacgccaacgcgtactactacaacgccacgtcgcgctacgacccacaaaccgacgcctacctataccacgcaaactaataaaaccgcaactacaacaaccaatacgcctacaactcgtctccctacgaacaacaaaacgaccgctatcaataccgcgaacgtacgttcgacgcgcgctacgatcgctactaccaatacttccgcgaccgctaccaccctataaacgacacgtatacctacgaaccgaactaccgcgacaaatactatcgcgaaccgtaccccgccgacttctacgacttaaactatcgccgccgataaacgcgatctctcgaccaaaaaaaaaaaaaataaaaaaacgaaccgccgataaaaacaaaaataaaacgaatcccaaccttccctaacctccgac

SEQ ID NO: 4825 - DNA, 510 bp, Artificial Sequence
  chemically treated genomic DNA (Homo sapiens) CpG-island No: 4825
aagggcgtgatgggcgcgggcgcgttgttcgttttgttcgtttgtttgttgttttcgttgttcggttgttgttgcgtttgtcgcggtaaggattttacgcgtcggtgagtttagatattgtttcgttttcgtttgggtttaggtcgtattttttgggtgttatcggatttagatttaattttttcgcgtttttgtttcggacgtggtttcgttttttttgtgtttggtttcggtcgagatttaatcgtttttgggtttcgtttcggtttcgttttttcgtttagatttcgttttcgtagggagttttcgtttgggaggaagaaggcgtcgtatcgattatgcgggcgttttagtcgtattagtatgaagttgtttcggatttcgtttcggaggtagaaattatttaaagtcgtaggtaaggatgatagcgcggggtatttgggagaaatatttttcgacgtaggaagttgttgggaaatgggtgtgagggggtttagattttagtgagga

SEQ ID NO: 4826 - DNA, 510 bp, Artificial Sequence
  chemically treated genomic DNA (Homo sapiens) CpG-island No: 4826
tcctcactaaaatctaaaccccctcacacccatttcccaacaacttcctacgtcgaaaaatatttctcccaaataccccgcgctatcatccttacctacgactttaaataatttctacctccgaaacgaaatccgaaacaacttcatactaatacgactaaaacgcccgcataatcgatacgacgccttcttcctcccaaacgaaaactccctacgaaaacgaaatctaaacgaaaaaacgaaaccgaaacgaaacccaaaaacgattaaatctcgaccgaaaccaaacacaaaaaaaacgaaaccacgtccgaaacaaaaacgcgaaaaaattaaatctaaatccgataacacccaaaaaatacgacctaaacccaaacgaaaacgaaacaatatctaaactcaccgacgcgtaaaatccttaccgcgacaaacgcaacaacaaccgaacaacgaaaacaacaaacaaacgaacaaaacgaacaacgcgcccgcgcccatcacgccctt

SEQ ID NO: 4827 - DNA, 510 bp, Artificial Sequence
  chemically treated genomic DNA (Homo sapiens) CpG-island No: 4827
tttttattgagatttggatttttttatatttattttttagtagttttttgcgtcgagaggtgttttttttagatatttcgcgttgttatttttatttacgattttgggtagtttttgttttcggagcgggattcggggtagttttatgttgatgcgattgaagcgttcgtatagtcggtgcggcgtttttttttttttaagcgaaagttttttgcgggggcggggtttgagcggaggggcggggtcggggcggggtttaggggcgattagatttcggtcggagttaagtatagaaggggcggggttacgttcggggtaggggcgcggaagggttggatttgggttcggtggtatttagagggtgcggtttgaatttaggcgaaagcggggtagtatttgggtttatcggcgcgtagggtttttgtcgcggtaagcgtagtagtagtcgagtagcgagagtagtaggtagacgagtaggacgagtagcgcgttcgcgtttattacgttttt

SEQ ID NO: 4828 - DNA, 510 bp, Artificial Sequence
  chemically treated genomic DNA (Homo sapiens) CpG-island No: 4828
aaaaacgtaataaacgcgaacgcgctactcgtcctactcgtctacctactactctcgctactcgactactactacgcttaccgcgacaaaaaccctacgcgccgataaacccaaatactaccccgctttcgcctaaattcaaaccgcaccctctaaataccaccgaacccaaatccaacccttccgcgcccctaccccgaacgtaaccccgccccttctatacttaactccgaccgaaatctaatcgcccctaaaccccgccccgaccccgcccctccgctcaaaccccgcccccgcaaaaaactttcgcttaaaaaaaaaaaaacgccgcaccgactatacgaacgcttcaatcgcatcaacataaaactaccccgaatcccgctccgaaaacaaaaactacccaaaatcgtaaataaaaataacaacgcgaaatatctaaaaaaaacacctctcgacgcaaaaaactactaaaaaataaatataaaaaaatccaaatctcaataaaaa

SEQ ID NO: 4829 - DNA, 1063 bp, Artificial Sequence
  chemically treated genomic DNA (Homo sapiens) CpG-island No: 4829
cgtcggcgtcgttttttgtgtttttgattacgttagttttcgtcgaggaggcgatattttttttcgcgtttttcgatagcgagcggtcggcgtttagcgtggaggggttcggaggggttttgtacgcgcgcgtggttcgacgcgaggttcggtcggttcgggttcggggcgagattgggggtttgtcgttgtcgttatcgttcgagcgtaggaaatcgtcgttatttgatttcgttattaagtttaaggtgttttggatttacggtaagtatagcgtcgttgtagttggtcgtgcgtttttattatcgtcgttaggtttcgaggtcgcgtttagttttagtaagaggaaacggacgtttagcgataaatcggcgtatacggtcgaatacggtagttttcggattcgcgatttaacgtcgcgtttttcggggttgttcgaggaggcgatagttttcgttgcgttttcgtcgtttagggttcgagcgcgcgtcgcgtttcggttttttggagtttacggacgtcggcggtttttcgcgaagcgcgtcgaggttgtttttatgttggtcgttgacgtgcgcggtaagattcgtagtttgggtcgcgtcgaggtggttttgggcgcgtagggttttagggaaaagtcggcgtttttatagaaagttaagcgtttcgtgtcgttagtttcgttcgttcgcgcgtttttagcgatcgaaatttcggggtttgagaaggcggcgatcgatttgttcgcgtttgagatttttcggaagaagatttttatttagaagtcgtcgcgtaagaagagtcgggaggcggcgggcgagttgggtagggcgggcgtatttattttgtagtaggttgtggttcgttcgcgcgtagtttttttagtttcgtagcgtcgttcgttattttatattttttacgttatcgggtacgggcggttttttattggtcgggtatcgcgcggttagcggaggttgcgttttattggtttaggttttgtagtcgtttttggattggagtagtgtgttttggcgggaagggtttatttcgttggtcgagg

SEQ ID NO: 4830 - DNA, 1063 bp, Artificial Sequence
  chemically treated genomic DNA (Homo sapiens) CpG-island No: 4830
cctcgaccaacgaaataaacccttcccgccaaaacacactactccaatccaaaaacgactacaaaacctaaaccaataaaacgcaacctccgctaaccgcgcgatacccgaccaataaaaaaccgcccgtacccgataacgtaaaaaatataaaataacgaacgacgctacgaaactaaaaaaactacgcgcgaacgaaccacaacctactacaaaataaatacgcccgccctacccaactcgcccgccgcctcccgactcttcttacgcgacgacttctaaataaaaatcttcttccgaaaaatctcaaacgcgaacaaatcgatcgccgccttctcaaaccccgaaatttcgatcgctaaaaacgcgcgaacgaacgaaactaacgacacgaaacgcttaactttctataaaaacgccgacttttccctaaaaccctacgcgcccaaaaccacctcgacgcgacccaaactacgaatcttaccgcgcacgtcaacgaccaacataaaaacaacctcgacgcgcttcgcgaaaaaccgccgacgtccgtaaactccaaaaaaccgaaacgcgacgcgcgctcgaaccctaaacgacgaaaacgcaacgaaaactatcgcctcctcgaacaaccccgaaaaacgcgacgttaaatcgcgaatccgaaaactaccgtattcgaccgtatacgccgatttatcgctaaacgtccgtttcctcttactaaaactaaacgcgacctcgaaacctaacgacgataataaaaacgcacgaccaactacaacgacgctatacttaccgtaaatccaaaacaccttaaacttaataacgaaatcaaataacgacgatttcctacgctcgaacgataacgacaacgacaaacccccaatctcgccccgaacccgaaccgaccgaacctcgcgtcgaaccacgcgcgcgtacaaaacccctccgaacccctccacgctaaacgccgaccgctcgctatcgaaaaacgcgaaaaaaaatatcgcctcctcgacgaaaactaacgtaatcaaaaacacaaaaaacgacgccgacg

SEQ ID NO: 4831 - DNA, 1063 bp, Artificial Sequence
  chemically treated genomic DNA (Homo sapiens) CpG-island No: 4831
tttcgattaacgggatgggtttttttcgttagagtatattgttttaatttaggagcggttgtaggatttgagttaatgagacgtaattttcgttagtcgcgcggtgttcggttaataggaggtcgttcgtgttcggtagcgtgggaggtgtggggtggcgggcggcgttgcgaagttgagggagttgcgcgcggacgagttatagtttgttatagggtgggtgcgttcgttttgtttagttcgttcgtcgtttttcggttttttttgcgcggcggtttttggatgggggttttttttcggggggttttaggcgcgggtaagtcggtcgtcgtttttttaggtttcggggtttcggtcgttgggggcgcgcgggcgggcgaggttggcggtacggagcgtttggttttttgtgggggcgtcggtttttttttggggttttgcgcgtttagggttatttcggcgcggtttaggttgcgagttttgtcgcgtacgttagcggttaatatggaggtagtttcggcgcgtttcgcgggggatcgtcggcgttcgtgggttttaagaggtcggggcgcggcgcgcgttcgggttttgggcggcgagggcgtagcgagggttgtcgttttttcgggtagtttcggggggcgcggcgttgggtcgcgggttcgggggttgtcgtgttcgatcgtatgcgtcgatttgtcgttgggcgttcgtttttttttgttggggttgggcgcggtttcggagtttggcggcggtggtgagggcgtacggttagttgtagcggcgttgtgtttgtcgtggatttaggatattttaggtttggtggcggggttaggtggcggcggttttttgcgttcgggcgatggcgatagcgataggtttttaatttcgtttcgggttcgggtcggtcgggtttcgcgtcgggttacgcgcgcgtatagagttttttcgggtttttttacgttggacgtcgatcgttcgttgtcggaggacgcggggaggggtatcgttttttcggcggaggttggcgtggttaagggtataggggacggcgtcggcg

SEQ ID NO: 4832 - DNA, 1063 bp, Artificial Sequence
  chemically treated genomic DNA (Homo sapiens) CpG-island No: 4832
cgccgacgccgtcccctatacccttaaccacgccaacctccgccgaaaaaacgatacccctccccgcgtcctccgacaacgaacgatcgacgtccaacgtaaaaaaacccgaaaaaactctatacgcgcgcgtaacccgacgcgaaacccgaccgacccgaacccgaaacgaaattaaaaacctatcgctatcgccatcgcccgaacgcaaaaaaccgccgccacctaaccccgccaccaaacctaaaatatcctaaatccacgacaaacacaacgccgctacaactaaccgtacgccctcaccaccgccgccaaactccgaaaccgcgcccaaccccaacaaaaaaaaacgaacgcccaacgacaaatcgacgcatacgatcgaacacgacaacccccgaacccgcgacccaacgccgcgccccccgaaactacccgaaaaaacgacaaccctcgctacgccctcgccgcccaaaacccgaacgcgcgccgcgccccgacctcttaaaacccacgaacgccgacgatcccccgcgaaacgcgccgaaactacctccatattaaccgctaacgtacgcgacaaaactcgcaacctaaaccgcgccgaaataaccctaaacgcgcaaaaccccaaaaaaaaaccgacgcccccacaaaaaaccaaacgctccgtaccgccaacctcgcccgcccgcgcgcccccaacgaccgaaaccccgaaacctaaaaaaacgacgaccgacttacccgcgcctaaaaccccccgaaaaaaaacccccatccaaaaaccgccgcgcaaaaaaaaccgaaaaacgacgaacgaactaaacaaaacgaacgcacccaccctataacaaactataactcgtccgcgcgcaactccctcaacttcgcaacgccgcccgccaccccacacctcccacgctaccgaacacgaacgacctcctattaaccgaacaccgcgcgactaacgaaaattacgtctcattaactcaaatcctacaaccgctcctaaattaaaacaatatactctaacgaaaaaaacccatcccgttaatcgaaa

SEQ ID NO: 4833 - DNA, 538 bp, Artificial Sequence
  chemically treated genomic DNA (Homo sapiens) CpG-island No: 4833
tttcgttcgtgtggatgcggtggtggcgtgtgaggtgtgtacgttggttgaaggttttgtcgtattcgtcgtatcggtagggtttttcgtcggtgtgtattcgtaggtgtatgttgagtagcgagttgtagttgaaggttttttcgtaggcgttgtatttgtagggtcgttcgttcgtgtggatgcgttggtgtacgttgagggacgagtggtagttgaaggttttttcgtattcgtcgtagaagaagggtttttcgtcggtgtggatgcgtcggtgttttagaaggttggtgttttaggtgaaggttttgtcgtatttatcgtatttgtaagttttttttcggttgtgttagcgtcggtgtagcgtgagggaggagttttggcggaacgttttttcgtattcgtcgtatacgaattcgtttttttcggcgttcgtttcgcgttgtcggcgtatttgggggaatttttttggtttatttggcgtggaggcgtttttttttgtatatagtttcgcgggggttttggttttgtttttagt

SEQ ID NO: 4834 - DNA, 538 bp, Artificial Sequence
  chemically treated genomic DNA (Homo sapiens) CpG-island No: 4834
actaaaaacaaaaccaaaacccccgcgaaactatatacaaaaaaaaacgcctccacgccaaataaaccaaaaaaattcccccaaatacgccgacaacgcgaaacgaacgccgaaaaaaacgaattcgtatacgacgaatacgaaaaaacgttccgccaaaactcctccctcacgctacaccgacgctaacacaaccgaaaaaaaacttacaaatacgataaatacgacaaaaccttcacctaaaacaccaaccttctaaaacaccgacgcatccacaccgacgaaaaacccttcttctacgacgaatacgaaaaaaccttcaactaccactcgtccctcaacgtacaccaacgcatccacacgaacgaacgaccctacaaatacaacgcctacgaaaaaaccttcaactacaactcgctactcaacatacacctacgaatacacaccgacgaaaaaccctaccgatacgacgaatacgacaaaaccttcaaccaacgtacacacctcacacgccaccaccgcatccacacgaacgaaa

SEQ ID NO: 4835 - DNA, 538 bp, Artificial Sequence
  chemically treated genomic DNA (Homo sapiens) CpG-island No: 4835
attgagggtagaattaaggttttcgcgagattgtgtgtaggggaaaacgtttttacgttaagtgagttagaaaagtttttttaggtgcgtcggtagcgcggggcgggcgtcggggagggcgagttcgtgtgcggcgagtgcgggaaggcgtttcgttagagttttttttttacgttgtatcggcgttggtatagtcgggagaaggtttataagtgcgatgaatgcggtaaggtttttatttggagtattaattttttggagtatcggcgtatttatatcggcgagaagttttttttttgcggcgagtgcgggaaggtttttagttgttattcgttttttaacgtgtattagcgtatttatacgggcgagcggttttataagtgtagcgtttgcgagaaggtttttagttgtagttcgttgtttagtatgtatttgcgggtgtatatcggcgagaagttttatcggtgcggcgagtgcggtaaggtttttaattagcgtatatattttatacgttattatcgtatttatacgggcgaga

SEQ ID NO: 4836 - DNA, 538 bp, Artificial Sequence
  chemically treated genomic DNA (Homo sapiens) CpG-island No: 4836
tctcgcccgtataaatacgataataacgtataaaatatatacgctaattaaaaaccttaccgcactcgccgcaccgataaaacttctcgccgatatacacccgcaaatacatactaaacaacgaactacaactaaaaaccttctcgcaaacgctacacttataaaaccgctcgcccgtataaatacgctaatacacgttaaaaaacgaataacaactaaaaaccttcccgcactcgccgcaaaaaaaaaacttctcgccgatataaatacgccgatactccaaaaaattaatactccaaataaaaaccttaccgcattcatcgcacttataaaccttctcccgactataccaacgccgatacaacgtaaaaaaaaaactctaacgaaacgccttcccgcactcgccgcacacgaactcgccctccccgacgcccgccccgcgctaccgacgcacctaaaaaaacttttctaactcacttaacgtaaaaacgttttcccctacacacaatctcgcgaaaaccttaattctaccctcaat

SEQ ID NO: 4837 - DNA, 703 bp, Artificial Sequence
  chemically treated genomic DNA (Homo sapiens) CpG-island No: 4837
tacgattatacgtacggagtttttttttcgcgttcggttgaggtggggtttaggtcggtttcgtagatatttattttttatattaggtttagttttatgttcggcgtatttacgtttcggtatattttcgttatacgtttttttcggcgaattcgcgttcggagattagggttaggtttaaggtttcgcggttaggagttatcggacgcggagcgattagcggataggtttcgaagcggatagagatcgtcgacggtttgagggatcggtaagtggatagatcggatttttataaaaggattgcgattgttataaagagtagtaggcggtcgttgcgggaaagcgcgtttgcgcgaaataggcgtaaattatatttttcgggagcgtttgcgtcgcgtaggcgttagattttattttttagagcgagttcgggtcggtgtttgcgtttcgacgcgaacgagtatttagtatatttttttaggaaatgtagtttttgggtttatagtcgggagtttcggtatttattatgtttttgcgggcggatgtcgttgtgtattttcgtgtgcggattagtgtagtgtcgttgtatgggtgtttaattgcgaggatattgggagggcggtgtttaggaattagaatttgttttgttagttcgtttacgtttttacgtagttgggagtcgggtgggtttttgtttatattt

SEQ ID NO: 4838 - DNA, 703 bp, Artificial Sequence
  chemically treated genomic DNA (Homo sapiens) CpG-island No: 4838
aaatataaacaaaaacccacccgactcccaactacgtaaaaacgtaaacgaactaacaaaacaaattctaattcctaaacaccgccctcccaatatcctcgcaattaaacacccatacaacgacactacactaatccgcacacgaaaatacacaacgacatccgcccgcaaaaacataataaataccgaaactcccgactataaacccaaaaactacatttcctaaaaaaatatactaaatactcgttcgcgtcgaaacgcaaacaccgacccgaactcgctctaaaaaataaaatctaacgcctacgcgacgcaaacgctcccgaaaaatataatttacgcctatttcgcgcaaacgcgctttcccgcaacgaccgcctactactctttataacaatcgcaatccttttataaaaatccgatctatccacttaccgatccctcaaaccgtcgacgatctctatccgcttcgaaacctatccgctaatcgctccgcgtccgataactcctaaccgcgaaaccttaaacctaaccctaatctccgaacgcgaattcgccgaaaaaaacgtataacgaaaatataccgaaacgtaaatacgccgaacataaaactaaacctaatataaaaaataaatatctacgaaaccgacctaaaccccacctcaaccgaacgcgaaaaaaaaactccgtacgtataatcgta

SEQ ID NO: 4839 - DNA, 703 bp, Artificial Sequence
  chemically treated genomic DNA (Homo sapiens) CpG-island No: 4839
agatgtgggtaggaatttattcgatttttagttacgtggggacgtggacgaattaataggataaattttagtttttggatatcgtttttttagtattttcgtaattagatatttatgtagcggtattatattgattcgtatacggagatatatagcgatattcgttcgtaagagtatggtgggtgtcggagttttcggttgtgggtttaggaattatattttttagaaggatgtgttagatattcgttcgcgtcgggacgtaagtatcggttcgaattcgttttaggaaatggagtttgacgtttgcgcggcgtaaacgttttcgggaggtgtagtttgcgtttatttcgcgtaggcgcgttttttcgtagcggtcgtttgttgttttttgtggtagtcgtagtttttttgtgggagttcggtttgtttatttgtcggttttttagatcgtcggcggtttttgttcgtttcgggatttgttcgttggtcgtttcgcgttcgatggtttttggtcgcggaattttaggtttggttttggttttcgagcgcgggttcgtcgggaggagcgtgtggcgggggtgtgtcggggcgtgagtgcgtcgagtatggggttgagtttggtgtggggagtgggtatttgcggagtcggtttgaattttattttagtcgggcgcggggagggggtttcgtgcgtgtgatcgtg

SEQ ID NO: 4840 - DNA, 703 bp, Artificial Sequence
  chemically treated genomic DNA (Homo sapiens) CpG-island No: 4840
cacgatcacacgcacgaaaccccctccccgcgcccgactaaaataaaattcaaaccgactccgcaaatacccactccccacaccaaactcaaccccatactcgacgcactcacgccccgacacacccccgccacacgctcctcccgacgaacccgcgctcgaaaaccaaaaccaaacctaaaattccgcgaccaaaaaccatcgaacgcgaaacgaccaacgaacaaatcccgaaacgaacaaaaaccgccgacgatctaaaaaaccgacaaataaacaaaccgaactcccacaaaaaaactacgactaccacaaaaaacaacaaacgaccgctacgaaaaaacgcgcctacgcgaaataaacgcaaactacacctcccgaaaacgtttacgccgcgcaaacgtcaaactccatttcctaaaacgaattcgaaccgatacttacgtcccgacgcgaacgaatatctaacacatccttctaaaaaatataattcctaaacccacaaccgaaaactccgacacccaccatactcttacgaacgaatatcgctatatatctccgtatacgaatcaatataataccgctacataaatatctaattacgaaaatactaaaaaaacgatatccaaaaactaaaatttatcctattaattcgtccacgtccccacgtaactaaaaatcgaataaattcctacccacatct

SEQ ID NO: 4841 - DNA, 7593 bp, Artificial Sequence
  chemically treated genomic DNA (Homo sapiens) CpG-island No: 4841
ggagttttcgttagcgatgtcgtgtacggcgttttcgttagcgatgtcgtgggcggcgttttcgttagcgatgttttgggcggcgttttttttagttatgtgtcgggcggcgttttcgttagcgacgtcgtggacggcgatttcgttagcgacgttttgggcggcgttttcgttagcgacgttttgggcggcgatttcgttagcgacgtcgtgggcggtattttcgttagcgacgtcgtgggcggcgatttcgttagcgacgttttgggcggcgttttcgttagcgacgttttgggcggcgttttcgttagcgatgttttggatggcgtttttgtgtgcgatgttttggatttcgatttcgttagcgacgttttggacggcgttttcgttagcgacgtcgtggacggcgttttcgttagcgacgttttgggcggcgatttcgttagcgacgttttgggcggcgttttcgttagcgacgtcgtgggcggcgatttcgttagcgacgtcgtgggcggcgttttcgttagcgacgttttgggcggcgatttcgttagtgacgttttgggcggcgttttcgttagtgatgtcgtgggcggcgttttgtttagcgatggtttgggcggttttttcgttagtgatgttttggacggcgtttttagcgatgtcgtcggcgatattttcggtagtaatgttttgggtagcgatttcgttagttacgttttggacggtgtggtgttttcgatagcgatgttgtggacggcgatttcgttagcgatgttttgggcggcgattttattagcgatgttatgggcggcgttcggtttagcgatcgtttgggcggtattttcgttagcgacgtcgtgggcggcgttttcgttagcgatgtcgtcggcgatattttcggtagcgatgttttgggcggcgatttcgttagcgatgtcgcgggcggcgttcggtttagcgatcgcgtgggcggtattttcgttagcgacgtcgtgggcggcgatttttttagcgacgtcgtggacggcgttttcgttagcgatgttttggacggcgttttcgtgtgtaatgttttgggcggcgttttcgttcgcgatgttttgggcggcgttttcgttcgcgatgtcgtgggcggcgatttcgttagcgatgtcgtgggcggcgttttcgttagcgatgttttggacggcgttttcgtgtgcgacgttttggattttaatttcgttagcgacgttttggacggcgttttcgttagcgacgttttggacggggttttcgttagcgacgttttggacggggttttttttagcgatgttttgggcggcgttttcgtttgcgatgttttgggcggcgttttcgttcgcgatgttttgggtagcgttttcgttggcgatgtcgtgggcggcgttttcgttagcgatgttttggacggcgttttcgtgtgcgacgttttggattttaatttcgttagcgacgttttggatggggttttttttagcgatgttttgggcggcgttttcgttcgcgatgttttggacggcgttttttttagagatgtcgtgggcggcgatttcgttagcgacgtcgtgggcggcgttttcgttagcgatgtcgtcggcgatattttcggtagcgatgttttgggcggtaatttcgttagcgatgtcgcgggcggcgttcggtttagcgatcgcgtgggcggtattttcgttagcgacgttatgggcggcgatttttttagcgacgttgtggacggcgttttcgttagcgatgttttggacggcgttttcgtgtgcgatgttttgggcggcgttttcgttcgcgatgttttgggcggcgttttcgttcgcgatgtcgtgggcggcgatttcgttagtgatgtcgtgggcggcgttttcgttagcgatgttttggacggcgttttcgtgtgcgacgttttggattttaatttcgttagcgacgttttggacggcgttttcgttagcgacgttttggacggggttttcgttagcgacgtcgtgggcggcgatttttttagcgacgtcgtggacggcgttttcgttagtaatgttttggacggcgttttcgtgtgcgatgttttgggcggcgttttcgttcgcgatgttttgggcggcgttttcgttcgcgatgttttggacggcgttttttttagagatgtcgtgggcggcgatttcgttagcgatgttttgggcggcgttttcgttcgcgatgttttgggtagcgttttcgttcgcgatgttgtgggcggcgatttcgttagcgatgttatgggcggcgttcggtttagcgattgtttgggcggtattttcgttagcgacgacgttgtggagggcgtattcgttaacgacgttttggacggcgttttcgttagcgacgtcgtgggcggtgatttttttagcgacgttttgggcggcgttttcgatagcgacgtagtggacggcgatttcgttagcgatgtcgtgggcggcgatttcgttagcgacgtcgtgggcggcgttttcgttagcgatgtcgtcggcgatattttcggtagcgatgttttgggcggcgatttcgttagcgatgtcgcgggcggcgttcggtttagcgatcgcgtgggcggtattttcgttagcgacgtcgtgggcggcgatttttttagcgatgtcgtggacggcgttttcgttagcgatgttttggacggcgttttcgtgtgcgatgttttgggcggcgttttcgttcgcgatgttttgggcggtattttcgttcgcgatgttatgggtagcgatttcgttagcgatgtcgtgggcggcgttttcgttagcgatgttttggacggcgttttcgtgtgcgatattttggattttaatttcgttagcgacgttttggacggcgttttcgttagcgacgttttggacggggttttcgttagcgacgtcgtgggcggtaatttttttagcgacgtcgtggacggcgttttcgttagtaatgttttggacggcgttttcgtgtgcgatgttttgggcggcgttttcgttcgcgatgttttgggcggcgttttcgttcgcgatgttttggacggcgttttttttagagatgttatgggtggcgatttcgttagcgatgttttgggcggcgttttcgttagcgacgtcgtgggcggcgttttcgttagcgacgttttggacggtattttcgttagtgatgttgtgggcggtattttgtttagcgatggtttgggcggttttttcgttagtgatgttatgggcggcgtttttagcgatgtcgtcggcgatattttcggtagcgatgttttgggtagcgatttcgttagttacgttttggacggtgtggtgttttcgatagcgatgttgtggacggcgatttcgttagcgatgttttgggcggcgatttcgttagcgatgttatgggcgttgttcggtttagcgatcgtttgggcggtattttcgttagcgacgacgttatggagggttttttggttaacgacgttttggacggcgttttcgttagtgacgtcgtgggcggtgatttttttagcgacgttttgggcggcgttttcgttagcgacgtcgtggacggcgttttcgttagcgacgttttgggcggcgttttcgttagcgacgttttgggcggcgttttcgttcgcgacgtcgtgggcggcgatttcgttagcgatgtcgtgggcggcgttttcgttagcgatgttttggacggcgttttcgtgtgcgatgttttggattttaatttcgttagcgacgttttggacgacgttttcgttagcgacgttttggatagggttttcgttagcgacgtcgtgggcggcgatttttttagcgacgtcgtggacggcgttttcgttagtaatgttttggacggcgttttcgtgtgcgatgttttgggcggcgttttcgttcgcgatgttttgggcggcgttttcgttcgcgatgttttggacggcgttttttttagagatgtcgtgggcggcgatttcgttagcgatgttttgggcggcgttttcgttcgcgatgttttgggtagcgttttcgttttcgatgtcgtgggcggcgatttcgttagcgatgttatgggcggcgttcggtttagcgatcgtttgggcggtattttcgttagcgaagacgttgtggagggcgtttttattaacgacgttttggacggcgttttcgttagcgacgtcgtgggcggtgatttttttagcgacgttttgggcggcgttttcgttagcgacgtcgtggacggcgttttcgttagcgacgttttggacggcgttttcgatagcgacgtcgtgggcggcgatttcgttagcgacgtcgtgggcggcgttttcgttagcgatgtcgtcggcgatattttcggtagcgatgttttgggtggcgatttcgttagcgatgtcgtgggcggtattcggtttagcgatcgcgtgggcggtattttcgttagcgacgtcgtgggcggcgatttcgttagcgacgtcgtggacggcgtttttgttagcgatgtcgtcggcgatattttcggtagcgatgttttgggcggtaatttcgttagcgatgtcgcgggcggcgttcggtttagcgatcgcgtgggcggtatttttgttagcgacgtcgtgggcggcgatttttttagcgacgtcgtggacggcgttttcgttagcgatgttttggacggcgttttcgtgtgcgatgttttgggcggcgttttcgttcgcgatgttttgggcggcgttttcgttcgcgatgttttggatagcgttttttttagagatgtcgtgggcggcgatttcgttagcgatgttttgggcggcgttttcgttcgcgatgtcgtgggcggcgatttcgttagcgatgttatgggcggcgttcggtttagcgatcgtttgggcggtattttcgttagcgacgacgtcgtggagggcgttttcgttaacgacgttttggacggcgttttcgttagcgacgtcgtgggcggtgatttttttagcgacgtcgtgggcggcgtttttattagcgatgtcgtcggcgatattttcggtagcgatgttttgggtggcgatttcgttagcgatgtcgtgggcggtattcggtttagcgatcgcgtgggcggtattttcgttagcgacgtcgtgggcggcgatttttttagcgacgtcgtggacggcgttttcgttagcgatgttttggacggtatttttatgtgttatgttttgggcggcgttttcgttcgcgatgtcgtgggcggcgatttcgttagtgatgtcgtgggcggcgttttcgttagcgatgttttggacggcgttttcgtgtgcgacgttttggattttaatttcgttagcgacgttttggacggcgttttcgttagcgacgttttggacggggttttttttagcgatgttttgggcggcgttttcgttcgcgatgttttggacggcgttttttttagagatgttttgggcggcgttttcgtttgcgatgttttgggcggtatttttttttgcgatgttttgggcggcgttttcgttcgcgatgttttgggtagcgatttcgttcgcgatgtcgtgggcggcgttttcgttagcgatgttttggacggcgttttcgtgtgcgacgttttggattttaatttcgttagcgacgttttggatagggttttcgttagcgacgttttggacggggttttttttagcgatgttttgggcggcgttttcgttcgcgatgttttggacggtgttttttttagagatgtcgtgggcggcgatttcgttagcgatgttttgggcggcgttttcgttcgcgatgttttgggtagcgttttcgtttgcgatgtcgtgggcggcgatttcgttagcgatgtcgtgggcggtattttcgttagcgatgttttggatggcgtttttgtgtgcgatgttttggatttcgatttcgttagcgacgttttggacggcgttttcgttagcgacgttttgggcggcgttttcgttagcgacgttttgggcggcgatttcgttagcgacgttttgggcggcgttttcgttagcgacgtcgtgggcggcgatttcgttagcgacgtcgtgggcggcgttttcgttagcgacgttttgggcggcgatttcgttagcgacgttttggacggcgttttcgttagtgatgtcgtgggcggtattttgtttagcgatggtttgggcggtttttttgttagtgatgttatgggcggcgtttttagcgatgtcgtcggcgatattttcggtagcgatgttttgggtagcgatttcgttagttacgttttggacggtgtggtgttttcgatagcgatgttgtggatggcgatttcgttagcgatgttttgcgcggtgatttcgttagcgatgttatgggcggcgttcggtttagcgatcgtttgggcggtattttcgttagcgacgacgtcgtggagggcgttttcgttaacgatattttggacggcgttttcgttagcgacgtcgtgggcggtgatttttttagcgacgttttgggcggcgttttcgttagcgacgttttcgacggcgttttcgttagcgacgttttgggcggcgatttcgttagcgacgtcgtgggcggcgttttcgttagcgatgtcgtcggcgacgttttcggtagcgatgttttgggcggtaatttcgttagcgatgtcgcgggcggcgttcggtttagcgatcgcgtgggcggtattttcgttagcgacgtcgtgggcggcgatttttttagcgacgtcgtggacggcgttttcgttagcgatgttttggacggcgttttcgttagcgacgttttggacggggttttcgttagcgacgttttggacggggttttttttagcgatgttttggacggcgttttcgttattgacgttttggacggggttttcgttagcgacgttttggacggggttttttttagcgatgttttgggcggtattttcgttcgcgatgttttggacggcgttttttttagagatgttttgggcggcgttttcgtttgcgatgttttgggcggcgttttcgtttgcgatgttttgggttgcgttttcgtttgcgatgtcgtgggcggcgttttcgttagcgatgttttgggcggcgttttcgtttgcgatgttttgggcggcgttttttttaaggacgttttgggcggcgatttcgttagcgatgtagtggacggcgttttcgttagcgacgttttgggcggcgatttcgttagcgacgtcgtgggcggcgtttttattagcgatattgtgggcggcgtttttattaacgatgttttgggtggtattttcgttagcgatgtcgtggatcgcgttttcgttagcgatgttttgggcggcgttttcgttagcgattacgtgggcggtattttcgttagcgatgtcgtggacggttttttcgttagcgatgttttgggcggcgtttttttttgcgatgttttggacggcgttttcgttagcgatgttatatatggcgtttttagtagtaatgttatatatagcgtttttattagcgatgtcgtgtatagtgtttttata

SEQ ID NO: 4842 - DNA, 7593 bp, Artificial Sequence
  chemically treated genomic DNA (Homo sapiens) CpG-island No: 4842
tataaaaacactatacacgacatcgctaataaaaacgctatatataacattactactaaaaacgccatatataacatcgctaacgaaaacgccgtccaaaacatcgcaaaaaaaaacgccgcccaaaacatcgctaacgaaaaaaccgtccacgacatcgctaacgaaaataccgcccacgtaatcgctaacgaaaacgccgcccaaaacatcgctaacgaaaacgcgatccacgacatcgctaacgaaaataccacccaaaacatcgttaataaaaacgccgcccacaatatcgctaataaaaacgccgcccacgacgtcgctaacgaaatcgccgcccaaaacgtcgctaacgaaaacgccgtccactacatcgctaacgaaatcgccgcccaaaacgtccttaaaaaaaacgccgcccaaaacatcgcaaacgaaaacgccgcccaaaacatcgctaacgaaaacgccgcccacgacatcgcaaacgaaaacgcaacccaaaacatcgcaaacgaaaacgccgcccaaaacatcgcaaacgaaaacgccgcccaaaacatctctaaaaaaaacgccgtccaaaacatcgcgaacgaaaataccgcccaaaacatcgctaaaaaaaaccccgtccaaaacgtcgctaacgaaaaccccgtccaaaacgtcaataacgaaaacgccgtccaaaacatcgctaaaaaaaaccccgtccaaaacgtcgctaacgaaaaccccgtccaaaacgtcgctaacgaaaacgccgtccaaaacatcgctaacgaaaacgccgtccacgacgtcgctaaaaaaatcgccgcccacgacgtcgctaacgaaaataccgcccacgcgatcgctaaaccgaacgccgcccgcgacatcgctaacgaaattaccgcccaaaacatcgctaccgaaaacgtcgccgacgacatcgctaacgaaaacgccgcccacgacgtcgctaacgaaatcgccgcccaaaacgtcgctaacgaaaacgccgtcgaaaacgtcgctaacgaaaacgccgcccaaaacgtcgctaaaaaaatcaccgcccacgacgtcgctaacgaaaacgccgtccaaaatatcgttaacgaaaacgccctccacgacgtcgtcgctaacgaaaataccgcccaaacgatcgctaaaccgaacgccgcccataacatcgctaacgaaatcaccgcgcaaaacatcgctaacgaaatcgccatccacaacatcgctatcgaaaacaccacaccgtccaaaacgtaactaacgaaatcgctacccaaaacatcgctaccgaaaatatcgccgacgacatcgctaaaaacgccgcccataacatcactaacaaaaaaaccgcccaaaccatcgctaaacaaaataccgcccacgacatcactaacgaaaacgccgtccaaaacgtcgctaacgaaatcgccgcccaaaacgtcgctaacgaaaacgccgcccacgacgtcgctaacgaaatcgccgcccacgacgtcgctaacgaaaacgccgcccaaaacgtcgctaacgaaatcgccgcccaaaacgtcgctaacgaaaacgccgcccaaaacgtcgctaacgaaaacgccgtccaaaacgtcgctaacgaaatcgaaatccaaaacatcgcacacaaaaacgccatccaaaacatcgctaacgaaaataccgcccacgacatcgctaacgaaatcgccgcccacgacatcgcaaacgaaaacgctacccaaaacatcgcgaacgaaaacgccgcccaaaacatcgctaacgaaatcgccgcccacgacatctctaaaaaaaacaccgtccaaaacatcgcgaacgaaaacgccgcccaaaacatcgctaaaaaaaaccccgtccaaaacgtcgctaacgaaaaccctatccaaaacgtcgctaacgaaattaaaatccaaaacgtcgcacacgaaaacgccgtccaaaacatcgctaacgaaaacgccgcccacgacatcgcgaacgaaatcgctacccaaaacatcgcgaacgaaaacgccgcccaaaacatcgcaaaaaaaaataccgcccaaaacatcgcaaacgaaaacgccgcccaaaacatctctaaaaaaaacgccgtccaaaacatcgcgaacgaaaacgccgcccaaaacatcgctaaaaaaaaccccgtccaaaacgtcgctaacgaaaacgccgtccaaaacgtcgctaacgaaattaaaatccaaaacgtcgcacacgaaaacgccgtccaaaacatcgctaacgaaaacgccgcccacgacatcactaacgaaatcgccgcccacgacatcgcgaacgaaaacgccgcccaaaacataacacataaaaataccgtccaaaacatcgctaacgaaaacgccgtccacgacgtcgctaaaaaaatcgccgcccacgacgtcgctaacgaaaataccgcccacgcgatcgctaaaccgaataccgcccacgacatcgctaacgaaatcgccacccaaaacatcgctaccgaaaatatcgccgacgacatcgctaataaaaacgccgcccacgacgtcgctaaaaaaatcaccgcccacgacgtcgctaacgaaaacgccgtccaaaacgtcgttaacgaaaacgccctccacgacgtcgtcgctaacgaaaataccgcccaaacgatcgctaaaccgaacgccgcccataacatcgctaacgaaatcgccgcccacgacatcgcgaacgaaaacgccgcccaaaacatcgctaacgaaatcgccgcccacgacatctctaaaaaaaacgctatccaaaacatcgcgaacgaaaacgccgcccaaaacatcgcgaacgaaaacgccgcccaaaacatcgcacacgaaaacgccgtccaaaacatcgctaacgaaaacgccgtccacgacgtcgctaaaaaaatcgccgcccacgacgtcgctaacaaaaataccgcccacgcgatcgctaaaccgaacgccgcccgcgacatcgctaacgaaattaccgcccaaaacatcgctaccgaaaatatcgccgacgacatcgctaacaaaaacgccgtccacgacgtcgctaacgaaatcgccgcccacgacgtcgctaacgaaaataccgcccacgcgatcgctaaaccgaataccgcccacgacatcgctaacgaaatcgccacccaaaacatcgctaccgaaaatatcgccgacgacatcgctaacgaaaacgccgcccacgacgtcgctaacgaaatcgccgcccacgacgtcgctatcgaaaacgccgtccaaaacgtcgctaacgaaaacgccgtccacgacgtcgctaacgaaaacgccgcccaaaacgtcgctaaaaaaatcaccgcccacgacgtcgctaacgaaaacgccgtccaaaacgtcgttaataaaaacgccctccacaacgtcttcgctaacgaaaataccgcccaaacgatcgctaaaccgaacgccgcccataacatcgctaacgaaatcgccgcccacgacatcgaaaacgaaaacgctacccaaaacatcgcgaacgaaaacgccgcccaaaacatcgctaacgaaatcgccgcccacgacatctctaaaaaaaacgccgtccaaaacatcgcgaacgaaaacgccgcccaaaacatcgcgaacgaaaacgccgcccaaaacatcgcacacgaaaacgccgtccaaaacattactaacgaaaacgccgtccacgacgtcgctaaaaaaatcgccgcccacgacgtcgctaacgaaaaccctatccaaaacgtcgctaacgaaaacgtcgtccaaaacgtcgctaacgaaattaaaatccaaaacatcgcacacgaaaacgccgtccaaaacatcgctaacgaaaacgccgcccacgacatcgctaacgaaatcgccgcccacgacgtcgcgaacgaaaacgccgcccaaaacgtcgctaacgaaaacgccgcccaaaacgtcgctaacgaaaacgccgtccacgacgtcgctaacgaaaacgccgcccaaaacgtcgctaaaaaaatcaccgcccacgacgtcactaacgaaaacgccgtccaaaacgtcgttaaccaaaaaaccctccataacgtcgtcgctaacgaaaataccgcccaaacgatcgctaaaccgaacaacgcccataacatcgctaacgaaatcgccgcccaaaacatcgctaacgaaatcgccgtccacaacatcgctatcgaaaacaccacaccgtccaaaacgtaactaacgaaatcgctacccaaaacatcgctaccgaaaatatcgccgacgacatcgctaaaaacgccgcccataacatcactaacgaaaaaaccgcccaaaccatcgctaaacaaaataccgcccacaacatcactaacgaaaataccgtccaaaacgtcgctaacgaaaacgccgcccacgacgtcgctaacgaaaacgccgcccaaaacatcgctaacgaaatcgccacccataacatctctaaaaaaaacgccgtccaaaacatcgcgaacgaaaacgccgcccaaaacatcgcgaacgaaaacgccgcccaaaacatcgcacacgaaaacgccgtccaaaacattactaacgaaaacgccgtccacgacgtcgctaaaaaaattaccgcccacgacgtcgctaacgaaaaccccgtccaaaacgtcgctaacgaaaacgccgtccaaaacgtcgctaacgaaattaaaatccaaaatatcgcacacgaaaacgccgtccaaaacatcgctaacgaaaacgccgcccacgacatcgctaacgaaatcgctacccataacatcgcgaacgaaaataccgcccaaaacatcgcgaacgaaaacgccgcccaaaacatcgcacacgaaaacgccgtccaaaacatcgctaacgaaaacgccgtccacgacatcgctaaaaaaatcgccgcccacgacgtcgctaacgaaaataccgcccacgcgatcgctaaaccgaacgccgcccgcgacatcgctaacgaaatcgccgcccaaaacatcgctaccgaaaatatcgccgacgacatcgctaacgaaaacgccgcccacgacgtcgctaacgaaatcgccgcccacgacatcgctaacgaaatcgccgtccactacgtcgctatcgaaaacgccgcccaaaacgtcgctaaaaaaatcaccgcccacgacgtcgctaacgaaaacgccgtccaaaacgtcgttaacgaatacgccctccacaacgtcgtcgctaacgaaaataccgcccaaacaatcgctaaaccgaacgccgcccataacatcgctaacgaaatcgccgcccacaacatcgcgaacgaaaacgctacccaaaacatcgcgaacgaaaacgccgcccaaaacatcgctaacgaaatcgccgcccacgacatctctaaaaaaaacgccgtccaaaacatcgcgaacgaaaacgccgcccaaaacatcgcgaacgaaaacgccgcccaaaacatcgcacacgaaaacgccgtccaaaacattactaacgaaaacgccgtccacgacgtcgctaaaaaaatcgccgcccacgacgtcgctaacgaaaaccccgtccaaaacgtcgctaacgaaaacgccgtccaaaacgtcgctaacgaaattaaaatccaaaacgtcgcacacgaaaacgccgtccaaaacatcgctaacgaaaacgccgcccacgacatcactaacgaaatcgccgcccacgacatcgcgaacgaaaacgccgcccaaaacatcgcgaacgaaaacgccgcccaaaacatcgcacacgaaaacgccgtccaaaacatcgctaacgaaaacgccgtccacaacgtcgctaaaaaaatcgccgcccataacgtcgctaacgaaaataccgcccacgcgatcgctaaaccgaacgccgcccgcgacatcgctaacgaaattaccgcccaaaacatcgctaccgaaaatatcgccgacgacatcgctaacgaaaacgccgcccacgacgtcgctaacgaaatcgccgcccacgacatctctaaaaaaaacgccgtccaaaacatcgcgaacgaaaacgccgcccaaaacatcgctaaaaaaaaccccatccaaaacgtcgctaacgaaattaaaatccaaaacgtcgcacacgaaaacgccgtccaaaacatcgctaacgaaaacgccgcccacgacatcgccaacgaaaacgctacccaaaacatcgcgaacgaaaacgccgcccaaaacatcgcaaacgaaaacgccgcccaaaacatcgctaaaaaaaaccccgtccaaaacgtcgctaacgaaaaccccgtccaaaacgtcgctaacgaaaacgccgtccaaaacgtcgctaacgaaattaaaatccaaaacgtcgcacacgaaaacgccgtccaaaacatcgctaacgaaaacgccgcccacgacatcgctaacgaaatcgccgcccacgacatcgcgaacgaaaacgccgcccaaaacatcgcgaacgaaaacgccgcccaaaacattacacacgaaaacgccgtccaaaacatcgctaacgaaaacgccgtccacgacgtcgctaaaaaaatcgccgcccacgacgtcgctaacgaaaataccgcccacgcgatcgctaaaccgaacgccgcccgcgacatcgctaacgaaatcgccgcccaaaacatcgctaccgaaaatatcgccgacgacatcgctaacgaaaacgccgcccacgacgtcgctaacgaaaataccgcccaaacgatcgctaaaccgaacgccgcccataacatcgctaataaaatcgccgcccaaaacatcgctaacgaaatcgccgtccacaacatcgctatcgaaaacaccacaccgtccaaaacgtaactaacgaaatcgctacccaaaacattactaccgaaaatatcgccgacgacatcgctaaaaacgccgtccaaaacatcactaacgaaaaaaccgcccaaaccatcgctaaacaaaacgccgcccacgacatcactaacgaaaacgccgcccaaaacgtcactaacgaaatcgccgcccaaaacgtcgctaacgaaaacgccgcccacgacgtcgctaacgaaatcgccgcccacgacgtcgctaacgaaaacgccgcccaaaacgtcgctaacgaaatcgccgcccaaaacgtcgctaacgaaaacgccgtccacgacgtcgctaacgaaaacgccgtccaaaacgtcgctaacgaaatcgaaatccaaaacatcgcacacaaaaacgccatccaaaacatcgctaacgaaaacgccgcccaaaacgtcgctaacgaaaacgccgcccaaaacgtcgctaacgaaatcgccgcccacgacgtcgctaacgaaaataccgcccacgacgtcgctaacgaaatcgccgcccaaaacgtcgctaacgaaaacgccgcccaaaacgtcgctaacgaaatcgccgtccacgacgtcgctaacgaaaacgccgcccgacacataactaaaaaaaacgccgcccaaaacatcgctaacgaaaacgccgcccacgacatcgctaacgaaaacgccgtacacgacatcgctaacgaaaactcc

SEQ ID NO: 4843 - DNA, 7593 bp, Artificial Sequence
  chemically treated genomic DNA (Homo sapiens) CpG-island No: 4843
tatgaggatattgtatacgatatcgttaatgaggacgttgtatatgatattgttattgaggacgttatatatgatatcgttaacgaggacgtcgtttagggtatcgtaaaggaggacgtcgtttagggtatcgttaacgaggaagtcgtttacgatatcgttaacgaggatgtcgtttacgtaatcgttaacgaggacgtcgtttagagtatcgttaacgaggacgcggtttacgatatcgttaacgaggatgttatttagggtatcgttaatgaggacgtcgtttataatatcgttaatgaggacgtcgtttacggcgtcgttaacgaggtcgtcgtttagggcgtcgttaacgaggacgtcgtttattgtatcgttaacgaggtcgtcgtttagggcgtttttaaagaggacgtcgtttaggatatcgtaaacgaggacgtcgtttagggtatcgttaacgaggacgtcgtttacggtatcgtaaacgaggacgtagtttaggatatcgtaaacgaggacgtcgtttaggatatcgtaaacgaggacgtcgtttagggtatttttaaggaggacgtcgtttagggtatcgcgaacgaggatgtcgtttagggtatcgttaaggaggatttcgtttagggcgtcgttaacgaggatttcgtttagggcgttaataacgaggacgtcgtttagggtatcgttaaggaggatttcgtttagggcgtcgttaacgaggatttcgtttagggcgtcgttaacgaggacgtcgtttagggtatcgttaacgaggacgtcgtttacggcgtcgttaaagaggtcgtcgtttacggcgtcgttaacgaggatgtcgtttacgcgatcgttaagtcggacgtcgttcgcggtatcgttaacgaggttgtcgtttagggtatcgttatcgaggacgtcgtcgacggtatcgttaacgaggacgtcgtttacggcgtcgttaacgaggtcgtcgtttagggcgtcgttaacgaggacgtcgtcgagggcgtcgttaacgaggacgtcgtttagggcgtcgttaaagaggttatcgtttacggcgtcgttaacgaggacgtcgtttagggtgtcgttaacgaggacgttttttacggcgtcgtcgttaacgaggatgtcgtttaagcgatcgttaagtcggacgtcgtttatggtatcgttaacgaggttatcgcgtagggtatcgttaacgaggtcgttatttatagtatcgttatcgaggatattatatcgtttagggcgtggttaacgaggtcgttgtttagggtatcgttatcgaggatgtcgtcgacggtatcgttgaggacgtcgtttatggtattattaataaggaggtcgtttaggttatcgttaagtaggatgtcgtttacggtattattaacgaggacgtcgtttagggcgtcgttaacgaggtcgtcgtttagggcgtcgttaacgaggacgtcgtttacggcgtcgttaacgaggtcgtcgtttacggcgtcgttaacgaggacgtcgtttagggcgtcgttaacgaggtcgtcgtttagggcgtcgttaacgaggacgtcgtttagggcgtcgttaacgaggacgtcgtttagggcgtcgttaacgaggtcgaagtttagggtatcgtatataaggacgttatttagggtatcgttaacgaggatgtcgtttacggtatcgttaacgaggtcgtcgtttacggtatcgtaaacgaggacgttgtttagggtatcgcgaacgaggacgtcgtttagggtatcgttaacgaggtcgtcgtttacggtatttttaaggaggatatcgtttagggtatcgcgaacgaggacgtcgtttagggtatcgttaaagagaatttcgtttagggcgtcgttaacgaggattttgtttagggcgtcgttaacgaggttgaagtttagggcgtcgtatacgaggacgtcgtttagggtatcgttaacgaggacgtcgtttacggtatcgcgaacgaggtcgttgtttagggtatcgcgaacgaggacgtcgtttaggatatcgtaaaggaggatgtcgtttaggatatcgtaaacgaggacgtcgtttagggtatttttaaggaggacgtcgtttagggtatcgcgaacgaggacgtcgtttagggtatcgttaaggaggatttcgtttagggcgtcgttaacgaggacgtcgtttagggcgtcgttaacgaggttgaagtttagggcgtcgtatacgaggacgtcgtttagggtatcgttaacgaggacgtcgtttacggtattattaacgaggtcgtcgtttacggtatcgcgaacgaggacgtcgtttagggtatagtatatgaggatgtcgtttagggtatcgttaacgaggacgtcgtttacggcgtcgttaaagaggtcgtcgtttacggcgtcgttaacgaggatgtcgtttacgcgatcgttaagtcggatgtcgtttacggtatcgttaacgaggtcgttatttagggtatcgttatcgaggatgtcgtcgacggtatcgttaatgaggacgtcgtttacggcgtcgttaaagaggttatcgtttacggcgtcgttaacgaggacgtcgtttagggcgtcgttaacgaggacgttttttacggcgtcgtcgttaacgaggatgtcgtttaagcgatcgttaagtcggacgtcgtttatggtatcgttaacgaggtcgtcgtttacggtatcgcgaacgaggacgtcgtttagggtatcgttaacgaggtcgtcgtttacggtatttttaaggaggacgttgtttagggtatcgcgaacgaggacgtcgtttagggtatcgcgaacgaggacgtcgtttagggtatcgtatacgaggacgtcgtttagggtatcgttaacgaggacgtcgtttacggcgtcgttaaagaggtcgtcgtttacggcgtcgttaataaggatgtcgtttacgcgatcgttaagtcggacgtcgttcgcggtatcgttaacgaggttgtcgtttagggtatcgttatcgaggatgtcgtcgacggtatcgttaataaggacgtcgtttacggcgtcgttaacgaggtcgtcgtttacggcgtcgttaacgaggatgtcgtttacgcgatcgttaagtcggatgtcgtttacggtatcgttaacgaggtcgttatttagggtatcgttatcgaggatgtcgtcgacggtatcgttaacgaggacgtcgtttacggcgtcgttaacgaggtcgtcgtttacggcgtcgttatcgaggacgtcgtttagggcgtcgttaacgaggacgtcgtttacggcgtcgttaacgaggacgtcgtttagggcgtcgttaaagaggttatcgtttacggcgtcgttaacgaggacgtcgtttagggcgtcgttaatgaggacgttttttatagcgttttcgttaacgaggatgtcgtttaagcgatcgttaagtcggacgtcgtttatggtatcgttaacgaggtcgtcgtttacggtatcgggaacgaggacgttgtttagggtatcgcgaacgaggacgtcgtttagggtatcgttaacgaggtcgtcgtttacggtatttttaaggaggacgtcgtttagggtatcgcgaacgaggacgtcgtttagggtatcgcgaacgaggacgtcgtttagggtatcgtatacgaggacgtcgtttagggtattgttaacgaggacgtcgtttacggcgtcgttaaagaggtcgtcgtttacggcgtcgttaacgaggattttgtttagggcgtcgttaacgaggacgtcgtttagggcgtcgttaacgaggttgaagtttagggtatcgtatacgaggacgtcgtttagggtatcgttaacgaggacgtcgtttacggtatcgttaacgaggtcgtcgtttacggcgtcgcgaacgaggacgtcgtttagggcgtcgttaacgaggacgtcgtttagggcgtcgttaacgaggacgtcgtttacggcgtcgttaacgaggacgtcgtttagggcgtcgttaaagaggttatcgtttacggcgttattaacgaggacgtcgtttagggcgtcgttaattaggaggttttttatggcgtcgtcgttaacgaggatgtcgtttaagcgatcgttaagtcggatagcgtttatggtatcgttaacgaggtcgtcgtttagggtatcgttaacgaggtcgtcgtttatagtatcgttatcgaggatattatatcgtttagggcgtggttaacgaggtcgttgtttagggtatcgttatcgaggatgtcgtcgacggtatcgttgaggacgtcgtttatggtattattaacgaggaggtcgtttaggttatcgttaagtaggatgtcgtttatagtattattaacgaggatgtcgtttagggcgtcgttaacgaggacgtcgtttacggcgtcgttaacgaggacgtcgtttagggtatcgttaacgaggtcgttatttatggtatttttaaggaggacgtcgtttagggtatcgcgaacgaggacgtcgtttagggtatcgcgaacgaggacgtcgtttagggtatcgtatacgaggacgtcgtttagggtattgttaacgaggacgtcgtttacggcgtcgttaaagaggttgtcgtttacggcgtcgttaacgaggatttcgtttagggcgtcgttaacgaggacgtcgtttagggcgtcgttaacgaggttgaagtttagggtgtcgtatacgaggacgtcgtttagggtatcgttaacgaggacgtcgtttacggtatcgttaacgaggtcgttgtttatggtatcgcgaacgaggatgtcgtttagggtatcgcgaacgaggacgtcgtttagggtatcgtatacgaggacgtcgtttagggtatcgttaacgaggacgtcgtttacggtatcgttaaagaggtcgtcgtttacggcgtcgttaacgaggatgtcgtttacgcgatcgttaagtcggacgtcgttcgcggtatcgttaacgaggtcgtcgtttagggtatcgttatcgaggatgtcgtcgacggtatcgttaacgaggacgtcgtttacggcgtcgttaacgaggtcgtcgtttacggtatcgttaacgaggtcgtcgtttattgcgtcgttatcgaggacgtcgtttagggcgtcgttaaagaggttatcgtttacggcgtcgttaacgaggacgtcgtttagggcgtcgttaacgagtacgttttttatagcgtcgtcgttaacgaggatgtcgtttaagtaatcgttaagtcggacgtcgtttatggtatcgttaacgaggtcgtcgtttatagtatcgcgaacgaggacgttgtttagggtatcgcgaacgaggacgtcgtttagggtatcgttaacgaggtcgtcgtttacggtatttttaaggaggacgtcgtttagggtatcgcgaacgaggacgtcgtttagggtatcgcgaacgaggacgtcgtttagggtatcgtatacgaggacgtcgtttagggtattgttaacgaggacgtcgtttacggcgtcgttaaagaggtcgtcgtttacggcgtcgttaacgaggatttcgtttagggcgtcgttaacgaggacgtcgtttagggcgtcgttaacgaggttgaagtttagggcgtcgtatacgaggacgtcgtttagggtatcgttaacgaggacgtcgtttacggtattattaacgaggtcgtcgtttacggtatcgcgaacgaggacgtcgtttagggtatcgcgaacgaggacgtcgtttagggtatcgtatacgaggacgtcgtttagggtatcgttaacgaggacgtcgtttatagcgtcgttaaagaggtcgtcgtttatggcgtcgttaacgaggatgtcgtttacgcgatcgttaagtcggacgtcgttcgcggtatcgttaacgaggttgtcgtttagggtatcgttatcgaggatgtcgtcgacggtatcgttaacgaggacgtcgtttacggcgtcgttaacgaggtcgtcgtttacggtatttttaaggaggacgtcgtttagggtatcgcgaacgaggacgtcgtttagggtatcgttaaggaggattttatttagggcgtcgttaacgaggttgaagtttagggcgtcgtatacgaggacgtcgtttagggtatcgttaacgaggacgtcgtttacggtatcgttaacgaggacgttgtttagggtatcgcgaacgaggacgtcgtttaggatatcgtaaacgaggacgtcgtttagggtatcgttaaggaggatttcgtttagggcgtcgttaacgaggatttcgtttagggcgtcgttaacgaggacgtcgtttagggcgtcgttaacgaggttgaagtttagggcgtcgtatacgaggacgtcgtttagggtatcgttaacgaggacgtcgtttacggtatcgttaacgaggtcgtcgtttacggtatcgcgaacgaggacgtcgtttagggtatcgcgaacgaggacgtcgtttagggtattgtatacgaggacgtcgtttagggtatcgttaacgaggacgtcgtttacggcgtcgttaaagaggtcgtcgtttacggcgtcgttaacgaggatgtcgtttacgcgatcgttaagtcggacgtcgttcgcggtatcgttaacgaggtcgtcgtttagggtatcgttatcgaggatgtcgtcgacggtatcgttaacgaggacgtcgtttacggcgtcgttaacgaggatgtcgtttaagcgatcgttaagtcggacgtcgtttatggtatcgttaatgaggtcgtcgtttagggtatcgttaacgaggtcgtcgtttatagtatcgttatcgaggatattatatcgtttagggcgtggttaacgaagtcgttgtttagggtattgttatcgaggatgtcgtcgacggtatcgttgaggacgtcgtttagggtattattaacgaggaggtcgtttaggttatcgttaagtaggacgtcgtttacggtattattaacgaggacgtcgtttagggcgttattaacgaggtcgtcgtttagggcgtcgttaacgaggacgtcgtttacggcgtcgttaacgaggtcgtcgtttacggcgtcgttaacgaggacgtcgtttagggcgtcgttaacgaggtcgtcgtttagggcgtcgttaacgaggacgtcgtttacggcgtcgttaacgaggacgtcgtttagggcgtcgttaacgaggtcgaagtttagggtatcgtatataaggacgttatttagggtatcgttaacgaggacgtcgtttagggcgtcgttaacgaggacgtcgtttagggcgtcgttaacgaggtcgtcgtttacggcgtcgttaacgaggatgtcgtttacggcgtcgttaacgaggtcgtcgtttagggcgtcgttaacgaggacgtcgtttagggcgtcgttaacgaggtcgtcgtttacggcgtcgttaacgaggacgtcgttcggtatatggttaaggaggacgtcgtttaggatatcgttaacgaggacgtcgtttacggtatcgttaacgaggacgtcgtatacggtatcgttaacgaggatttt

SEQ ID NO: 4844 - DNA, 7593 bp, Artificial Sequence
  chemically treated genomic DNA (Homo sapiens) CpG-island No: 4844
aaaatcctcgttaacgataccgtatacgacgtcctcgttaacgataccgtaaacgacgtcctcgttaacgatatcctaaacgacgtcctccttaaccatataccgaacgacgtcctcgttaacgacgccgtaaacgacgacctcgttaacgacgccctaaacgacgtcctcgttaacgacgccctaaacgacgacctcgttaacgacgccgtaaacgacatcctcgttaacgacgccgtaaacgacgacctcgttaacgacgccctaaacgacgtcctcgttaacgacgccctaaacgacgtcctcgttaacgataccctaaataacgtccttatatacgataccctaaacttcgacctcgttaacgacgccctaaacgacgtcctcgttaacgacgccgtaaacgacgtcctcgttaacgacgccctaaacgacgacctcgttaacgacgccctaaacgacgtcctcgttaacgacgccgtaaacgacgacctcgttaacgacgccgtaaacgacgtcctcgttaacgacgccctaaacgacgacctcgttaataacgccctaaacgacgtcctcgttaataataccgtaaacgacgtcctacttaacgataacctaaacgacctcctcgttaataataccctaaacgacgtcctcaacgataccgtcgacgacatcctcgataacaataccctaaacaacgacttcgttaaccacgccctaaacgatataatatcctcgataacgatactataaacgacgacctcgttaacgataccctaaacgacgacctcattaacgataccataaacgacgtccgacttaacgatcgcttaaacgacatcctcgttaacgacgccgtaaacgacgtcctcgttaacgataccgtcgacgacatcctcgataacgataccctaaacgacgacctcgttaacgataccgcgaacgacgtccgacttaacgatcgcgtaaacgacatcctcgttaacgacgccgtaaacgacgacctctttaacgacgccgtaaacgacgtcctcgttaacgataccctaaacgacgtcctcgtatacaataccctaaacgacgtcctcgttcgcgataccctaaacgacgtcctcgttcgcgataccgtaaacgacgacctcgttaacgataccgtaaacgacgtcctcgttaacgataccctaaacgacgtcctcgtatacgacgccctaaacttcaacctcgttaacgacgccctaaacgacgtcctcgttaacgacgccctaaacgaaatcctcgttaacgacgccctaaacgaaatcctccttaacgataccctaaacgacgtcctcgtttacgatatcctaaacgacgtcctcgttcgcgataccctaaacaacgtcctcgttaacgataccgtaaacgacgtcctcgttaacgataccctaaacgacgtcctcgtatacgacgccctaaacttcaacctcgttaacgacgccctaaataaaatcctccttaacgataccctaaacgacgtcctcgttcgcgataccctaaacgacgtcctccttaaaaataccgtaaacgacgacctcgttaacgacgccgtaaacgacgtcctcgttaacgataccgtcgacgacatcctcgataacgataccctaaacgacaacctcgttaacgataccgcgaacgacgtccgacttaacgatcgcgtaaacgacatcctcgttaacgacgccataaacgacgacctctttaacgacgctataaacgacgtcctcgttaacgataccctaaacgacgtcctcgtatacgataccctaaacgacgtcctcgttcgcgataccctaaacgacgtcctcgttcgcgataccgtaaacgacgacctcgttaataataccgtaaacgacgtcctcgttaacgataccctaaacgacgtcctcgtatacgacgccctaaacttcaacctcgttaacgacgccctaaacgacgtcctcgttaacgacgccctaaacgaaatcctcgttaacgacgccgtaaacgacgacctctttaacgacgccgtaaacgacgtcctcgttaacaataccctaaacgacgtcctcgtatacgataccctaaacgacgtcctcgttcgcgataccctaaacgacgtcctcgttcgcgataccctaaacgacgtcctccttaaaaataccgtaaacgacgacctcgttaacgataccctaaacgacgtcctcgttcgcgataccctaaacaacgtcctcgttcgcgatactataaacgacgacctcgttaacgataccataaacgacgtccgacttaacgattacttaaacgacatcctcgttaacgacgacgctataaaaaacgtactcgttaacgacgccctaaacgacgtcctcgttaacgacgccgtaaacgataacctctttaacgacgccctaaacgacgtcctcgataacgacgcaataaacgacgacctcgttaacgataccgtaaacgacgacctcgttaacgacgccgtaaacgacgtcctcgttaacgataccgtcgacgacatcctcgataacgataccctaaacgacgacctcgttaacgataccgcgaacgacgtccgacttaacgatcgcgtaaacgacatcctcgttaacgacgccgtaaacgacgacctctttaacgataccgtaaacgacgtcctcgttaacgataccctaaacgacgtcctcgtatacgataccctaaacgacgtcctcgttcgcgataccctaaacgacatcctcgttcgcgataccataaacaacgacctcgttaacgataccgtaaacgacgtcctcgttaacgataccctaaacgacgtcctcgtatacgacaccctaaacttcaacctcgttaacgacgccctaaacgacgtcctcgttaacgacgccctaaacgaaatcctcgttaacgacgccgtaaacgacaacctctttaacgacgccgtaaacgacgtcctcgttaacaataccctaaacgacgtcctcgtatacgataccctaaacgacgtcctcgttcgcgataccctaaacgacgtcctcgttcgcgataccctaaacgacgtcctccttaaaaataccataaataacgacctcgttaacgataccctaaacgacgtcctcgttaacgacgccgtaaacgacgtcctcgttaacgacgccctaaacgacatcctcgttaataatactataaacgacatcctacttaacgataacctaaacgacctcctcgttaataataccataaacgacgtcctcaacgataccgtcgacgacatcctcgataacgataccctaaacaacgacctcgttaaccacgccctaaacgatataatatcctcgataacgatactataaacgacgacctcgttaacgataccctaaacgacgacctcgttaacgataccataaacgctatccgacttaacgatcgcttaaacgacatcctcgttaacgacgacgccataaaaaacctcctaattaacgacgccctaaacgacgtcctcgttaataacgccgtaaacgataacctctttaacgacgccctaaacgacgtcctcgttaacgacgccgtaaacgacgtcctcgttaacgacgccctaaacgacgtcctcgttaacgacgccctaaacgacgtcctcgttcgcgacgccgtaaacgacgacctcgttaacgataccgtaaacgacgtcctcgttaacgataccctaaacgacgtcctcgtatacgataccctaaacttcaacctcgttaacgacgccctaaacgacgtcctcgttaacgacgccctaaacaaaatcctcgttaacgacgccgtaaacgacgacctctttaacgacgccgtaaacgacgtcctcgttaacaataccctaaacgacgtcctcgtatacgataccctaaacgacgtcctcgttcgcgataccctaaacgacgtcctcgttcgcgataccctaaacgacgtcctccttaaaaataccgtaaacgacgacctcgttaacgataccctaaacgacgtcctcgttcgcgataccctaaacaacgtcctcgttcccgataccgtaaacgacgacctcgttaacgataccataaacgacgtccgacttaacgatcgcttaaacgacatcctcgttaacgaaaacgctataaaaaacgtcctcattaacgacgccctaaacgacgtcctcgttaacgacgccgtaaacgataacctctttaacgacgccctaaacgacgtcctcgttaacgacgccgtaaacgacgtcctcgttaacgacgccctaaacgacgtcctcgataacgacgccgtaaacgacgacctcgttaacgacgccgtaaacgacgtcctcgttaacgataccgtcgacgacatcctcgataacgataccctaaataacgacctcgttaacgataccgtaaacgacatccgacttaacgatcgcgtaaacgacatcctcgttaacgacgccgtaaacgacgacctcgttaacgacgccgtaaacgacgtccttattaacgataccgtcgacgacatcctcgataacgataccctaaacgacaacctcgttaacgataccgcgaacgacgtccgacttaacgatcgcgtaaacgacatccttattaacgacgccgtaaacgacgacctctttaacgacgccgtaaacgacgtcctcgttaacgataccctaaacgacgtcctcgtatacgataccctaaacgacgtcctcgttcgcgataccctaaacgacgtcctcgttcgcgataccctaaacaacgtcctccttaaaaataccgtaaacgacgacctcgttaacgataccctaaacgacgtcctcgttcgcgataccgtaaacgacgacctcgttaacgataccataaacgacgtccgacttaacgatcgcttaaacgacatcctcgttaacgacgacgccgtaaaaaacgtcctcgttaacgacgccctaaacgacgtcctcgttaacgacgccgtaaacgataacctctttaacgacgccgtaaacgacgtcctcattaacgataccgtcgacgacatcctcgataacgataccctaaataacgacctcgttaacgataccgtaaacgacatccgacttaacgatcgcgtaaacgacatcctcgttaacgacgccgtaaacgacgacctctttaacgacgccgtaaacgacgtcctcgttaacgataccctaaacgacatcctcatatactataccctaaacgacgtcctcgttcgcgataccgtaaacgacgacctcgttaataataccgtaaacgacgtcctcgttaacgataccctaaacgacgtcctcgtatacgacgccctaaacttcaacctcgttaacgacgccctaaacgacgtcctcgttaacgacgccctaaacgaaatcctccttaacgataccctaaacgacgtcctcgttcgcgataccctaaacgacgtcctccttaaaaataccctaaacgacgtcctcgtttacgatatcctaaacgacatcctcctttacgatatcctaaacgacgtcctcgttcgcgataccctaaacaacgacctcgttcgcgataccgtaaacgacgtcctcgttaacgataccctaaacgacgtcctcgtatacgacgccctaaacttcaacctcgttaacgacgccctaaacaaaatcctcgttaacgacgccctaaacgaaattctctttaacgataccctaaacgacgtcctcgttcgcgataccctaaacgatatcctccttaaaaataccgtaaacgacgacctcgttaacgataccctaaacgacgtcctcgttcgcgataccctaaacaacgtcctcgtttacgataccgtaaacgacgacctcgttaacgataccgtaaacgacatcctcgttaacgataccctaaataacgtccttatatacgataccctaaacttcgacctcgttaacgacgccctaaacgacgtcctcgttaacgacgccctaaacgacgtcctcgttaacgacgccctaaacgacgacctcgttaacgacgccctaaacgacgtcctcgttaacgacgccgtaaacgacgacctcgttaacgacgccgtaaacgacgtcctcgttaacgacgccctaaacgacgacctcgttaacgacgccctaaacgacgtcctcgttaataataccgtaaacgacatcctacttaacgataacctaaacgacctccttattaataataccataaacgacgtcctcaacgataccgtcgacgacatcctcgataacgataccctaaacaacgacctcgttaaccacgccctaaacgatataatatcctcgataacgatactataaataacgacctcgttaacgataccctacgcgataacctcgttaacgataccataaacgacgtccgacttaacgatcgcttaaacgacatcctcgttaacgacgacgccgtaaaaaacgtcctcgttaacgacaccctaaacgacgtcctcgttaacgacgccgtaaacgataacctctttaacgacgccctaaacgacgtcctcgttaacgacgccctcgacgacgtcctcgttaacgacgccctaaacgacgacctcgttaacgacgccgtaaacgacgtcctcgttaacgataccgtcgacgacgtcctcgataacgataccctaaacgacaacctcgttaacgataccgcgaacgacgtccgacttaacgatcgcgtaaacgacatcctcgttaacgacgccgtaaacgacgacctctttaacgacgccgtaaacgacgtcctcgttaacgataccctaaacgacgtcctcgttaacgacgccctaaacgaaatcctcgttaacgacgccctaaacgaaatcctccttaacgataccctaaacgacgtcctcgttattaacgccctaaacgaaatcctcgttaacgacgccctaaacgaaatcctccttaacgataccctaaacgacatcctcgttcgcgataccctaaacgacgtcctccttaaaaataccctaaacgacgtcctcgtttacgatatcctaaacgacgtcctcgtttacgatatcctaaactacgtcctcgtttacgataccgtaaacgacgtcctcgttaacgataccctaaacgacgtcctcgtttacgatatcctaaacgacgtcctctttaaaaacgccctaaacgacgacctcgttaacgatacaataaacgacgtcctcgttaacgacgccctaaacgacgacctcgttaacgacgccgtaaacgacgtcctcattaacgatattataaacgacgtcctcattaacgataccctaaataacatcctcgttaacgatatcgtaaaccgcgtcctcgttaacgatactctaaacgacgtcctcgttaacgattacgtaaacgacatcctcgttaacgatatcgtaaacgacttcctcgttaacgataccctaaacgacgtcctcctttacgataccctaaacgacgtcctcgttaacgatatcatatataacgtcctcaataacaatatcatatacaacgtcctcattaacgatatcgtatacaatatcctcata

SEQ ID NO: 4845 - DNA, 933 bp, Artificial Sequence
  chemically treated genomic DNA (Homo sapiens) CpG-island No: 4845
  misc_feature (71)..(71): n is either a, c, g or t
  misc_feature (244)..(244): n is either a, c, g or t
  misc_feature (351)..(351): n is either a, c, g or t
  misc_feature (383)..(383): n is either a, c, g or t
  misc_feature (394)..(394): n is either a, c, g or t
  misc_feature (410)..(411): n is either a, c, g or t
  misc_feature (415)..(415): n is either a, c, g or t
  misc_feature (442)..(442): n is either a, c, g or t
  misc_feature (479)..(479): n is either a, c, g or t
  misc_feature (513)..(513): n is either a, c, g or t
  misc_feature (528)..(528): n is either a, c, g or t
  misc_feature (563)..(563): n is either a, c, g or t
  misc_feature (591)..(591): n is either a, c, g or t
  misc_feature (613)..(613): n is either a, c, g or t
  misc_feature (621)..(621): n is either a, c, g or t
  misc_feature (677)..(677): n is either a, c, g or t
  misc_feature (694)..(694): n is either a, c, g or t
  misc_feature (696)..(696): n is either a, c, g or t
  misc_feature (708)..(708): n is either a, c, g or t
  misc_feature (724)..(724): n is either a, c, g or t
  misc_feature (726)..(726): n is either a, c, g or t
  misc_feature (733)..(733): n is either a, c, g or t
  misc_feature (739)..(739): n is either a, c, g or t
  misc_feature (746)..(746): n is either a, c, g or t
  misc_feature (755)..(755): n is either a, c, g or t
  misc_feature (767)..(767): n is either a, c, g or t
  misc_feature (774)..(775): n is either a, c, g or t
  misc_feature (790)..(791): n is either a, c, g or t
  misc_feature (797)..(797): n is either a, c, g or t
  misc_feature (807)..(807): n is either a, c, g or t
  misc_feature (818)..(818): n is either a, c, g or t
  misc_feature (829)..(829): n is either a, c, g or t
  misc_feature (834)..(834): n is either a, c, g or t
  misc_feature (848)..(848): n is either a, c, g or t
  misc_feature (852)..(853): n is either a, c, g or t
gttttttacgttcgttaaatcgttttttttgcgggttattttggttttttttatcgcggtacggagggttngggtcgggttttcgcggagtcgggttaatttttcgagtagcgtagcggagtcgtttttcgtacggagttgtcggtcgtttagaaaatagtgaggtaacgtttcggtttcgagtattcggtcgagttcgtttagtagttcgaggtagtaggcgttcgtattttttggtcgcgtnaggtagagcgtaggtagtcgttcgtacgtttagtatagtagcgttcgtaggaggtagggcgtcgtcgttcgggtttcggttattagcgggcgtagtagcgtttgggntcgtcgcgtgcgtttgtagtagcggcgttggntatgcgcgtantttgagcgttagtttnnttgngcgggtaaaatagagttgttaggcggnaggcgtacggtcgttcggtgtcgttatcgggtattanggtagaaggaagtcgatttagaggttagcggatncggtttacgagtggntttcgagttttttcgggttagttcgttacggatanttattgggattaggtcgaagagtagganggcggcgagggggtttaggggntagttagngaggacggtggtgaaattcgcgtggcgagttgcgtgtattagacgcggagtatttngggatagggattagagnanttcggcgatcgntcgttagcgtagtaanangaattanggtagnttatttngggcggaantataatgtgggnttacgtnnttttcgagttttcgnnacggtntttgggattngggttttcgancggttgttttnggtgnacgttattatttanttgnntttttaaaggtgcggtagagttaaggtcgacgacgttatgttgaggcgattcggacgttgaaacgttattaggcgatttt

SEQ ID NO: 4846 - DNA, 933 bp, Artificial Sequence
  chemically treated genomic DNA (Homo sapiens) CpG-island No: 4846
  misc_feature (81)..(82): n is either a, c, g or t
  misc_feature (86)..(86): n is either a, c, g or t
  misc_feature (100)..(100): n is either a, c, g or t
  misc_feature (105)..(105): n is either a, c, g or t
  misc_feature (116)..(116): n is either a, c, g or t
  misc_feature (127)..(127): n is either a, c, g or t
  misc_feature (137)..(137): n is either a, c, g or t
  misc_feature (143)..(144): n is either a, c, g or t
  misc_feature (159)..(160): n is either a, c, g or t
  misc_feature (167)..(167): n is either a, c, g or t
  misc_feature (179)..(179): n is either a, c, g or t
  misc_feature (188)..(188): n is either a, c, g or t
  misc_feature (195)..(195): n is either a, c, g or t
  misc_feature (201)..(201): n is either a, c, g or t
  misc_feature (208)..(208): n is either a, c, g or t
  misc_feature (210)..(210): n is either a, c, g or t
  misc_feature (226)..(226): n is either a, c, g or t
  misc_feature (238)..(238): n is either a, c, g or t
  misc_feature (240)..(240): n is either a, c, g or t
  misc_feature (257)..(257): n is either a, c, g or t
  misc_feature (313)..(313): n is either a, c, g or t
  misc_feature (321)..(321): n is either a, c, g or t
  misc_feature (343)..(343): n is either a, c, g or t
  misc_feature (371)..(371): n is either a, c, g or t
  misc_feature (406)..(406): n is either a, c, g or t
  misc_feature (421)..(421): n is either a, c, g or t
  misc_feature (455)..(455): n is either a, c, g or t
  misc_feature (492)..(492): n is either a, c, g or t
  misc_feature (519)..(519): n is either a, c, g or t
  misc_feature (523)..(524): n is either a, c, g or t
  misc_feature (540)..(540): n is either a, c, g or t
  misc_feature (551)..(551): n is either a, c, g or t
  misc_feature (583)..(583): n is either a, c, g or t
  misc_feature (690)..(690): n is either a, c, g or t
  misc_feature (863)..(863): n is either a, c, g or t
aaaatcgcctaataacgtttcaacgtccgaatcgcctcaacataacgtcgtcgaccttaactctaccgcacctttaaaaanncaantaaataataacgtncaccnaaaacaaccgntcgaaaacccnaatcccaaanaccgtnncgaaaactcgaaaannacgtaancccacattatanttccgcccnaaataanctaccntaattcntnttactacgctaacgancgatcgccgaantnctctaatccctatcccnaaatactccgcgtctaatacacgcaactcgccacgcgaatttcaccaccgtcctcnctaactancccctaaaccccctcgccgccntcctactcttcgacctaatcccaataantatccgtaacgaactaacccgaaaaaactcgaaanccactcgtaaaccgnatccgctaacctctaaatcgacttccttctaccntaatacccgataacgacaccgaacgaccgtacgcctnccgcctaacaactctattttacccgcncaannaaactaacgctcaaantacgcgcatanccaacgccgctactacaaacgcacgcgacgancccaaacgctactacgcccgctaataaccgaaacccgaacgacgacgccctacctcctacgaacgctactatactaaacgtacgaacgactacctacgctctacctnacgcgaccaaaaaatacgaacgcctactacctcgaactactaaacgaactcgaccgaatactcgaaaccgaaacgttacctcactattttctaaacgaccgacaactccgtacgaaaaacgactccgctacgctactcgaaaaattaacccgactccgcgaaaacccgacccnaaccctccgtaccgcgataaaaaaaaccaaaataacccgcaaaaaaaacgatttaacgaacgtaaaaaac

SEQ ID NO: 4847 - DNA, 933 bp, Artificial Sequence
  chemically treated genomic DNA (Homo sapiens) CpG-island No: 4847
  misc_feature (81)..(82): n is either a, c, g or t
  misc_feature (86)..(86): n is either a, c, g or t
  misc_feature (100)..(100): n is either a, c, g or t
  misc_feature (105)..(105): n is either a, c, g or t
  misc_feature (116)..(116): n is either a, c, g or t
  misc_feature (127)..(127): n is either a, c, g or t
  misc_feature (137)..(137): n is either a, c, g or t
  misc_feature (143)..(144): n is either a, c, g or t
  misc_feature (159)..(160): n is either a, c, g or t
  misc_feature (167)..(167): n is either a, c, g or t
  misc_feature (179)..(179): n is either a, c, g or t
  misc_feature (188)..(188): n is either a, c, g or t
  misc_feature (195)..(195): n is either a, c, g or t
  misc_feature (201)..(201): n is either a, c, g or t
  misc_feature (208)..(208): n is either a, c, g or t
  misc_feature (210)..(210): n is either a, c, g or t
  misc_feature (226)..(226): n is either a, c, g or t
  misc_feature (238)..(238): n is either a, c, g or t
  misc_feature (240)..(240): n is either a, c, g or t
  misc_feature (257)..(257): n is either a, c, g or t
  misc_feature (313)..(313): n is either a, c, g or t
  misc_feature (321)..(321): n is either a, c, g or t
  misc_feature (343)..(343): n is either a, c, g or t
  misc_feature (371)..(371): n is either a, c, g or t
  misc_feature (406)..(406): n is either a, c, g or t
  misc_feature (421)..(421): n is either a, c, g or t
  misc_feature (455)..(455): n is either a, c, g or t
  misc_feature (492)..(492): n is either a, c, g or t
  misc_feature (519)..(519): n is either a, c, g or t
  misc_feature (523)..(524): n is either a, c, g or t
  misc_feature (540)..(540): n is either a, c, g or t
  misc_feature (551)..(551): n is either a, c, g or t
  misc_feature (583)..(583): n is either a, c, g or t
  misc_feature (690)..(690): n is either a, c, g or t
  misc_feature (863)..(863): n is either a, c, g or t
aaaatcgtttagtgacgttttagcgttcgagtcgttttagtatgacgtcgtcgattttggttttatcgtatttttgaaaanntaantgagtagtgacgtntattnaaggtagtcgntcgaaagtttnagttttaaangtcgtnncggaggttcgggaanngcgtggntttatattatgntttcgtttnaggtggnttgttntggtttntnttgttacgttggcggncggtcgtcgagntnttttgatttttgttttngggtgtttcgcgtttggtgtacgtagttcgttacgcgggttttattatcgtttttnttggttantttttgagttttttcgtcgttnttttgtttttcgatttgattttagtggntgttcgtggcgggttggttcgagggggttcggagnttattcgtgggtcgngttcgttggtttttgagtcggtttttttttattntggtgttcggtggcggtatcgagcggtcgtgcgtttntcgtttggtagttttgttttgttcgtntagnngagttggcgtttaaantgcgcgtatanttagcgtcgttgttgtaggcgtacgcggcggntttaggcgttattgcgttcgttggtggtcgggattcgggcggcggcgttttattttttgcggacgttgttgtattgggcgtgcgagcggttgtttgcgttttatttngcgcggttagaaaatgcgggcgtttgttgtttcgggttgttagacgagttcggtcgagtgttcgaggtcgggacgttgttttattattttttgaacggtcgatagtttcgtacgggggacgatttcgttgcgttgttcggagaattggttcggtttcgcggggattcggtttnggtttttcgtgtcgcggtggaggaggttaaagtggttcgtaaggggggcggtttggcgggcgtggggggt

SEQ ID NO: 4848 - DNA, 933 bp, Artificial Sequence
  chemically treated genomic DNA (Homo sapiens) CpG-island No: 4848
  misc_feature (71)..(71): n is either a, c, g or t
  misc_feature (244)..(244): n is either a, c, g or t
  misc_feature (351)..(351): n is either a, c, g or t
  misc_feature (383)..(383): n is either a, c, g or t
  misc_feature (394)..(394): n is either a, c, g or t
  misc_feature (410)..(411): n is either a, c, g or t
  misc_feature (415)..(415): n is either a, c, g or t
  misc_feature (442)..(442): n is either a, c, g or t
  misc_feature (479)..(479): n is either a, c, g or t
  misc_feature (513)..(513): n is either a, c, g or t
  misc_feature (528)..(528): n is either a, c, g or t
  misc_feature (563)..(563): n is either a, c, g or t
  misc_feature (591)..(591): n is either a, c, g or t
  misc_feature (613)..(613): n is either a, c, g or t
  misc_feature (621)..(621): n is either a, c, g or t
  misc_feature (677)..(677): n is either a, c, g or t
  misc_feature (694)..(694): n is either a, c, g or t
  misc_feature (696)..(696): n is either a, c, g or t
  misc_feature (708)..(708): n is either a, c, g or t
  misc_feature (724)..(724): n is either a, c, g or t
  misc_feature (726)..(726): n is either a, c, g or t
  misc_feature (733)..(733): n is either a, c, g or t
  misc_feature (739)..(739): n is either a, c, g or t
  misc_feature (746)..(746): n is either a, c, g or t
  misc_feature (755)..(755): n is either a, c, g or t
  misc_feature (767)..(767): n is either a, c, g or t
  misc_feature (774)..(775): n is either a, c, g or t
  misc_feature (790)..(791): n is either a, c, g or t
  misc_feature (797)..(797): n is either a, c, g or t
  misc_feature (807)..(807): n is either a, c, g or t
  misc_feature (818)..(818): n is either a, c, g or t
  misc_feature (829)..(829): n is either a, c, g or t
  misc_feature (834)..(834): n is either a, c, g or t
  misc_feature (848)..(848): n is either a, c, g or t
  misc_feature (852)..(853): n is either a, c, g or t
accccccacgcccgccaaaccgccccccttacgaaccactttaacctcctccaccgcgacacgaaaaaccnaaaccgaatccccgcgaaaccgaaccaattctccgaacaacgcaacgaaatcgtcccccgtacgaaactatcgaccgttcaaaaaataataaaacaacgtcccgacctcgaacactcgaccgaactcgtctaacaacccgaaacaacaaacgcccgcattttctaaccgcgcnaaataaaacgcaaacaaccgctcgcacgcccaatacaacaacgtccgcaaaaaataaaacgccgccgcccgaatcccgaccaccaacgaacgcaataacgcctaaanccgccgcgtacgcctacaacaacgacgctaantatacgcgcantttaaacgccaactcnnctanacgaacaaaacaaaactaccaaacganaaacgcacgaccgctcgataccgccaccgaacaccanaataaaaaaaaaccgactcaaaaaccaacgaacncgacccacgaataanctccgaaccccctcgaaccaacccgccacgaacanccactaaaatcaaatcgaaaaacaaaanaacgacgaaaaaactcaaaaantaaccaanaaaaacgataataaaacccgcgtaacgaactacgtacaccaaacgcgaaacacccnaaaacaaaaatcaaaananctcgacgaccgnccgccaacgtaacaananaaaccanaacaanccacctnaaacgaaancataatataaanccacgcnnttcccgaacctccgnnacgacntttaaaactnaaactttcgancgactaccttnaatanacgtcactactcanttannttttcaaaaatacgataaaaccaaaatcgacgacgtcatactaaaacgactcgaacgctaaaacgtcactaaacgatttt

SEQ ID NO: 4849 - DNA, 798 bp, Artificial Sequence
  chemically treated genomic DNA (Homo sapiens) CpG-island No: 4849
  misc_feature (185)..(185): n is either a, c, g or t
  misc_feature (197)..(197): n is either a, c, g or t
  misc_feature (206)..(206): n is either a, c, g or t
  misc_feature (361)..(361): n is either a, c, g or t
  misc_feature (369)..(369): n is either a, c, g or t
  misc_feature (380)..(380): n is either a, c, g or t
  misc_feature (412)..(412): n is either a, c, g or t
  misc_feature (415)..(415): n is either a, c, g or t
  misc_feature (417)..(417): n is either a, c, g or t
  misc_feature (419)..(419): n is either a, c, g or t
  misc_feature (422)..(422): n is either a, c, g or t
  misc_feature (491)..(491): n is either a, c, g or t
  misc_feature (532)..(532): n is either a, c, g or t
  misc_feature (574)..(574): n is either a, c, g or t
  misc_feature (638)..(638): n is either a, c, g or t
  misc_feature (645)..(645): n is either a, c, g or t
gtcggcgttttttcgtcgttttttttcgttttagatgttttatattgcgcggttttagtcgggttagggagcgttaggagcgattggagtataaagcgtcgtagtcgttcgtttagcgtatttttcgggggacgtaacgtcgcgttaggtcgggggttgatttggaaatgaggtttcggcggcgncggcgttaattngtttttaanatagtggcggataaatagggtttggggttggttcgtacgttgtttgatcgttttcgttcgtcgttttattttttcgcgggtttcgtatttcgagattttagcgtattttatcgttttgtttgttagggttttcgaaagcgttgttggtttttttntcgcggtntattcggcggnttttttttcgttttttgaatcggtagttagtntgngntnagnttttaagggttcggcgtttagggatttaaaggattttttcgcgtttcgcgaggtttcggggtttcgggntttcgtttttttgttgttttcgtttttgttagggtcgcggnttagtttttgttggttattttattgcgattatgttcgttttntgcggggagtcggttttcgattttgtcggttttatttttttaatggtgagtttttatttgcgtntcggggntgtcgtttttcgaggtttttgcggtgtcgttatttcgacgcggggtgtttggcggtgttttgggagaaatagggtattagtttttattttatgttttcggtcggaaaaaatagggaggttgtagtcggaggtagtcgtttaaatagaattttt

SEQ ID NO: 4850 - DNA, 798 bp, Artificial Sequence
  chemically treated genomic DNA (Homo sapiens) CpG-island No: 4850
  misc_feature (154)..(154): n is either a, c, g or t
  misc_feature (161)..(161): n is either a, c, g or t
  misc_feature (225)..(225): n is either a, c, g or t
  misc_feature (267)..(267): n is either a, c, g or t
  misc_feature (308)..(308): n is either a, c, g or t
  misc_feature (377)..(377): n is either a, c, g or t
  misc_feature (380)..(380): n is either a, c, g or t
  misc_feature (382)..(382): n is either a, c, g or t
  misc_feature (384)..(384): n is either a, c, g or t
  misc_feature (387)..(387): n is either a, c, g or t
  misc_feature (419)..(419): n is either a, c, g or t
  misc_feature (430)..(430): n is either a, c, g or t
  misc_feature (438)..(438): n is either a, c, g or t
  misc_feature (593)..(593): n is either a, c, g or t
  misc_feature (602)..(602): n is either a, c, g or t
  misc_feature (614)..(614): n is either a, c, g or t
aaaaattctatttaaacgactacctccgactacaacctccctattttttccgaccgaaaacataaaataaaaactaataccctatttctcccaaaacaccgccaaacaccccgcgtcgaaataacgacaccgcaaaaacctcgaaaaacgacanccccganacgcaaataaaaactcaccattaaaaaaataaaaccgacaaaatcgaaaaccgactccccgcanaaaacgaacataatcgcaataaaataaccaacaaaaactaanccgcgaccctaacaaaaacgaaaacaacaaaaaaacgaaancccgaaaccccgaaacctcgcgaaacgcgaaaaaatcctttaaatccctaaacgccgaacccttaaaanctnancncanactaactaccgattcaaaaaacgaaaaaaaanccgccgaatanaccgcganaaaaaaaccaacaacgctttcgaaaaccctaacaaacaaaacgataaaatacgctaaaatctcgaaatacgaaacccgcgaaaaaataaaacgacgaacgaaaacgatcaaacaacgtacgaaccaaccccaaaccctatttatccgccactatnttaaaaacnaattaacgccgncgccgccgaaacctcatttccaaatcaacccccgacctaacgcgacgttacgtcccccgaaaaatacgctaaacgaacgactacgacgctttatactccaatcgctcctaacgctccctaacccgactaaaaccgcgcaatataaaacatctaaaacgaaaaaaaacgacgaaaaaacgccgac

SEQ ID NO: 4851 - DNA, 798 bp, Artificial Sequence
  chemically treated genomic DNA (Homo sapiens) CpG-island No: 4851
  misc_feature (154)..(154): n is either a, c, g or t
  misc_feature (161)..(161): n is either a, c, g or t
  misc_feature (225)..(225): n is either a, c, g or t
  misc_feature (267)..(267): n is either a, c, g or t
  misc_feature (308)..(308): n is either a, c, g or t
  misc_feature (377)..(377): n is either a, c, g or t
  misc_feature (380)..(380): n is either a, c, g or t
  misc_feature (382)..(382): n is either a, c, g or t
  misc_feature (384)..(384): n is either a, c, g or t
  misc_feature (387)..(387): n is either a, c, g or t
  misc_feature (419)..(419): n is either a, c, g or t
  misc_feature (430)..(430): n is either a, c, g or t
  misc_feature (438)..(438): n is either a, c, g or t
  misc_feature (593)..(593): n is either a, c, g or t
  misc_feature (602)..(602): n is either a, c, g or t
  misc_feature (614)..(614): n is either a, c, g or t
aaaggttttgtttggacggttgttttcggttataatttttttgtttttttcggtcgaaaatatgaaatagaaattagtgttttattttttttaaggtatcgttaaatatttcgcgtcggggtggcgatatcgtaggggtttcgggaggcggtantttcgangcgtaaatggagatttattattaggagggtgaagtcggtaaggtcgggggtcgatttttcgtanggaacgaatatggtcgtagtggggtggttagtagggattaantcgcggttttggtaagaacgagggtagtaagaaggcggaanttcgagatttcggagtttcgcggggcgcgggagggttttttgagtttttgggcgtcgggtttttgaggnttngntntangttaattgtcggtttagagggcggaaagaggntcgtcgggtgngtcgcganagaggggttagtagcgttttcggagattttggtaagtaaggcgatggggtgcgttgaggtttcggggtgcggggttcgcggggaggtggagcggcgggcggaaacgattaggtagcgtgcgggttagttttaagttttgtttgttcgttattgtnttgaaaatnagttggcgtcgncgtcgtcggggttttatttttaggttagttttcggtttgacgcggcgttgcgtttttcgggaggtgcgttaggcgaacggttgcggcgttttgtgttttagtcgtttttaacgttttttggttcggttggggtcgcgtagtgtagggtatttgaggcggggagaagcggcggggagacgtcggt

SEQ ID NO: 4852 - DNA, 798 bp, Artificial Sequence
  chemically treated genomic DNA (Homo sapiens) CpG-island No: 4852
  misc_feature (185)..(185): n is either a, c, g or t
  misc_feature (197)..(197): n is either a, c, g or t
  misc_feature (206)..(206): n is either a, c, g or t
  misc_feature (361)..(361): n is either a, c, g or t
  misc_feature (369)..(369): n is either a, c, g or t
  misc_feature (380)..(380): n is either a, c, g or t
  misc_feature (412)..(412): n is either a, c, g or t
  misc_feature (415)..(415): n is either a, c, g or t
  misc_feature (417)..(417): n is either a, c, g or t
  misc_feature (419)..(419): n is either a, c, g or t
  misc_feature (422)..(422): n is either a, c, g or t
  misc_feature (491)..(491): n is either a, c, g or t
  misc_feature (532)..(532): n is either a, c, g or t
  misc_feature (574)..(574): n is either a, c, g or t
  misc_feature (638)..(638): n is either a, c, g or t
  misc_feature (645)..(645): n is either a, c, g or t
accgacgtctccccgccgcttctccccgcctcaaataccctacactacgcgaccccaaccgaaccaaaaaacgttaaaaacgactaaaacacaaaacgccgcaaccgttcgcctaacgcacctcccgaaaaacgcaacgccgcgtcaaaccgaaaactaacctaaaaataaaaccccgacgacgncgacgccaactnattttcaanacaataacgaacaaacaaaacttaaaactaacccgcacgctacctaatcgtttccgcccgccgctccacctccccgcgaaccccgcaccccgaaacctcaacgcaccccatcgccttacttaccaaaatctccgaaaacgctactaacccctctntcgcgacncacccgacgancctctttccgccctctaaaccgacaattaacntanancnaancctcaaaaacccgacgcccaaaaactcaaaaaaccctcccgcgccccgcgaaactccgaaatctcgaanttccgccttcttactaccctcgttcttaccaaaaccgcganttaatccctactaaccaccccactacgaccatattcgttccntacgaaaaatcgacccccgaccttaccgacttcaccctcctaataataaatctccatttacgcntcgaaantaccgcctcccgaaacccctacgatatcgccaccccgacgcgaaatatttaacgataccttaaaaaaaataaaacactaatttctatttcatattttcgaccgaaaaaaacaaaaaaattataaccgaaaacaaccgtccaaacaaaaccttt

SEQ ID NO: 4853 - DNA, 1747 bp, Artificial Sequence
  chemically treated genomic DNA (Homo sapiens) CpG-island No: 4853
  misc_feature (15)..(15): n is either a, c, g or t
  misc_feature (36)..(36): n is either a, c, g or t
  misc_feature (333)..(333): n is either a, c, g or t
  misc_feature (436)..(436): n is either a, c, g or t
  misc_feature (471)..(471): n is either a, c, g or t
  misc_feature (589)..(589): n is either a, c, g or t
  misc_feature (594)..(594): n is either a, c, g or t
  misc_feature (617)..(617): n is either a, c, g or t
  misc_feature (686)..(686): n is either a, c, g or t
  misc_feature (718)..(719): n is either a, c, g or t
  misc_feature (725)..(725): n is either a, c, g or t
  misc_feature (733)..(733): n is either a, c, g or t
  misc_feature (737)..(737): n is either a, c, g or t
  misc_feature (748)..(748): n is either a, c, g or t
  misc_feature (764)..(764): n is either a, c, g or t
  misc_feature (771)..(771): n is either a, c, g or t
  misc_feature (773)..(773): n is either a, c, g or t
  misc_feature (787)..(787): n is either a, c, g or t
  misc_feature (789)..(789): n is either a, c, g or t
  misc_feature (794)..(794): n is either a, c, g or t
  misc_feature (803)..(803): n is either a, c, g or t
  misc_feature (817)..(817): n is either a, c, g or t
  misc_feature (824)..(824): n is either a, c, g or t
  misc_feature (831)..(831): n is either a, c, g or t
  misc_feature (834)..(834): n is either a, c, g or t
  misc_feature (836)..(836): n is either a, c, g or t
  misc_feature (841)..(841): n is either a, c, g or t
  misc_feature (843)..(843): n is either a, c, g or t
  misc_feature (858)..(858): n is either a, c, g or t
  misc_feature (862)..(862): n is either a, c, g or t
  misc_feature (868)..(868): n is either a, c, g or t
  misc_feature (870)..(870): n is either a, c, g or t
  misc_feature (874)..(874): n is either a, c, g or t
  misc_feature (880)..(880): n is either a, c, g or t
  misc_feature (924)..(924): n is either a, c, g or t
  misc_feature (936)..(936): n is either a, c, g or t
  misc_feature (938)..(938): n is either a, c, g or t
  misc_feature (953)..(953): n is either a, c, g or t
  misc_feature (955)..(955): n is either a, c, g or t
  misc_feature (989)..(989): n is either a, c, g or t
  misc_feature (1013)..(1013): n is either a, c, g or t
  misc_feature (1040)..(1040): n is either a, c, g or t
  misc_feature (1054)..(1054): n is either a, c, g or t
  misc_feature (1069)..(1069): n is either a, c, g or t
  misc_feature (1106)..(1106): n is either a, c, g or t
  misc_feature (1153)..(1153): n is either a, c, g or t
  misc_feature (1158)..(1158): n is either a, c, g or t
  misc_feature (1182)..(1182): n is either a, c, g or t
  misc_feature (1302)..(1302): n is either a, c, g or t
  misc_feature (1320)..(1320): n is either a, c, g or t
  misc_feature (1322)..(1322): n is either a, c, g or t
  misc_feature (1336)..(1336): n is either a, c, g or t
  misc_feature (1340)..(1340): n is either a, c, g or t
  misc_feature (1427)..(1427): n is either a, c, g or t
  misc_feature (1464)..(1464): n is either a, c, g or t
  misc_feature (1498)..(1498): n is either a, c, g or t
  misc_feature (1516)..(1516): n is either a, c, g or t
  misc_feature (1523)..(1523): n is either a, c, g or t
  misc_feature (1541)..(1541): n is either a, c, g or t
  misc_feature (1640)..(1640): n is either a, c, g or t
aattgtcggacgttntttagggtttagggcgcggtnggggaggttttagcgggtttgtatttttttaggtattcgttttaggcgggtttaagtttttaattagattttcggcgatttagcgtttagggaacgttaatgcgggtgatttttttcgttgtgtagggcggtgattcgggttggcgcgtttagtttttcgttagagtcggtcggggatttttttgataaatgcgatatttttttgtttttgcgtttttcgatcgcgcgttcggtttcgcgtgttttttacgttttataattttgtacgttttattcggtcgcgtatttttttcggantcgtgcgtcgtcgtttttattattgcgtttttagttgtgtgttttttgcgatcgggtttttcgatcgggcgttatcgtttgcgattttgagagttttgcgttngagagatcgtgcggttatttcgtttcgaggcgagntttttttgtttggtttttatttttagagcgtgtatttttcggttcgtgcggtttttaaggtggggcgttgggcggcgtcgaacggtcgaggtcgggcggggcggcgcggatcgaggancgtantcgcgtcgttatcggtcggcggntgttcgatcgggacggtagtcgtgttttcgtttttttttttttttttatttttttcgggtattttattnggtttcggcgtcggcgcgttcggtcgtttggnnggtcgngcggtatntcgngggatggtaanggcgtcggcgttcgancgacgantngtttcggagttgangngagancgtcggtantacgggcgcgattngtcgagncgtagtnatntnatttngncggaatggtttaggncggnttggtntngatngggcgncggggagtcgcggattgaggtagtgggcggcgaggggacgtcgnggagttcggggntnagtcggcgcgcggtngnggggttttcgggacgcgttgagtttggaggaganttttgcggttgtataattagtttnattaacgaggagtaggcgtgggtcgtngtgttattagtgtntgcggttttttgcgncgtcgtcgttcgtcgtcgttagtttcgttatcgtgtncgttcggtcgcgtagattcgcgtttggagggacggcgtcgttatttntggtngttcgcggtcgacgacgcgggagnagtcgtttttagttgcgggtgaggtcgtcgggtttttttttttcgtagtttttggaatattcgtcgttgggtcgttttatttttagcgttttcggttttttcgttttcgtcgtttttttnttattttgttacgggagnanttttcgggaggatntcgngcggggattcgtaggggaggacggcgttaggtcgtggttgtcggggtttttcggaggttagagtttcgtggcgggcgacggcgtaanattcgttgtgcggaggacgtttgggtgggtttggttntgcgggcgcggggcgttcgttattgtgttgtttncgggatagttgtttcggncgcgttntgggagcggtgggttggnttttgtttcgggttagcggtttgtgcgttttacgtcgtggttgttgatatacggtcgggtttacggggtggggagggtatcgtaggttttacgcggggntttcgtacggatttttagtgtcgttgtcggaaatatcgtattttttacgggaaattagtagtattttatattagatagttttttttcggttcggaaatgtaaagatg

SEQ ID NO: 4854 - DNA, 1747 bp, Artificial Sequence
  chemically treated genomic DNA (Homo sapiens) CpG-island No: 4854
  misc_feature (108)..(108): n is either a, c, g or t
  misc_feature (207)..(207): n is either a, c, g or t
  misc_feature (225)..(225): n is either a, c, g or t
  misc_feature (232)..(232): n is either a, c, g or t
  misc_feature (250)..(250): n is either a, c, g or t
  misc_feature (284)..(284): n is either a, c, g or t
  misc_feature (321)..(321): n is either a, c, g or t
  misc_feature (408)..(408): n is either a, c, g or t
  misc_feature (412)..(412): n is either a, c, g or t
  misc_feature (426)..(426): n is either a, c, g or t
  misc_feature (428)..(428): n is either a, c, g or t
  misc_feature (446)..(446): n is either a, c, g or t
  misc_feature (566)..(566): n is either a, c, g or t
  misc_feature (590)..(590): n is either a, c, g or t
  misc_feature (595)..(595): n is either a, c, g or t
  misc_feature (642)..(642): n is either a, c, g or t
  misc_feature (679)..(679): n is either a, c, g or t
  misc_feature (694)..(694): n is either a, c, g or t
  misc_feature (708)..(708): n is either a, c, g or t
  misc_feature (735)..(735): n is either a, c, g or t
  misc_feature (759)..(759): n is either a, c, g or t
  misc_feature (793)..(793): n is either a, c, g or t
  misc_feature (795)..(795): n is either a, c, g or t
  misc_feature (810)..(810): n is either a, c, g or t
  misc_feature (812)..(812): n is either a, c, g or t
  misc_feature (824)..(824): n is either a, c, g or t
  misc_feature (868)..(868): n is either a, c, g or t
  misc_feature (874)..(874): n is either a, c, g or t
  misc_feature (878)..(878): n is either a, c, g or t
  misc_feature (880)..(880): n is either a, c, g or t
  misc_feature (886)..(886): n is either a, c, g or t
  misc_feature (890)..(890): n is either a, c, g or t
  misc_feature (905)..(905): n is either a, c, g or t
  misc_feature (907)..(907): n is either a, c, g or t
  misc_feature (912)..(912): n is either a, c, g or t
  misc_feature (914)..(914): n is either a, c, g or t
  misc_feature (917)..(917): n is either a, c, g or t
  misc_feature (924)..(924): n is either a, c, g or t
  misc_feature (931)..(931): n is either a, c, g or t
  misc_feature (945)..(945): n is either a, c, g or t
  misc_feature (954)..(954): n is either a, c, g or t
  misc_feature (959)..(959): n is either a, c, g or t
  misc_feature (961)..(961): n is either a, c, g or t
  misc_feature (975)..(975): n is either a, c, g or t
  misc_feature (977)..(977): n is either a, c, g or t
  misc_feature (984)..(984): n is either a, c, g or t
  misc_feature (1000)..(1000): n is either a, c, g or t
  misc_feature (1011)..(1011): n is either a, c, g or t
  misc_feature (1015)..(1015): n is either a, c, g or t
  misc_feature (1023)..(1023): n is either a, c, g or t
  misc_feature (1029)..(1030): n is either a, c, g or t
  misc_feature (1062)..(1062): n is either a, c, g or t
  misc_feature (1131)..(1131): n is either a, c, g or t
  misc_feature (1154)..(1154): n is either a, c, g or t
  misc_feature (1159)..(1159): n is either a, c, g or t
  misc_feature (1277)..(1277): n is either a, c, g or t
  misc_feature (1312)..(1312): n is either a, c, g or t
  misc_feature (1415)..(1415): n is either a, c, g or t
  misc_feature (1712)..(1712): n is either a, c, g or t
  misc_feature (1733)..(1733): n is either a, c, g or t
catctttacatttccgaaccgaaaaaaaactatctaatataaaatactactaatttcccgtaaaaaatacgatatttccgacaacgacactaaaaatccgtacgaaanccccgcgtaaaacctacgataccctccccaccccgtaaacccgaccgtatatcaacaaccacgacgtaaaacgcacaaaccgctaacccgaaacaaaanccaacccaccgctcccanaacgcgnccgaaacaactatcccgnaaacaacacaataacgaacgccccgcgcccgcanaaccaaacccacccaaacgtcctccgcacaacgaatnttacgccgtcgcccgccacgaaactctaacctccgaaaaaccccgacaaccacgacctaacgccgtcctcccctacgaatccccgcncganatcctcccgaaaantnctcccgtaacaaaataanaaaaaaacgacgaaaacgaaaaaaccgaaaacgctaaaaataaaacgacccaacgacgaatattccaaaaactacgaaaaaaaaaaacccgacgacctcacccgcaactaaaaacgactnctcccgcgtcgtcgaccgcgaacnaccanaaataacgacgccgtccctccaaacgcgaatctacgcgaccgaacgnacacgataacgaaactaacgacgacgaacgacgacgncgcaaaaaaccgcanacactaataacacnacgacccacgcctactcctcgttaatnaaactaattatacaaccgcaaaantctcctccaaactcaacgcgtcccgaaaaccccncnaccgcgcgccgactnanccccgaactccncgacgtcccctcgccgcccactacctcaatccgcgactccccgncgcccnatcnanaccaanccgncctaaaccattccgncnaaatnanatnactacgnctcgacnaatcgcgcccgtantaccgacgntctcncntcaactccgaaacnantcgtcgntcgaacgccgacgccnttaccatcccncganataccgcncgaccnnccaaacgaccgaacgcgccgacgccgaaaccnaataaaatacccgaaaaaaataaaaaaaaaaaaaaaaacgaaaacacgactaccgtcccgatcgaacanccgccgaccgataacgacgcgantacgntcctcgatccgcgccgccccgcccgacctcgaccgttcgacgccgcccaacgccccaccttaaaaaccgcacgaaccgaaaaatacacgctctaaaaataaaaaccaaacaaaaaaanctcgcctcgaaacgaaataaccgcacgatctctcnaacgcaaaactctcaaaatcgcaaacgataacgcccgatcgaaaaacccgatcgcaaaaaacacacaactaaaaacgcaataataaaaacgacgacgcacgantccgaaaaaaatacgcgaccgaataaaacgtacaaaattataaaacgtaaaaaacacgcgaaaccgaacgcgcgatcgaaaaacgcaaaaacaaaaaaatatcgcatttatcaaaaaaatccccgaccgactctaacgaaaaactaaacgcgccaacccgaatcaccgccctacacaacgaaaaaaatcacccgcattaacgttccctaaacgctaaatcgccgaaaatctaattaaaaacttaaacccgcctaaaacgaatacctaaaaaaatacaaacccgctaaaacctccccnaccgcgccctaaaccctaaanaacgtccgacaatt

SEQ ID NO: 4855 - DNA, 1747 bp, Artificial Sequence
  chemically treated genomic DNA (Homo sapiens) CpG-island No: 4855
  misc_feature (108)..(108): n is either a, c, g or t
  misc_feature (207)..(207): n is either a, c, g or t
  misc_feature (225)..(225): n is either a, c, g or t
  misc_feature (232)..(232): n is either a, c, g or t
  misc_feature (250)..(250): n is either a, c, g or t
  misc_feature (284)..(284): n is either a, c, g or t
  misc_feature (321)..(321): n is either a, c, g or t
  misc_feature (408)..(408): n is either a, c, g or t
  misc_feature (412)..(412): n is either a, c, g or t
  misc_feature (426)..(426): n is either a, c, g or t
  misc_feature (428)..(428): n is either a, c, g or t
  misc_feature (446)..(446): n is either a, c, g or t
  misc_feature (566)..(566): n is either a, c, g or t
  misc_feature (590)..(590): n is either a, c, g or t
  misc_feature (595)..(595): n is either a, c, g or t
  misc_feature (642)..(642): n is either a, c, g or t
  misc_feature (679)..(679): n is either a, c, g or t
  misc_feature (694)..(694): n is either a, c, g or t
  misc_feature (708)..(708): n is either a, c, g or t
  misc_feature (735)..(735): n is either a, c, g or t
  misc_feature (759)..(759): n is either a, c, g or t
  misc_feature (793)..(793): n is either a, c, g or t
  misc_feature (795)..(795): n is either a, c, g or t
  misc_feature (810)..(810): n is either a, c, g or t
  misc_feature (812)..(812): n is either a, c, g or t
  misc_feature (824)..(824): n is either a, c, g or t
  misc_feature (868)..(868): n is either a, c, g or t
  misc_feature (874)..(874): n is either a, c, g or t
  misc_feature (878)..(878): n is either a, c, g or t
  misc_feature (880)..(880): n is either a, c, g or t
  misc_feature (886)..(886): n is either a, c, g or t
  misc_feature (890)..(890): n is either a, c, g or t
  misc_feature (905)..(905): n is either a, c, g or t
  misc_feature (907)..(907): n is either a, c, g or t
  misc_feature (912)..(912): n is either a, c, g or t
  misc_feature (914)..(914): n is either a, c, g or t
  misc_feature (917)..(917): n is either a, c, g or t
  misc_feature (924)..(924): n is either a, c, g or t
  misc_feature (931)..(931): n is either a, c, g or t
  misc_feature (945)..(945): n is either a, c, g or t
  misc_feature (954)..(954): n is either a, c, g or t
  misc_feature (959)..(959): n is either a, c, g or t
  misc_feature (961)..(961): n is either a, c, g or t
  misc_feature (975)..(975): n is either a, c, g or t
  misc_feature (977)..(977): n is either a, c, g or t
  misc_feature (984)..(984): n is either a, c, g or t
  misc_feature (1000)..(1000): n is either a, c, g or t
  misc_feature (1011)..(1011): n is either a, c, g or t
  misc_feature (1015)..(1015): n is either a, c, g or t
  misc_feature (1023)..(1023): n is either a, c, g or t
  misc_feature (1029)..(1030): n is either a, c, g or t
  misc_feature (1062)..(1062): n is either a, c, g or t
  misc_feature (1131)..(1131): n is either a, c, g or t
  misc_feature (1154)..(1154): n is either a, c, g or t
  misc_feature (1159)..(1159): n is either a, c, g or t
  misc_feature (1277)..(1277): n is either a, c, g or t
  misc_feature (1312)..(1312): n is either a, c, g or t
  misc_feature (1415)..(1415): n is either a, c, g or t
  misc_feature (1712)..(1712): n is either a, c, g or t
  misc_feature (1733)..(1733): n is either a, c, g or t
tatttttatattttcgaatcgaggaaaggttgtttaatgtggaatattgttagtttttcgtgaggagtgcggtgttttcgatagcggtattgaggattcgtgcggagntttcgcgtgaagtttgcgatgttttttttatttcgtgaattcggtcgtgtgttagtagttacggcgtgaggcgtataggtcgttggttcggagtagggnttagtttatcgtttttanaacgcgntcggggtagttgtttcgngggtagtataatgacgagcgtttcgcgttcgtanggttaggtttatttaaacgtttttcgtatagcggatnttgcgtcgtcgttcgttacgaggttttgattttcgaggggtttcggtagttacggtttgacgtcgtttttttttgcgggttttcgtncggnattttttcgggggntnttttcgtggtaaaatggnggggggacggcgggggcggaagggtcggggacgttgagggtaaggcggtttagcggcgggtgttttaagaattacgagggaaaggggttcggcggttttattcgtaattgggggcggttnttttcgcgtcgtcggtcgcgggtngttangggtgacggcgtcgtttttttagacgcggatttgcgcggtcgagcgnatacggtggcggggttggcggcggcgggcggcggcgncgtagggaatcgtangtattggtagtatnacggtttacgtttgtttttcgttgatngggttggttgtatagtcgtagganttttttttaggtttagcgcgtttcgggagttttntngtcgcgcgtcggttngntttcgggttttncggcgttttttcgtcgtttattgttttagttcgcggtttttcgncgtttngttngngttagntcgntttgagttatttcgntngggtngngtngttgcgnttcggtnagtcgcgttcgtgntgtcggcgnttttntnttagtttcggagtnantcgtcgntcgggcgtcggcgttnttattattttncggnatatcgtncggttnnttaaacgatcgggcgcgtcggcgtcgggattnagtggagtgttcgggaggggtgggggagaggaggggggcggggatacggttgtcgtttcggtcggatantcgtcggtcggtagcgacgcgantgcgnttttcggttcgcgtcgtttcgttcggtttcggtcgttcggcgtcgtttagcgttttattttaggggtcgtacgggtcgggggatgtacgttttggaggtgaggattaggtaggagggnttcgtttcgaggcgagatggtcgtacggttttttnagcgtagggtttttagagtcgtaggcggtgacgttcggtcggggggttcggtcgtaagggatatatagttgggggcgtaatggtgagggcggcgacgtacggnttcggaggggatgcgcggtcgggtagggcgtgtagggttgtggggcgtgggggatacgcggggtcgggcgcgcggtcggggggcgtaggggtaagagggtgtcgtatttattagggaagttttcggtcgattttggcggggaattgggcgcgttaattcgggttatcgttttgtatagcgggagaagttattcgtattgacgttttttaggcgttggatcgtcgaaggtttggttgaaaatttgaattcgtttggagcggatgtttaagaaaatgtaggttcgttgaagtttttttngtcgcgttttgggttttgaanagcgttcggtagtt

SEQ ID NO: 4856 - DNA, 1747 bp, Artificial Sequence
  chemically treated genomic DNA (Homo sapiens) CpG-island No: 4856
  misc_feature (15)..(15): n is either a, c, g or t
  misc_feature (36)..(36): n is either a, c, g or t
  misc_feature (333)..(333): n is either a, c, g or t
  misc_feature (436)..(436): n is either a, c, g or t
  misc_feature (471)..(471): n is either a, c, g or t
  misc_feature (589)..(589): n is either a, c, g or t
  misc_feature (594)..(594): n is either a, c, g or t
  misc_feature (617)..(617): n is either a, c, g or t
  misc_feature (686)..(686): n is either a, c, g or t
  misc_feature (718)..(719): n is either a, c, g or t
  misc_feature (725)..(725): n is either a, c, g or t
  misc_feature (733)..(733): n is either a, c, g or t
  misc_feature (737)..(737): n is either a, c, g or t
  misc_feature (748)..(748): n is either a, c, g or t
  misc_feature (764)..(764): n is either a, c, g or t
  misc_feature (771)..(771): n is either a, c, g or t
  misc_feature (773)..(773): n is either a, c, g or t
  misc_feature (787)..(787): n is either a, c, g or t
  misc_feature (789)..(789): n is either a, c, g or t
  misc_feature (794)..(794): n is either a, c, g or t
  misc_feature (803)..(803): n is either a, c, g or t
  misc_feature (817)..(817): n is either a, c, g or t
  misc_feature (824)..(824): n is either a, c, g or t
  misc_feature (831)..(831): n is either a, c, g or t
  misc_feature (834)..(834): n is either a, c, g or t
  misc_feature (836)..(836): n is either a, c, g or t
  misc_feature (841)..(841): n is either a, c, g or t
  misc_feature (843)..(843): n is either a, c, g or t
  misc_feature (858)..(858): n is either a, c, g or t
  misc_feature (862)..(862): n is either a, c, g or t
  misc_feature (868)..(868): n is either a, c, g or t
  misc_feature (870)..(870): n is either a, c, g or t
  misc_feature (874)..(874): n is either a, c, g or t
  misc_feature (880)..(880): n is either a, c, g or t
  misc_feature (924)..(924): n is either a, c, g or t
  misc_feature (936)..(936): n is either a, c, g or t
  misc_feature (938)..(938): n is either a, c, g or t
  misc_feature (953)..(953): n is either a, c, g or t
  misc_feature (955)..(955): n is either a, c, g or t
  misc_feature (989)..(989): n is either a, c, g or t
  misc_feature (1013)..(1013): n is either a, c, g or t
  misc_feature (1040)..(1040): n is either a, c, g or t
  misc_feature (1054)..(1054): n is either a, c, g or t
  misc_feature (1069)..(1069): n is either a, c, g or t
  misc_feature (1106)..(1106): n is either a, c, g or t
  misc_feature (1153)..(1153): n is either a, c, g or t
  misc_feature (1158)..(1158): n is either a, c, g or t
  misc_feature (1182)..(1182): n is either a, c, g or t
  misc_feature (1302)..(1302): n is either a, c, g or t
  misc_feature (1320)..(1320): n is either a, c, g or t
  misc_feature (1322)..(1322): n is either a, c, g or t
  misc_feature (1336)..(1336): n is either a, c, g or t
  misc_feature (1340)..(1340): n is either a, c, g or t
  misc_feature (1427)..(1427): n is either a, c, g or t
  misc_feature (1464)..(1464): n is either a, c, g or t
  misc_feature (1498)..(1498): n is either a, c, g or t
  misc_feature (1516)..(1516): n is either a, c, g or t
  misc_feature (1523)..(1523): n is either a, c, g or t
  misc_feature (1541)..(1541): n is either a, c, g or t
  misc_feature (1640)..(1640): n is either a, c, g or t
aactaccgaacgctnttcaaaacccaaaacgcgacnaaaaaaacttcaacgaacctacattttcttaaacatccgctccaaacgaattcaaattttcaaccaaaccttcgacgatccaacgcctaaaaaacgtcaatacgaataacttctcccgctatacaaaacgataacccgaattaacgcgcccaattccccgccaaaatcgaccgaaaacttccctaataaatacgacaccctcttacccctacgccccccgaccgcgcgcccgaccccgcgtatcccccacgccccacaaccctacacgccctacccgaccgcgcatcccctccgaanccgtacgtcgccgccctcaccattacgcccccaactatatatcccttacgaccgaaccccccgaccgaacgtcaccgcctacgactctaaaaaccctacgctnaaaaaaccgtacgaccatctcgcctcgaaacgaanccctcctacctaatcctcacctccaaaacgtacatcccccgacccgtacgacccctaaaataaaacgctaaacgacgccgaacgaccgaaaccgaacgaaacgacgcgaaccgaaaancgcantcgcgtcgctaccgaccgacgantatccgaccgaaacgacaaccgtatccccgcccccctcctctcccccacccctcccgaacactccactnaatcccgacgccgacgcgcccgatcgtttaannaaccgnacgatatnccgnaaaataataanaacgccgacgcccgancgacgantnactccgaaactaananaaaancgccgacancacgaacgcgactnaccgaancgcaacnacncnacccnancgaaataactcaaancganctaacncnaacnaaacgncgaaaaaccgcgaactaaaacaataaacgacgaaaaaacgccgnaaaacccgaaancnaaccgacgcgcgacnanaaaactcccgaaacgcgctaaacctaaaaaaaantcctacgactatacaaccaacccnatcaacgaaaaacaaacgtaaaccgtnatactaccaatacntacgattccctacgncgccgccgcccgccgccgccaaccccgccaccgtatncgctcgaccgcgcaaatccgcgtctaaaaaaacgacgccgtcacccntaacnacccgcgaccgacgacgcgaaaanaaccgcccccaattacgaataaaaccgccgaacccctttccctcgtaattcttaaaacacccgccgctaaaccgccttaccctcaacgtccccgacccttccgcccccgccgtccccccnccattttaccacgaaaanancccccgaaaaaatnccgnacgaaaacccgcaaaaaaaaacgacgtcaaaccgtaactaccgaaacccctcgaaaatcaaaacctcgtaacgaacgacgacgcaanatccgctatacgaaaaacgtttaaataaacctaaccntacgaacgcgaaacgctcgtcattatactacccncgaaacaactaccccgancgcgttntaaaaacgataaactaanccctactccgaaccaacgacctatacgcctcacgccgtaactactaacacacgaccgaattcacgaaataaaaaaaacatcgcaaacttcacgcgaaanctccgcacgaatcctcaataccgctatcgaaaacaccgcactcctcacgaaaaactaacaatattccacattaaacaacctttcctcgattcgaaaatataaaaata

SEQ ID NO: 4857 - DNA, 529 bp, Artificial Sequence
  chemically treated genomic DNA (Homo sapiens) CpG-island No: 4857
gcgtatgatttttttttagttttgttattttttttttacgtcggcgtttttatttatagatacgttttattatgatttttttttgattttattcgttattttttattatacgtttgtcgttatgtacgtttacgattagataagttttatgttcgtgatttttttatacgtttttttcgtttcgtttagttttgagacgaattgtgtttacgatacgcgtcgttttattcgtacgttcgcgtatcgtacgcgtcgattgtcgttttgttatcgatgagattatttttcgttttagtattttacggcgagtatagtttatttttattcgtcgcgcgtttatagtgttttcgtcgacgttaggttcgttatgatattatttgattagattggtatgacgcgtcgtttttttatgttagtatacgatatttcgtttttatgtttatatgtcgtgttgaacgcgatattacgattattcgtagttgtcgattattttaacgtgtattttcgatttattatattttttcgtata

SEQ ID NO: 4858 - DNA, 529 bp, Artificial Sequence
  chemically treated genomic DNA (Homo sapiens) CpG-island No: 4858
tatacgaaaaaatataataaatcgaaaatacacgttaaaataatcgacaactacgaataatcgtaatatcgcgttcaacacgacatataaacataaaaacgaaatatcgtatactaacataaaaaaacgacgcgtcataccaatctaatcaaataatatcataacgaacctaacgtcgacgaaaacactataaacgcgcgacgaataaaaataaactatactcgccgtaaaatactaaaacgaaaaataatctcatcgataacaaaacgacaatcgacgcgtacgatacgcgaacgtacgaataaaacgacgcgtatcgtaaacacaattcgtctcaaaactaaacgaaacgaaaaaaacgtataaaaaaatcacgaacataaaacttatctaatcgtaaacgtacataacgacaaacgtataataaaaaataacgaataaaatcaaaaaaaaatcataataaaacgtatctataaataaaaacgccgacgtaaaaaaaaaataacaaaactaaaaaaaaatcatacgc

SEQ ID NO: 4859 - DNA, 529 bp, Artificial Sequence
  chemically treated genomic DNA (Homo sapiens) CpG-island No: 4859
tgtacggaaagatgtagtaggtcgagggtatacgttgaggtagtcggtagttacgaatggtcgtaatgtcgcgtttagtacgatatgtaggtatggaggcgaggtgtcgtatattgatatagaggagcgacgcgttatgttagtttagttaagtagtgttatagcggatttagcgtcgacgggggtattgtaagcgcgcggcgagtgaagatggattatattcgtcgtagagtattaggacgaggagtggttttatcgatagtaagacgatagtcgacgcgtgcgatgcgcgggcgtgcgaatgagacggcgcgtatcgtagatatagttcgttttaggattggacggagcgagaggagcgtgtaaaagagttacgggtataagatttgtttagtcgtaggcgtatatgacggtaggcgtgtggtagaggatgacggatgaggttaggaaggagttataatggggcgtgtttgtaagtaggagcgtcgacgtggaaggagagtgataaggttgagaagaagttatgcgt

SEQ ID NO: 4860 - DNA, 529 bp, Artificial Sequence
  chemically treated genomic DNA (Homo sapiens) CpG-island No: 4860
acgcataacttcttctcaaccttatcactctccttccacgtcgacgctcctacttacaaacacgccccattataactccttcctaacctcatccgtcatcctctaccacacgcctaccgtcatatacgcctacgactaaacaaatcttatacccgtaactcttttacacgctcctctcgctccgtccaatcctaaaacgaactatatctacgatacgcgccgtctcattcgcacgcccgcgcatcgcacgcgtcgactatcgtcttactatcgataaaaccactcctcgtcctaatactctacgacgaatataatccatcttcactcgccgcgcgcttacaatacccccgtcgacgctaaatccgctataacactacttaactaaactaacataacgcgtcgctcctctatatcaatatacgacacctcgcctccatacctacatatcgtactaaacgcgacattacgaccattcgtaactaccgactacctcaacgtataccctcgacctactacatctttccgtaca

SEQ ID NO: 4861 - DNA, 566 bp, Artificial Sequence
  chemically treated genomic DNA (Homo sapiens) CpG-island No: 4861
cgcggattgtgtatacggtttttggggtttcgggggcgcggtagtggggtacgggattcgggggatttcgtattcggcgatatcgttacgagcggatagtgcgtatagcgagatcggcgttcgcggtgatcgcgtcgttcggtgttatgcgtaatttcggatttgtcgtagtatcggcgttggcggtatttcgcgtaatcggcgaacgcggggattatgcgttttcgtgcgcgtattagcggatgcgcgtcgtattcgggtgattcgtcgttttcgggggtatttcggcgaaatttgcgtgaaattttgtattgattcgttaatatgtgggataagcggcggcgtatcgcgtagattcgcggataatgcgcgtagagttgggcgattattgcggcgattcgggggattattatcgtagttacgcggttgtattgggcggatatttcgtgagtagacggcgcgtgagaacgcgtgggaatgcgtttgaaatttttcgcgatattttagcgttttattttcgggcgatattatcgtagagatgcgcgttgaattatcggcggcggtat

SEQ ID NO: 4862 - DNA, 566 bp, Artificial Sequence
  chemically treated genomic DNA (Homo sapiens) CpG-island No: 4862
ataccgccgccgataattcaacgcgcatctctacgataatatcgcccgaaaataaaacgctaaaatatcgcgaaaaatttcaaacgcattcccacgcgttctcacgcgccgtctactcacgaaatatccgcccaatacaaccgcgtaactacgataataatcccccgaatcgccgcaataatcgcccaactctacgcgcattatccgcgaatctacgcgatacgccgccgcttatcccacatattaacgaatcaatacaaaatttcacgcaaatttcgccgaaatacccccgaaaacgacgaatcacccgaatacgacgcgcatccgctaatacgcgcacgaaaacgcataatccccgcgttcgccgattacgcgaaataccgccaacgccgatactacgacaaatccgaaattacgcataacaccgaacgacgcgatcaccgcgaacgccgatctcgctatacgcactatccgctcgtaacgatatcgccgaatacgaaatcccccgaatcccgtaccccactaccgcgcccccgaaaccccaaaaaccgtatacacaatccgcg

SEQ ID NO: 4863 - DNA, 566 bp, Artificial Sequence
  chemically treated genomic DNA (Homo sapiens) CpG-island No: 4863
gtgtcgtcgtcggtggtttagcgcgtatttttgcgatgatatcgttcggaagtagggcgttggagtatcgcgagagattttaggcgtatttttacgcgtttttacgcgtcgtttgtttacgaaatgttcgtttagtataatcgcgtagttgcggtaatagtttttcgaatcgtcgtaatagtcgtttagttttgcgcgtattattcgcggatttacgcgatacgtcgtcgtttattttatatgttgacggattagtgtagagttttacgtagatttcgtcgagatgttttcgaggacggcgaattattcggatgcggcgcgtattcgttaatacgcgtacgagaacgtatgattttcgcgttcgtcggttacgcgagatgtcgttagcgtcgatgttgcggtaaattcgaggttgcgtatagtatcggacggcgcgattatcgcggacgtcggtttcgttatgcgtattattcgttcgtgacggtgtcgtcggatgcgaggtttttcgaatttcgtgttttattatcgcgttttcgagattttaagggtcgtgtgtataattcgcg

SEQ ID NO: 4864 - DNA, 566 bp, Artificial Sequence
  chemically treated genomic DNA (Homo sapiens) CpG-island No: 4864
cgcgaattatacacacgacccttaaaatctcgaaaacgcgataataaaacacgaaattcgaaaaacctcgcatccgacgacaccgtcacgaacgaataatacgcataacgaaaccgacgtccgcgataatcgcgccgtccgatactatacgcaacctcgaatttaccgcaacatcgacgctaacgacatctcgcgtaaccgacgaacgcgaaaatcatacgttctcgtacgcgtattaacgaatacgcgccgcatccgaataattcgccgtcctcgaaaacatctcgacgaaatctacgtaaaactctacactaatccgtcaacatataaaataaacgacgacgtatcgcgtaaatccgcgaataatacgcgcaaaactaaacgactattacgacgattcgaaaaactattaccgcaactacgcgattatactaaacgaacatttcgtaaacaaacgacgcgtaaaaacgcgtaaaaatacgcctaaaatctctcgcgatactccaacgccctacttccgaacgatatcatcgcaaaaatacgcgctaaaccaccgacgacgacac

SEQ ID NO: 4865 - DNA, 674 bp, Artificial Sequence
  chemically treated genomic DNA (Homo sapiens) CpG-island No: 4865
ttacgttcgtattttgggcgtttttatcgtattttcgaggttggtaattcgcgtttttcgggagttgagggagttttgttttttttagttcgtcgtttttgttcgttttcgagttcgcgttattttatattttagacgtcgaatttttttttttttttcgtcgtttttcgttggttagatttttttcgttttttttaatttttttagggaacggttgtttcgaggttagttttaaagcgtcgtcgtcgttcgcgacgttcgttttattttaggattcgagtcgtagagttgttaggtttggacgcgtttagtttgttgatttagtgcgggtgatttagttgggatttgtgcgagtggcgttgcggcgtattcgtcggtttttgtgcgtaggtagagttggcgacgtcgaagtcgcgtttcgttttttgtagagtttatttgagggcggggttttttagaaaagcggtttcgtagtacgggcgcgttttagacgatcggtttcgcgcgtttcgacgtacgtaggtaagtagcgcgttcgtaagaggagagcggttgagggtgcggcgagcggtggcgcgtcgttgtttagggtttttgagttattagagtcgggtttcgtggtttttttttaggttttttaacgtttgggttttgcggggatttcgttacgtttt

SEQ ID NO: 4866 - DNA, 674 bp, Artificial Sequence
  chemically treated genomic DNA (Homo sapiens) CpG-island No: 4866
aaaacgtaacgaaatccccgcaaaacccaaacgttaaaaaacctaaaaaaaaaccacgaaacccgactctaataactcaaaaaccctaaacaacgacgcgccaccgctcgccgcaccctcaaccgctctcctcttacgaacgcgctacttacctacgtacgtcgaaacgcgcgaaaccgatcgtctaaaacgcgcccgtactacgaaaccgcttttctaaaaaaccccgccctcaaataaactctacaaaaaacgaaacgcgacttcgacgtcgccaactctacctacgcacaaaaaccgacgaatacgccgcaacgccactcgcacaaatcccaactaaatcacccgcactaaatcaacaaactaaacgcgtccaaacctaacaactctacgactcgaatcctaaaataaaacgaacgtcgcgaacgacgacgacgctttaaaactaacctcgaaacaaccgttccctaaaaaaattaaaaaaaacgaaaaaaatctaaccaacgaaaaacgacgaaaaaaaaaaaaaaattcgacgtctaaaatataaaataacgcgaactcgaaaacgaacaaaaacgacgaactaaaaaaaacaaaactccctcaactcccgaaaaacgcgaattaccaacctcgaaaatacgataaaaacgcccaaaatacgaacgtaa

SEQ ID NO: 4867 - DNA, 674 bp, Artificial Sequence
  chemically treated genomic DNA (Homo sapiens) CpG-island No: 4867
agagcgtggcgagattttcgtagaatttaggcgttggagggtttggggaagagttacgaggttcgattttagtggtttaggggttttgggtagcggcgcgttatcgttcgtcgtatttttagtcgttttttttttgcgggcgcgttgtttgtttgcgtgcgtcgggacgcgcggggtcgatcgtttgaagcgcgttcgtattgcggagtcgtttttttagggagtttcgtttttaggtgggttttgtaggaggcggggcgcgatttcggcgtcgttagttttgtttgcgtataggagtcggcgggtgcgtcgtagcgttattcgtatagattttagttgggttattcgtattgagttaatagattgagcgcgtttaggtttgatagttttgcggttcgggttttgaggtgaggcgggcgtcgcgggcggcggcggcgttttgaggttagtttcgggatagtcgttttttgggggagttagaggggacgaggagggtttggttagcgagggacggcggggagagaaggggagttcggcgtttgaggtgtggggtgacgcgggttcggaagcgggtagaggcggcgagttgagggaaatagagtttttttagttttcgggaagcgcgggttgttagtttcggggatgcggtgggagcgtttaggatgcggacgtga

SEQ ID NO: 4868 - DNA, 674 bp, Artificial Sequence
  chemically treated genomic DNA (Homo sapiens) CpG-island No: 4868
tcacgtccgcatcctaaacgctcccaccgcatccccgaaactaacaacccgcgcttcccgaaaactaaaaaaactctatttccctcaactcgccgcctctacccgcttccgaacccgcgtcaccccacacctcaaacgccgaactccccttctctccccgccgtccctcgctaaccaaaccctcctcgtcccctctaactcccccaaaaaacgactatcccgaaactaacctcaaaacgccgccgccgcccgcgacgcccgcctcacctcaaaacccgaaccgcaaaactatcaaacctaaacgcgctcaatctattaactcaatacgaataacccaactaaaatctatacgaataacgctacgacgcacccgccgactcctatacgcaaacaaaactaacgacgccgaaatcgcgccccgcctcctacaaaacccacctaaaaacgaaactccctaaaaaaacgactccgcaatacgaacgcgcttcaaacgatcgaccccgcgcgtcccgacgcacgcaaacaaacaacgcgcccgcaaaaaaaaaacgactaaaaatacgacgaacgataacgcgccgctacccaaaacccctaaaccactaaaatcgaacctcgtaactcttccccaaaccctccaacgcctaaattctacgaaaatctcgccacgctct

SEQ ID NO: 4869 - DNA, 980 bp, Artificial Sequence
  chemically treated genomic DNA (Homo sapiens) CpG-island No: 4869
gtcgtgcggttcgaggcgaatttgttttagagtcgtcgggtttttttatttcgagtcgtatttttagtttcggtttgaggtggtcggcgattgcgtgcgtaaatataagattcgtattttatttttcgttattgtagtttcgcggtcgcgtttagagttttcggaatagatcggatttaatgcggattaggtaagcggaagtgtgtcgttttttttcggttagcgtagtacgagacgaggcggggaatcgcgggaggaggcggggtttagtgttgacgaatagttttcggggtttatgggcgcgggggtagtcgttcggttttttcggcgcgtttttttttcggggttgttgacgttttttagttttttatttttataaagtttcgcggcggttttgttttttttgtattcgcggcgcgttgcggttcgtggcgcggtttcgttttcgtttagtttcgtcggttttttttttttttcggagtcgcgcgtgaggacggttgaggtcgtaggtttgtggcggcgcgtcgggacgcgcgggcgagggtttatcgagagggcgggcgggcgtcggcggaattttcggttatagtttcgagtttttggggtcgttttttttcgtcgcgtggcgtagtcggggggcgcggtcgcggcgtcggggcgtcgggaggggcggagcgcgggagtgtttgtcgggacgcgggtcgggttgggtttcggaaggattaagtttgcggagcggtttttgttcgtcggtcgtgcggcgaggtagggtttgggttgcgatttcggcggtcgttcgcggttttgggagagttggggcgcgtgtttgaatttttcggttgtttttgtttttggagatttatttgatggggacgttaggtgtgtaggggcgtggcgcgtaggtaagcggattcggtgtttgtttcgtttaggggatgtttattagagcgttaggtttttttatttttattttttagaga

SEQ ID NO: 4870 - DNA, 980 bp, Artificial Sequence
  chemically treated genomic DNA (Homo sapiens) CpG-island No: 4870
tctctaaaaaataaaaataaaaaaacctaacgctctaataaacatcccctaaacgaaacaaacaccgaatccgcttacctacgcgccacgcccctacacacctaacgtccccatcaaataaatctccaaaaacaaaaacaaccgaaaaattcaaacacgcgccccaactctcccaaaaccgcgaacgaccgccgaaatcgcaacccaaaccctacctcgccgcacgaccgacgaacaaaaaccgctccgcaaacttaatccttccgaaacccaacccgacccgcgtcccgacaaacactcccgcgctccgcccctcccgacgccccgacgccgcgaccgcgccccccgactacgccacgcgacgaaaaaaaacgaccccaaaaactcgaaactataaccgaaaattccgccgacgcccgcccgccctctcgataaaccctcgcccgcgcgtcccgacgcgccgccacaaacctacgacctcaaccgtcctcacgcgcgactccgaaaaaaaaaaaaaaccgacgaaactaaacgaaaacgaaaccgcgccacgaaccgcaacgcgccgcgaatacaaaaaaaacaaaaccgccgcgaaactttataaaaataaaaaactaaaaaacgtcaacaaccccgaaaaaaaaacgcgccgaaaaaaccgaacgactacccccgcgcccataaaccccgaaaactattcgtcaacactaaaccccgcctcctcccgcgattccccgcctcgtctcgtactacgctaaccgaaaaaaaacgacacacttccgcttacctaatccgcattaaatccgatctattccgaaaactctaaacgcgaccgcgaaactacaataacgaaaaataaaatacgaatcttatatttacgcacgcaatcgccgaccacctcaaaccgaaactaaaaatacgactcgaaataaaaaaacccgacgactctaaaacaaattcgcctcgaaccgcacgac

SEQ ID NO: 4871 - DNA, 980 bp, Artificial Sequence
  chemically treated genomic DNA (Homo sapiens) CpG-island No: 4871
tttttaaaaaataaaaataaaaaagtttagcgttttagtgagtattttttggacgaggtaggtatcgggttcgtttatttacgcgttacgtttttgtatatttggcgtttttattaggtaggtttttaaggataggggtagtcgggaagtttaggtacgcgttttagtttttttaagatcgcgagcggtcgtcggggtcgtagtttaggttttgtttcgtcgtacggtcgacgagtagaagtcgtttcgtaaatttggttttttcggagtttagttcggttcgcgtttcggtagatattttcgcgtttcgtttttttcgacgtttcgacgtcgcggtcgcgtttttcgattgcgttacgcggcggggaggggcggttttaggggttcggggttgtagtcgagggtttcgtcggcgttcgttcgttttttcggtagattttcgttcgcgcgtttcggcgcgtcgttatagatttgcggttttagtcgtttttacgcgcggtttcgggaggggaaggaggtcgacggggttaggcgggaacggggtcgcgttacgggtcgtagcgcgtcgcgggtataaggagggtagaatcgtcgcggagttttgtggaaatgaggggttggggggcgttaatagtttcggggagggggcgcgtcggagaggtcgggcggttgttttcgcgtttataggtttcgggagttgttcgttaatattaggtttcgttttttttcgcggtttttcgtttcgtttcgtgttgcgttggtcggaaggaagcggtatattttcgtttgtttggttcgtattgagttcggtttgtttcggagattttgagcgcggtcgcggagttgtagtggcggggagtggggtgcggattttgtgtttgcgtacgtagtcgtcggttattttaggtcggagttagagatacggttcgggataggagggttcggcggttttgaggtaggttcgtttcgagtcgtacggt

SEQ ID NO: 4872 - DNA, 980 bp, Artificial Sequence
  chemically treated genomic DNA (Homo sapiens) CpG-island No: 4872
accgtacgactcgaaacgaacctacctcaaaaccgccgaaccctcctatcccgaaccgtatctctaactccgacctaaaataaccgacgactacgtacgcaaacacaaaatccgcaccccactccccgccactacaactccgcgaccgcgctcaaaatctccgaaacaaaccgaactcaatacgaaccaaacaaacgaaaatataccgcttccttccgaccaacgcaacacgaaacgaaacgaaaaaccgcgaaaaaaaacgaaacctaatattaacgaacaactcccgaaacctataaacgcgaaaacaaccgcccgacctctccgacgcgccccctccccgaaactattaacgccccccaacccctcatttccacaaaactccgcgacgattctaccctccttatacccgcgacgcgctacgacccgtaacgcgaccccgttcccgcctaaccccgtcgacctccttcccctcccgaaaccgcgcgtaaaaacgactaaaaccgcaaatctataacgacgcgccgaaacgcgcgaacgaaaatctaccgaaaaaacgaacgaacgccgacgaaaccctcgactacaaccccgaacccctaaaaccgcccctccccgccgcgtaacgcaatcgaaaaacgcgaccgcgacgtcgaaacgtcgaaaaaaacgaaacgcgaaaatatctaccgaaacgcgaaccgaactaaactccgaaaaaaccaaatttacgaaacgacttctactcgtcgaccgtacgacgaaacaaaacctaaactacgaccccgacgaccgctcgcgatcttaaaaaaactaaaacgcgtacctaaacttcccgactacccctatccttaaaaacctacctaataaaaacgccaaatatacaaaaacgtaacgcgtaaataaacgaacccgatacctacctcgtccaaaaaatactcactaaaacgctaaacttttttatttttattttttaaaaa

SEQ ID NO: 4873 - DNA, 656 bp, Artificial Sequence
  chemically treated genomic DNA (Homo sapiens) CpG-island No: 4873
  misc_feature (80)..(80): n is either a, c, g or t
  misc_feature (106)..(106): n is either a, c, g or t
  misc_feature (109)..(109): n is either a, c, g or t
  misc_feature (274)..(274): n is either a, c, g or t
  misc_feature (351)..(351): n is either a, c, g or t
  misc_feature (375)..(375): n is either a, c, g or t
  misc_feature (393)..(393): n is either a, c, g or t
  misc_feature (412)..(412): n is either a, c, g or t
  misc_feature (427)..(427): n is either a, c, g or t
  misc_feature (465)..(465): n is either a, c, g or t
  misc_feature (518)..(518): n is either a, c, g or t
  misc_feature (556)..(556): n is either a, c, g or t
  misc_feature (561)..(561): n is either a, c, g or t
  misc_feature (651)..(651): n is either a, c, g or t
ttcgaaagaaagttttacgaatttataaaggttttttttcgtttttttttcgaagttttttttttattttgtatttcggnttgtggatttattttttttttgttgnatntcggtcgtcggtttgtcgggtttggcgttttttagaaggtttagcgtcgggaaggggtttgtagttgtttcgttatcgtgcggttcgacgttatttcgcgttcgtgtgtaggttcggttcggtttttggttttcggtgcgagggttaacgttaggtttcggtttncggttttcggattaggtcgtgatttcgggtgttatgaagtaggagggttcggcgcggcgtcgcggcgcgaataaggncgaaaaacgtcgttcgtcgaaganagaataagaattttaatncgtcgtcggttttttaggnatgtggagatgaaangagaaggtagcgacgggtgtcgggttaacgggggaggntagacgttaagacggcggcgttagcggttgagtatttttagcgagagttggantatagttattttggagggtacggtagtttaggtcgggnaacgntgtcgcgatcgcgggtgatagcgatttttgtgatttggttttttgttgggaagttatagtagtttttattatttttagttttttgggatntattt

SEQ ID NO: 4874 - DNA, 656 bp, Artificial Sequence
  chemically treated genomic DNA (Homo sapiens) CpG-island No: 4874
  misc_feature (6)..(6): n is either a, c, g or t
  misc_feature (96)..(96): n is either a, c, g or t
  misc_feature (101)..(101): n is either a, c, g or t
  misc_feature (139)..(139): n is either a, c, g or t
  misc_feature (192)..(192): n is either a, c, g or t
  misc_feature (230)..(230): n is either a, c, g or t
  misc_feature (245)..(245): n is either a, c, g or t
  misc_feature (264)..(264): n is either a, c, g or t
  misc_feature (282)..(282): n is either a, c, g or t
  misc_feature (306)..(306): n is either a, c, g or t
  misc_feature (383)..(383): n is either a, c, g or t
  misc_feature (548)..(548): n is either a, c, g or t
  misc_feature (551)..(551): n is either a, c, g or t
  misc_feature (577)..(577): n is either a, c, g or t
aaatanatcccaaaaaactaaaaataataaaaactactataacttcccaacaaaaaaccaaatcacaaaaatcgctatcacccgcgatcgcgacancgttncccgacctaaactaccgtaccctccaaaataactatantccaactctcgctaaaaatactcaaccgctaacgccgccgtcttaacgtctancctcccccgttaacccgacacccgtcgctaccttctcntttcatctccacatncctaaaaaaccgacgacgnattaaaattcttattctntcttcgacgaacgacgtttttcgnccttattcgcgccgcgacgccgcgccgaaccctcctacttcataacacccgaaatcacgacctaatccgaaaaccgnaaaccgaaacctaacgttaaccctcgcaccgaaaaccaaaaaccgaaccgaacctacacacgaacgcgaaataacgtcgaaccgcacgataacgaaacaactacaaaccccttcccgacgctaaaccttctaaaaaacgccaaacccgacaaaccgacgaccganatncaacaaaaaaaaaataaatccacaanccgaaatacaaaataaaaaaaaaacttcgaaaaaaaaacgaaaaaaaacctttataaattcgtaaaactttctttcgaa

SEQ ID NO: 4875 - DNA, 656 bp, Artificial Sequence
  chemically treated genomic DNA (Homo sapiens) CpG-island No: 4875
  misc_feature (6)..(6): n is either a, c, g or t
  misc_feature (96)..(96): n is either a, c, g or t
  misc_feature (101)..(101): n is either a, c, g or t
  misc_feature (139)..(139): n is either a, c, g or t
  misc_feature (192)..(192): n is either a, c, g or t
  misc_feature (230)..(230): n is either a, c, g or t
  misc_feature (245)..(245): n is either a, c, g or t
  misc_feature (264)..(264): n is either a, c, g or t
  misc_feature (282)..(282): n is either a, c, g or t
  misc_feature (306)..(306): n is either a, c, g or t
  misc_feature (383)..(383): n is either a, c, g or t
  misc_feature (548)..(548): n is either a, c, g or t
  misc_feature (551)..(551): n is either a, c, g or t
  misc_feature (577)..(577): n is either a, c, g or t
gggtgnattttaaagaattgagggtggtggaggttgttgtggttttttagtaagaagttaaattataggggtcgttgttattcgcgatcgcggtancgttnttcggtttgggttgtcgtattttttaaggtgattgtgntttagttttcgttgggagtgtttagtcgttggcgtcgtcgttttggcgtttgntttttttcgttgattcggtattcgtcgttgtttttttnttttatttttatatntttggggggtcggcggcgngttggggtttttgttttnttttcggcgggcggcgtttttcgnttttgttcgcgtcgcggcgtcgcgtcgagtttttttgttttatggtattcggggttacggtttagttcggggatcgnaggtcggggtttggcgttaattttcgtatcggggattaggagtcgagtcgggtttgtatacgagcgcgagatagcgtcgggtcgtacgatgacggagtagttgtaaattttttttcggcgttgggttttttgggaaacgttaggttcggtaggtcgacggtcgangtntaataaaggggaaataaatttatagntcgaggtgtaggatgaaggaggagtttcgaggaaggagcggggaggagtttttatgggttcgtggggttttttttcgag

SEQ ID NO: 4876 - DNA, 656 bp, Artificial Sequence
  chemically treated genomic DNA (Homo sapiens) CpG-island No: 4876
  misc_feature (80)..(80): n is either a, c, g or t
  misc_feature (106)..(106): n is either a, c, g or t
  misc_feature (109)..(109): n is either a, c, g or t
  misc_feature (274)..(274): n is either a, c, g or t
  misc_feature (351)..(351): n is either a, c, g or t
  misc_feature (375)..(375): n is either a, c, g or t
  misc_feature (393)..(393): n is either a, c, g or t
  misc_feature (412)..(412): n is either a, c, g or t
  misc_feature (427)..(427): n is either a, c, g or t
  misc_feature (465)..(465): n is either a, c, g or t
  misc_feature (518)..(518): n is either a, c, g or t
  misc_feature (556)..(556): n is either a, c, g or t
  misc_feature (561)..(561): n is either a, c, g or t
  misc_feature (651)..(651): n is either a, c, g or t
ctcgaaaaaaaaccccacgaacccataaaaactcctccccgctccttcctcgaaactcctccttcatcctacacctcganctataaatttatttcccctttattanacntcgaccgtcgacctaccgaacctaacgtttcccaaaaaacccaacgccgaaaaaaaatttacaactactccgtcatcgtacgacccgacgctatctcgcgctcgtatacaaacccgactcgactcctaatccccgatacgaaaattaacgccaaaccccgacctncgatccccgaactaaaccgtaaccccgaataccataaaacaaaaaaactcgacgcgacgccgcgacgcgaacaaaancgaaaaacgccgcccgccgaaaanaaaacaaaaaccccaacncgccgccgaccccccaaanatataaaaataaaanaaaaaaacaacgacgaataccgaatcaacgaaaaaaancaaacgccaaaacgacgacgccaacgactaaacactcccaacgaaaactaaancacaatcaccttaaaaaatacgacaacccaaaccgaanaacgntaccgcgatcgcgaataacaacgacccctataatttaacttcttactaaaaaaccacaacaacctccaccaccctcaattctttaaaatncaccc

SEQ ID NO: 4877 - DNA, 660 bp, Artificial Sequence
  chemically treated genomic DNA (Homo sapiens) CpG-island No: 4877
  misc_feature (68)..(68): n is either a, c, g or t
  misc_feature (84)..(84): n is either a, c, g or t
  misc_feature (93)..(93): n is either a, c, g or t
  misc_feature (202)..(202): n is either a, c, g or t
  misc_feature (218)..(218): n is either a, c, g or t
  misc_feature (226)..(226): n is either a, c, g or t
  misc_feature (636)..(636): n is either a, c, g or t
  misc_feature (638)..(638): n is either a, c, g or t
cgttttttcggattttttgtaagttttttttttatattcgcgttcgcgttttcgttttttcgttcggnttttgttttttttttnttggtcgtngatttcgttttcgttttcgtttcggtttcgcgtagttttcggtttttggtagagtttagttcgcgtttattcggagtcggggagggagagaaaaatgagtttttttgtngttcggtggcggtgtntaattgantcgcgcgcgggcgggttgcgcgtcgggttgggggttttattcgaagttatcggcgcgtaattatcgggaaaaaattgggacggtatcgcggtgaaattagttaacgattattacggtgggttcgcggaagatcgtttggcgttgagggttgtagatttcgttataatacgttggacgggtcggggatttggagtacggcggaggcggattttatttttgtttcgattttttttttattttttttatttttaatttttttttcgttcgcgttttttttttttatttattttgtcgtcgtatcgattcgcggtcgattttcgtagcggttagcgttttcgttcgttgttttttttttttttagttcggtttttttcgcgggggttgttatcgagcgtttggtataggacggntntatgtttcggggaaggagggat

SEQ ID NO: 4878 - DNA, 660 bp, Artificial Sequence
  chemically treated genomic DNA (Homo sapiens) CpG-island No: 4878
  misc_feature (23)..(23): n is either a, c, g or t
  misc_feature (25)..(25): n is either a, c, g or t
  misc_feature (435)..(435): n is either a, c, g or t
  misc_feature (443)..(443): n is either a, c, g or t
  misc_feature (459)..(459): n is either a, c, g or t
  misc_feature (568)..(568): n is either a, c, g or t
  misc_feature (577)..(577): n is either a, c, g or t
  misc_feature (593)..(593): n is either a, c, g or t
atccctccttccccgaaacatananccgtcctataccaaacgctcgataacaacccccgcgaaaaaaaccgaactaaaaaaaaaaaaaacaacgaacgaaaacgctaaccgctacgaaaatcgaccgcgaatcgatacgacgacaaaataaataaaaaaaaaaaacgcgaacgaaaaaaaaattaaaaataaaaaaaataaaaaaaaaatcgaaacaaaaataaaatccgcctccgccgtactccaaatccccgacccgtccaacgtattataacgaaatctacaaccctcaacgccaaacgatcttccgcgaacccaccgtaataatcgttaactaatttcaccgcgataccgtcccaattttttcccgataattacgcgccgataacttcgaataaaacccccaacccgacgcgcaacccgcccgcgcgcgantcaattanacaccgccaccgaacnacaaaaaaactcatttttctctccctccccgactccgaataaacgcgaactaaactctaccaaaaaccgaaaactacgcgaaaccgaaacgaaaacgaaaacgaaatcnacgaccaanaaaaaaaaaacaaaanccgaacgaaaaaacgaaaacgcgaacgcgaatataaaaaaaaaacttacaaaaaatccgaaaaaacg

SEQ ID NO: 4879 - DNA, 660 bp, Artificial Sequence
  chemically treated genomic DNA (Homo sapiens) CpG-island No: 4879
  misc_feature (23)..(23): n is either a, c, g or t
  misc_feature (25)..(25): n is either a, c, g or t
  misc_feature (435)..(435): n is either a, c, g or t
  misc_feature (443)..(443): n is either a, c, g or t
  misc_feature (459)..(459): n is either a, c, g or t
  misc_feature (568)..(568): n is either a, c, g or t
  misc_feature (577)..(577): n is either a, c, g or t
  misc_feature (593)..(593): n is either a, c, g or t
gttttttttttttcggggtatgngntcgttttgtgttaggcgttcggtgatagttttcgcgggggaggtcgggttgggaaaggagagggtagcgggcgggggcgttggtcgttgcgagggtcggtcgcgggtcgatacggcggtaggatgaatgggagaggggagcgcgggcgggaggaggattgaggatgagggggatgagggagaggtcggagtaggggtggggttcgttttcgtcgtgttttaggttttcggttcgtttagcgtgttgtgacgggatttgtagtttttagcgttaagcggtttttcgcggatttatcgtagtgatcgttaattaattttatcgcggtatcgttttagttttttttcgataattgcgcgtcggtagtttcgagtaaggtttttagttcggcgcgtagttcgttcgcgcgcganttaattgnatatcgttatcgggtngtaggaaaatttattttttttttttttttcggtttcgggtgggcgcgggttgagttttgttaagggtcgggggttacgcggggtcggggcgggggcgggggcggggttnacggttagnggagggagggtagggntcgagcgagggggcgggggcgcgggcgcgggtgtgggaaggaggtttgtaaggaattcgaggaggcg

SEQ ID NO: 4880 - DNA, 660 bp, Artificial Sequence
  chemically treated genomic DNA (Homo sapiens) CpG-island No: 4880
  misc_feature (68)..(68): n is either a, c, g or t
  misc_feature (84)..(84): n is either a, c, g or t
  misc_feature (93)..(93): n is either a, c, g or t
  misc_feature (202)..(202): n is either a, c, g or t
  misc_feature (218)..(218): n is either a, c, g or t
  misc_feature (226)..(226): n is either a, c, g or t
  misc_feature (636)..(636): n is either a, c, g or t
  misc_feature (638)..(638): n is either a, c, g or t
cgcctcctcgaattccttacaaacctccttcccacacccgcgcccgcgcccccgccccctcgctcganccctaccctccctccnctaaccgtnaaccccgcccccgcccccgccccgaccccgcgtaacccccgacccttaacaaaactcaacccgcgcccacccgaaaccgaaaaaaaaaaaaaaaataaattttcctacnacccgataacgatatncaattaantcgcgcgcgaacgaactacgcgccgaactaaaaaccttactcgaaactaccgacgcgcaattatcgaaaaaaaactaaaacgataccgcgataaaattaattaacgatcactacgataaatccgcgaaaaaccgcttaacgctaaaaactacaaatcccgtcacaacacgctaaacgaaccgaaaacctaaaacacgacgaaaacgaaccccacccctactccgacctctccctcatccccctcatcctcaatcctcctcccgcccgcgctcccctctcccattcatcctaccgccgtatcgacccgcgaccgaccctcgcaacgaccaacgcccccgcccgctaccctctcctttcccaacccgacctcccccgcgaaaactatcaccgaacgcctaacacaaaacgancncataccccgaaaaaaaaaaaac

SEQ ID NO: 4881 - DNA, 887 bp, Artificial Sequence
  chemically treated genomic DNA (Homo sapiens) CpG-island No: 4881
  misc_feature (38)..(38): n is either a, c, g or t
  misc_feature (40)..(40): n is either a, c, g or t
  misc_feature (67)..(67): n is either a, c, g or t
  misc_feature (69)..(69): n is either a, c, g or t
  misc_feature (280)..(280): n is either a, c, g or t
  misc_feature (316)..(316): n is either a, c, g or t
  misc_feature (390)..(390): n is either a, c, g or t
  misc_feature (413)..(413): n is either a, c, g or t
  misc_feature (436)..(436): n is either a, c, g or t
  misc_feature (730)..(730): n is either a, c, g or t
  misc_feature (737)..(737): n is either a, c, g or t
tattttttcgtggggacgtattttaagattcgaagagngnttattttttattagtttagagtgttgngnttaatcgtcgtttatcgttatttatacgcgtttttagaaattttgttatcgaaaacgcgttttaaatttatagatcgatacgtaacggatttacggatttcgagttttcgattacgattttcgttttagttaagttatatttcgtttttggtcggtcgtatttattatatttgcgcgtcgttatttgtcgttgttgttttcggacggtttntcgtgtggttttttcgcgtttcggttttggtttcgnggcgcgtcgttagtcgttcgtcgtcgttattttttttaggtttaggaggtggtttatcgagaagtttattgatntatttgggcgtagtcgtcgggtntttagcgcgggtggaggcggcgngcggtttcgggtttagcgtcggtttgtttagggagaaaggcggcggtcgcgattgtttaatgattcgacgaaagtcgggggggtcggagggggtttcgggttcgggttttaggaagggtcgcgggcgcgggtcggagcgagagtttcggtcgtttcgcgttttgttttagttttcgtcgttattattacgttcgcggttcgttcggcgttgacgtcggggaaataaatttttcgtttttttttttttagttacggtcgttcgtttcggagtcgttggtgatacgtcgtgcgttnggttatnacgttttatttttgaagtaaatttcgtttttcgttttttttttcgttttttttttttcgcgcgtttcgttcgtttttatttcggattttggcgttgggggcggggaaggggtgttttttttttattttttttatttattttttagggagt

SEQ ID NO: 4882 - DNA, 887 bp, Artificial Sequence
  chemically treated genomic DNA (Homo sapiens) CpG-island No: 4882
  misc_feature (151)..(151): n is either a, c, g or t
  misc_feature (158)..(158): n is either a, c, g or t
  misc_feature (452)..(452): n is either a, c, g or t
  misc_feature (475)..(475): n is either a, c, g or t
  misc_feature (498)..(498): n is either a, c, g or t
  misc_feature (572)..(572): n is either a, c, g or t
  misc_feature (608)..(608): n is either a, c, g or t
  misc_feature (819)..(819): n is either a, c, g or t
  misc_feature (821)..(821): n is either a, c, g or t
  misc_feature (848)..(848): n is either a, c, g or t
  misc_feature (850)..(850): n is either a, c, g or t
actccctaaaaaataaataaaaaaaataaaaaaaaaacaccccttccccgcccccaacgccaaaatccgaaataaaaacgaacgaaacgcgcgaaaaaaaaaaaacgaaaaaaaaaacgaaaaacgaaatttacttcaaaaataaaacgtnataaccnaacgcacgacgtatcaccaacgactccgaaacgaacgaccgtaactaaaaaaaaaaaaacgaaaaatttatttccccgacgtcaacgccgaacgaaccgcgaacgtaataataacgacgaaaactaaaacaaaacgcgaaacgaccgaaactctcgctccgacccgcgcccgcgacccttcctaaaacccgaacccgaaaccccctccgacccccccgactttcgtcgaatcattaaacaatcgcgaccgccgcctttctccctaaacaaaccgacgctaaacccgaaaccgcncgccgcctccacccgcgctaaanacccgacgactacgcccaaatanatcaataaacttctcgataaaccacctcctaaacctaaaaaaaataacgacgacgaacgactaacgacgcgccncgaaaccaaaaccgaaacgcgaaaaaaccacacganaaaccgtccgaaaacaacaacgacaaataacgacgcgcaaatataataaatacgaccgaccaaaaacgaaatataacttaactaaaacgaaaatcgtaatcgaaaactcgaaatccgtaaatccgttacgtatcgatctataaatttaaaacgcgttttcgataacaaaatttctaaaaacgcgtataaataacgataaacgacgattaancncaacactctaaactaataaaaaataancnctcttcgaatcttaaaatacgtccccacgaaaaaata

SEQ ID NO: 4883 - DNA, 887 bp, Artificial Sequence
  chemically treated genomic DNA (Homo sapiens) CpG-island No: 4883
  misc_feature (151)..(151): n is either a, c, g or t
  misc_feature (158)..(158): n is either a, c, g or t
  misc_feature (452)..(452): n is either a, c, g or t
  misc_feature (475)..(475): n is either a, c, g or t
  misc_feature (498)..(498): n is either a, c, g or t
  misc_feature (572)..(572): n is either a, c, g or t
  misc_feature (608)..(608): n is either a, c, g or t
  misc_feature (819)..(819): n is either a, c, g or t
  misc_feature (821)..(821): n is either a, c, g or t
  misc_feature (848)..(848): n is either a, c, g or t
  misc_feature (850)..(850): n is either a, c, g or t
attttttaaaaagtgggtggggagggtgaagggaggatatttttttttcgtttttagcgttagagttcggggtgggggcgggcgaggcgcgcggggaggagagggcggaggagaggacggggggcgaggtttgttttaagaatggggcgtngtggttnggcgtacggcgtgttattagcggtttcggagcgagcggtcgtggttgagaaggggagggcggaaagtttgttttttcgacgttagcgtcgggcgggtcgcgagcgtagtgatggcggcgggagttagggtagagcgcggggcggtcggggttttcgtttcgattcgcgttcgcgattttttttgggattcgagttcgagatttttttcggttttttcggttttcgtcgggttattggatagtcgcggtcgtcgtttttttttttggataagtcggcgttgggttcggggtcgtncgtcgtttttattcgcgttgggngttcggcgattgcgtttaggtgnattaatgaatttttcggtgagttattttttggatttggaagaggtggcggcggcgggcggttggcggcgcgttncggggttagggtcgaggcgcgggagggttatacggngagtcgttcgggggtagtagcggtagatggcggcgcgtaggtatggtgagtacggtcggttagggacggggtgtggtttggttggggcgagggtcgtggtcggaggttcggggttcgtggattcgttgcgtgtcggtttatagatttagggcgcgttttcggtggtaggatttttgggggcgcgtgtaagtgacggtggacggcggttgantntagtattttgggttggtggagggtgantntttttcgggttttggggtgcgtttttacgggaaagtg

SEQ ID NO: 4884 - DNA, 887 bp, Artificial Sequence
  chemically treated genomic DNA (Homo sapiens) CpG-island No: 4884
  misc_feature (38)..(38): n is either a, c, g or t
  misc_feature (40)..(40): n is either a, c, g or t
  misc_feature (67)..(67): n is either a, c, g or t
  misc_feature (69)..(69): n is either a, c, g or t
  misc_feature (280)..(280): n is either a, c, g or t
  misc_feature (316)..(316): n is either a, c, g or t
  misc_feature (390)..(390): n is either a, c, g or t
  misc_feature (413)..(413): n is either a, c, g or t
  misc_feature (436)..(436): n is either a, c, g or t
  misc_feature (730)..(730): n is either a, c, g or t
  misc_feature (737)..(737): n is either a, c, g or t
cactttcccgtaaaaacgcaccccaaaacccgaaaaanantcaccctccaccaacccaaaatactanantcaaccgccgtccaccgtcacttacacgcgcccccaaaaatcctaccaccgaaaacgcgccctaaatctataaaccgacacgcaacgaatccacgaaccccgaacctccgaccacgaccctcgccccaaccaaaccacaccccgtccctaaccgaccgtactcaccatacctacgcgccgccatctaccgctactacccccgaacgactcnccgtataaccctcccgcgcctcgaccctaaccccgnaacgcgccgccaaccgcccgccgccgccacctcttccaaatccaaaaaataactcaccgaaaaattcattaatncacctaaacgcaatcgccgaacncccaacgcgaataaaaacgacgnacgaccccgaacccaacgccgacttatccaaaaaaaaaaacgacgaccgcgactatccaataacccgacgaaaaccgaaaaaaccgaaaaaaatctcgaactcgaatcccaaaaaaaatcgcgaacgcgaatcgaaacgaaaaccccgaccgccccgcgctctaccctaactcccgccgccatcactacgctcgcgacccgcccgacgctaacgtcgaaaaaacaaactttccgccctccccttctcaaccacgaccgctcgctccgaaaccgctaataacacgccgtacgccnaaccacnacgccccattcttaaaacaaacctcgccccccgtcctctcctccgccctctcctccccgcgcgcctcgcccgcccccaccccgaactctaacgctaaaaacgaaaaaaaaatatcctcccttcaccctccccacccactttttaaaaaat

SEQ ID NO: 4885 - DNA, 1084 bp, Artificial Sequence
  chemically treated genomic DNA (Homo sapiens) CpG-island No: 4885
gtcgcgcggttttgtttttttatttagtcgatgattcgggtttcgagcgtttggtgggcgttttggcgtcggttttgtgttagttgtcgttgcgcgtggtcgtagatttgtggagtcgtcgtgaattgagcgcgtaggggttcgtggtttggttttacgcgtagcggcgttagattttgtaggagggcggcgtggtggttttgtttttttttttcggtgcggtggcgttgtgtagcgagtggttataggatggggtgttcgggttcggggcgtacggttcgtacgacgtttttcgcgtttcgtttagttgcgtgttgttcgattttttgtagggtcgggcgttcggtagttacgtgggggtttgtttcgataggttgttttattcggacgtcgtattcgttttttttcgtatcgtgttcgtttttatattgtttttttaattgttagattttttgggggttttgtagtagtttcgcgtttcgcgtttcgggcggttttaagagagagcggagtaagtgtttcgggttttttagttagttttggatagttatttttatttttcggggattttcgcgtcgggacgcggggtgggattaggggcgggatttggggcgggggacgggatttaaataaaggtagacgttgtttttttatttatgtggtttatacgcgttttcgttttagtggcggggttggtaaacgtcgttttttagtttcgcggttttttaaagttcggataggtgtagttcggtgtcgtttttggttggttggcgtggggtgacgtaatggtatatggttcgtcgttattggttgggcggtaagtttcgttttttggattgcggcgcgggtgggggttgtgcgttttacgtaggttgtggtagcgacgcggtgaggagacggtttacggcgttcgcgggttggggcggtcgtttttttttttttcgtggtttacgagggtttggatttttttttgtcggttcgtgggtcgtgtttttgtttttttgcgaggttttgaatttgattttttttttttatattcggattcgggtttttttttttaagttcggggtttcggatatttttt

SEQ ID NO: 4886 - DNA, 1084 bp, Artificial Sequence
  chemically treated genomic DNA (Homo sapiens) CpG-island No: 4886
aaaaaatatccgaaaccccgaacttaaaaaaaaaaacccgaatccgaatataaaaaaaaaaaatcaaattcaaaacctcgcaaaaaaacaaaaacacgacccacgaaccgacaaaaaaaaatccaaaccctcgtaaaccacgaaaaaaaaaaaaacgaccgccccaacccgcgaacgccgtaaaccgtctcctcaccgcgtcgctaccacaacctacgtaaaacgcacaacccccacccgcgccgcaatccaaaaaacgaaacttaccgcccaaccaataacgacgaaccatataccattacgtcaccccacgccaaccaaccaaaaacgacaccgaactacacctatccgaactttaaaaaaccgcgaaactaaaaaacgacgtttaccaaccccgccactaaaacgaaaacgcgtataaaccacataaataaaaaaacaacgtctacctttatttaaatcccgtcccccgccccaaatcccgcccctaatcccaccccgcgtcccgacgcgaaaatccccgaaaaataaaaataactatccaaaactaactaaaaaacccgaaacacttactccgctctctcttaaaaccgcccgaaacgcgaaacgcgaaactactacaaaacccccaaaaaatctaacaattaaaaaaacaatataaaaacgaacacgatacgaaaaaaaacgaatacgacgtccgaataaaacaacctatcgaaacaaacccccacgtaactaccgaacgcccgaccctacaaaaaatcgaacaacacgcaactaaacgaaacgcgaaaaacgtcgtacgaaccgtacgccccgaacccgaacaccccatcctataaccactcgctacacaacgccaccgcaccgaaaaaaaaaaacaaaaccaccacgccgccctcctacaaaatctaacgccgctacgcgtaaaaccaaaccacgaacccctacgcgctcaattcacgacgactccacaaatctacgaccacgcgcaacgacaactaacacaaaaccgacgccaaaacgcccaccaaacgctcgaaacccgaatcatcgactaaataaaaaaacaaaaccgcgcgac

SEQ ID NO: 4887 - DNA, 1084 bp, Artificial Sequence
  chemically treated genomic DNA (Homo sapiens) CpG-island No: 4887
gggaggtgttcggaatttcgggtttggagggaggagttcggattcggatatgaagggaagggattagatttagggtttcgtagaagggtaaaggtacggtttacgagtcggtagagaaggatttagattttcgtaggttacggagaaggaagaagcgatcgttttagttcgcgggcgtcgtgggtcgtttttttatcgcgtcgttgttatagtttgcgtaaaacgtataatttttattcgcgtcgtagtttagggggcggagtttgtcgtttagttaatggcgacgggttatgtgttattacgttattttacgttagttaattagaggcggtatcgagttgtatttgttcgggttttaaagggtcgcggggttagggaacgacgtttgttagtttcgttattgaaacggagacgcgtgtgggttatatgggtagaaaaatagcgtttgtttttatttaagtttcgtttttcgttttaggtttcgtttttggttttatttcgcgtttcggcgcgggagttttcgggggatggaagtagttatttagggttggttgaagggttcgggatatttgtttcgtttttttttggagtcgttcggaacgcggggcgcgaggttgttgtagggtttttaggaagtttggtagttgggagggtagtgtgaagacgggtacggtgcggaaaagggcgggtacggcgttcgggtggagtagtttgtcgaagtaggtttttacgtagttgtcgggcgttcggttttgtaagaagtcgggtagtacgtagttgagcgaggcgcggaaggcgtcgtgcgggtcgtgcgtttcgggttcggatattttattttgtagttattcgttgtatagcgttatcgtatcgggagagaagagtaagattattacgtcgtttttttgtagggtttggcgtcgttgcgcgtgaaattaagttacgggtttttgcgcgtttagtttacgacggttttataggtttacggttacgcgtagcggtagttggtatagggtcgacgttagggcgtttattaggcgttcgaaattcgagttatcggttgagtagaggagtagagtcgcgcggt

SEQ ID NO: 4888 - DNA, 1084 bp, Artificial Sequence
  chemically treated genomic DNA (Homo sapiens) CpG-island No: 4888
accgcgcgactctactcctctactcaaccgataactcgaatttcgaacgcctaataaacgccctaacgtcgaccctataccaactaccgctacgcgtaaccgtaaacctataaaaccgtcgtaaactaaacgcgcaaaaacccgtaacttaatttcacgcgcaacgacgccaaaccctacaaaaaaacgacgtaataatcttactcttctctcccgatacgataacgctatacaacgaataactacaaaataaaatatccgaacccgaaacgcacgacccgcacgacgccttccgcgcctcgctcaactacgtactacccgacttcttacaaaaccgaacgcccgacaactacgtaaaaacctacttcgacaaactactccacccgaacgccgtacccgcccttttccgcaccgtacccgtcttcacactaccctcccaactaccaaacttcctaaaaaccctacaacaacctcgcgccccgcgttccgaacgactccaaaaaaaaacgaaacaaatatcccgaacccttcaaccaaccctaaataactacttccatcccccgaaaactcccgcgccgaaacgcgaaataaaaccaaaaacgaaacctaaaacgaaaaacgaaacttaaataaaaacaaacgctatttttctacccatataacccacacgcgtctccgtttcaataacgaaactaacaaacgtcgttccctaaccccgcgaccctttaaaacccgaacaaatacaactcgataccgcctctaattaactaacgtaaaataacgtaataacacataacccgtcgccattaactaaacgacaaactccgccccctaaactacgacgcgaataaaaattatacgttttacgcaaactataacaacgacgcgataaaaaaacgacccacgacgcccgcgaactaaaacgatcgcttcttccttctccgtaacctacgaaaatctaaatccttctctaccgactcgtaaaccgtacctttacccttctacgaaaccctaaatctaatcccttcccttcatatccgaatccgaactcctccctccaaacccgaaattccgaacacctccc

SEQ ID NO: 4889 - DNA, 751 bp, Artificial Sequence
  chemically treated genomic DNA (Homo sapiens) CpG-island No: 4889
gcggcggattcggaggcgtagcggcgtttggtgggagcgttggttgaattgttacgggtagcgttgggcggcgggcgcgacgtgatcgtggatttgtgggaggggaggtacgtggcgcgcgtgggttcgttgtcgtggttttgggcggcgcggacgcgcgtagcgcgggagtagggtattgtgttgttgttgtggagcggcgtcgattttcgttcggttagcggtttcgattttcgcgtcgcgtttttgttcgttttgttttacgttgtttcgcgttcgttgttgttgttcgtttattttagtcgtttttgcgttaagggcgatattttttcgtcgttgcgcgttttgtcgcgttatcgtttgttgcgcgatttgtcgcgtttgttgcgggcgttggacgcgcggtttttcgtagaggttattagttggggtcgttttggggcgcggtagcgtaggtagagtcgtttagagttgtgtagtcggtttgaacgagaggtcgttcgatttgtagatttaggttgagtagagttttatcgtagtttcgggtgtttgcggtcgtaacgtaacggatattggttggaatttcggaatgagttttcgattttgaaatttttggggtgtttcgaggacgattggtcgaaaagtcgtattttttgttttataggtcggaagttttagtttagttttcgcgcgcgtttttttttttttttatatttttttttgattgagagtttttttaatttttgttttg

SEQ ID NO: 4890 - DNA, 751 bp, Artificial Sequence
  chemically treated genomic DNA (Homo sapiens) CpG-island No: 4890
caaaacaaaaattaaaaaaactctcaatcaaaaaaaaatataaaaaaaaaaaaaaacgcgcgcgaaaactaaactaaaacttccgacctataaaacaaaaaatacgacttttcgaccaatcgtcctcgaaacaccccaaaaatttcaaaatcgaaaactcattccgaaattccaaccaatatccgttacgttacgaccgcaaacacccgaaactacgataaaactctactcaacctaaatctacaaatcgaacgacctctcgttcaaaccgactacacaactctaaacgactctacctacgctaccgcgccccaaaacgaccccaactaataacctctacgaaaaaccgcgcgtccaacgcccgcaacaaacgcgacaaatcgcgcaacaaacgataacgcgacaaaacgcgcaacgacgaaaaaatatcgcccttaacgcaaaaacgactaaaataaacgaacaacaacaacgaacgcgaaacaacgtaaaacaaaacgaacaaaaacgcgacgcgaaaatcgaaaccgctaaccgaacgaaaatcgacgccgctccacaacaacaacacaataccctactcccgcgctacgcgcgtccgcgccgcccaaaaccacgacaacgaacccacgcgcgccacgtacctcccctcccacaaatccacgatcacgtcgcgcccgccgcccaacgctacccgtaacaattcaaccaacgctcccaccaaacgccgctacgcctccgaatccgccgc

SEQ ID NO: 4891 - DNA, 751 bp, Artificial Sequence
  chemically treated genomic DNA (Homo sapiens) CpG-island No: 4891
tagaataggggttagaggagtttttagttaagggaaagtatgaggaggaagagggacgcgcgcggggattgggttgggattttcggtttgtgaggtagggaatgcggtttttcggttagtcgttttcgaggtattttaaggattttagggtcgaaggtttatttcggggttttagttagtgttcgttgcgttgcggtcgtagatattcgggattgcggtggagttttgtttaatttaggtttgtaagtcgggcggtttttcgtttaagtcggttgtatagttttaggcggttttgtttgcgttgtcgcgttttaaggcggttttagttggtggtttttgcgaaaggtcgcgcgtttagcgttcgtagtagacgcggtaggtcgcgtagtaggcggtagcgcggtagggcgcgtagcggcggggggatgtcgtttttggcgtagaggcgattgaagtaagcgagtagtagtagcgggcgcggggtagcgtggagtagggcgagtaggggcgcggcgcgggggtcggggtcgttgatcgggcgaaggtcggcgtcgttttatagtagtagtatagtgttttgttttcgcgttacgcgcgttcgcgtcgtttagagttacggtagcgggtttacgcgcgttacgtgtttttttttttataggtttacgattacgtcgcgttcgtcgtttagcgttgttcgtagtagtttagttagcgtttttattaggcgtcgttgcgttttcgagttcgtcgt

SEQ ID NO: 4892 - DNA, 751 bp, Artificial Sequence
  chemically treated genomic DNA (Homo sapiens) CpG-island No: 4892
acgacgaactcgaaaacgcaacgacgcctaataaaaacgctaactaaactactacgaacaacgctaaacgacgaacgcgacgtaatcgtaaacctataaaaaaaaaaacacgtaacgcgcgtaaacccgctaccgtaactctaaacgacgcgaacgcgcgtaacgcgaaaacaaaacactatactactactataaaacgacgccgaccttcgcccgatcaacgaccccgacccccgcgccgcgcccctactcgccctactccacgctaccccgcgcccgctactactactcgcttacttcaatcgcctctacgccaaaaacgacatccccccgccgctacgcgccctaccgcgctaccgcctactacgcgacctaccgcgtctactacgaacgctaaacgcgcgacctttcgcaaaaaccaccaactaaaaccgccttaaaacgcgacaacgcaaacaaaaccgcctaaaactatacaaccgacttaaacgaaaaaccgcccgacttacaaacctaaattaaacaaaactccaccgcaatcccgaatatctacgaccgcaacgcaacgaacactaactaaaaccccgaaataaaccttcgaccctaaaatccttaaaatacctcgaaaacgactaaccgaaaaaccgcattccctacctcacaaaccgaaaatcccaacccaatccccgcgcgcgtccctcttcctcctcatactttcccttaactaaaaactcctctaacccctattcta

SEQ ID NO: 4893 - DNA, 677 bp, Artificial Sequence
  chemically treated genomic DNA (Homo sapiens) CpG-island No: 4893
cggacgcgagtttaggtcggttattagaaagacgtttcgagttcgggggttaggtttagagttgcggaggtcgtttagttcgatttgatttaggtttcgttcgcgcgttcgcggtcgttttttgttgggggtcggaggagcgggtatcgagagatttttagttttgttcgcggttttcgtttcggtttattattgaggtttacggaggcgattaaaggtcggcgtacggtttggtcgtttagcgattttcggttgaggaagggtcgttttaggtttaatataggttgtttcggggtggcgggtatcgtggtttgtattaagggtcgtagcgcgttcgttatttcgcgggacgtggtcgataggacgggcgcgaacgggtttgagcgggatgttatcgataatatggcgatagtcgttttaatcgttaagtcggttatagggacgattttttaattacggcgtaggcgcgaggaggcgcgggacgcgtgacgatagcgcgtcgtcggaaaggaaattttgtagttttgtagggcggggtaaatttggagaggcgttgcgtcgggggacggggttataagtcgtcgttgggggcggggtttgcggtttatttgtaggtttcggtgttatttcgttagtgtttcgagagatttttagaagaacgagagggttgaataggg

SEQ ID NO: 4894 - DNA, 677 bp, Artificial Sequence
  chemically treated genomic DNA (Homo sapiens) CpG-island No: 4894
ccctattcaaccctctcgttcttctaaaaatctctcgaaacactaacgaaataacaccgaaacctacaaataaaccgcaaaccccgcccccaacgacgacttataaccccgtcccccgacgcaacgcctctccaaatttaccccgccctacaaaactacaaaatttcctttccgacgacgcgctatcgtcacgcgtcccgcgcctcctcgcgcctacgccgtaattaaaaaatcgtccctataaccgacttaacgattaaaacgactatcgccatattatcgataacatcccgctcaaacccgttcgcgcccgtcctatcgaccacgtcccgcgaaataacgaacgcgctacgacccttaatacaaaccacgatacccgccaccccgaaacaacctatattaaacctaaaacgacccttcctcaaccgaaaatcgctaaacgaccaaaccgtacgccgacctttaatcgcctccgtaaacctcaataataaaccgaaacgaaaaccgcgaacaaaactaaaaatctctcgatacccgctcctccgacccccaacaaaaaacgaccgcgaacgcgcgaacgaaacctaaatcaaatcgaactaaacgacctccgcaactctaaacctaacccccgaactcgaaacgtctttctaataaccgacctaaactcgcgtccg

SEQ ID NO: 4895 - DNA, 677 bp, Artificial Sequence
  chemically treated genomic DNA (Homo sapiens) CpG-island No: 4895
ttttgtttagttttttcgtttttttggggatttttcgggatattgacgaggtggtatcgggatttataggtgggtcgtaagtttcgtttttagcgacggtttgtagtttcgtttttcgacgtagcgtttttttaagtttgtttcgttttgtaggattgtagaatttttttttcggcggcgcgttgtcgttacgcgtttcgcgttttttcgcgtttgcgtcgtggttggaaggtcgtttttgtgatcggtttggcggttggagcggttgtcgttatgttgtcggtagtatttcgtttaggttcgttcgcgttcgttttgtcggttacgtttcgcggggtggcgggcgcgttgcggtttttggtgtaggttacggtgttcgttatttcggagtagtttgtgttggatttgaagcggtttttttttagtcgggagtcgttgagcggttaggtcgtgcgtcggtttttggtcgttttcgtgggttttaatggtgagtcggggcgagggtcgcgagtagggttgggggtttttcggtgttcgttttttcggtttttagtagggagcggtcgcgggcgcgcgagcggagtttgaattaggtcgggttgggcggttttcgtaattttgggtttggttttcgggttcggggcgtttttttggtggtcggtttggattcgcgttcg

SEQ ID NO: 4896 - DNA, 677 bp, Artificial Sequence
  chemically treated genomic DNA (Homo sapiens) CpG-island No: 4896
cgaacgcgaatccaaaccgaccaccaaaaaaacgccccgaacccgaaaaccaaacccaaaattacgaaaaccgcccaacccgacctaattcaaactccgctcgcgcgcccgcgaccgctccctactaaaaaccgaaaaaacgaacaccgaaaaacccccaaccctactcgcgaccctcgccccgactcaccattaaaacccacgaaaacgaccaaaaaccgacgcacgacctaaccgctcaacgactcccgactaaaaaaaaaccgcttcaaatccaacacaaactactccgaaataacgaacaccgtaacctacaccaaaaaccgcaacgcgcccgccaccccgcgaaacgtaaccgacaaaacgaacgcgaacgaacctaaacgaaatactaccgacaacataacgacaaccgctccaaccgccaaaccgatcacaaaaacgaccttccaaccacgacgcaaacgcgaaaaaacgcgaaacgcgtaacgacaacgcgccgccgaaaaaaaaattctacaatcctacaaaacgaaacaaacttaaaaaaacgctacgtcgaaaaacgaaactacaaaccgtcgctaaaaacgaaacttacgacccacctataaatcccgataccacctcgtcaatatcccgaaaaatccccaaaaaaacgaaaaaactaaacaaaa

SEQ ID NO: 4897 - DNA, 558 bp, Artificial Sequence
  chemically treated genomic DNA (Homo sapiens) CpG-island No: 4897
ataagtacgttttattcgcgtcggaagagaaacgttgcggtttttttacggttttttcggtttgttttagggtggatttagtagattcgttcgtggagtttttaggagtggagtttcgggcgtttttatatttttcgatacgtcggattcggtttagtcgcgttaagtcgtaaagggttcgaaggtcggggcgtatcgttgtcgttagggttatggagggcgcgttcgtagttaattggagcgtcgaggtagttaacgttagcgtcgcgtcgtcgggggtcgagggtaatcgtatcgtcggattttcgcggcgtaacgaggttttggcgcgcgtggaggtggcggtgttgtgttttattttgtttttggcgttgagcgggaatgcgtgtgtgttgttggcgttgcgtattatacgttagaagtattcgcgtttttttttttttatgaagtatttaagtatcgtcgatttggtggtggtagtgttttaggtgttgtcgtagttgttgtgggatattatttttcgtttttacgggttcgatttgttgtgtcgtttggtta

SEQ ID NO: 4898 - DNA, 558 bp, Artificial Sequence
  chemically treated genomic DNA (Homo sapiens) CpG-island No: 4898
taaccaaacgacacaacaaatcgaacccgtaaaaacgaaaaataatatcccacaacaactacgacaacacctaaaacactaccaccaccaaatcgacgatacttaaatacttcataaaaaaaaaaaaacgcgaatacttctaacgtataatacgcaacgccaacaacacacacgcattcccgctcaacgccaaaaacaaaataaaacacaacaccgccacctccacgcgcgccaaaacctcgttacgccgcgaaaatccgacgatacgattaccctcgacccccgacgacgcgacgctaacgttaactacctcgacgctccaattaactacgaacgcgccctccataaccctaacgacaacgatacgccccgaccttcgaaccctttacgacttaacgcgactaaaccgaatccgacgtatcgaaaaatataaaaacgcccgaaactccactcctaaaaactccacgaacgaatctactaaatccaccctaaaacaaaccgaaaaaaccgtaaaaaaaccgcaacgtttctcttccgacgcgaataaaacgtacttat

SEQ ID NO: 4899 - DNA, 558 bp, Artificial Sequence
  chemically treated genomic DNA (Homo sapiens) CpG-island No: 4899
tgattaggcggtatagtaggtcgggttcgtagaagcggaaggtgatgttttatagtaattgcggtagtatttgaaatattgttattattaggtcggcgatgtttaggtgttttatgaagaagaagaggcgcgagtgtttttggcgtgtggtgcgtagcgttagtagtatatacgtattttcgtttagcgttaggagtaggatgagatatagtatcgttatttttacgcgcgttagggtttcgttgcgtcgcgggggttcggcggtgcggttgttttcggttttcggcggcgcggcgttggcgttggttgtttcggcgttttagttggttgcgagcgcgttttttatgattttggcggtagcggtgcgtttcggttttcgagttttttacggtttggcgcggttgggtcggattcggcgtgtcggagggtgtaggggcgttcggggttttatttttggagattttacggacggatttgttgagtttattttgaaataaatcgggagggtcgtgaggagatcgtagcgtttttttttcgacgcgggtagggcgtgtttgt

SEQ ID NO: 4900 - DNA, 558 bp, Artificial Sequence
  chemically treated genomic DNA (Homo sapiens) CpG-island No: 4900
acaaacacgccctacccgcgtcgaaaaaaaaacgctacgatctcctcacgaccctcccgatttatttcaaaataaactcaacaaatccgtccgtaaaatctccaaaaataaaaccccgaacgcccctacaccctccgacacgccgaatccgacccaaccgcgccaaaccgtaaaaaactcgaaaaccgaaacgcaccgctaccgccaaaatcataaaaaacgcgctcgcaaccaactaaaacgccgaaacaaccaacgccaacgccgcgccgccgaaaaccgaaaacaaccgcaccgccgaacccccgcgacgcaacgaaaccctaacgcgcgtaaaaataacgatactatatctcatcctactcctaacgctaaacgaaaatacgtatatactactaacgctacgcaccacacgccaaaaacactcgcgcctcttcttcttcataaaacacctaaacatcgccgacctaataataacaatatttcaaatactaccgcaattactataaaacatcaccttccgcttctacgaacccgacctactataccgcctaatca

SEQ ID NO: 4901 - DNA, 506 bp, Artificial Sequence
  chemically treated genomic DNA (Homo sapiens) CpG-island No: 4901
cgtcgtcgtatcgatcgtttggtagtgttcgttacgtggttcggttgtttggtggttagcgcgtcgtaggtgtatattttttttttgcgcgaggtggttgacggcgttttcgattgttgggtcgtttttatttagttttggggatttaaggtttatattatatggattacgttagttgtttatatcgtgtcggttatcgtgttcgttgtttgttacggttttattagttttaagatttggtagaatttgcggtttaagatcgttgtagcggcggcggtcgaggcgttagagggcgcggcggttggcgatggggggcgcgtggttttggcgcgtgttagtagcgttaagtttatttttaaggttaagattcgtacggttaagatgatttttattatcgtgttggtttttatcgtgtgttggacgtttttttttttcgtgtagatgtggagcgtttgggatgttaacgcgtttaaggaaggtagttagggttgggagatttaggagga

SEQ ID NO: 4902 - DNA, 506 bp, Artificial Sequence
  chemically treated genomic DNA (Homo sapiens) CpG-island No: 4902
tcctcctaaatctcccaaccctaactaccttccttaaacgcgttaacatcccaaacgctccacatctacacgaaaaaaaaaaacgtccaacacacgataaaaaccaacacgataataaaaatcatcttaaccgtacgaatcttaaccttaaaaataaacttaacgctactaacacgcgccaaaaccacgcgccccccatcgccaaccgccgcgccctctaacgcctcgaccgccgccgctacaacgatcttaaaccgcaaattctaccaaatcttaaaactaataaaaccgtaacaaacaacgaacacgataaccgacacgatataaacaactaacgtaatccatataatataaaccttaaatccccaaaactaaataaaaacgacccaacaatcgaaaacgccgtcaaccacctcgcgcaaaaaaaaaatatacacctacgacgcgctaaccaccaaacaaccgaaccacgtaacgaacactaccaaacgatcgatacgacgacg

SEQ ID NO: 4903 - DNA, 506 bp, Artificial Sequence
  chemically treated genomic DNA (Homo sapiens) CpG-island No: 4903
tttttttgggttttttagttttggttattttttttgggcgcgttggtattttagacgttttatatttgtacgaagaagaaaggcgtttagtatacgatgaaggttagtacgatgatgaaagttattttgatcgtgcggattttggttttggagatgagtttgacgttgttgatacgcgttagggttacgcgttttttatcgttagtcgtcgcgttttttggcgtttcggtcgtcgtcgttgtagcggttttgagtcgtaaattttgttagattttgaagttgataaggtcgtagtaggtagcgagtacgatgatcggtacgatgtagatagttagcgtgatttatgtgatgtaggttttgggtttttagggttggatgaagacggtttagtagtcgaagacgtcgttagttatttcgcgtagagagaagatgtgtatttgcggcgcgttggttattaggtagtcgagttacgtggcgagtattgttaggcggtcggtgcggcggcg

SEQ ID NO: 4904 - DNA, 506 bp, Artificial Sequence
  chemically treated genomic DNA (Homo sapiens) CpG-island No: 4904
cgccgccgcaccgaccgcctaacaatactcgccacgtaactcgactacctaataaccaacgcgccgcaaatacacatcttctctctacgcgaaataactaacgacgtcttcgactactaaaccgtcttcatccaaccctaaaaacccaaaacctacatcacataaatcacgctaactatctacatcgtaccgatcatcgtactcgctacctactacgaccttatcaacttcaaaatctaacaaaatttacgactcaaaaccgctacaacgacgacgaccgaaacgccaaaaaacgcgacgactaacgataaaaaacgcgtaaccctaacgcgtatcaacaacgtcaaactcatctccaaaaccaaaatccgcacgatcaaaataactttcatcatcgtactaaccttcatcgtatactaaacgcctttcttcttcgtacaaatataaaacgtctaaaataccaacgcgcccaaaaaaaataaccaaaactaaaaaacccaaaaaaa

SEQ ID NO: 4905 - DNA, 1179 bp, Artificial Sequence
  chemically treated genomic DNA (Homo sapiens) CpG-island No: 4905
ggcgttagtatcgacgtttgtttttcgcggttataattcgttgcgcgagttcggggattcgtcgtcggaggttacgaagtcgtcgggtagggtcgtagcgttagcgaggatttaggatcgtttcgagttcggacgtagttagataaatgttcgtcggaggcgtagggtagaagtttttgggatttagtcgtttttatttcggcgttacgtattagtttcgttcgggtttagaagtcggcgttaaggagatttttaagtttcgatattaaaggtttcgtaaagataacggtagtagggggtcgaggggagttcggttaaggcgttttgcgtagggggtggaattgttttcgggatgggggaggggaacgttatttcgttatataacgaaggtagagttttcgtataaagggagtttcggtttttttcgttttttttcgttagaagatgcgttcgtacgttcgcgttttttggagtagtttagcgttcgatttattcgttttttttttatatttattagttagtttttcgaggttttttcggtcggtttacgtagaggcggcggcggtcgagagcgtaggcggaggggtcgcgcggtttttttcgcggacgtacggcggcgggtagcgttgtttcggttttagcgttttcggacgttgtgttgggtcgattttttttttttttcgcgcgttttacgttttgagcgttaggtttttggtttaggtttcgcggtcgtattgttttggtcgttacgtttcgcgtttgcgtcgcgtattttaggggttcgtcgagagggcggggaggtgacgaggtgaggtgggggtagggagcgggttgcgcgaacgtatcgtatacgcggtttgggagggattatcggttcgtagtttcgggggaggtttagcggttcgcgttttttgtcggaggttttgcgtcgtcgtagtttttttttgggcggggaagagtttttttcgagtttcgagggcgattttattttttaggattattttacgttaggcggttagcgaatttatttcgttcgtttttatcgtttttttaagttttggggaattgggagaaacgtggcgcgtagcggtattttttttacgttgttttttaagggaaaggacgcgagtggttttgtttaggttaggtaaggtagatggtattttagatttcgaagtg

SEQ ID NO: 4906 - DNA, 1179 bp, Artificial Sequence
  chemically treated genomic DNA (Homo sapiens) CpG-island No: 4906
cacttcgaaatctaaaataccatctaccttacctaacctaaacaaaaccactcgcgtcctttcccttaaaaaacaacgtaaaaaaaataccgctacgcgccacgtttctcccaattccccaaaacttaaaaaaacgataaaaacgaacgaaataaattcgctaaccgcctaacgtaaaataatcctaaaaaataaaatcgccctcgaaactcgaaaaaaactcttccccgcccaaaaaaaaactacgacgacgcaaaacctccgacaaaaaacgcgaaccgctaaacctcccccgaaactacgaaccgataatccctcccaaaccgcgtatacgatacgttcgcgcaacccgctccctacccccacctcacctcgtcacctccccgccctctcgacgaacccctaaaatacgcgacgcaaacgcgaaacgtaacgaccaaaacaatacgaccgcgaaacctaaaccaaaaacctaacgctcaaaacgtaaaacgcgcgaaaaaaaaaaaaaatcgacccaacacaacgtccgaaaacgctaaaaccgaaacaacgctacccgccgccgtacgtccgcgaaaaaaaccgcgcgacccctccgcctacgctctcgaccgccgccgcctctacgtaaaccgaccgaaaaaacctcgaaaaactaactaataaatataaaaaaaaaacgaataaatcgaacgctaaactactccaaaaaacgcgaacgtacgaacgcatcttctaacgaaaaaaaacgaaaaaaaccgaaactccctttatacgaaaactctaccttcgttatataacgaaataacgttcccctcccccatcccgaaaacaattccaccccctacgcaaaacgccttaaccgaactcccctcgaccccctactaccgttatctttacgaaacctttaatatcgaaacttaaaaatctccttaacgccgacttctaaacccgaacgaaactaatacgtaacgccgaaataaaaacgactaaatcccaaaaacttctaccctacgcctccgacgaacatttatctaactacgtccgaactcgaaacgatcctaaatcctcgctaacgctacgaccctacccgacgacttcgtaacctccgacgacgaatccccgaactcgcgcaacgaattataaccgcgaaaaacaaacgtcgatactaacgcc

SEQ ID NO: 4907 - DNA, 1179 bp, Artificial Sequence
  chemically treated genomic DNA (Homo sapiens) CpG-island No: 4907
tatttcggggtttgagatgttatttgttttgtttaatttgggtaagattattcgcgtttttttttttgaggagtagcgtgggaaaggtgtcgttgcgcgttacgttttttttagttttttagggtttgaaggggcggtggaggcgggcgggataaattcgttggtcgtttggcgtggagtaattttagagggtgggatcgttttcggggttcgggaggggttttttttcgtttagaaggagattgcggcggcgtaaggttttcggtagggggcgcgggtcgttgggtttttttcggggttgcgggtcggtggttttttttaggtcgcgtgtgcggtgcgttcgcgtagttcgttttttgtttttattttatttcgttattttttcgttttttcggcgggtttttgaggtgcgcggcgtaggcgcggagcgtggcggttagggtagtgcggtcgcggagtttaggttaggggtttggcgtttagggcgtggggcgcgcggggagggagaggggtcggtttagtatagcgttcgggagcgttagggtcggagtagcgttgttcgtcgtcgtgcgttcgcgggaaggatcgcgcggttttttcgtttgcgttttcggtcgtcgtcgtttttgcgtgggtcggtcgggagggtttcgggggattgattggtgagtgtgagggaggagcgggtgggtcgggcgttggattgttttaggggacgcgggcgtgcgggcgtattttttaacgggagagggcgggagagatcggagttttttttatacggaaattttgttttcgttatatggcgggatggcgttttttttttttatttcgaaggtagttttattttttgcgtaggacgttttggtcgggtttttttcggttttttgttgtcgttgtttttacggaatttttggtgtcggggtttggaagtttttttggcgtcggtttttgggttcgggcgaagttggtgcgtggcgtcggggtggaggcggttaagttttagggatttttgttttgcgttttcgacgggtatttgtttggttgcgttcgggttcgggacgattttgggttttcgttggcgttgcggttttgttcggcggtttcgtgattttcggcggcgaattttcgggttcgcgtaacgagttgtagtcgcggagagtaggcgtcgatgttggcgtt

SEQ ID NO: 4908 - DNA, 1179 bp, Artificial Sequence
  chemically treated genomic DNA (Homo sapiens) CpG-island No: 4908
aacgccaacatcgacgcctactctccgcgactacaactcgttacgcgaacccgaaaattcgccgccgaaaatcacgaaaccgccgaacaaaaccgcaacgccaacgaaaacccaaaatcgtcccgaacccgaacgcaaccaaacaaatacccgtcgaaaacgcaaaacaaaaatccctaaaacttaaccgcctccaccccgacgccacgcaccaacttcgcccgaacccaaaaaccgacgccaaaaaaacttccaaaccccgacaccaaaaattccgtaaaaacaacgacaacaaaaaaccgaaaaaaacccgaccaaaacgtcctacgcaaaaaataaaactaccttcgaaataaaaaaaaaaaacgccatcccgccatataacgaaaacaaaatttccgtataaaaaaaactccgatctctcccgccctctcccgttaaaaaatacgcccgcacgcccgcgtcccctaaaacaatccaacgcccgacccacccgctcctccctcacactcaccaatcaatcccccgaaaccctcccgaccgacccacgcaaaaacgacgacgaccgaaaacgcaaacgaaaaaaccgcgcgatccttcccgcgaacgcacgacgacgaacaacgctactccgaccctaacgctcccgaacgctatactaaaccgacccctctccctccccgcgcgccccacgccctaaacgccaaacccctaacctaaactccgcgaccgcactaccctaaccgccacgctccgcgcctacgccgcgcacctcaaaaacccgccgaaaaaacgaaaaaataacgaaataaaataaaaacaaaaaacgaactacgcgaacgcaccgcacacgcgacctaaaaaaaaccaccgacccgcaaccccgaaaaaaacccaacgacccgcgccccctaccgaaaaccttacgccgccgcaatctccttctaaacgaaaaaaaacccctcccgaaccccgaaaacgatcccaccctctaaaattactccacgccaaacgaccaacgaatttatcccgcccgcctccaccgccccttcaaaccctaaaaaactaaaaaaaacgtaacgcgcaacgacacctttcccacgctactcctcaaaaaaaaaaacgcgaataatcttacccaaattaaacaaaacaaataacatctcaaaccccgaaata

SEQ ID NO: 4909 - DNA, 770 bp, Artificial Sequence
  chemically treated genomic DNA (Homo sapiens) CpG-island No: 4909
ttcggcgtcggcgcgtagtatgtcgggagttgtagttttcgcgaggtaagtttcgtttcgtttttgtttgggggaggaggttggagagtcgttttgtcggtttttgaattttgtcgcgaaaagcgcgcgtggcggttttcggtttcgtttttcgtaggacgcggtgtcgcgttattttggtaatcgttttttagtcgtcgttgattgggttgggtcgcggggggcgggcgggggacgagacgcgggggttgttgtcggcgttcgcgtttgttagtcgggttagagcggagtagcgggtaggattgtttggtcggttgtttcgcggagaggttgcgcgcgtcggtcgggggaggcggatagtcgggttcggcgtttgtggggcgcggcgcgcggtattcgggtttgagattaggcgaggcgtcggcgcgcgttagacggcgcgaggttgcggtttcgggagttttcgcgcgtcgttcggggttatgggcgcgtgagagtttagcgcgcgcggtttttgttgcggtttgcgagttcgtatattcggtgtatagtttttcgggtcgttttcgtgttcgttttgcgttattgggatcggttgttttttagcgtcgaggttttcgaggttgtattcgagtttgcgtcgttcgttgtcgtcgtcgtcgtcgttgtcgtcgtcgttgttcgtcggttttttttttttttatattcggggtttagagtaggaggaggaggggtcggtgtattttcgtcgttgttttttgtaatttgta

SEQ ID NO: 4910 - DNA, 770 bp, Artificial Sequence
  chemically treated genomic DNA (Homo sapiens) CpG-island No: 4910
tacaaattacaaaaaacaacgacgaaaatacaccgacccctcctcctcctactctaaaccccgaatataaaaaaaaaaaaaaccgacgaacaacgacgacgacaacgacgacgacgacgacaacgaacgacgcaaactcgaatacaacctcgaaaacctcgacgctaaaaaacaaccgatcccaataacgcaaaacgaacacgaaaacgacccgaaaaactatacaccgaatatacgaactcgcaaaccgcaacaaaaaccgcgcgcgctaaactctcacgcgcccataaccccgaacgacgcgcgaaaactcccgaaaccgcaacctcgcgccgtctaacgcgcgccgacgcctcgcctaatctcaaacccgaataccgcgcgccgcgccccacaaacgccgaacccgactatccgcctcccccgaccgacgcgcgcaacctctccgcgaaacaaccgaccaaacaatcctacccgctactccgctctaacccgactaacaaacgcgaacgccgacaacaacccccgcgtctcgtcccccgcccgccccccgcgacccaacccaatcaacgacgactaaaaaacgattaccaaaataacgcgacaccgcgtcctacgaaaaacgaaaccgaaaaccgccacgcgcgcttttcgcgacaaaattcaaaaaccgacaaaacgactctccaacctcctcccccaaacaaaaacgaaacgaaacttacctcgcgaaaactacaactcccgacatactacgcgccgacgccgaa

SEQ ID NO: 4911 - DNA, 770 bp, Artificial Sequence
  chemically treated genomic DNA (Homo sapiens) CpG-island No: 4911
tgtaggttgtaaagaatagcggcgagaatgtatcggttttttttttttttgttttgagtttcgggtgtggggggaggggaagtcggcgaatagcggcggcggtagcggcggcggcggcggtagcgggcgacgtaagttcggatgtagtttcgggggtttcggcgttgagaaatagtcgattttagtggcgtaggacggatacgaggacggttcgggggattgtgtatcgggtgtgcgagttcgtaagtcgtagtaggggtcgcgcgcgttgggtttttacgcgtttatggtttcgggcggcgcgcgggggttttcggggtcgtagtttcgcgtcgtttggcgcgcgtcggcgtttcgtttggttttaggttcgggtgtcgcgcgtcgcgttttataggcgtcgggttcggttgttcgtttttttcggtcggcgcgcgtagttttttcgcggagtagtcggttaggtagttttgttcgttgtttcgttttggttcgattgataggcgcgagcgtcggtagtagttttcgcgtttcgtttttcgttcgtttttcgcggtttagtttaattagcggcggttgagaggcggttattagggtgacgcggtatcgcgttttgcgaggggcggagtcgggggtcgttacgcgcgtttttcgcggtaaaatttaaaggtcggtagggcggttttttaatttttttttttaagtagggacgaggcggaatttgtttcgcgaggattgtaattttcggtatgttgcgcgtcggcgtcggg

SEQ ID NO: 4912 - DNA, 770 bp, Artificial Sequence
  chemically treated genomic DNA (Homo sapiens) CpG-island No: 4912
cccgacgccgacgcgcaacataccgaaaattacaatcctcgcgaaacaaattccgcctcgtccctacttaaaaaaaaaaattaaaaaaccgccctaccgacctttaaattttaccgcgaaaaacgcgcgtaacgacccccgactccgcccctcgcaaaacgcgataccgcgtcaccctaataaccgcctctcaaccgccgctaattaaactaaaccgcgaaaaacgaacgaaaaacgaaacgcgaaaactactaccgacgctcgcgcctatcaatcgaaccaaaacgaaacaacgaacaaaactacctaaccgactactccgcgaaaaaactacgcgcgccgaccgaaaaaaacgaacaaccgaacccgacgcctataaaacgcgacgcgcgacacccgaacctaaaaccaaacgaaacgccgacgcgcgccaaacgacgcgaaactacgaccccgaaaacccccgcgcgccgcccgaaaccataaacgcgtaaaaacccaacgcgcgcgacccctactacgacttacgaactcgcacacccgatacacaatcccccgaaccgtcctcgtatccgtcctacgccactaaaatcgactatttctcaacgccgaaacccccgaaactacatccgaacttacgtcgcccgctaccgccgccgccgccgctaccgccgccgctattcgccgacttcccctccccccacacccgaaactcaaaacaaaaaaaaaaaaaaccgatacattctcgccgctattctttacaacctaca

SEQ ID NO: 4913 - DNA, 540 bp, Artificial Sequence
  chemically treated genomic DNA (Homo sapiens) CpG-island No: 4913
gcgcgtggggttgcgggtcgttttttttttttatttcggtttatcgaagaagggcggtaggtgggatatcgtttcgaggaagggttcggtttcgatttgtttgttcgcgggtagcggttttagtaagtgttcggttagtagcgttatttcggggtcgaggttcgcggtgatgttttagtcggcgtcgcgggcgtcgatatcgttttttcggtcgtcgtcgttagcgtcggggtcgttatagtcgttcgtcgtagcgtttaggggacgttagcgtcgttattttcgttcgtacggcgttttcgtagtcgagcgtttagcgtcgttcgtcggtcgagcgtttaaattgtcgggcgcgtcgtttcgttttcgtttatcggtttttaattcgcgttcgtcgtcgaggttttcgcgtttttattggtcggggggtcggtcgggggcgggacgtagaggaggtgcgtcggtttatgggtttcggagggtttaagtgagtcgtttttaggtgagttttttttaggtgtgtttttcgtcgttttcggt

SEQ ID NO: 4914 - DNA, 540 bp, Artificial Sequence
  chemically treated genomic DNA (Homo sapiens) CpG-island No: 4914
accgaaaacgacgaaaaacacacctaaaaaaaactcacctaaaaacgactcacttaaaccctccgaaacccataaaccgacgcacctcctctacgtcccgcccccgaccgaccccccgaccaataaaaacgcgaaaacctcgacgacgaacgcgaattaaaaaccgataaacgaaaacgaaacgacgcgcccgacaatttaaacgctcgaccgacgaacgacgctaaacgctcgactacgaaaacgccgtacgaacgaaaataacgacgctaacgtcccctaaacgctacgacgaacgactataacgaccccgacgctaacgacgacgaccgaaaaaacgatatcgacgcccgcgacgccgactaaaacatcaccgcgaacctcgaccccgaaataacgctactaaccgaacacttactaaaaccgctacccgcgaacaaacaaatcgaaaccgaacccttcctcgaaacgatatcccacctaccgcccttcttcgataaaccgaaataaaaaaaaaaaacgacccgcaaccccacgcgc

SEQ ID NO: 4915 - DNA, 540 bp, Artificial Sequence
  chemically treated genomic DNA (Homo sapiens) CpG-island No: 4915
atcgggggcggcgggaggtatatttggggaagatttatttgggagcggtttatttgggtttttcgggatttatgaatcggcgtattttttttgcgtttcgttttcggtcggtttttcggttaatgggggcgcggagatttcggcggcgggcgcggattgggagtcggtgagcgggggcggggcggcgcgttcggtagtttaggcgttcggtcggcgggcggcgttgagcgttcggttacgagggcgtcgtgcgggcggaagtggcgacgttggcgttttttggacgttgcggcgggcggttgtgacggtttcggcgttgacggcggcggtcgggggggcggtgtcgacgttcgcggcgtcggttggggtattatcgcgggtttcgatttcgaaatggcgttgttggtcgaatatttgttgaagtcgttgttcgcggataagtagatcgagatcgggttttttttcgaggcggtgttttatttgtcgttttttttcggtgagtcggaatggaggggggaggcggttcgtagttttacgcgt

SEQ ID NO: 4916 - DNA, 540 bp, Artificial Sequence
  chemically treated genomic DNA (Homo sapiens) CpG-island No: 4916
acgcgtaaaactacgaaccgcctcccccctccattccgactcaccgaaaaaaaacgacaaataaaacaccgcctcgaaaaaaaacccgatctcgatctacttatccgcgaacaacgacttcaacaaatattcgaccaacaacgccatttcgaaatcgaaacccgcgataataccccaaccgacgccgcgaacgtcgacaccgcccccccgaccgccgccgtcaacgccgaaaccgtcacaaccgcccgccgcaacgtccaaaaaacgccaacgtcgccacttccgcccgcacgacgccctcgtaaccgaacgctcaacgccgcccgccgaccgaacgcctaaactaccgaacgcgccgccccgcccccgctcaccgactcccaatccgcgcccgccgccgaaatctccgcgcccccattaaccgaaaaaccgaccgaaaacgaaacgcaaaaaaaatacgccgattcataaatcccgaaaaacccaaataaaccgctcccaaataaatcttccccaaatatacctcccgccgcccccgat

SEQ ID NO: 4917 - DNA, 524 bp, Artificial Sequence
  chemically treated genomic DNA (Homo sapiens) CpG-island No: 4917
gggaattttaacggttgcgacgaatcggtgttatcggtgcgaggtagttttagtagcgagacgttttttttaggtagcgatttttttagcgttagtagttttagttttacgagtgaggtttttcgcgagaacgtttgtttttcggtttttttcggggtgggtgggaggggcgcgttcggtcgtgtttgatttagttttcgcgtttttagttttttgtcgcggttgcgagatttttttagcgttgttcgaggtttcgcgcggttatagtatgatgggcggttagcgggaggcggcgattcgggacgacgacgacgatttgttgtaattcgttatttagtagagtttgtttgaggcgggtagtgagtatgattaggtgcgttttcgcgggcgcgcggggttacgggatttcgcgtcgttattgtaacgtttacgttttttcgtaggttattatttgggaggcgttaattaatagtaagttaggtatttattttatgttttacgaggtcgtcgataggataggttag

SEQ ID NO: 4918 - DNA, 524 bp, Artificial Sequence
  chemically treated genomic DNA (Homo sapiens) CpG-island No: 4918
ctaacctatcctatcgacgacctcgtaaaacataaaataaatacctaacttactattaattaacgcctcccaaataataacctacgaaaaaacgtaaacgttacaataacgacgcgaaatcccgtaaccccgcgcgcccgcgaaaacgcacctaatcatactcactacccgcctcaaacaaactctactaaataacgaattacaacaaatcgtcgtcgtcgtcccgaatcgccgcctcccgctaaccgcccatcatactataaccgcgcgaaacctcgaacaacgctaaaaaaatctcgcaaccgcgacaaaaaactaaaaacgcgaaaactaaatcaaacacgaccgaacgcgcccctcccacccaccccgaaaaaaaccgaaaaacaaacgttctcgcgaaaaacctcactcgtaaaactaaaactactaacgctaaaaaaatcgctacctaaaaaaaacgtctcgctactaaaactacctcgcaccgataacaccgattcgtcgcaaccgttaaaattccc

SEQ ID NO: 4919 - DNA, 524 bp, Artificial Sequence
  chemically treated genomic DNA (Homo sapiens) CpG-island No: 4919
ttgatttgttttgtcggcgatttcgtaggatatggggtgggtgtttggtttgttgttggttagcgttttttagatggtgatttgcggggaggcgtgggcgttatagtggcggcgcggagtttcgtggtttcgcgcgttcgcggagacgtatttggttatatttattgttcgttttaagtaggttttgttggatggcgaattgtagtaggtcgtcgtcgtcgtttcgggtcgtcgtttttcgttggtcgtttattatgttgtagtcgcgcggggtttcgaataacgttggggagatttcgtagtcgcggtaggaggttgggggcgcgggggttgggttaggtacggtcgggcgcgttttttttatttatttcggggagagtcgaggggtaggcgttttcgcggggggttttattcgtggagttggagttgttgacgttggaggagtcgttgtttggggaaggcgtttcgttgttggggttgtttcgtatcgatggtatcggttcgtcgtagtcgttgaggttttt

SEQ ID NO: 4920 - DNA, 524 bp, Artificial Sequence
  chemically treated genomic DNA (Homo sapiens) CpG-island No: 4920
aaaaacctcaacgactacgacgaaccgataccatcgatacgaaacaaccccaacaacgaaacgccttccccaaacaacgactcctccaacgtcaacaactccaactccacgaataaaaccccccgcgaaaacgcctacccctcgactctccccgaaataaataaaaaaaacgcgcccgaccgtacctaacccaacccccgcgcccccaacctcctaccgcgactacgaaatctccccaacgttattcgaaaccccgcgcgactacaacataataaacgaccaacgaaaaacgacgacccgaaacgacgacgacgacctactacaattcgccatccaacaaaacctacttaaaacgaacaataaatataaccaaatacgtctccgcgaacgcgcgaaaccacgaaactccgcgccgccactataacgcccacgcctccccgcaaatcaccatctaaaaaacgctaaccaacaacaaaccaaacacccaccccatatcctacgaaatcgccgacaaaacaaatcaa

SEQ ID NO: 4921 - DNA, 571 bp, Artificial Sequence
  chemically treated genomic DNA (Homo sapiens) CpG-island No: 4921
acgtcgcgggattgatcgtttttattagagggtggtgtcgcgggtcgttttggagtttttacgtcgtgtttcggtttcggtcggtgggtgggtgcgtcgcgggagttcgcgatattttttttttatttttaggagcgtttcgtttacgtcgtagcgttagtttgcgttttcggcgttagtgtttagttttcggtttagtttagggttaggtttcggcggttacgtgtttcggagttacgacgagtagttgcggttggcgatggaattgtcggcgtaggagtaggaggagaggcggcggcgcgcgcgttaggaggaggaggagttggagcgtattttgaggtttttattgatcgagtagtagcgttttttgtcgggattttcgttagcgttacgcgcgttacgtttagggttaggagttagataaatttcggtttgcgcgtttgtagagcggcggttggagattggagttatcgtttcgcgggtgtagtagtatagtaggtacggttcggggagggattcggtatggtcgcggggtatttttttaggttagggttttggaggtaattggtat

SEQ ID NO: 4922 - DNA, 571 bp, Artificial Sequence
  chemically treated genomic DNA (Homo sapiens) CpG-island No: 4922
ataccaattacctccaaaaccctaacctaaaaaaataccccgcgaccataccgaatccctccccgaaccgtacctactatactactacacccgcgaaacgataactccaatctccaaccgccgctctacaaacgcgcaaaccgaaatttatctaactcctaaccctaaacgtaacgcgcgtaacgctaacgaaaatcccgacaaaaaacgctactactcgatcaataaaaacctcaaaatacgctccaactcctcctcctcctaacgcgcgcgccgccgcctctcctcctactcctacgccgacaattccatcgccaaccgcaactactcgtcgtaactccgaaacacgtaaccgccgaaacctaaccctaaactaaaccgaaaactaaacactaacgccgaaaacgcaaactaacgctacgacgtaaacgaaacgctcctaaaaataaaaaaaaaatatcgcgaactcccgcgacgcacccacccaccgaccgaaaccgaaacacgacgtaaaaactccaaaacgacccgcgacaccaccctctaataaaaacgatcaatcccgcgacgt

SEQ ID NO: 4923 - DNA, 571 bp, Artificial Sequence
  chemically treated genomic DNA (Homo sapiens) CpG-island No: 4923
gtgttagttgtttttagggttttggtttgggaaggtatttcgcggttatgtcgaattttttttcgaatcgtgtttgttgtgttgttgtattcgcgaggcggtggttttagtttttagtcgtcgttttgtaggcgcgtaggtcggggtttgtttggtttttggttttgggcgtggcgcgcgtggcgttggcgagggtttcggtagggggcgttattgttcggttagtgagagttttaggatgcgttttagttttttttttttttggcgcgcgcgtcgtcgtttttttttttgtttttgcgtcgatagttttatcgttagtcgtagttgttcgtcgtagtttcggaatacgtggtcgtcggaatttggttttgagttgggtcgagggttgggtattgacgtcgggggcgtaggttggcgttgcggcgtgggcggggcgtttttgggggtggggaaggaatgtcgcgggttttcgcggcgtatttatttatcggtcggggtcgggatacggcgtggaggttttagggcggttcgcggtattattttttagtggaggcggttagtttcgcggcgt

SEQ ID NO: 4924 - DNA, 571 bp, Artificial Sequence
  chemically treated genomic DNA (Homo sapiens) CpG-island No: 4924
acgccgcgaaactaaccgcctccactaaaaaataataccgcgaaccgccctaaaacctccacgccgtatcccgaccccgaccgataaataaatacgccgcgaaaacccgcgacattccttccccacccccaaaaacgccccgcccacgccgcaacgccaacctacgcccccgacgtcaatacccaaccctcgacccaactcaaaaccaaattccgacgaccacgtattccgaaactacgacgaacaactacgactaacgataaaactatcgacgcaaaaacaaaaaaaaaaacgacgacgcgcgcgccaaaaaaaaaaaaaactaaaacgcatcctaaaactctcactaaccgaacaataacgccccctaccgaaaccctcgccaacgccacgcgcgccacgcccaaaaccaaaaaccaaacaaaccccgacctacgcgcctacaaaacgacgactaaaaactaaaaccaccgcctcgcgaatacaacaacacaacaaacacgattcgaaaaaaaattcgacataaccgcgaaataccttcccaaaccaaaaccctaaaaacaactaacac

SEQ ID NO: 4925 - DNA, 584 bp, Artificial Sequence
  chemically treated genomic DNA (Homo sapiens) CpG-island No: 4925
gttggacgcggcgaggttttgttttttttttttttaggtttagttcgttagcggaagaatttcgcgtttttttcggcgcgttattttttttaggacgaatttttggtaaagcgttttgagttcgcgggtcgaggtttttttaggagcgggttattttatttcgttgggatttaggagtttcgcgagggttgttaggagaagtagttgtgggcgaaggcggaggaggcgttattttaagcggtttcgggttcggttcgtcgtttagtcgtttcgttagcgagggagcgcgcgtatttcgtttttttagttttagcgttttcgcgtattcgcgttttcgcgtcgttcgcgcgttcgttggttttgggttcgcgcgcgtttttttttagatagtgggttttcggtatcgtttcgttttaatgttcgtttatagtagcggagtgtgcgcgtacgcgttttaaattcgaagtcggaaaagttaagtgtaggagtcgggttagcgcgtaaggtttagtagggtaggcggggggtttttttttcgttcggggattcgttttagtaggtttttgtagtttgtagagtagttg

SEQ ID NO: 4926 - DNA, 584 bp, Artificial Sequence
  chemically treated genomic DNA (Homo sapiens) CpG-island No: 4926
caactactctacaaactacaaaaacctactaaaacgaatccccgaacgaaaaaaaaaccccccgcctaccctactaaaccttacgcgctaacccgactcctacacttaacttttccgacttcgaatttaaaacgcgtacgcgcacactccgctactataaacgaacattaaaacgaaacgataccgaaaacccactatctaaaaaaaaacgcgcgcgaacccaaaaccaacgaacgcgcgaacgacgcgaaaacgcgaatacgcgaaaacgctaaaactaaaaaaacgaaatacgcgcgctccctcgctaacgaaacgactaaacgacgaaccgaacccgaaaccgcttaaaataacgcctcctccgccttcgcccacaactacttctcctaacaaccctcgcgaaactcctaaatcccaacgaaataaaataacccgctcctaaaaaaacctcgacccgcgaactcaaaacgctttaccaaaaattcgtcctaaaaaaaataacgcgccgaaaaaaacgcgaaattcttccgctaacgaactaaacctaaaaaaaaaaaaaacaaaacctcgccgcgtccaac

SEQ ID NO: 4927 - DNA, 584 bp, Artificial Sequence
  chemically treated genomic DNA (Homo sapiens) CpG-island No: 4927
tagttgttttatagattgtagggatttgttgagacgaattttcggacgaggaaagggtttttcgtttgttttattgagttttgcgcgttgattcggtttttatatttaattttttcggtttcgggtttaagacgcgtgcgcgtatatttcgttgttgtgggcgggtattggggcggggcgatatcgggggtttattgtttggggaggggcgcgcgcgagtttagggttaacggacgcgcgggcggcgcgggggcgcgggtgcgcgggggcgttggggttggaggggcggggtgcgcgcgttttttcgttggcggagcggttgggcggcgggtcgggttcggggtcgtttggaatggcgtttttttcgttttcgtttataattgttttttttggtagttttcgcgaggtttttgggttttagcgaggtaaggtgattcgtttttgggaaggtttcggttcgcgagtttaaagcgttttgttaaaagttcgttttggaaggagtggcgcgtcgagggggacgcggagttttttcgttggcgggttgggtttggggagagagagggtagggtttcgtcgcgtttagt

SEQ ID NO: 4928 - DNA, 584 bp, Artificial Sequence
  chemically treated genomic DNA (Homo sapiens) CpG-island No: 4928
actaaacgcgacgaaaccctaccctctctctccccaaacccaacccgccaacgaaaaaactccgcgtccccctcgacgcgccactccttccaaaacgaacttttaacaaaacgctttaaactcgcgaaccgaaaccttcccaaaaacgaatcaccttacctcgctaaaacccaaaaacctcgcgaaaactaccaaaaaaaacaattataaacgaaaacgaaaaaaacgccattccaaacgaccccgaacccgacccgccgcccaaccgctccgccaacgaaaaaacgcgcgcaccccgcccctccaaccccaacgcccccgcgcacccgcgcccccgcgccgcccgcgcgtccgttaaccctaaactcgcgcgcgcccctccccaaacaataaacccccgatatcgccccgccccaatacccgcccacaacaacgaaatatacgcgcacgcgtcttaaacccgaaaccgaaaaaattaaatataaaaaccgaatcaacgcgcaaaactcaataaaacaaacgaaaaaccctttcctcgtccgaaaattcgtctcaacaaatccctacaatctataaaacaacta

SEQ ID NO: 4929 - DNA, 518 bp, Artificial Sequence
  chemically treated genomic DNA (Homo sapiens) CpG-island No: 4929
  misc_feature (44)..(44): n is either a, c, g or t
ggttaatttagagcgcgtacgcgcgggagggttttgggtagttngcgtttggcgggcggattcgcgggtaaaagcgcggagttcgtcgagtagacggtttcgtagtacgttgtacgtcggggttttttagtttcgttatgtcgtcgtggggcgtcgttttcgcgtttattttggtcgtgttcgtttttttcggtttgttcggttcgcggtttcgggattttggggcgcgtcgtcggagagaggattttgtcggggtttaagatcgtagacgacggggaggaggcggacggcggaggttcggcggattagtttagcgacgggcgcgagttattgtcgggagggtgtagttttgtttgtaagtcgtcggttttggtttagtgtttgttgcgcgttttgcggcgtttagaggcgttggaggtcggttcgcgtttttggtttttcgggttttatttgtagattttttgttattcgttttgttcgtagcgtttgggtttgagttggttcgggagtatttgtag

SEQ ID NO: 4930 - DNA, 518 bp, Artificial Sequence
  chemically treated genomic DNA (Homo sapiens) CpG-island No: 4930
  misc_feature (475)..(475): n is either a, c, g or t
ctacaaatactcccgaaccaactcaaacccaaacgctacgaacaaaacgaataacaaaaaatctacaaataaaacccgaaaaaccaaaaacgcgaaccgacctccaacgcctctaaacgccgcaaaacgcgcaacaaacactaaaccaaaaccgacgacttacaaacaaaactacaccctcccgacaataactcgcgcccgtcgctaaactaatccgccgaacctccgccgtccgcctcctccccgtcgtctacgatcttaaaccccgacaaaatcctctctccgacgacgcgccccaaaatcccgaaaccgcgaaccgaacaaaccgaaaaaaacgaacacgaccaaaataaacgcgaaaacgacgccccacgacgacataacgaaactaaaaaaccccgacgtacaacgtactacgaaaccgtctactcgacgaactccgcgcttttacccgcgaatccgcccgccaaacgcnaactacccaaaaccctcccgcgcgtacgcgctctaaattaacc

SEQ ID NO: 4931 - DNA, 518 bp, Artificial Sequence
  chemically treated genomic DNA (Homo sapiens) CpG-island No: 4931
  misc_feature (475)..(475): n is either a, c, g or t
ttgtaggtattttcgggttagtttaggtttaggcgttacgggtaggacgaatggtagagggtttgtaggtggggttcggagaattaggagcgcgggtcggtttttagcgtttttgagcgtcgtagggcgcgtagtaggtattgggttagggtcgacggtttgtaaataaggttgtattttttcggtagtggttcgcgttcgtcgttgaattggttcgtcgggttttcgtcgttcgtttttttttcgtcgtttacggttttgggtttcggtagggtttttttttcgacggcgcgttttagggtttcggagtcgcgggtcgagtaggtcgagaagggcgagtacggttaagatgagcgcgagggcggcgttttacggcggtatggcgaagttggagagtttcggcgtgtagcgtgttgcggggtcgtttattcggcgagtttcgcgtttttgttcgcgggttcgttcgttaggcgtnggttgtttagggttttttcgcgcgtgcgcgttttggattggtt

SEQ ID NO: 4932 - DNA, 518 bp, Artificial Sequence
  chemically treated genomic DNA (Homo sapiens) CpG-island No: 4932
  misc_feature (44)..(44): n is either a, c, g or t
aaccaatccaaaacgcgcacgcgcgaaaaaaccctaaacaaccnacgcctaacgaacgaacccgcgaacaaaaacgcgaaactcgccgaataaacgaccccgcaacacgctacacgccgaaactctccaacttcgccataccgccgtaaaacgccgccctcgcgctcatcttaaccgtactcgcccttctcgacctactcgacccgcgactccgaaaccctaaaacgcgccgtcgaaaaaaaaaccctaccgaaacccaaaaccgtaaacgacgaaaaaaaaacgaacgacgaaaacccgacgaaccaattcaacgacgaacgcgaaccactaccgaaaaaatacaaccttatttacaaaccgtcgaccctaacccaatacctactacgcgccctacgacgctcaaaaacgctaaaaaccgacccgcgctcctaattctccgaaccccacctacaaaccctctaccattcgtcctacccgtaacgcctaaacctaaactaacccgaaaatacctacaa

SEQ ID NO: 4933 - DNA, 801 bp, Artificial Sequence
  chemically treated genomic DNA (Homo sapiens) CpG-island No: 4933
ttgcgggcgcgcgtttttgcggcggcgttttcggggttcgcgtttcgtgcgtattcgcgttcgttgcgggcgtttgtttttttcgtcgagcggcgtttttgtgtgcgggggtgtgggaggcgagcgcgagttcgcgtagttcgttagagtgttcgtttttttttagggcgggtgggggtttttcgcgtcgttcgtcgtcgtcgtttcgcgaggacgttcgttgttcgtttcgttcgtatcgcgtcgggcgcgtcgttttcgttcgtcgtcgttcgtatatgttcgattcgtagtttcgcgagtaggtagcgtcggtttttcgtttcgcggtttcgggttcggtttcggcgtcgtttttttttttcggtcgggcgtcgcggtttcggtatgaggagcgggcgatgattttcgttaacgttttcgttaggaaggggttcgagggtaagtattcgttgtattatttcgtgtggtataatcgttatcgcgagttggagaaggaggttcgcgcgggttaggtaggagcgttttcggggcgcgcggggatttcgcggtcgggtacgttcgttcggtttggggagggggtgcggcgcgggttgtttcgtttttttggcgagtttgcggcgcgtttttgtttgcggtcgcggtttttgtgtttgttgatcgggaaagggtgatgggagcgggttttgttcgtttttttcggtcgggacgggcgggattatacgtgtttcggatttatttagatgagagtagaggtttttgtgtttttttttcgtcggggtagtgagggttgtagggagg

SEQ ID NO: 4934 - DNA, 801 bp, Artificial Sequence
  chemically treated genomic DNA (Homo sapiens) CpG-island No: 4934
cctccctacaaccctcactaccccgacgaaaaaaaaacacaaaaacctctactctcatctaaataaatccgaaacacgtataatcccgcccgtcccgaccgaaaaaaacgaacaaaacccgctcccatcaccctttcccgatcaacaaacacaaaaaccgcgaccgcaaacaaaaacgcgccgcaaactcgccaaaaaaacgaaacaacccgcgccgcaccccctccccaaaccgaacgaacgtacccgaccgcgaaatccccgcgcgccccgaaaacgctcctacctaacccgcgcgaacctccttctccaactcgcgataacgattataccacacgaaataatacaacgaatacttaccctcgaaccccttcctaacgaaaacgttaacgaaaatcatcgcccgctcctcataccgaaaccgcgacgcccgaccgaaaaaaaaaaacgacgccgaaaccgaacccgaaaccgcgaaacgaaaaaccgacgctacctactcgcgaaactacgaatcgaacatatacgaacgacgacgaacgaaaacgacgcgcccgacgcgatacgaacgaaacgaacaacgaacgtcctcgcgaaacgacgacgacgaacgacgcgaaaaacccccacccgccctaaaaaaaaacgaacactctaacgaactacgcgaactcgcgctcgcctcccacacccccgcacacaaaaacgccgctcgacgaaaaaaacaaacgcccgcaacgaacgcgaatacgcacgaaacgcgaaccccgaaaacgccgccgcaaaaacgcgcgcccgcaa

SEQ ID NO: 4935 - DNA, 801 bp, Artificial Sequence
  chemically treated genomic DNA (Homo sapiens) CpG-island No: 4935
tttttttgtagtttttattgtttcggcggaggaggggtatagaggtttttatttttatttaggtgagttcgaaatacgtgtggtttcgttcgtttcggtcggagggagcgggtagggttcgtttttattattttttttcggttaataagtataaaagtcgcggtcgtaaataaagacgcgtcgtaaattcgttagggaggcgggatagttcgcgtcgtattttttttttaggtcggacgggcgtgttcggtcgcggggttttcgcgcgtttcgaaggcgtttttatttggttcgcgcggatttttttttttagttcgcggtggcggttgtgttatacgaggtagtgtagcggatatttgttttcgggtttttttttggcggaggcgttggcggggattatcgttcgttttttatgtcggggtcgcggcgttcggtcggggaggagggacggcgtcggagtcgggttcggggtcgcggggcggggggtcggcgttgtttgttcgcggggttgcggatcgagtatgtgcgagcggcggcgagcgggggcggcgcgttcggcgcggtgcgggcggagcgggtaacgggcgttttcgcgaggcggcggcggcgggcggcgcggagagtttttattcgttttgggagggagcgggtattttggcgggttgcgcggattcgcgttcgttttttatattttcgtatataaagacgtcgttcggcggagggagtaggcgttcgtagcgggcgcgggtgcgtacgggacgcgggtttcggggacgtcgtcgtagggacgcgcgttcgtag

SEQ ID NO: 4936 - DNA, 801 bp, Artificial Sequence
  chemically treated genomic DNA (Homo sapiens) CpG-island No: 4936
ctacgaacgcgcgtccctacgacgacgtccccgaaacccgcgtcccgtacgcacccgcgcccgctacgaacgcctactccctccgccgaacgacgtctttatatacgaaaatataaaaaacgaacgcgaatccgcgcaacccgccaaaatacccgctccctcccaaaacgaataaaaactctccgcgccgcccgccgccgccgcctcgcgaaaacgcccgttacccgctccgcccgcaccgcgccgaacgcgccgcccccgctcgccgccgctcgcacatactcgatccgcaaccccgcgaacaaacaacgccgaccccccgccccgcgaccccgaacccgactccgacgccgtccctcctccccgaccgaacgccgcgaccccgacataaaaaacgaacgataatccccgccaacgcctccgccaaaaaaaaacccgaaaacaaatatccgctacactacctcgtataacacaaccgccaccgcgaactaaaaaaaaaaatccgcgcgaaccaaataaaaacgccttcgaaacgcgcgaaaaccccgcgaccgaacacgcccgtccgacctaaaaaaaaaatacgacgcgaactatcccgcctccctaacgaatttacgacgcgtctttatttacgaccgcgacttttatacttattaaccgaaaaaaaataataaaaacgaaccctacccgctccctccgaccgaaacgaacgaaaccacacgtatttcgaactcacctaaataaaaataaaaacctctatacccctcctccgccgaaacaataaaaactacaaaaaaa

SEQ ID NO: 4937 - DNA, 768 bp, Artificial Sequence
  chemically treated genomic DNA (Homo sapiens) CpG-island No: 4937
  misc_feature (710)..(710): n is either a, c, g or t
attttacgcggaaagtgaaggggagggggttgtgagggtgatttatattgttttcgggttaggcgagcgttgtagcggaggttagggtcgtagcgacgttgttcgtcggggtcgggtatttgtcgcggtttttttaagcgttttcgtttttttttgttcgcgttcgggttttttttttttagggggcgcggtcggtagcgcgcggcggggcgggggtgcggtttttttttttgtgggtagggtttgcgtcgttttttgtagaagcggtcgggagtcgcgtagggggcggagagaggagtcgcgagcggcggcggggcggcgcggggcggagggcgttcgagggcgagcgggtaggcgggtacggcgggtttcgggttagtttcggggcggacggttggtcgggcgcgcggagtttcgtcggggtttcgtcggagtcgggtcgggtagtaggggtcgtcgtcgtcgttcgggttcgtcgttcgcgttttttacgttggtttagagggttgcggtcgcgtcgtcgttgaggatgtttcgaaaggggtcgcgagcggaggtgtgtgcggattgtagcgtttcgggtaagcgcggcggggtcgggggcgggatcgtatagttaggtcgtcgtcgggcgtgcgtcggggtttggtaagagcgttgtgcggggtcggagggttgggcggggcggggggttgcgagttttaggttgnggtttcgtttcggttattgcggattgcgtttttggcgggagggacggtttggggtgtt

SEQ ID NO: 4938 - DNA, 768 bp, Artificial Sequence
  chemically treated genomic DNA (Homo sapiens) CpG-island No: 4938
  misc_feature (59)..(59): n is either a, c, g or t
aacaccccaaaccgtccctcccgccaaaaacgcaatccgcaataaccgaaacgaaaccncaacctaaaactcgcaaccccccgccccgcccaaccctccgaccccgcacaacgctcttaccaaaccccgacgcacgcccgacgacgacctaactatacgatcccgcccccgaccccgccgcgcttacccgaaacgctacaatccgcacacacctccgctcgcgacccctttcgaaacatcctcaacgacgacgcgaccgcaaccctctaaaccaacgtaaaaaacgcgaacgacgaacccgaacgacgacgacgacccctactacccgacccgactccgacgaaaccccgacgaaactccgcgcgcccgaccaaccgtccgccccgaaactaacccgaaacccgccgtacccgcctacccgctcgccctcgaacgccctccgccccgcgccgccccgccgccgctcgcgactcctctctccgccccctacgcgactcccgaccgcttctacaaaaaacgacgcaaaccctacccacaaaaaaaaaaaccgcacccccgccccgccgcgcgctaccgaccgcgccccctaaaaaaaaaaaacccgaacgcgaacaaaaaaaaacgaaaacgcttaaaaaaaccgcgacaaatacccgaccccgacgaacaacgtcgctacgaccctaacctccgctacaacgctcgcctaacccgaaaacaatataaatcaccctcacaaccccctccccttcactttccgcgtaaaat

SEQ ID NO: 4939 - DNA, 768 bp, Artificial Sequence
  chemically treated genomic DNA (Homo sapiens) CpG-island No: 4939
  misc_feature (59)..(59): n is either a, c, g or t
ggtattttaggtcgtttttttcgttaagggcgtagttcgtagtggtcgaggcggggttntagtttggagttcgtagtttttcgtttcgtttagtttttcggtttcgtatagcgtttttgttaggtttcggcgtacgttcggcggcggtttggttgtgcggtttcgttttcggtttcgtcgcgtttattcggggcgttgtagttcgtatatattttcgttcgcggtttttttcgggatatttttagcggcgacgcggtcgtagttttttgggttagcgtggggggcgcgggcggcgggttcgggcggcggcggcggtttttgttgttcggttcggtttcggcgaggtttcggcgaggtttcgcgcgttcggttaatcgttcgtttcggggttggttcggaattcgtcgtgttcgtttgttcgttcgttttcgggcgtttttcgtttcgcgtcgtttcgtcgtcgttcgcggttttttttttcgttttttgcgcggttttcggtcgtttttgtaggaagcggcgtaggttttgtttatagggggaggggtcgtattttcgtttcgtcgcgcgttgtcggtcgcgttttttagagaaaggaagttcgggcgcgggtaggagggggcgggggcgtttaaaggggtcgcggtagatgttcggtttcggcgggtagcgtcgttgcggttttggttttcgttgtagcgttcgtttggttcggaggtaatgtgagttatttttatagtttttttttttttatttttcgcgtggggt

SEQ ID NO: 4940 - DNA, 768 bp, Artificial Sequence
  chemically treated genomic DNA (Homo sapiens) CpG-island No: 4940
  misc_feature (710)..(710): n is either a, c, g or t
accccacgcgaaaaataaaaaaaaaaaaactataaaaataactcacattacctccgaaccaaacgaacgctacaacgaaaaccaaaaccgcaacgacgctacccgccgaaaccgaacatctaccgcgacccctttaaacgcccccgccccctcctacccgcgcccgaacttcctttctctaaaaaacgcgaccgacaacgcgcgacgaaacgaaaatacgacccctccccctataaacaaaacctacgccgcttcctacaaaaacgaccgaaaaccgcgcaaaaaacgaaaaaaaaaaccgcgaacgacgacgaaacgacgcgaaacgaaaaacgcccgaaaacgaacgaacaaacgaacacgacgaattccgaaccaaccccgaaacgaacgattaaccgaacgcgcgaaacctcgccgaaacctcgccgaaaccgaaccgaacaacaaaaaccgccgccgccgcccgaacccgccgcccgcgccccccacgctaacccaaaaaactacgaccgcgtcgccgctaaaaatatcccgaaaaaaaccgcgaacgaaaatatatacgaactacaacgccccgaataaacgcgacgaaaccgaaaacgaaaccgcacaaccaaaccgccgccgaacgtacgccgaaacctaacaaaaacgctatacgaaaccgaaaaactaaacgaaacgaaaaactacgaactccaaactanaaccccgcctcgaccactacgaactacgcccttaacgaaaaaaacgacctaaaatacc

SEQ ID NO: 4941 - DNA, 605 bp, Artificial Sequence
  chemically treated genomic DNA (Homo sapiens) CpG-island No: 4941
tttcggcgtacggttatttttatttcgcgggtttttattcgtacggcgcgcgtgtagtttatagtttggttgtttcgatgttcgttttttattagtattcggaaggtaggtagcgttgcgttttggtcgtatgagtcgattagtaggtacgtgtaggtgtttatgaagtcgaagcgtcggtcgtcgaagtttatatagtgtgggttttcggatttttggtaggtttcgaagcgatcggggtagtagtttaggaggtcgttttggacgttgtagcgtttattcgtcgggtagttttgtttgtcgcggtaggtgatttgatgggtggcgtcgttgtaggtgtagcgtttttggtataattcgttcgtttatattttttggttcggagcgagttggagattttggaaggtgtagttatacgacgaggtcggtacgtaggcgtcgtcgttggttacgaagtttgggaggtatacgtagttttttacgtaggggcgttcggagtagttggacggcgtcgtagtttcgttgtaggaggtcgggtaagtagggtcgtagagtttatagcggttgttggtagggtaggatagggttgcggggagattagagag

SEQ ID NO: 4942 - DNA, 605 bp, Artificial Sequence
  chemically treated genomic DNA (Homo sapiens) CpG-island No: 4942
ctctctaatctccccgcaaccctatcctaccctaccaacaaccgctataaactctacgaccctacttacccgacctcctacaacgaaactacgacgccgtccaactactccgaacgcccctacgtaaaaaactacgtatacctcccaaacttcgtaaccaacgacgacgcctacgtaccgacctcgtcgtataactacaccttccaaaatctccaactcgctccgaaccaaaaaatataaacgaacgaattataccaaaaacgctacacctacaacgacgccacccatcaaatcacctaccgcgacaaacaaaactacccgacgaataaacgctacaacgtccaaaacgacctcctaaactactaccccgatcgcttcgaaacctaccaaaaatccgaaaacccacactatataaacttcgacgaccgacgcttcgacttcataaacacctacacgtacctactaatcgactcatacgaccaaaacgcaacgctacctaccttccgaatactaataaaaaacgaacatcgaaacaaccaaactataaactacacgcgcgccgtacgaataaaaacccgcgaaataaaaataaccgtacgccgaaa

SEQ ID NO: 4943 - DNA, 605 bp, Artificial Sequence
  chemically treated genomic DNA (Homo sapiens) CpG-island No: 4943
ttttttgattttttcgtagttttgttttgttttgttaatagtcgttatgagttttgcggttttgtttgttcgattttttgtaacggggttgcggcgtcgtttaattgtttcgggcgtttttgcgtggagggttgcgtgtgttttttaggtttcgtggttagcggcggcgtttgcgtgtcggtttcgtcgtgtggttgtattttttagggtttttagttcgtttcgggttaggaagtgtgggcggacgagttgtgttaaaggcgttgtatttgtaacggcgttatttattaggttatttgtcgcgataagtagagttgttcggcgggtgagcgttgtagcgtttagaacggttttttgggttgttatttcgatcgtttcgggatttgttaggggttcggggatttatattatgtgagtttcgacggtcggcgtttcgattttatgggtatttgtacgtatttgttggtcggtttatgcggttagaacgtagcgttgtttgtttttcgggtgttggtggaaaacgagtatcggggtagttagattgtgagttatacgcgcgtcgtgcgggtggaggttcgcggggtgaaggtggtcgtgcgtcggga

SEQ ID NO: 4944 - DNA, 605 bp, Artificial Sequence
  chemically treated genomic DNA (Homo sapiens) CpG-island No: 4944
tcccgacgcacgaccaccttcaccccgcgaacctccacccgcacgacgcgcgtataactcacaatctaactaccccgatactcgttttccaccaacacccgaaaaacaaacaacgctacgttctaaccgcataaaccgaccaacaaatacgtacaaatacccataaaatcgaaacgccgaccgtcgaaactcacataatataaatccccgaacccctaacaaatcccgaaacgatcgaaataacaacccaaaaaaccgttctaaacgctacaacgctcacccgccgaacaactctacttatcgcgacaaataacctaataaataacgccgttacaaatacaacgcctttaacacaactcgtccgcccacacttcctaacccgaaacgaactaaaaaccctaaaaaatacaaccacacgacgaaaccgacacgcaaacgccgccgctaaccacgaaacctaaaaaacacacgcaaccctccacgcaaaaacgcccgaaacaattaaacgacgccgcaaccccgttacaaaaaatcgaacaaacaaaaccgcaaaactcataacgactattaacaaaacaaaacaaaactacgaaaaaatcaaaaaa

SEQ ID NO: 4945 - DNA, 1106 bp, Artificial Sequence
  chemically treated genomic DNA (Homo sapiens) CpG-island No: 4945
cggaagaatgaagttttcgtttagacggtacgcgttttattgggagtaatttttttttagtttgcggtaacggtggtattttcgcgttatttttcggttttcgcgttttttttaatatcgtggttatttttttttttttttcgagcgaggtagtttttagagttatatttttggcgatttttttttcgttattcggtcgattcggcgtgcggtcgttcgggggagtaagggagggaagggagcggtttatcgaggcgtagtagttcgttttagattttcgcgtttcgatataaagcgtttggtcgggtcggcgttatttgtttttattcggttcgcggggttggggaagtttttcggttgcgatcgtattttttttcgaagttaagttttttttcgttttggtttttttagttgttcgaggtattgttcggataaattttatcgcgttttggttgggaaagtaaaagttggcgtcgggggtcggggggatcggggagtcgcgtttggttatttattcgggcgtttgggagttttttcggttttttcggagcgttgtcggaggtcgattataggcgttagcgtcggagattagtcggggcgcggcgggaatatagttagggagtgagtggggggcgtagattttttttaggcgtcggttttagattttgtcgttgcgagttgtcgagtttttttcgcggagggaataaagttttcggcgttggttcggttcggttgttttttttatatttcgaagtagtttttcggttttttgtcgttttttgggcggagggcggtcggtaggcggttaatggggattttgtaagcgggttggcggcgcggtttatttattttcgagttgttttgttaggtcggcgttgcgggttttgcgcggcgttcgttgttttttttagtttcgcgtttcgggttcgttggcgcgttttatcgcgtatatttcgtatatatttattcgttttatatttacgtcggtcggggagttagtgcgttcgttcggaacgcgggcgttttatttgtgatatattgttaagttgttttttgattgggttttagggaaatacggttttttcgtttcgagatgtgtattggga

SEQ ID NO: 4946 - DNA, 1106 bp, Artificial Sequence
  chemically treated genomic DNA (Homo sapiens) CpG-island No: 4946
tcccaatacacatctcgaaacgaaaaaaccgtatttccctaaaacccaatcaaaaaacaacttaacaatatatcacaaataaaacgcccgcgttccgaacgaacgcactaactccccgaccgacgtaaatataaaacgaataaatatatacgaaatatacgcgataaaacgcgccaacgaacccgaaacgcgaaactaaaaaaaacaacgaacgccgcgcaaaacccgcaacgccgacctaacaaaacaactcgaaaataaataaaccgcgccgccaacccgcttacaaaatccccattaaccgcctaccgaccgccctccgcccaaaaaacgacaaaaaaccgaaaaactacttcgaaatataaaaaaaacaaccgaaccgaaccaacgccgaaaactttattccctccgcgaaaaaaactcgacaactcgcaacgacaaaatctaaaaccgacgcctaaaaaaaatctacgccccccactcactccctaactatattcccgccgcgccccgactaatctccgacgctaacgcctataatcgacctccgacaacgctccgaaaaaaccgaaaaaactcccaaacgcccgaataaataaccaaacgcgactccccgatccccccgacccccgacgccaacttttactttcccaaccaaaacgcgataaaatttatccgaacaatacctcgaacaactaaaaaaaccaaaacgaaaaaaaacttaacttcgaaaaaaaatacgatcgcaaccgaaaaacttccccaaccccgcgaaccgaataaaaacaaataacgccgacccgaccaaacgctttatatcgaaacgcgaaaatctaaaacgaactactacgcctcgataaaccgctcccttccctcccttactcccccgaacgaccgcacgccgaatcgaccgaataacgaaaaaaaaatcgccaaaaatataactctaaaaactacctcgctcgaaaaaaaaaaaaaaataaccacgatattaaaaaaaacgcgaaaaccgaaaaataacgcgaaaataccaccgttaccgcaaactaaaaaaaaattactcccaataaaacgcgtaccgtctaaacgaaaacttcattcttccg

SEQ ID NO: 4947 - DNA, 1106 bp, Artificial Sequence
  chemically treated genomic DNA (Homo sapiens) CpG-island No: 4947
ttttagtatatatttcgggacggaagaatcgtgtttttttagaatttagttagagggtagtttagtaatgtgttataggtggggcgttcgcgtttcgggcggacgtattggtttttcggtcggcgtgggtgtggggcgagtgggtgtgtgcggggtgtgcgcggtagagcgcgttagcgagttcggagcgcggagttgggaggagtagcgagcgtcgcgtagaattcgtagcgtcggtttggtagggtagttcggaggtgggtgggtcgcgtcgttagttcgtttgtagggtttttattggtcgtttgtcggtcgtttttcgtttaaaaggcggtaaggagtcgagaggttgtttcggagtgtgaggaggatagtcggatcgagttaacgtcggggattttgtttttttcgcggaggggattcggtaattcgtagcggtagggtttggggtcggcgtttgggagggatttgcgttttttatttattttttagttgtgttttcgtcgcgtttcggttagttttcggcgttggcgtttatggtcggttttcgatagcgtttcggagggatcgggggagtttttaggcgttcgggtgagtagttaggcgcggtttttcggttttttcgattttcggcgttagtttttgtttttttagttagggcgcggtggggtttgttcgggtagtgtttcgagtaattgggaaggttaaggcggagggaaatttggtttcggggagaagtgcgatcgtagtcgggaggtttttttagtttcgcgggtcgggtgagaataggtggcgtcggttcgattaggcgttttgtgtcggggcgcgaggatttggagcgaattgttgcgtttcggtgggtcgttttttttttttttttgttttttcgggcggtcgtacgtcgggtcggtcgggtaacggagagggagtcgttaggaatgtggttttggggattgtttcgttcggggaaggggagagggtggttacggtgttaggagaggcgcgggagtcgagaggtggcgcgggggtgttatcgttgtcgtaggttggagagagattgtttttagtgaggcgcgtatcgtttgggcgagggttttattttttcg

SEQ ID NO: 4948 - DNA, 1106 bp, Artificial Sequence
  chemically treated genomic DNA (Homo sapiens) CpG-island No: 4948
cgaaaaaataaaaccctcgcccaaacgatacgcgcctcactaaaaacaatctctctccaacctacgacaacgataacacccccgcgccacctctcgactcccgcgcctctcctaacaccgtaaccaccctctccccttccccgaacgaaacaatccccaaaaccacattcctaacgactccctctccgttacccgaccgacccgacgtacgaccgcccgaaaaaacaaaaaaaaaaaaaaaacgacccaccgaaacgcaacaattcgctccaaatcctcgcgccccgacacaaaacgcctaatcgaaccgacgccacctattctcacccgacccgcgaaactaaaaaaacctcccgactacgatcgcacttctccccgaaaccaaatttccctccgccttaaccttcccaattactcgaaacactacccgaacaaaccccaccgcgccctaactaaaaaaacaaaaactaacgccgaaaatcgaaaaaaccgaaaaaccgcgcctaactactcacccgaacgcctaaaaactcccccgatccctccgaaacgctatcgaaaaccgaccataaacgccaacgccgaaaactaaccgaaacgcgacgaaaacacaactaaaaaataaataaaaaacgcaaatccctcccaaacgccgaccccaaaccctaccgctacgaattaccgaatcccctccgcgaaaaaaacaaaatccccgacgttaactcgatccgactatcctcctcacactccgaaacaacctctcgactccttaccgccttttaaacgaaaaacgaccgacaaacgaccaataaaaaccctacaaacgaactaacgacgcgacccacccacctccgaactaccctaccaaaccgacgctacgaattctacgcgacgctcgctactcctcccaactccgcgctccgaactcgctaacgcgctctaccgcgcacaccccgcacacacccactcgccccacacccacgccgaccgaaaaaccaatacgtccgcccgaaacgcgaacgccccacctataacacattactaaactaccctctaactaaattctaaaaaaacacgattcttccgtcccgaaatatatactaaaa

SEQ ID NO: 4949 - DNA, 637 bp, Artificial Sequence
  chemically treated genomic DNA (Homo sapiens) CpG-island No: 4949
ttggggtttgggtagggtaggcggtttagagggagttatagtggcggcggcggcgggcggttgtggtggatttgggaaaagttgcgaggcggtcgttggaagttgcgcgggcgggcgggtggattgcgtcgagtcgcggttgcggtagtgggcgttgtgcgttcggttatgtttttcggcgcggcgttgcgcggcgggaggattgcggcggggagtaggggatattaaggtgggggttgtgatcgcggggtgggggcgggggtacgggtagagtagagttatcggtttcgtatagttacgcgtaggtggggaggaaagaggtttagcgagcgttcggacgtggggagagaagaggtttagcgagcgttcggagagtcgggagtggagggtatatagttagcggcggtagtttaggagtaggaggtagagagggcgcgttgcgattcgcgtatttcgggtttgttgggcgtcgagtaaattttagggggcgggttgttagagcgttgggtcgcggagagggcgtagcgtagttttcggcgtttcgtttgggtgtagtttgggtttagggttaataatttttttcggcgttttttgtttgttcggcgcggagcggttttggtttggcgggatgtgggtt

SEQ ID NO: 4950 - DNA, 637 bp, Artificial Sequence
  chemically treated genomic DNA (Homo sapiens) CpG-island No: 4950
aacccacatcccgccaaaccaaaaccgctccgcgccgaacaaacaaaaaacgccgaaaaaaattattaaccctaaacccaaactacacccaaacgaaacgccgaaaactacgctacgccctctccgcgacccaacgctctaacaacccgccccctaaaatttactcgacgcccaacaaacccgaaatacgcgaatcgcaacgcgccctctctacctcctactcctaaactaccgccgctaactatataccctccactcccgactctccgaacgctcgctaaacctcttctctccccacgtccgaacgctcgctaaacctctttcctccccacctacgcgtaactatacgaaaccgataactctactctacccgtacccccgcccccaccccgcgatcacaacccccaccttaatatcccctactccccgccgcaatcctcccgccgcgcaacgccgcgccgaaaaacataaccgaacgcacaacgcccactaccgcaaccgcgactcgacgcaatccacccgcccgcccgcgcaacttccaacgaccgcctcgcaacttttcccaaatccaccacaaccgcccgccgccgccgccactataactccctctaaaccgcctaccctacccaaaccccaa

SEQ ID NO: 4951 - DNA, 637 bp, Artificial Sequence
  chemically treated genomic DNA (Homo sapiens) CpG-island No: 4951
agtttatatttcgttagattaaggtcgtttcgcgtcgggtaggtagggggcgtcggggagggttattgattttggatttaggttgtatttagacgaagcgtcggaggttgcgttgcgtttttttcgcggtttaacgttttggtagttcgttttttggggtttgttcggcgtttagtaagttcgaggtgcgcgggtcgtagcgcgttttttttgttttttgtttttaggttgtcgtcgttggttgtgtgttttttattttcggtttttcgagcgttcgttgggttttttttttttttacgttcgagcgttcgttgggttttttttttttttatttgcgcgtggttgtgcggagtcggtagttttgttttgttcgtgttttcgtttttatttcgcgattatagtttttattttggtgttttttatttttcgtcgtagttttttcgtcgcgtagcgtcgcgtcggagagtatggtcgagcgtatagcgtttattatcgtagtcgcggttcggcgtagtttattcgttcgttcgcgtaatttttagcggtcgtttcgtaattttttttaagtttattatagtcgttcgtcgtcgtcgttattgtggttttttttgagtcgtttattttatttaaattttag

SEQ ID NO: 4952 - DNA, 637 bp, Artificial Sequence
  chemically treated genomic DNA (Homo sapiens) CpG-island No: 4952
ctaaaatttaaataaaataaacgactcaaaaaaaaccacaataacgacgacgacgaacgactataataaacttaaaaaaaattacgaaacgaccgctaaaaattacgcgaacgaacgaataaactacgccgaaccgcgactacgataataaacgctatacgctcgaccatactctccgacgcgacgctacgcgacgaaaaaactacgacgaaaaataaaaaacaccaaaataaaaactataatcgcgaaataaaaacgaaaacacgaacaaaacaaaactaccgactccgcacaaccacgcgcaaataaaaaaaaaaaaaacccaacgaacgctcgaacgtaaaaaaaaaaaaaacccaacgaacgctcgaaaaaccgaaaataaaaaacacacaaccaacgacgacaacctaaaaacaaaaaacaaaaaaaacgcgctacgacccgcgcacctcgaacttactaaacgccgaacaaaccccaaaaaacgaactaccaaaacgttaaaccgcgaaaaaaacgcaacgcaacctccgacgcttcgtctaaatacaacctaaatccaaaatcaataaccctccccgacgccccctacctacccgacgcgaaacgaccttaatctaacgaaatataaact

SEQ ID NO: 4953 - DNA, 760 bp, Artificial Sequence
  chemically treated genomic DNA (Homo sapiens) CpG-island No: 4953
  misc_feature (204)..(204): n is either a, c, g or t
  misc_feature (216)..(216): n is either a, c, g or t
  misc_feature (218)..(218): n is either a, c, g or t
  misc_feature (240)..(240): n is either a, c, g or t
  misc_feature (280)..(280): n is either a, c, g or t
  misc_feature (282)..(282): n is either a, c, g or t
  misc_feature (300)..(300): n is either a, c, g or t
  misc_feature (351)..(351): n is either a, c, g or t
  misc_feature (355)..(355): n is either a, c, g or t
  misc_feature (363)..(363): n is either a, c, g or t
  misc_feature (393)..(393): n is either a, c, g or t
  misc_feature (407)..(407): n is either a, c, g or t
  misc_feature (414)..(414): n is either a, c, g or t
  misc_feature (416)..(416): n is either a, c, g or t
  misc_feature (451)..(451): n is either a, c, g or t
  misc_feature (453)..(453): n is either a, c, g or t
  misc_feature (459)..(459): n is either a, c, g or t
  misc_feature (479)..(479): n is either a, c, g or t
  misc_feature (494)..(494): n is either a, c, g or t
  misc_feature (496)..(496): n is either a, c, g or t
  misc_feature (508)..(508): n is either a, c, g or t
  misc_feature (510)..(510): n is either a, c, g or t
  misc_feature (526)..(526): n is either a, c, g or t
  misc_feature (542)..(542): n is either a, c, g or t
  misc_feature (573)..(573): n is either a, c, g or t
  misc_feature (581)..(581): n is either a, c, g or t
  misc_feature (611)..(611): n is either a, c, g or t
  misc_feature (629)..(629): n is either a, c, g or t
  misc_feature (639)..(639): n is either a, c, g or t
  misc_feature (661)..(661): n is either a, c, g or t
  misc_feature (672)..(672): n is either a, c, g or t
  misc_feature (681)..(681): n is either a, c, g or t
  misc_feature (687)..(687): n is either a, c, g or t
  misc_feature (690)..(690): n is either a, c, g or t
  misc_feature (706)..(706): n is either a, c, g or t
  misc_feature (708)..(708): n is either a, c, g or t
  misc_feature (710)..(710): n is either a, c, g or t
  misc_feature (729)..(729): n is either a, c, g or t
  misc_feature (731)..(731): n is either a, c, g or t
  misc_feature (736)..(736): n is either a, c, g or t
gttgaggtgcgagacgcggagggttgtttgtgtagtggagagggtgagagtgggcgtgaaaggtgcgacggggtggggagacggtgtggtgagggacgcgtgtacgtgtgtgggtggtgtgtgtgtgtgtgtgtgtgtgtgtgtgtgtgtgtgtgtgtgtgtgtgtgtgtgtgtgtgagggagcgagcggcgtgcgtgcgaggntgcgtgtgtgtngncgcgttagatgtggtcgggtanagtgattgacggtagggttgtgtgtgagtgcgtgcggggngntgcgagcgtgagcgagancgcgtgcgcgaggtggtgcgtgcgggagaggcgatgataagcgtgcgcggngggntgtgtggntgagagcgacggtgtgcgtgtgtgtgagtncgtgcgagagcgtntagcgtngngtggagtgatgaggatgagagtgtgtgttagcgangnagtgtncgcgtgggcgcgagcgcggntggggcgcgcgaggngntgagagtgtgtngntgggtgagtgtgtgtntgagtttgagagaggnattgggcgggagtgtgtgttgcgacgatggngtgtgggncgagagtgcgtggggttgcgtgcgcgagancggtggcgtgggagtttntgcgagagantgagagttgtcgatcgcgtcgncgtcgtgcgangaggtttgntgtgtnatnagaggttggggtttgngngngggattgtgtaagtacggngngcgantgtggagagttagagttacgaggt

SEQ ID NO: 4954 - DNA, 760 bp, Artificial Sequence
  chemically treated genomic DNA (Homo sapiens) CpG-island No: 4954
  misc_feature (25)..(25): n is either a, c, g or t
  misc_feature (30)..(30): n is either a, c, g or t
  misc_feature (32)..(32): n is either a, c, g or t
  misc_feature (51)..(51): n is either a, c, g or t
  misc_feature (53)..(53): n is either a, c, g or t
  misc_feature (55)..(55): n is either a, c, g or t
  misc_feature (71)..(71): n is either a, c, g or t
  misc_feature (74)..(74): n is either a, c, g or t
  misc_feature (80)..(80): n is either a, c, g or t
  misc_feature (89)..(89): n is either a, c, g or t
  misc_feature (100)..(100): n is either a, c, g or t
  misc_feature (122)..(122): n is either a, c, g or t
  misc_feature (132)..(132): n is either a, c, g or t
  misc_feature (150)..(150): n is either a, c, g or t
  misc_feature (180)..(180): n is either a, c, g or t
  misc_feature (188)..(188): n is either a, c, g or t
  misc_feature (219)..(219): n is either a, c, g or t
  misc_feature (235)..(235): n is either a, c, g or t
  misc_feature (251)..(251): n is either a, c, g or t
  misc_feature (253)..(253): n is either a, c, g or t
  misc_feature (265)..(265): n is either a, c, g or t
  misc_feature (267)..(267): n is either a, c, g or t
  misc_feature (282)..(282): n is either a, c, g or t
  misc_feature (302)..(302): n is either a, c, g or t
  misc_feature (308)..(308): n is either a, c, g or t
  misc_feature (310)..(310): n is either a, c, g or t
  misc_feature (345)..(345): n is either a, c, g or t
  misc_feature (347)..(347): n is either a, c, g or t
  misc_feature (354)..(354): n is either a, c, g or t
  misc_feature (368)..(368): n is either a, c, g or t
  misc_feature (398)..(398): n is either a, c, g or t
  misc_feature (406)..(406): n is either a, c, g or t
  misc_feature (410)..(410): n is either a, c, g or t
  misc_feature (461)..(461): n is either a, c, g or t
  misc_feature (479)..(479): n is either a, c, g or t
  misc_feature (481)..(481): n is either a, c, g or t
  misc_feature (521)..(521): n is either a, c, g or t
  misc_feature (543)..(543): n is either a, c, g or t
  misc_feature (545)..(545): n is either a, c, g or t
  misc_feature (557)..(557): n is either a, c, g or t
acctcgtaactctaactctccacantcgcncnccgtacttacacaatcccncncncaaaccccaacctctnatnacacancaaacctcntcgcacgacgncgacgcgatcgacaactctcantctctcgcanaaactcccacgccaccgntctcgcgcacgcaaccccacgcactctcgncccacacnccatcgtcgcaacacacactcccgcccaatncctctctcaaactcanacacacactcacccancnacacactctcancncctcgcgcgccccanccgcgctcgcgcccacgcgnacactncntcgctaacacacactctcatcctcatcactccacncnacgctanacgctctcgcacgnactcacacacacgcacaccgtcgctctcanccacacancccnccgcgcacgcttatcatcgcctctcccgcacgcaccacctcgcgcacgcgntctcgctcacgctcgcancnccccgcacgcactcacacacaaccctaccgtcaatcactntacccgaccacatctaacgcgncnacacacacgcancctcgcacgcacgccgctcgctccctcacacacacacacacacacacacacacacacacacacacacacacacacacacacacacaccacccacacacgtacacgcgtccctcaccacaccgtctccccaccccgtcgcacctttcacgcccactctcaccctctccactacacaaacaaccctccgcgtctcgcacctcaac

SEQ ID NO: 4955 - DNA, 760 bp, Artificial Sequence
  chemically treated genomic DNA (Homo sapiens) CpG-island No: 4955
  misc_feature (25)..(25): n is either a, c, g or t
  misc_feature (30)..(30): n is either a, c, g or t
  misc_feature (32)..(32): n is either a, c, g or t
  misc_feature (51)..(51): n is either a, c, g or t
  misc_feature (53)..(53): n is either a, c, g or t
  misc_feature (55)..(55): n is either a, c, g or t
  misc_feature (71)..(71): n is either a, c, g or t
  misc_feature (74)..(74): n is either a, c, g or t
  misc_feature (80)..(80): n is either a, c, g or t
  misc_feature (89)..(89): n is either a, c, g or t
  misc_feature (100)..(100): n is either a, c, g or t
  misc_feature (122)..(122): n is either a, c, g or t
  misc_feature (132)..(132): n is either a, c, g or t
  misc_feature (150)..(150): n is either a, c, g or t
  misc_feature (180)..(180): n is either a, c, g or t
  misc_feature (188)..(188): n is either a, c, g or t
  misc_feature (219)..(219): n is either a, c, g or t
  misc_feature (235)..(235): n is either a, c, g or t
  misc_feature (251)..(251): n is either a, c, g or t
  misc_feature (253)..(253): n is either a, c, g or t
  misc_feature (265)..(265): n is either a, c, g or t
  misc_feature (267)..(267): n is either a, c, g or t
  misc_feature (282)..(282): n is either a, c, g or t
  misc_feature (302)..(302): n is either a, c, g or t
  misc_feature (308)..(308): n is either a, c, g or t
  misc_feature (310)..(310): n is either a, c, g or t
  misc_feature (345)..(345): n is either a, c, g or t
  misc_feature (347)..(347): n is either a, c, g or t
  misc_feature (354)..(354): n is either a, c, g or t
  misc_feature (368)..(368): n is either a, c, g or t
  misc_feature (398)..(398): n is either a, c, g or t
  misc_feature (406)..(406): n is either a, c, g or t
  misc_feature (410)..(410): n is either a, c, g or t
  misc_feature (461)..(461): n is either a, c, g or t
  misc_feature (479)..(479): n is either a, c, g or t
  misc_feature (481)..(481): n is either a, c, g or t
  misc_feature (521)..(521): n is either a, c, g or t
  misc_feature (543)..(543): n is either a, c, g or t
  misc_feature (545)..(545): n is either a, c, g or t
  misc_feature (557)..(557): n is either a, c, g or t
atttcgtggttttggttttttatantcgtntntcgtatttgtatagttttntntntaggttttagtttttngtngtatantaggttttntcgtacgacgncgacgcggtcgataatttttantttttcgtangggtttttacgttatcgntttcgcgtacgtaattttacgtattttcgntttatatnttatcgtcgtagtatatattttcgtttagtnttttttttagatttanatatatatttatttantnatatatttttantntttcgcgcgttttantcgcgttcgcgtttacgcgnatattntntcgttaatatatatttttatttttattattttatntngcgttangcgttttcgtacgngtttatatatacgtatatcgtcgtttttanttatatantttntcgcgtacgtttgttatcgtttttttcgtacgtattatttcgcgtacgcgntttcgtttacgttcgtantntttcgtacgtatttatatatagttttatcgttagttattntattcgattatatttagcgcgntngtatatacgtantttcgtacgtacgtcgttcgtttttttatatatatatatatatatatatatatatatatatatatatatatatatatatatatatattatttatatacgtgtacgcgttttttattatatcgtttttttatttcgtcgtattttttacgtttatttttattttttttattgtataaatagtttttcgcgtttcgtattttagt

SEQ ID NO: 4956 - DNA, 760 bp, Artificial Sequence
  chemically treated genomic DNA (Homo sapiens) CpG-island No: 4956
  misc_feature (204)..(204): n is either a, c, g or t
  misc_feature (216)..(216): n is either a, c, g or t
  misc_feature (218)..(218): n is either a, c, g or t
  misc_feature (240)..(240): n is either a, c, g or t
  misc_feature (280)..(280): n is either a, c, g or t
  misc_feature (282)..(282): n is either a, c, g or t
  misc_feature (300)..(300): n is either a, c, g or t
  misc_feature (351)..(351): n is either a, c, g or t
  misc_feature (355)..(355): n is either a, c, g or t
  misc_feature (363)..(363): n is either a, c, g or t
  misc_feature (393)..(393): n is either a, c, g or t
  misc_feature (407)..(407): n is either a, c, g or t
  misc_feature (414)..(414): n is either a, c, g or t
  misc_feature (416)..(416): n is either a, c, g or t
  misc_feature (451)..(451): n is either a, c, g or t
  misc_feature (453)..(453): n is either a, c, g or t
  misc_feature (459)..(459): n is either a, c, g or t
  misc_feature (479)..(479): n is either a, c, g or t
  misc_feature (494)..(494): n is either a, c, g or t
  misc_feature (496)..(496): n is either a, c, g or t
  misc_feature (508)..(508): n is either a, c, g or t
  misc_feature (510)..(510): n is either a, c, g or t
  misc_feature (526)..(526): n is either a, c, g or t
  misc_feature (542)..(542): n is either a, c, g or t
  misc_feature (573)..(573): n is either a, c, g or t
  misc_feature (581)..(581): n is either a, c, g or t
  misc_feature (611)..(611): n is either a, c, g or t
  misc_feature (629)..(629): n is either a, c, g or t
  misc_feature (639)..(639): n is either a, c, g or t
  misc_feature (661)..(661): n is either a, c, g or t
  misc_feature (672)..(672): n is either a, c, g or t
  misc_feature (681)..(681): n is either a, c, g or t
  misc_feature (687)..(687): n is either a, c, g or t
  misc_feature (690)..(690): n is either a, c, g or t
  misc_feature (706)..(706): n is either a, c, g or t
  misc_feature (708)..(708): n is either a, c, g or t
  misc_feature (710)..(710): n is either a, c, g or t
  misc_feature (729)..(729): n is either a, c, g or t
  misc_feature (731)..(731): n is either a, c, g or t
  misc_feature (736)..(736): n is either a, c, g or t
actaaaatacgaaacgcgaaaaactatttatacaataaaaaaaataaaaataaacgtaaaaaatacgacgaaataaaaaaacgatataataaaaaacgcgtacacgtatataaataatatatatatatatatatatatatatatatatatatatatatatatatatatatatatataaaaaaacgaacgacgtacgtacgaaantacgtatatacnancgcgctaaatataatcgaatanaataactaacgataaaactatatataaatacgtacgaaanantacgaacgtaaacgaaancgcgtacgcgaaataatacgtacgaaaaaaacgataacaaacgtacgcganaaantatataantaaaaacgacgatatacgtatatataaacncgtacgaaaacgcntaacgcnanataaaataataaaaataaaaatatatattaacgananaatatncgcgtaaacgcgaacgcgantaaaacgcgcgaaanantaaaaatatatnantaaataaatatatatntaaatctaaaaaaaanactaaacgaaaatatatactacgacgataanatataaancgaaaatacgtaaaattacgtacgcgaaancgataacgtaaaaacccntacgaaaaantaaaaattatcgaccgcgtcgncgtcgtacganaaaacctantatacnacnaaaaactaaaacctanananaaaactatacaaatacgananacgantataaaaaaccaaaaccacgaaat

SEQ ID NO: 4957 - DNA, 1000 bp, Artificial Sequence
  chemically treated genomic DNA (Homo sapiens) CpG-island No: 4957
  misc_feature (1)..(1): n is either a, c, g or t
  misc_feature (15)..(15): n is either a, c, g or t
  misc_feature (17)..(17): n is either a, c, g or t
  misc_feature (44)..(44): n is either a, c, g or t
  misc_feature (62)..(62): n is either a, c, g or t
  misc_feature (66)..(66): n is either a, c, g or t
  misc_feature (68)..(68): n is either a, c, g or t
  misc_feature (89)..(89): n is either a, c, g or t
  misc_feature (117)..(117): n is either a, c, g or t
  misc_feature (125)..(125): n is either a, c, g or t
  misc_feature (151)..(151): n is either a, c, g or t
  misc_feature (154)..(154): n is either a, c, g or t
  misc_feature (187)..(187): n is either a, c, g or t
  misc_feature (190)..(190): n is either a, c, g or t
  misc_feature (213)..(213): n is either a, c, g or t
  misc_feature (232)..(232): n is either a, c, g or t
  misc_feature (236)..(236): n is either a, c, g or t
  misc_feature (238)..(238): n is either a, c, g or t
  misc_feature (308)..(308): n is either a, c, g or t
  misc_feature (316)..(316): n is either a, c, g or t
  misc_feature (328)..(328): n is either a, c, g or t
  misc_feature (330)..(330): n is either a, c, g or t
  misc_feature (341)..(341): n is either a, c, g or t
  misc_feature (360)..(360): n is either a, c, g or t
  misc_feature (372)..(372): n is either a, c, g or t
  misc_feature (457)..(457): n is either a, c, g or t
  misc_feature (459)..(459): n is either a, c, g or t
  misc_feature (520)..(520): n is either a, c, g or t
  misc_feature (605)..(605): n is either a, c, g or t
  misc_feature (641)..(641): n is either a, c, g or t
  misc_feature (682)..(682): n is either a, c, g or t
  misc_feature (798)..(798): n is either a, c, g or t
ngcgcgagcgatggngngtgtgtggttcgtgtggtgtgatggantggggtgacggcgaggantgtnantgcgtgcggtgcgagaggagngcgagagttgggcgcgtagcgggtgggngggttggncgcggcgggtgtgaaggatgataggnggngtgtgagaagcgtggagacgaagtcggttgtanggntgtcgtttgcgtgtgggtggagngcgttcggtttgacgtgangggngnggtagtagtaatgtggcgagttgttgacgcggggcgtgtaggacgtattatcggagggatgggggtacgnggttgttntgtacgtcgcgngntggttacgggncgtaagtgtgtaacgcggngtgtgtataggncgtcgagtacggatatcgttgcgtgaatgggaagagcgtattgtgaagagttgtgcgggtgggttcgcgcgtttgttggttaggnanggagacgcgagacgttttttgggagcgagcgagtagttgtgtgttcgtagagaaggtgggngaagttcgtcgacgttgtgagaagcgcgagacgaagttgtggtgtgtgttgataggaaatgagattgttgcgtcgcgtaacgagngtggtgggttggcgggcgaggaagaagtggtggggngaggcggggagagttttacgcgttttgcgtaggtgttgggngaagacgacgatgttgtaaggggagaagatgcgttgtgtgggggtggtgcgtcgcgtcgtacgttatcgagcgcgcgcgtttgttgcgagagcgtgtgcgtgtagaacgcgttagngttcgttttagagtgtcgcgcgtagagagggaagagttgttgcgggaggatgagtagatagaagtttgtgcggatacgatggagagtcgagcgggagggttgttgtggagagaggtcgtacgtgttgtgcgagagagcgagaagtgtgtttgttcgttgtgttgtgttttgtcgtttcggcggagggtatgggttgtggttg

SEQ ID NO: 4958 - DNA, 1000 bp, Artificial Sequence
  chemically treated genomic DNA (Homo sapiens) CpG-island No: 4958
  misc_feature (203)..(203): n is either a, c, g or t
  misc_feature (319)..(319): n is either a, c, g or t
  misc_feature (360)..(360): n is either a, c, g or t
  misc_feature (396)..(396): n is either a, c, g or t
  misc_feature (481)..(481): n is either a, c, g or t
  misc_feature (542)..(542): n is either a, c, g or t
  misc_feature (544)..(544): n is either a, c, g or t
  misc_feature (629)..(629): n is either a, c, g or t
  misc_feature (641)..(641): n is either a, c, g or t
  misc_feature (660)..(660): n is either a, c, g or t
  misc_feature (671)..(671): n is either a, c, g or t
  misc_feature (673)..(673): n is either a, c, g or t
  misc_feature (685)..(685): n is either a, c, g or t
  misc_feature (693)..(693): n is either a, c, g or t
  misc_feature (763)..(763): n is either a, c, g or t
  misc_feature (765)..(765): n is either a, c, g or t
  misc_feature (769)..(769): n is either a, c, g or t
  misc_feature (788)..(788): n is either a, c, g or t
  misc_feature (811)..(811): n is either a, c, g or t
  misc_feature (814)..(814): n is either a, c, g or t
  misc_feature (847)..(847): n is either a, c, g or t
  misc_feature (850)..(850): n is either a, c, g or t
  misc_feature (876)..(876): n is either a, c, g or t
  misc_feature (884)..(884): n is either a, c, g or t
  misc_feature (912)..(912): n is either a, c, g or t
  misc_feature (933)..(933): n is either a, c, g or t
  misc_feature (935)..(935): n is either a, c, g or t
  misc_feature (939)..(939): n is either a, c, g or t
  misc_feature (957)..(957): n is either a, c, g or t
  misc_feature (984)..(984): n is either a, c, g or t
  misc_feature (986)..(986): n is either a, c, g or t
  misc_feature (1000)..(1000): n is either a, c, g or t
caaccacaacccataccctccgccgaaacgacaaaacacaacacaacgaacaaacacacttctcgctctctcgcacaacacgtacgacctctctccacaacaaccctcccgctcgactctccatcgtatccgcacaaacttctatctactcatcctcccgcaacaactcttccctctctacgcgcgacactctaaaacgaacnctaacgcgttctacacgcacacgctctcgcaacaaacgcgcgcgctcgataacgtacgacgcgacgcaccacccccacacaacgcatcttctccccttacaacatcgtcgtcttcncccaacacctacgcaaaacgcgtaaaactctccccgcctcnccccaccacttcttcctcgcccgccaacccaccacnctcgttacgcgacgcaacaatctcatttcctatcaacacacaccacaacttcgtctcgcgcttctcacaacgtcgacgaacttcncccaccttctctacgaacacacaactactcgctcgctcccaaaaaacgtctcgcgtctccntncctaaccaacaaacgcgcgaacccacccgcacaactcttcacaatacgctcttcccattcacgcaacgatatccgtactcgacgncctatacacacnccgcgttacacacttacgncccgtaaccancncgcgacgtacanaacaaccncgtacccccatccctccgataatacgtcctacacgccccgcgtcaacaactcgccacattactactaccncncccntcacgtcaaaccgaacgcnctccacccacacgcaaacgacanccntacaaccgacttcgtctccacgcttctcacacnccncctatcatccttcacacccgccgcgnccaacccncccacccgctacgcgcccaactctcgcnctcctctcgcaccgcacgcantnacantcctcgccgtcaccccantccatcacaccacacgaaccacacacncnccatcgctcgcgcn

SEQ ID NO: 4959 - DNA, 1000 bp, Artificial Sequence
  chemically treated genomic DNA (Homo sapiens) CpG-island No: 4959
  misc_feature (203)..(203): n is either a, c, g or t
  misc_feature (319)..(319): n is either a, c, g or t
  misc_feature (360)..(360): n is either a, c, g or t
  misc_feature (396)..(396): n is either a, c, g or t
  misc_feature (481)..(481): n is either a, c, g or t
  misc_feature (542)..(542): n is either a, c, g or t
  misc_feature (544)..(544): n is either a, c, g or t
  misc_feature (629)..(629): n is either a, c, g or t
  misc_feature (641)..(641): n is either a, c, g or t
  misc_feature (660)..(660): n is either a, c, g or t
  misc_feature (671)..(671): n is either a, c, g or t
  misc_feature (673)..(673): n is either a, c, g or t
  misc_feature (685)..(685): n is either a, c, g or t
  misc_feature (693)..(693): n is either a, c, g or t
  misc_feature (763)..(763): n is either a, c, g or t
  misc_feature (765)..(765): n is either a, c, g or t
  misc_feature (769)..(769): n is either a, c, g or t
  misc_feature (788)..(788): n is either a, c, g or t
  misc_feature (811)..(811): n is either a, c, g or t
  misc_feature (814)..(814): n is either a, c, g or t
  misc_feature (847)..(847): n is either a, c, g or t
  misc_feature (850)..(850): n is either a, c, g or t
  misc_feature (876)..(876): n is either a, c, g or t
  misc_feature (884)..(884): n is either a, c, g or t
  misc_feature (912)..(912): n is either a, c, g or t
  misc_feature (933)..(933): n is either a, c, g or t
  misc_feature (935)..(935): n is either a, c, g or t
  misc_feature (939)..(939): n is either a, c, g or t
  misc_feature (957)..(957): n is either a, c, g or t
  misc_feature (984)..(984): n is either a, c, g or t
  misc_feature (986)..(986): n is either a, c, g or t
  misc_feature (1000)..(1000): n is either a, c, g or t
taattatagtttatatttttcgtcggagcgataaaatataatatagcgggtaggtatatttttcgttttttcgtatagtacgtgcgatttttttttatagtagttttttcgttcgattttttatcgtgttcgtataaatttttgtttgtttattttttcgtagtaatttttttttttttgcgcgcgatattttaggacggatnttggcgcgttttatacgtatacgttttcgtaataggcgcgcgcgttcggtgacgtgcggcgcggcgtattatttttatataacgtattttttttttttataatatcgtcgtttttntttagtatttacgtagggcgcgtggggtttttttcgttttnttttattatttttttttcgttcgttaatttattatnttcgttgcgcggcgtagtagttttattttttgttaatatatattatagtttcgtttcgcgttttttataacgtcggcgggttttntttattttttttacgagtatataattattcgttcgtttttagagggcgtttcgcgtttttntntttggttaatagacgcgcgggtttattcgtataattttttataatacgttttttttatttacgtagcggtgttcgtgttcggcgntttgtgtatatntcgcgttgtatatttgcgnttcgtggttantncgcgacgtatanaataattncgtgtttttattttttcggtggtgcgttttatacgtttcgcgttagtaattcgttatattgttgttattntntttnttacgttaggtcgagcgtnttttatttatacgtaggcggtanttntatagtcgatttcgtttttacgttttttatatnttntttgttattttttatattcgtcgcgnttagtttntttattcgttgcgcgtttagttttcgtntttttttcgtatcgtacgtantngtanttttcgtcgttattttantttattatattatacgagttatatatntnttatcgttcgcgtn

SEQ ID NO: 4960 - DNA, 1000 bp, Artificial Sequence
  chemically treated genomic DNA (Homo sapiens) CpG-island No: 4960
  misc_feature (1)..(1): n is either a, c, g or t
  misc_feature (15)..(15): n is either a, c, g or t
  misc_feature (17)..(17): n is either a, c, g or t
  misc_feature (44)..(44): n is either a, c, g or t
  misc_feature (62)..(62): n is either a, c, g or t
  misc_feature (66)..(66): n is either a, c, g or t
  misc_feature (68)..(68): n is either a, c, g or t
  misc_feature (89)..(89): n is either a, c, g or t
  misc_feature (117)..(117): n is either a, c, g or t
  misc_feature (125)..(125): n is either a, c, g or t
  misc_feature (151)..(151): n is either a, c, g or t
  misc_feature (154)..(154): n is either a, c, g or t
  misc_feature (187)..(187): n is either a, c, g or t
  misc_feature (190)..(190): n is either a, c, g or t
  misc_feature (213)..(213): n is either a, c, g or t
  misc_feature (232)..(232): n is either a, c, g or t
  misc_feature (236)..(236): n is either a, c, g or t
  misc_feature (238)..(238): n is either a, c, g or t
  misc_feature (308)..(308): n is either a, c, g or t
  misc_feature (316)..(316): n is either a, c, g or t
  misc_feature (328)..(328): n is either a, c, g or t
  misc_feature (330)..(330): n is either a, c, g or t
  misc_feature (341)..(341): n is either a, c, g or t
  misc_feature (360)..(360): n is either a, c, g or t
  misc_feature (372)..(372): n is either a, c, g or t
  misc_feature (457)..(457): n is either a, c, g or t
  misc_feature (459)..(459): n is either a, c, g or t
  misc_feature (520)..(520): n is either a, c, g or t
  misc_feature (605)..(605): n is either a, c, g or t
  misc_feature (641)..(641): n is either a, c, g or t
  misc_feature (682)..(682): n is either a, c, g or t
  misc_feature (798)..(798): n is either a, c, g or t
nacgcgaacgataananatatataactcgtataatataataaantaaaataacgacgaaaantacnantacgtacgatacgaaaaaaanacgaaaactaaacgcgcaacgaataaanaaactaancgcgacgaatataaaaaataacaaanaanatataaaaaacgtaaaaacgaaatcgactatanaantaccgcctacgtataaataaaanacgctcgacctaacgtaanaaananaataacaacaatataacgaattactaacgcgaaacgtataaaacgcaccaccgaaaaaataaaaacacgnaattattntatacgtcgcgnantaaccacgaancgcaaatatacaacgcganatatacacaaancgccgaacacgaacaccgctacgtaaataaaaaaaacgtattataaaaaattatacgaataaacccgcgcgtctattaaccaaananaaaaacgcgaaacgccctctaaaaacgaacgaataattatatactcgtaaaaaaaataaanaaaacccgccgacgttataaaaaacgcgaaacgaaactataatatatattaacaaaaaataaaactactacgccgcgcaacgaanataataaattaacgaacgaaaaaaaaataataaaanaaaacgaaaaaaaccccacgcgccctacgtaaatactaaanaaaaacgacgatattataaaaaaaaaaaatacgttatataaaaataatacgccgcgccgcacgtcaccgaacgcgcgcgcctattacgaaaacgtatacgtataaaacgcgccaanatccgtcctaaaatatcgcgcgcaaaaaaaaaaaaattactacgaaaaaataaacaaacaaaaatttatacgaacacgataaaaaatcgaacgaaaaaactactataaaaaaaaatcgcacgtactatacgaaaaaacgaaaaatatacctacccgctatattatattttatcgctccgacgaaaaatataaactataatta

SEQ ID NO: 4961 - DNA, 803 bp, Artificial Sequence
  chemically treated genomic DNA (Homo sapiens) CpG-island No: 4961
atttttagcgttttatttttttcgtaaaagtggcgttttcgttttttcggtttaggtatattcgttcggggttcgtacgttcggtttagatattagcgcggtggagagtatcgggtggggttttcgaagggtgaggttcggaggcgtcgcggagggggggttttttagagaggagggggcgttgcgggaaggtttttaagggaggttgcgtttaattttcgacgttttgtatttagttcggcgcggcgcgtttagtcgttttttcggatttttttcggggcgcgggagtttagcggcgcgtttagtttttatttatggtggtgatgatcgtgatcgtaaagtagaaggagtcggcgaatttttattggacgtcggcgcggtgcggtttcgattgtaggattattagttttagttgtcggtagttttcgttgttgatgttgtatttttttttgattcggattttttcggttttgagtttttttttttcgcgtatttcgtggttcgattcgagggcgtcgaatacggcggcgtttattagtaggtaggtgaaggtgtagacgatgagggatagagttcgtacgttttgtttttttatggtcgttagtaaggagtcggcgcggggggtatgtttcgtaggtttatagtcgcgcgcgttttattgtagcgttcggcggtcgtcgtcgttttttttttcgtcgtcgtcgtcgtcgtttttaagttgtaagcggcggcggtagtagtagtagtagtagcggggaggcggggggcggggaggttggggggggtttttttcgttggggtcg

SEQ ID NO: 4962 - DNA, 803 bp, Artificial Sequence
  chemically treated genomic DNA (Homo sapiens) CpG-island No: 4962
cgaccccaacgaaaaaaaccccccccaacctccccgccccccgcctccccgctactactactactactaccgccgccgcttacaacttaaaaacgacgacgacgacgacgaaaaaaaaaacgacgacgaccgccgaacgctacaataaaacgcgcgcgactataaacctacgaaacataccccccgcgccgactccttactaacgaccataaaaaaacaaaacgtacgaactctatccctcatcgtctacaccttcacctacctactaataaacgccgccgtattcgacgccctcgaatcgaaccacgaaatacgcgaaaaaaaaaaactcaaaaccgaaaaaatccgaatcaaaaaaaaatacaacatcaacaacgaaaactaccgacaactaaaactaataatcctacaatcgaaaccgcaccgcgccgacgtccaataaaaattcgccgactccttctactttacgatcacgatcatcaccaccataaataaaaactaaacgcgccgctaaactcccgcgccccgaaaaaaatccgaaaaaacgactaaacgcgccgcgccgaactaaatacaaaacgtcgaaaattaaacgcaacctcccttaaaaaccttcccgcaacgccccctcctctctaaaaaaccccccctccgcgacgcctccgaacctcacccttcgaaaaccccacccgatactctccaccgcgctaatatctaaaccgaacgtacgaaccccgaacgaatatacctaaaccgaaaaaacgaaaacgccacttttacgaaaaaaataaaacgctaaaaat

SEQ ID NO: 4963 - DNA, 803 bp, Artificial Sequence
  chemically treated genomic DNA (Homo sapiens) CpG-island No: 4963
cggttttagcggagggggttttttttagttttttcgtttttcgttttttcgttgttgttgttgttgttgtcgtcgtcgtttataatttggaggcggcggcggcggcggcggaggaggaggcggcggcggtcgtcgggcgttgtagtgggacgcgcgcggttgtgagtttgcgggatatgtttttcgcgtcggttttttgttggcggttatgaagaggtagaacgtgcggattttgttttttatcgtttgtatttttatttatttgttggtgggcgtcgtcgtgttcgacgttttcgagtcggattacgagatgcgcgaggaggagaaatttaaagtcgaggagattcggattaaggggaagtataatattagtagcgaggattatcggtagttggagttggtgattttgtagtcggaatcgtatcgcgtcggcgtttagtggaaattcgtcggttttttttattttgcgattacggttattattattataggtaagggttgggcgcgtcgttgggttttcgcgtttcgggaggagttcggggaggcggttgagcgcgtcgcgtcgggttgggtgtagggcgtcgagggttaaacgtagttttttttgggggttttttcgtagcgtttttttttttttagggagtttttttttcgcggcgttttcgagttttatttttcggggattttattcggtgttttttatcgcgttggtgtttgggtcgggcgtgcgagtttcgagcgagtgtgtttgagtcgggagggcggaggcgttatttttgcgaagagagtggagcgttaagaat

SEQ ID NO: 4964 - DNA, 803 bp, Artificial Sequence
  chemically treated genomic DNA (Homo sapiens) CpG-island No: 4964
attcttaacgctccactctcttcgcaaaaataacgcctccgccctcccgactcaaacacactcgctcgaaactcgcacgcccgacccaaacaccaacgcgataaaaaacaccgaataaaatccccgaaaaataaaactcgaaaacgccgcgaaaaaaaaactccctaaaaaaaaaaaaacgctacgaaaaaacccccaaaaaaaactacgtttaaccctcgacgccctacacccaacccgacgcgacgcgctcaaccgcctccccgaactcctcccgaaacgcgaaaacccaacgacgcgcccaacccttacctataataataataaccgtaatcgcaaaataaaaaaaaccgacgaatttccactaaacgccgacgcgatacgattccgactacaaaatcaccaactccaactaccgataatcctcgctactaatattatacttccccttaatccgaatctcctcgactttaaatttctcctcctcgcgcatctcgtaatccgactcgaaaacgtcgaacacgacgacgcccaccaacaaataaataaaaatacaaacgataaaaaacaaaatccgcacgttctacctcttcataaccgccaacaaaaaaccgacgcgaaaaacatatcccgcaaactcacaaccgcgcgcgtcccactacaacgcccgacgaccgccgccgcctcctcctccgccgccgccgccgccgcctccaaattataaacgacgacgacaacaacaacaacaacaacgaaaaaacgaaaaacgaaaaaactaaaaaaaaccccctccgctaaaaccg

SEQ ID NO: 4965 - DNA, 669 bp, Artificial Sequence
  chemically treated genomic DNA (Homo sapiens) CpG-island No: 4965
  misc_feature (99)..(99): n is either a, c, g or t
  misc_feature (116)..(116): n is either a, c, g or t
  misc_feature (164)..(164): n is either a, c, g or t
  misc_feature (182)..(182): n is either a, c, g or t
  misc_feature (187)..(187): n is either a, c, g or t
  misc_feature (227)..(227): n is either a, c, g or t
  misc_feature (266)..(266): n is either a, c, g or t
  misc_feature (270)..(270): n is either a, c, g or t
  misc_feature (276)..(276): n is either a, c, g or t
  misc_feature (314)..(314): n is either a, c, g or t
  misc_feature (318)..(318): n is either a, c, g or t
  misc_feature (327)..(327): n is either a, c, g or t
  misc_feature (344)..(344): n is either a, c, g or t
ggacgaatcgggttattattgcgattttatttagtagttgaggttttaaggaatagttttaattttttttgggatattaattcgtgtattcgttagagnatcgaggcgagaacgtntcgagaatcgtttagacgcgttcggaattgcgttttggattttttttntagcgatcgcgtagtttnttggngcgttttttggcgttattgttcgtttcgtatcgcgttcgncgtttcgcgttaggtttcgtttgggattatgggtgggtntatngtcggntgcgtttcggttaatgcggcggttgcgtagagatcggntttngtttttgangtcgcgcgtacgtcggngggcgggaacggtgcgcgtaatttttcgggttaataattgagtagcgcgcgggattcgggtggggaagttggagttgttgcggggttcgcggggaagttttggcggtggagttatggtcggttagttgagcgagggggttattgcggtgaggaggtatcgggggttgggtcggcggttcggggtggttgcggtttcgagtttcgcggagtagagagggggaggggagttcggggcgacgggggatgaacgcgaggggaggagatggcggggggaggtgggaaattcgtcgggcgtttttttagtgttatcgttttttttttaaag

SEQ ID NO: 4966 - DNA, 669 bp, Artificial Sequence
  chemically treated genomic DNA (Homo sapiens) CpG-island No: 4966
  misc_feature (326)..(326): n is either a, c, g or t
  misc_feature (343)..(343): n is either a, c, g or t
  misc_feature (352)..(352): n is either a, c, g or t
  misc_feature (356)..(356): n is either a, c, g or t
  misc_feature (394)..(394): n is either a, c, g or t
  misc_feature (400)..(400): n is either a, c, g or t
  misc_feature (404)..(404): n is either a, c, g or t
  misc_feature (443)..(443): n is either a, c, g or t
  misc_feature (483)..(483): n is either a, c, g or t
  misc_feature (488)..(488): n is either a, c, g or t
  misc_feature (506)..(506): n is either a, c, g or t
  misc_feature (554)..(554): n is either a, c, g or t
  misc_feature (571)..(571): n is either a, c, g or t
ctttaaaaaaaaaacgataacactaaaaaaacgcccgacgaatttcccacctccccccgccatctcctcccctcgcgttcatcccccgtcgccccgaactcccctccccctctctactccgcgaaactcgaaaccgcaaccaccccgaaccgccgacccaacccccgatacctcctcaccgcaataaccccctcgctcaactaaccgaccataactccaccgccaaaacttccccgcgaaccccgcaacaactccaacttccccacccgaatcccgcgcgctactcaattattaacccgaaaaattacgcgcaccgttcccgcccnccgacgtacgcgcgacntcaaaaacnaaanccgatctctacgcaaccgccgcattaaccgaaacgcanccgacnatanacccacccataatcccaaacgaaacctaacgcgaaacgncgaacgcgatacgaaacgaacaataacgccaaaaaacgcnccaanaaactacgcgatcgctanaaaaaaaatccaaaacgcaattccgaacgcgtctaaacgattctcganacgttctcgcctcgatnctctaacgaatacacgaattaatatcccaaaaaaaattaaaactattccttaaaacctcaactactaaataaaatcgcaataataacccgattcgtcc

SEQ ID NO: 4967 - DNA, 669 bp, Artificial Sequence
  chemically treated genomic DNA (Homo sapiens) CpG-island No: 4967
  misc_feature (326)..(326): n is either a, c, g or t
  misc_feature (343)..(343): n is either a, c, g or t
  misc_feature (352)..(352): n is either a, c, g or t
  misc_feature (356)..(356): n is either a, c, g or t
  misc_feature (394)..(394): n is either a, c, g or t
  misc_feature (400)..(400): n is either a, c, g or t
  misc_feature (404)..(404): n is either a, c, g or t
  misc_feature (443)..(443): n is either a, c, g or t
  misc_feature (483)..(483): n is either a, c, g or t
  misc_feature (488)..(488): n is either a, c, g or t
  misc_feature (506)..(506): n is either a, c, g or t
  misc_feature (554)..(554): n is either a, c, g or t
  misc_feature (571)..(571): n is either a, c, g or t
ttttgaggagggggcgatgatattagagggacgttcggcgggttttttattttttttcgttatttttttttttcgcgtttatttttcgtcgtttcgggtttttttttttttttttatttcgcgaggttcggggtcgtagttatttcggatcgtcggtttagttttcggtatttttttatcgtaatggttttttcgtttagttggtcgattatggttttatcgttaagattttttcgcggatttcgtaatagttttagtttttttattcgggtttcgcgcgttgtttagttattggttcgagaagttgcgcgtatcgttttcgtttntcgacgtgcgcgcggtnttaggggtngggntcggtttttacgtagtcgtcgtattggtcgaggcgtantcgatngtgnatttatttatggttttaagcgaggtttggcgcgggacgncggacgcggtgcggggcggatagtggcgttaaggggcgtnttagngagttgcgcggtcgttgnggagggagtttagggcgtagtttcgggcgcgtttgagcggttttcgangcgttttcgtttcggtnttttggcgagtgtacgggttggtattttagaggaggttaaagttgttttttgagattttagttgttaaatagagtcgtagtagtgattcgattcgttt

SEQ ID NO: 4968 - DNA, 669 bp, Artificial Sequence
  chemically treated genomic DNA (Homo sapiens) CpG-island No: 4968
  misc_feature (99)..(99): n is either a, c, g or t
  misc_feature (116)..(116): n is either a, c, g or t
  misc_feature (164)..(164): n is either a, c, g or t
  misc_feature (182)..(182): n is either a, c, g or t
  misc_feature (187)..(187): n is either a, c, g or t
  misc_feature (227)..(227): n is either a, c, g or t
  misc_feature (266)..(266): n is either a, c, g or t
  misc_feature (270)..(270): n is either a, c, g or t
  misc_feature (276)..(276): n is either a, c, g or t
  misc_feature (314)..(314): n is either a, c, g or t
  misc_feature (318)..(318): n is either a, c, g or t
  misc_feature (327)..(327): n is either a, c, g or t
  misc_feature (344)..(344): n is either a, c, g or t
aaacgaatcgaatcactactacgactctatttaacaactaaaatctcaaaaaacaactttaacctcctctaaaataccaacccgtacactcgccaaaanaccgaaacgaaaacgcntcgaaaaccgctcaaacgcgcccgaaactacgccctaaactccctccncaacgaccgcgcaactcnctaanacgccccttaacgccactatccgccccgcaccgcgtccgncgtcccgcgccaaacctcgcttaaaaccataaataaatncacnatcgantacgcctcgaccaatacgacgactacgtaaaaaccgancccnacccctaanaccgcgcgcacgtcganaaacgaaaacgatacgcgcaacttctcgaaccaataactaaacaacgcgcgaaacccgaataaaaaaactaaaactattacgaaatccgcgaaaaaatcttaacgataaaaccataatcgaccaactaaacgaaaaaaccattacgataaaaaaataccgaaaactaaaccgacgatccgaaataactacgaccccgaacctcgcgaaataaaaaaaaaaaaaaaaacccgaaacgacgaaaaataaacgcgaaaaaaaaaaataacgaaaaaaaataaaaaacccgccgaacgtccctctaatatcatcgccccctcctcaaaa

SEQ ID NO: 4969 - DNA, 617 bp, Artificial Sequence
  chemically treated genomic DNA (Homo sapiens) CpG-island No: 4969
gaaaagggcggtggtttagtaatgagggggtcggggttggcgatttaggggtcgggttgggtgtaagcggcgtggttggtaatgagtgggtggtgttgcggagtaggtggaattggggaggaaggggcgtggttggtattgagggggcggggttacgaagaaggagaagttggggagaaaacgcgcgtggttggtattaagggtcggggttagggaggaggaggagttggggaggaagcggcgaggttggtaatgagggggcggggttagggaggaggcggagttggggaggaagcggcgaggttggtaatgagggggcggggttagggaggaggcggagttggggaggaagcggcgtggttggtaatgagggggcggggttagggaggaggcggagttggggaggaagcggcgtggttggtaatgacggggcggggttagggaggaggcggagttggggaggaagcggcgtggttggtaatgagggggcggggttagggaggaggcggagttggggaggaagcggcgtggttggttagtaggggacggtttggggaggagggttcgagggttcgagggtttaggtggaggcggggcgtttatttatttagtagtag

SEQ ID NO: 4970 - DNA, 617 bp, Artificial Sequence
  chemically treated genomic DNA (Homo sapiens) CpG-island No: 4970
ctactactaaataaataaacgccccgcctccacctaaaccctcgaaccctcgaaccctcctccccaaaccgtcccctactaaccaaccacgccgcttcctccccaactccgcctcctccctaaccccgccccctcattaccaaccacgccgcttcctccccaactccgcctcctccctaaccccgccccgtcattaccaaccacgccgcttcctccccaactccgcctcctccctaaccccgccccctcattaccaaccacgccgcttcctccccaactccgcctcctccctaaccccgccccctcattaccaacctcgccgcttcctccccaactccgcctcctccctaaccccgccccctcattaccaacctcgccgcttcctccccaactcctcctcctccctaaccccgacccttaataccaaccacgcgcgttttctccccaacttctccttcttcgtaaccccgccccctcaataccaaccacgccccttcctccccaattccacctactccgcaacaccacccactcattaccaaccacgccgcttacacccaacccgacccctaaatcgccaaccccgaccccctcattactaaaccaccgcccttttc

SEQ ID NO: 4971 - DNA, 617 bp, Artificial Sequence
  chemically treated genomic DNA (Homo sapiens) CpG-island No: 4971
ttgttgttgggtgagtgagcgtttcgtttttatttggattttcggattttcggatttttttttttaggtcgttttttgttaattagttacgtcgttttttttttagtttcgttttttttttaatttcgtttttttattattagttacgtcgttttttttttagtttcgttttttttttaatttcgtttcgttattattagttacgtcgttttttttttagtttcgttttttttttaatttcgtttttttattattagttacgtcgttttttttttagtttcgttttttttttaatttcgtttttttattattagtttcgtcgttttttttttagtttcgttttttttttaatttcgtttttttattattagtttcgtcgttttttttttagtttttttttttttttaatttcggtttttagtattagttacgcgcgttttttttttagttttttttttttcgtaatttcgtttttttagtattagttacgtttttttttttttagttttatttgtttcgtaatattatttatttattattagttacgtcgtttgtatttaattcggtttttggatcgttaatttcggtttttttattattaagttatcgtttttttt

SEQ ID NO: 4972 - DNA, 617 bp, Artificial Sequence
  chemically treated genomic DNA (Homo sapiens) CpG-island No: 4972
aaaaaaaacgataacttaataataaaaaaaccgaaattaacgatccaaaaaccgaattaaatacaaacgacgtaactaataataaataaataatattacgaaacaaataaaactaaaaaaaaaaaaacgtaactaatactaaaaaaacgaaattacgaaaaaaaaaaaactaaaaaaaaaacgcgcgtaactaatactaaaaaccgaaattaaaaaaaaaaaaaaactaaaaaaaaaacgacgaaactaataataaaaaaacgaaattaaaaaaaaaacgaaactaaaaaaaaaacgacgaaactaataataaaaaaacgaaattaaaaaaaaaacgaaactaaaaaaaaaacgacgtaactaataataaaaaaacgaaattaaaaaaaaaacgaaactaaaaaaaaaacgacgtaactaataataacgaaacgaaattaaaaaaaaaacgaaactaaaaaaaaaacgacgtaactaataataaaaaaacgaaattaaaaaaaaaacgaaactaaaaaaaaaacgacgtaactaattaacaaaaaacgacctaaaaaaaaaaatccgaaaatccgaaaatccaaataaaaacgaaacgctcactcacccaacaacaa

SEQ ID NO: 4973 - DNA, 1183 bp, Artificial Sequence
  chemically treated genomic DNA (Homo sapiens) CpG-island No: 4973
gtttgttcgggggggggcggttttaggcggttatttgtatgatacgattcgttttagttttttttaattatttgagtaacggtcgttgtttcggggtgttttcgggttttttttttacgttttaggcggtggtgggagttgtcggcggcggcggtatttatcggttgcgcggttaggtttttttgttagcgcggtgtaagggaggagttgaagggaggagtaaaggggtatcgtttttttcgcgtcgttacgtattcgtttgattggtttagtttatttttttagcgcgattttattagtttttgcgagcggtatttcggtagtatcggcgcgttatttgtatatttgtgttcgcgtcgttgattggttcgggcgcggaggggcggtcgtgatcgtcgtcgtttttgtcgcggttttagtcgcgtcgggttgtttaagagggagcgtttttttcgtcgtttttttttttttttggcgcggttcgatttagggcggagggcggtgcgaggcggggtcgttgtttcgttttaatatggtttcgtcgcgtcgtcgatttaatcgttggcgcggttattttcggagttttgggcggtttcggggcggggaaggtttggggtcgggcgttttttggtcggagcgcggggtagtgtagtggttcgggttttttcggtagtttcgtcgcggtcgttacgttaggtcgcgtttttacggcggttttttttttcgcgtcgttcgtttcgcggtttcgtcgttacgttaggtttcggtagggtacgttttagtcgcgagttgattagtggcggggtcggcgtagaggttatttatatgtagggtatttttcgggtagttcgggttcgtcgaggaagggcgagagtttttaaagacgttttttttaaggagtcgtggatttagttttacgtttttttttcgcgcggagattcgggtgttacgcgttcgtgttgtagaatcgggagtacggagcgtgtcgcgatgatgttgcgattgagtttaggtgttagtatttgtagtagtcggcgttcgtcgcggagatttagttttacgtcgcgagttaggggagagcgcgtatttagtttgcggttgtaattttgttttttcgaggtttaggttttcgttttttattgtatagttacgaagggagagaaaaataaacgtaagaatttaa

SEQ ID NO: 4974 - DNA, 1183 bp, Artificial Sequence
  chemically treated genomic DNA (Homo sapiens) CpG-island No: 4974
ttaaattcttacgtttatttttctctcccttcgtaactatacaataaaaaacgaaaacctaaacctcgaaaaaacaaaattacaaccgcaaactaaatacgcgctctcccctaactcgcgacgtaaaactaaatctccgcgacgaacgccgactactacaaatactaacacctaaactcaatcgcaacatcatcgcgacacgctccgtactcccgattctacaacacgaacgcgtaacacccgaatctccgcgcgaaaaaaaaacgtaaaactaaatccacgactccttaaaaaaaacgtctttaaaaactctcgcccttcctcgacgaacccgaactacccgaaaaataccctacatataaataacctctacgccgaccccgccactaatcaactcgcgactaaaacgtaccctaccgaaacctaacgtaacgacgaaaccgcgaaacgaacgacgcgaaaaaaaaaaccgccgtaaaaacgcgacctaacgtaacgaccgcgacgaaactaccgaaaaaacccgaaccactacactaccccgcgctccgaccaaaaaacgcccgaccccaaaccttccccgccccgaaaccgcccaaaactccgaaaataaccgcgccaacgattaaatcgacgacgcgacgaaaccatattaaaacgaaacaacgaccccgcctcgcaccgccctccgccctaaatcgaaccgcgccaaaaaaaaaaaaaaacgacgaaaaaaacgctccctcttaaacaacccgacgcgactaaaaccgcgacaaaaacgacgacgatcacgaccgcccctccgcgcccgaaccaatcaacgacgcgaacacaaatatacaaataacgcgccgatactaccgaaataccgctcgcaaaaactaataaaatcgcgctaaaaaaataaactaaaccaatcaaacgaatacgtaacgacgcgaaaaaaacgatacccctttactcctcccttcaactcctcccttacaccgcgctaacaaaaaaacctaaccgcgcaaccgataaataccgccgccgccgacaactcccaccaccgcctaaaacgtaaaaaaaaaacccgaaaacaccccgaaacaacgaccgttactcaaataattaaaaaaaactaaaacgaatcgtatcatacaaataaccgcctaaaaccgcccccccccgaacaaac

SEQ ID NO: 4975 - DNA, 1183 bp, Artificial Sequence
  chemically treated genomic DNA (Homo sapiens) CpG-island No: 4975
ttaaatttttgcgtttattttttttttttttcgtaattgtgtaatggagaacgggagtttgagtttcgggaagatagggttgtaatcgtaggttaggtgcgcgtttttttttagttcgcggcgtggagttgggttttcgcggcgggcgtcggttattgtaggtgttggtatttgggtttaatcgtagtattatcgcgatacgtttcgtgttttcgattttatagtacgggcgcgtgatattcgggttttcgcgcgaaaggagaacgtgggattaaatttacggttttttaagaaggacgtttttggaaattttcgttttttttcggcggattcgagttgttcgagagatgttttgtatgtgagtgatttttgcgtcgatttcgttattggttagttcgcggttggggcgtgttttgtcggggtttgacgtggcggcggggtcgcggggcgggcggcgcgaggggagaggtcgtcgtgagggcgcggtttgacgtggcggtcgcggcggggttgtcgggggagttcggattattgtattgtttcgcgtttcggttagagggcgttcggttttaagtttttttcgtttcgaggtcgtttagggtttcgggagtaatcgcgttagcgattgggtcggcggcgcggcggggttatgttggagcggagtaacgatttcgtttcgtatcgtttttcgttttgggtcgggtcgcgttaggagggaaggggagcggcgaaggggacgtttttttttaggtagttcgacgcggttggagtcgcggtaggagcggcggcggttacgatcgttttttcgcgttcgggttaattagcggcgcgggtataaatatgtaaatagcgcgtcggtgttgtcggagtgtcgttcgtaggggttggtggggtcgcgttgggggagtgaattgggttaattaggcgggtgcgtggcggcgcgggggaagcggtgtttttttatttttttttttaattttttttttgtatcgcgttgataggggggtttggtcgcgtagtcggtaaatgtcgtcgtcgtcggtagtttttattatcgtttggggcgtggggaggaaattcgggggtatttcggggtaacggtcgttgtttaaatggttgggagaagttggagcgggtcgtgttatataggtggtcgtttgaggtcgttttttttcgggtaagt

SEQ ID NO: 4976 - DNA, 1183 bp, Artificial Sequence
  chemically treated genomic DNA (Homo sapiens) CpG-island No: 4976
acttacccgaaaaaaaacgacctcaaacgaccacctatataacacgacccgctccaacttctcccaaccatttaaacaacgaccgttaccccgaaatacccccgaatttcctccccacgccccaaacgataataaaaactaccgacgacgacgacatttaccgactacgcgaccaaacccccctatcaacgcgatacaaaaaaaaaattaaaaaaaaaaataaaaaaacaccgcttcccccgcgccgccacgcacccgcctaattaacccaattcactcccccaacgcgaccccaccaacccctacgaacgacactccgacaacaccgacgcgctatttacatatttatacccgcgccgctaattaacccgaacgcgaaaaaacgatcgtaaccgccgccgctcctaccgcgactccaaccgcgtcgaactacctaaaaaaaaacgtccccttcgccgctccccttccctcctaacgcgacccgacccaaaacgaaaaacgatacgaaacgaaatcgttactccgctccaacataaccccgccgcgccgccgacccaatcgctaacgcgattactcccgaaaccctaaacgacctcgaaacgaaaaaaacttaaaaccgaacgccctctaaccgaaacgcgaaacaatacaataatccgaactcccccgacaaccccgccgcgaccgccacgtcaaaccgcgccctcacgacgacctctcccctcgcgccgcccgccccgcgaccccgccgccacgtcaaaccccgacaaaacacgccccaaccgcgaactaaccaataacgaaatcgacgcaaaaatcactcacatacaaaacatctctcgaacaactcgaatccgccgaaaaaaaacgaaaatttccaaaaacgtccttcttaaaaaaccgtaaatttaatcccacgttctcctttcgcgcgaaaacccgaatatcacgcgcccgtactataaaatcgaaaacacgaaacgtatcgcgataatactacgattaaacccaaataccaacacctacaataaccgacgcccgccgcgaaaacccaactccacgccgcgaactaaaaaaaaacgcgcacctaacctacgattacaaccctatcttcccgaaactcaaactcccgttctccattacacaattacgaaaaaaaaaaaaaataaacgcaaaaatttaa

SEQ ID NO: 4977 - DNA, 1028 bp, Artificial Sequence
  chemically treated genomic DNA (Homo sapiens) CpG-island No: 4977
ggcggcggggataaaaattttcggcggcgagggtaaaaagtcgcggtggtaaaaagcggcggcgatcggggtaaaaagtcgcggtagtaaaaagtcgcggcggcggggataaaaagtcgttgcggcgggggtaaaaggcggcggtaatagcggtaaaaagtcgcgggcgtaaaaagcggcggtaatagcggcgtcggtaaaaagtcgcggcgaggaaaaagtcgttgcggcgggggggtaaaaagttgtgatagcggggggtaaaaagtcgcggcgggtaaaacgtcgtggcgggtaaaaagtcgcggcgggtaaaaagttacggcggcggtggggtaaaaattagcgtcggtggcggcgggggggtagaaagtcgcggcggtagaaagtcgcggcggtaaaaagttacggcggcgagggtgtaaaaagttgtgtcggcggtggggtaaaaagtttggtcgggtaaaaagtcgcggtcgcggcggggggtaaaaagtcgaggcgggtaaaaagtcgaggtagggtgggggtaaaaagtcgcggcggcggaggggtaaaaagtcgcggcggcgggttagggtagaaagtcgtagcgggtaaaaagtcgaggcggggtgggggtaaaaagtcgcggcggcgggtgggtggtagaaagtcgcggcgggtaaaaagtcgcgggggtagggtggaaaaagttaaggcggtgataaagtcgcggcggcgggggggggggataaagttttggcgggtaaaaagttagggcggtaaaattcgtagcggtgaagagttaaaaatttgcggtggttaaaaagttttagcgttgagggggtaaaaagtcgtagcgtataaaaagtcgaggcgcggtggggggagaaagtcgtcgcgacggggcgggaaaaattcgcggcggcgggggggtaaaaagtcgcggcggcggggggcgaaataatggagatggggtagaaggtcggtatagtttggtattgttggagtggatgtgataggaaatgtgtagttaaagataaaaa

SEQ ID NO: 4978 - DNA, 1028 bp, Artificial Sequence
  chemically treated genomic DNA (Homo sapiens) CpG-island No: 4978
tttttatctttaactacacatttcctatcacatccactccaacaataccaaactataccgaccttctaccccatctccattatttcgccccccgccgccgcgactttttacccccccgccgccgcgaatttttcccgccccgtcgcgacgactttctccccccaccgcgcctcgactttttatacgctacgactttttaccccctcaacgctaaaactttttaaccaccgcaaatttttaactcttcaccgctacgaattttaccgccctaactttttacccgccaaaactttatcccccccccccgccgccgcgactttatcaccgccttaactttttccaccctacccccgcgactttttacccgccgcgactttctaccacccacccgccgccgcgactttttacccccaccccgcctcgactttttacccgctacgactttctaccctaacccgccgccgcgactttttacccctccgccgccgcgactttttacccccaccctacctcgactttttacccgcctcgactttttaccccccgccgcgaccgcgactttttacccgaccaaactttttaccccaccgccgacacaactttttacaccctcgccgccgtaactttttaccgccgcgactttctaccgccgcgactttctacccccccgccgccaccgacgctaatttttaccccaccgccgccgtaactttttacccgccgcgactttttacccgccacgacgttttacccgccgcgactttttaccccccgctatcacaactttttacccccccgccgcaacgactttttcctcgccgcgactttttaccgacgccgctattaccgccgctttttacgcccgcgactttttaccgctattaccgccgccttttacccccgccgcaacgactttttatccccgccgccgcgactttttactaccgcgactttttaccccgatcgccgccgctttttaccaccgcgactttttaccctcgccgccgaaaatttttatccccgccgcc

SEQ ID NO: 4979 - DNA, 1028 bp, Artificial Sequence
  chemically treated genomic DNA (Homo sapiens) CpG-island No: 4979
tttttgtttttggttgtatattttttgttatatttattttagtaatgttaagttgtgtcggttttttattttatttttattatttcgtttttcgtcgtcgcggttttttgttttttcgtcgtcgcggatttttttcgtttcgtcgcggcggttttttttttttatcgcgtttcggttttttgtacgttgcggttttttgtttttttaacgttagagttttttgattatcgtaggtttttgattttttatcgttgcgaattttgtcgttttggttttttgttcgttagggttttgtttttttttttcgtcgtcgcggttttattatcgttttggttttttttattttgttttcgcggttttttgttcgtcgcggttttttgttatttattcgtcgtcgcggttttttgtttttatttcgtttcggttttttgttcgttgcggttttttgttttaattcgtcgtcgcggttttttgttttttcgtcgtcgcggttttttgtttttattttgtttcggttttttgttcgtttcggttttttgtttttcgtcgcggtcgcggttttttgttcgattaggttttttgttttatcgtcgatatagttttttgtattttcgtcgtcgtggttttttgtcgtcgcggttttttgtcgtcgcggttttttgttttttcgtcgttatcggcgttgatttttgttttatcgtcgtcgtggttttttgttcgtcgcggttttttattcgttacggcgttttattcgtcgcggttttttgtttttcgttgttatagttttttgttttttcgtcgtagcgatttttttttcgtcgcggttttttgtcgacgtcgttgttgtcgtcgttttttgcgttcgcggttttttgtcgttgttgtcgtcgttttttgttttcgtcgtagcggttttttgttttcgtcgtcgcggttttttgttatcgcgattttttgtttcggtcgtcgtcgttttttgttatcgcgattttttgttttcgtcgtcgaggatttttgttttcgtcgtt

SEQ ID NO: 4980 - DNA, 1028 bp, Artificial Sequence
  chemically treated genomic DNA (Homo sapiens) CpG-island No: 4980
aacgacgaaaacaaaaatcctcgacgacgaaaacaaaaaatcgcgataacaaaaaacgacgacgaccgaaacaaaaaatcgcgataacaaaaaaccgcgacgacgaaaacaaaaaaccgctacgacgaaaacaaaaaacgacgacaacaacgacaaaaaaccgcgaacgcaaaaaacgacgacaacaacgacgtcgacaaaaaaccgcgacgaaaaaaaaatcgctacgacgaaaaaacaaaaaactataacaacgaaaaacaaaaaaccgcgacgaataaaacgccgtaacgaataaaaaaccgcgacgaacaaaaaaccacgacgacgataaaacaaaaatcaacgccgataacgacgaaaaaacaaaaaaccgcgacgacaaaaaaccgcgacgacaaaaaaccacgacgacgaaaatacaaaaaactatatcgacgataaaacaaaaaacctaatcgaacaaaaaaccgcgaccgcgacgaaaaacaaaaaaccgaaacgaacaaaaaaccgaaacaaaataaaaacaaaaaaccgcgacgacgaaaaaacaaaaaaccgcgacgacgaattaaaacaaaaaaccgcaacgaacaaaaaaccgaaacgaaataaaaacaaaaaaccgcgacgacgaataaataacaaaaaaccgcgacgaacaaaaaaccgcgaaaacaaaataaaaaaaaccaaaacgataataaaaccgcgacgacgaaaaaaaaaaacaaaaccctaacgaacaaaaaaccaaaacgacaaaattcgcaacgataaaaaatcaaaaacctacgataatcaaaaaactctaacgttaaaaaaacaaaaaaccgcaacgtacaaaaaaccgaaacgcgataaaaaaaaaaaaccgccgcgacgaaacgaaaaaaatccgcgacgacgaaaaaacaaaaaaccgcgacgacgaaaaacgaaataataaaaataaaataaaaaaccgacacaacttaacattactaaaataaatataacaaaaaatatacaaccaaaaacaaaaa

SEQ ID NO: 4981 - DNA, 587 bp, Artificial Sequence
  chemically treated genomic DNA (Homo sapiens) CpG-island No: 4981
ttttttagttgtaaattgtttcgattatttatcgcggggtcggatattgacgtaatttttaggtagaaggttcgatttttatttagtatgagagtcgcgatttttttaattttcgtttttggttagcgtttatttttcgtcgtcgttttcgaaatcggttttcgggaggatcgtgcgtcgggggcgcgggcgcggtcgggtttgttttattagcgcgttcgtattcggtgggcgttggtttttttgatttcggcgcggttttttcgtttatttcgttttttcggcgtttcgtcgtaggttcgagtttcggcggtcgtttttcgttattttatttcgtgggggagtcggcggtcgttgggggtgttgtagggtttagcgtattttggaggcgaagggagtcgggaagtgggatcgcgcgggagtttcgtaacgagttatgtaatcgggtaggggttcgtaattcgggacgggagggaggtagtttcgcgggaattttcgttttttcgtttttttgtcgggagcgtagtttcggaagttttattgggtcggtcggtttttacgtggggtttttcgttttttgaggttag

SEQ ID NO: 4982 - DNA, 587 bp, Artificial Sequence
  chemically treated genomic DNA (Homo sapiens) CpG-island No: 4982
ctaacctcaaaaaacgaaaaaccccacgtaaaaaccgaccgacccaataaaacttccgaaactacgctcccgacaaaaaaacgaaaaaacgaaaattcccgcgaaactacctccctcccgtcccgaattacgaacccctacccgattacataactcgttacgaaactcccgcgcgatcccacttcccgactcccttcgcctccaaaatacgctaaaccctacaacacccccaacgaccgccgactcccccacgaaataaaataacgaaaaacgaccgccgaaactcgaacctacgacgaaacgccgaaaaaacgaaataaacgaaaaaaccgcgccgaaatcaaaaaaaccaacgcccaccgaatacgaacgcgctaataaaacaaacccgaccgcgcccgcgcccccgacgcacgatcctcccgaaaaccgatttcgaaaacgacgacgaaaaataaacgctaaccaaaaacgaaaattaaaaaaatcgcgactctcatactaaataaaaatcgaaccttctacctaaaaattacgtcaatatccgaccccgcgataaataatcgaaacaatttacaactaaaaaa

SEQ ID NO: 4983 - DNA, 587 bp, Artificial Sequence
  chemically treated genomic DNA (Homo sapiens) CpG-island No: 4983
ttggttttagggggcggggggttttacgtgggggtcggtcggtttaatggggttttcggggttgcgttttcggtagggaagcgggagggcgaaagttttcgcggggttgtttttttttcgtttcgggttgcgggtttttgttcggttatataattcgttgcggggttttcgcgcggttttatttttcggtttttttcgtttttaggatgcgttgagttttataatatttttagcggtcgtcggtttttttacgaggtgaggtggcggggggcggtcgtcggggttcggatttgcggcggggcgtcgagggggcggggtaggcggggaggtcgcgtcggggttaggggggttagcgtttatcgggtacgagcgcgttggtgaggtaggttcggtcgcgttcgcgttttcggcgtacggttttttcgggagtcggtttcggggacggcggcggggagtgggcgttggttagggacgagggttgaggaggtcgcggtttttatgttgggtgggagtcgggttttttgtttgggggttgcgttagtgttcgatttcgcgatgagtggtcgggataatttgtaattagaggg

SEQ ID NO: 4984 - DNA, 587 bp, Artificial Sequence
  chemically treated genomic DNA (Homo sapiens) CpG-island No: 4984
ccctctaattacaaattatcccgaccactcatcgcgaaatcgaacactaacgcaacccccaaacaaaaaacccgactcccacccaacataaaaaccgcgacctcctcaaccctcgtccctaaccaacgcccactccccgccgccgtccccgaaaccgactcccgaaaaaaccgtacgccgaaaacgcgaacgcgaccgaacctacctcaccaacgcgctcgtacccgataaacgctaacccccctaaccccgacgcgacctccccgcctaccccgccccctcgacgccccgccgcaaatccgaaccccgacgaccgccccccgccacctcacctcgtaaaaaaaccgacgaccgctaaaaatattataaaactcaacgcatcctaaaaacgaaaaaaaccgaaaaataaaaccgcgcgaaaaccccgcaacgaattatataaccgaacaaaaacccgcaacccgaaacgaaaaaaaaacaaccccgcgaaaactttcgccctcccgcttccctaccgaaaacgcaaccccgaaaaccccattaaaccgaccgacccccacgtaaaaccccccgccccctaaaaccaa

SEQ ID NO: 4985 - DNA, 599 bp, Artificial Sequence
  chemically treated genomic DNA (Homo sapiens) CpG-island No: 4985
  misc_feature (6)..(6): n is either a, c, g or t
  misc_feature (9)..(9): n is either a, c, g or t
  misc_feature (18)..(18): n is either a, c, g or t
  misc_feature (30)..(30): n is either a, c, g or t
  misc_feature (45)..(45): n is either a, c, g or t
  misc_feature (135)..(135): n is either a, c, g or t
  misc_feature (158)..(158): n is either a, c, g or t
aggcgntanggggagttnacgcgatgtatnttttcgtttcgagangaattttggttgcgttgcgacgggtacgtcggtttgcgttaaggtcgttttttttaggcggcgggcgtttttttcggttcgggtcgcggnttttttcgtttcggcgagcgcgncggttggattgtgggttgggggttgcggcggttttcgggttagttttttcgtattcgatcgggtcgagtcggttgggcgggagatagagggaaagtagtggagtcgggagtagaagcgttagaggtagtggtcgtggcgcggcggggcggtttttttggaggtcggggatgtgggaaaggcggtggtagtagcggcggaggcggcgttcgtaaattcggggaaaattgttggttgattaggatattcgggagagacgtgagggagtcgtcgttgttattttttatttttgaatgaaattgcgttcgagagggcggttttgtgtttttcgagtcgattggtagtcgggcgtagtggtcggggttcggaattcgaggttcgggcgttttaaaaatttgaggaaatttaaaatgaaaaagaattagaaggaattttaatggaaa

SEQ ID NO: 4986 - DNA, 599 bp, Artificial Sequence
  chemically treated genomic DNA (Homo sapiens) CpG-island No: 4986
  misc_feature (442)..(442): n is either a, c, g or t
  misc_feature (465)..(465): n is either a, c, g or t
  misc_feature (555)..(555): n is either a, c, g or t
  misc_feature (570)..(570): n is either a, c, g or t
  misc_feature (582)..(582): n is either a, c, g or t
  misc_feature (591)..(591): n is either a, c, g or t
  misc_feature (594)..(594): n is either a, c, g or t
tttccattaaaattccttctaattctttttcattttaaatttcctcaaatttttaaaacgcccgaacctcgaattccgaaccccgaccactacgcccgactaccaatcgactcgaaaaacacaaaaccgccctctcgaacgcaatttcattcaaaaataaaaaataacaacgacgactccctcacgtctctcccgaatatcctaatcaaccaacaattttccccgaatttacgaacgccgcctccgccgctactaccaccgcctttcccacatccccgacctccaaaaaaaccgccccgccgcgccacgaccactacctctaacgcttctactcccgactccactactttccctctatctcccgcccaaccgactcgacccgatcgaatacgaaaaaactaacccgaaaaccgccgcaacccccaacccacaatccaaccgncgcgctcgccgaaacgaaaaaanccgcgacccgaaccgaaaaaaacgcccgccgcctaaaaaaaacgaccttaacgcaaaccgacgtacccgtcgcaacgcaaccaaaattcntctcgaaacgaaaanatacatcgcgtnaactccccntancgcct

SEQ ID NO: 4987 - DNA, 599 bp, Artificial Sequence
  chemically treated genomic DNA (Homo sapiens) CpG-island No: 4987
  misc_feature (442)..(442): n is either a, c, g or t
  misc_feature (465)..(465): n is either a, c, g or t
  misc_feature (555)..(555): n is either a, c, g or t
  misc_feature (570)..(570): n is either a, c, g or t
  misc_feature (582)..(582): n is either a, c, g or t
  misc_feature (591)..(591): n is either a, c, g or t
  misc_feature (594)..(594): n is either a, c, g or t
tttttattaaaattttttttagtttttttttattttggatttttttaaatttttgaggcgttcgagtttcgggtttcgggtttcggttattgcgttcgattgttagtcggttcggggagtatagggtcgttttttcgagcgtagttttatttaggggtgagaggtggtagcggcggtttttttacgtttttttcgggtgttttgattagttagtagtttttttcgggtttgcgagcgtcgttttcgtcgttgttgttatcgttttttttatattttcggtttttaggggagtcgtttcgtcgcgttacgattattgtttttagcgtttttgttttcgattttattgttttttttttatttttcgtttagtcggttcggttcggtcgggtgcggggagattagttcggaggtcgtcgtagtttttagtttataatttaatcgncgcgttcgtcggggcggggaggntcgcggttcgggtcggggggagcgttcgtcgtttggggaaagcggttttggcgtaggtcggcgtgttcgtcgtagcgtagttagagtttntttcggggcgggganatatatcgcgtnggttttttntgncgttt

SEQ ID NO: 4988 - DNA, 599 bp, Artificial Sequence
  chemically treated genomic DNA (Homo sapiens) CpG-island No: 4988
  misc_feature (6)..(6): n is either a, c, g or t
  misc_feature (9)..(9): n is either a, c, g or t
  misc_feature (18)..(18): n is either a, c, g or t
  misc_feature (30)..(30): n is either a, c, g or t
  misc_feature (45)..(45): n is either a, c, g or t
  misc_feature (135)..(135): n is either a, c, g or t
  misc_feature (158)..(158): n is either a, c, g or t
aaacgncanaaaaaaccnacgcgatatatntccccgccccgaaanaaactctaactacgctacgacgaacacgccgacctacgccaaaaccgctttccccaaacgacgaacgctccccccgacccgaaccgcgancctccccgccccgacgaacgcgncgattaaattataaactaaaaactacgacgacctccgaactaatctccccgcacccgaccgaaccgaaccgactaaacgaaaaataaaaaaaaaacaataaaatcgaaaacaaaaacgctaaaaacaataatcgtaacgcgacgaaacgactcccctaaaaaccgaaaatataaaaaaaacgataacaacaacgacgaaaacgacgctcgcaaacccgaaaaaaactactaactaatcaaaacacccgaaaaaaacgtaaaaaaaccgccgctaccacctctcacccctaaataaaactacgctcgaaaaaacgaccctatactccccgaaccgactaacaatcgaacgcaataaccgaaacccgaaacccgaaactcgaacgcctcaaaaatttaaaaaaatccaaaataaaaaaaaactaaaaaaaattttaataaaaa

SEQ ID NO: 4989 - DNA, 1183 bp, Artificial Sequence
  chemically treated genomic DNA (Homo sapiens) CpG-island No: 4989
  misc_feature (529)..(529): n is either a, c, g or t
  misc_feature (542)..(542): n is either a, c, g or t
  misc_feature (645)..(645): n is either a, c, g or t
  misc_feature (750)..(750): n is either a, c, g or t
  misc_feature (1087)..(1087): n is either a, c, g or t
cggtttcgcgttagcgtcggtggttcgtttcgtttttttttatttttcgtttttttttcggttttttttttttttttttttcgttttcgttaagtaatggtttgttttttttttttgggcggtagatttgtattgcgttttttttttcggttcggcgttcgtttttttttcggtttcgtgtcgtatcgttattcgtttcgttttttgttttttgttttcgtgtacgtgttttttttttttgttgcgcgtcggcgtgcgtttttcgcgtggtttttacgacgttttcgtcgtttttgcgttttttcgttttattatcgtgcgttagcgttgtgcgcgtttcgtcgggttgacgttttcgtttttattacgtttcgtttgcgtatatttttttgtttgtcgtgtcgttttgtttattcgttttcgcgttttttttcgcgcgatcgcgcgtgattcgtttgttttttgtacgcgttttttttttttttgcgttgtattcgttgcgacgttatcgcgatgtgagacgcgttanttgatatgacgtntacgtgcgtcgtgttgtattttgtttcgtcgttattgcgcgatcgcgacgcgtcgtcgcgatttgtcgttgcgagacgttacgacgttttgtgttgtgtttantttgtattacgattcgattgtgtcgttcgttgtcgtgcgttatattcgtttttattcgttacgcgtcgcgcgttttttcgttgtatcgtgcgtttgtcgatttangcgtttgatgttttgtcgtcgtatataacgttttacgtatattatatgtttttattgttgtgcgtgtgtcgtgcgtatagcgagattagtgtgttcgtttcgatcgcgttttttattatatatatatgcgcgtttgcgcgttttttatcgttatcgtcgttttgtcgtttatgtttgttcggttttgttcgtcgtttgtttcgtttgtaattgtttcgtttcgtttttattttgttatatttttgcggtttttacgtcgttcgttcgtttcgatttttacgtttacgtcggttcgcgtttcgttttgttttttttgtttttttttcgcgatatattngttgcgttcgtttcgtcgtttcgcgttttggtattcgttcgtttcggagttcgtttttttcgtatgtcgttttttttttttcgagtttttcgtttt

SEQ ID NO: 4990 - DNA, 1183 bp, Artificial Sequence
  chemically treated genomic DNA (Homo sapiens) CpG-island No: 4990
  misc_feature (97)..(97): n is either a, c, g or t
  misc_feature (434)..(434): n is either a, c, g or t
  misc_feature (539)..(539): n is either a, c, g or t
  misc_feature (642)..(642): n is either a, c, g or t
  misc_feature (655)..(655): n is either a, c, g or t
aaaacgaaaaactcgaaaaaaaaaaaacgacatacgaaaaaaacgaactccgaaacgaacgaataccaaaacgcgaaacgacgaaacgaacgcaacnaatatatcgcgaaaaaaaaacaaaaaaaacaaaacgaaacgcgaaccgacgtaaacgtaaaaatcgaaacgaacgaacgacgtaaaaaccgcaaaaatataacaaaataaaaacgaaacgaaacaattacaaacgaaacaaacgacgaacaaaaccgaacaaacataaacgacaaaacgacgataacgataaaaaacgcgcaaacgcgcatatatatataataaaaaacgcgatcgaaacgaacacactaatctcgctatacgcacgacacacgcacaacaataaaaacatataatatacgtaaaacgttatatacgacgacaaaacatcaaacgcntaaatcgacaaacgcacgatacaacgaaaaaacgcgcgacgcgtaacgaataaaaacgaatataacgcacgacaacgaacgacacaatcgaatcgtaatacaaantaaacacaacacaaaacgtcgtaacgtctcgcaacgacaaatcgcgacgacgcgtcgcgatcgcgcaataacgacgaaacaaaatacaacacgacgcacgtanacgtcatatcaantaacgcgtctcacatcgcgataacgtcgcaacgaatacaacgcaaaaaaaaaaaaaacgcgtacaaaaaacaaacgaatcacgcgcgatcgcgcgaaaaaaaacgcgaaaacgaataaacaaaacgacacgacaaacaaaaaaatatacgcaaacgaaacgtaataaaaacgaaaacgtcaacccgacgaaacgcgcacaacgctaacgcacgataataaaacgaaaaaacgcaaaaacgacgaaaacgtcgtaaaaaccacgcgaaaaacgcacgccgacgcgcaacaaaaaaaaaaaacacgtacacgaaaacaaaaaacaaaaaacgaaacgaataacgatacgacacgaaaccgaaaaaaaaacgaacgccgaaccgaaaaaaaaaacgcaatacaaatctaccgcccaaaaaaaaaaaacaaaccattacttaacgaaaacgaaaaaaaaaaaaaaaaaaaaccgaaaaaaaaacgaaaaataaaaaaaaacgaaacgaaccaccgacgctaacgcgaaaccg

SEQ ID NO: 4991 - DNA, 1183 bp, Artificial Sequence
  chemically treated genomic DNA (Homo sapiens) CpG-island No: 4991
  misc_feature (97)..(97): n is either a, c, g or t
  misc_feature (434)..(434): n is either a, c, g or t
  misc_feature (539)..(539): n is either a, c, g or t
  misc_feature (642)..(642): n is either a, c, g or t
  misc_feature (655)..(655): n is either a, c, g or t
aggacgaagagttcgggaggagaagggcggtatacggggaggacggatttcggagcgggcgagtgttaaggcgcggagcggcgaagcgagcgtagtngatgtgtcgcgggaagaagatagagagggtagagcgagacgcgagtcgacgtgggcgtaggagtcgaaacgagcggacggcgtggaggtcgtaaaggtgtgatagggtagaagcgggacggagtagttgtaggcgagataggcgacgagtagagtcgggtagatatgagcgatagagcggcggtggcgatgggagacgcgtagacgcgtatgtgtgtgtgatgaaggacgcgatcggggcgagtatattgatttcgttgtgcgtacgatatacgtatagtagtagggatatatgatgtacgtaggacgttgtgtgcgacggtaaagtattaagcgtntgggtcgatagacgtacgatgtagcgagagagcgcgcgacgcgtgacgagtgagggcgagtgtggcgtacgatagcgagcgatatagtcgagtcgtgatatagantgggtatagtatagagcgtcgtgacgtttcgtagcggtagatcgcgacgacgcgtcgcgatcgcgtagtaacgacgggatagagtatagtacggcgtacgtgnacgttatattagntggcgcgttttatatcgcgatgacgtcgtagcggatgtaacgtaggggggaggagagcgcgtgtaagagatagacgagttacgcgcggtcgcgcgaggaggagcgcgagagcgagtgggtagagcgatacgatagatagagagatgtgcgtaaacggaacgtggtggggacgggagcgttagttcgacggggcgcgtatagcgttggcgtacggtggtagagcgggagagcgtagggacggcgagagcgtcgtagaggttacgcgggagacgtacgtcggcgcgtagtagaggaggagggtacgtgtacggggatagggagtagaggacggagcgggtaacggtgcggtacggagtcgagggaagggcgggcgtcgagtcgagagagagggcgtagtgtaggtttgtcgtttaggagaagagagtaggttattgtttggcgggggcgaagaggggagggggaagaagtcgggggaggagcgaggaatgggagaaggcggagcgggttatcgacgttggcgcggagtcg

SEQ ID NO: 4992 - DNA, 1183 bp, Artificial Sequence
  chemically treated genomic DNA (Homo sapiens) CpG-island No: 4992
  misc_feature (529)..(529): n is either a, c, g or t
  misc_feature (542)..(542): n is either a, c, g or t
  misc_feature (645)..(645): n is either a, c, g or t
  misc_feature (750)..(750): n is either a, c, g or t
  misc_feature (1087)..(1087): n is either a, c, g or t
cgactccgcgccaacgtcgataacccgctccgccttctcccattcctcgctcctcccccgacttcttccccctcccctcttcgcccccgccaaacaataacctactctcttctcctaaacgacaaacctacactacgccctctctctcgactcgacgcccgcccttccctcgactccgtaccgcaccgttacccgctccgtcctctactccctatccccgtacacgtaccctcctcctctactacgcgccgacgtacgtctcccgcgtaacctctacgacgctctcgccgtccctacgctctcccgctctaccaccgtacgccaacgctatacgcgccccgtcgaactaacgctcccgtccccaccacgttccgtttacgcacatctctctatctatcgtatcgctctacccactcgctctcgcgctcctcctcgcgcgaccgcgcgtaactcgtctatctcttacacgcgctctcctcccccctacgttacatccgctacgacgtcatcgcgatataaaacgcgccanctaatataacgtncacgtacgccgtactatactctatcccgtcgttactacgcgatcgcgacgcgtcgtcgcgatctaccgctacgaaacgtcacgacgctctatactatacccantctatatcacgactcgactatatcgctcgctatcgtacgccacactcgccctcactcgtcacgcgtcgcgcgctctctcgctacatcgtacgtctatcgacccanacgcttaatactttaccgtcgcacacaacgtcctacgtacatcatatatccctactactatacgtatatcgtacgcacaacgaaatcaatatactcgccccgatcgcgtccttcatcacacacacatacgcgtctacgcgtctcccatcgccaccgccgctctatcgctcatatctacccgactctactcgtcgcctatctcgcctacaactactccgtcccgcttctaccctatcacacctttacgacctccacgccgtccgctcgtttcgactcctacgcccacgtcgactcgcgtctcgctctaccctctctatcttcttcccgcgacacatcnactacgctcgcttcgccgctccgcgccttaacactcgcccgctccgaaatccgtcctccccgtataccgcccttctcctcccgaactcttcgtcct

SEQ ID NO: 4993 - DNA, 935 bp, Artificial Sequence
  chemically treated genomic DNA (Homo sapiens) CpG-island No: 4993
  misc_feature (271)..(271): n is either a, c, g or t
tatttagtttaatttattttttttttttttttatttttacgtttttcgtattatttagatttattgcgttttttaatttttatttttcgtagtttcgtacgtagtgatttatttattttttaaattttcggtttttattttttttatttaatcgcgtttatcgatatttttttttttttttcgtattttttttttagtcgttttttgttttttcgttttttcgttaattttaggtattttttttatttcgttagtttcgttttttattatntttatatcgttttaatacgtttttttttttttttatcgttacgttgtatgtcgtattttgtttcgcgagttttaagttttttgttaacgttttttcgtattagtatttcgttatttgtttattattatcgtatttttgtatcggtttttattttacgttatttttttatttttttttgttttttgttattcgttcgtttttttcgtatttttcgtttcgtttttatcgtatatcgtttttttattatattttttcgtttttttttttttttattcgttttttggtttttcgtacgcgtatttttttaatttttatttattcgttgatcgttttatcgcgttatgtttattttttatttgttatcgttacgttttattgcgttttcgatttttttatgtcgtttggtatttttataatcgcgattttttatttttacgttattagttttatttatttttttcgtttttttggaagttgtcgtttaagaattcgtttttcgtttttcgaataatcgtatcgattttataatcgttatttatagtttattttaggcgttttatcgatttcgttattttaattcgtattttttacgtgtttcgtttttttatttttaatttgtacgttaattttatcggttttattatacggttattcgttttcgttt

SEQ ID NO: 4994 - DNA, 935 bp, Artificial Sequence
  chemically treated genomic DNA (Homo sapiens) CpG-island No: 4994
  misc_feature (665)..(665): n is either a, c, g or t
aaacgaaaacgaataaccgtataataaaaccgataaaattaacgtacaaattaaaaataaaaaaacgaaacacgtaaaaaatacgaattaaaataacgaaatcgataaaacgcctaaaataaactataaataacgattataaaatcgatacgattattcgaaaaacgaaaaacgaattcttaaacgacaacttccaaaaaaacgaaaaaaataaataaaactaataacgtaaaaataaaaaatcgcgattataaaaataccaaacgacataaaaaaatcgaaaacgcaataaaacgtaacgataacaaataaaaaataaacataacgcgataaaacgatcaacgaataaataaaaattaaaaaaatacgcgtacgaaaaaccaaaaaacgaataaaaaaaaaaaaaaacgaaaaaatataataaaaaaacgatatacgataaaaacgaaacgaaaaatacgaaaaaaacgaacgaataacaaaaaacaaaaaaaaataaaaaaataacgtaaaataaaaaccgatacaaaaatacgataataataaacaaataacgaaatactaatacgaaaaaacgttaacaaaaaacttaaaactcgcgaaacaaaatacgacatacaacgtaacgataaaaaaaaaaaaaaacgtattaaaacgatataaanataataaaaaacgaaactaacgaaataaaaaaaatacctaaaattaacgaaaaaacgaaaaaacaaaaaacgactaaaaaaaaaatacgaaaaaaaaaaaaaaatatcgataaacgcgattaaataaaaaaaataaaaaccgaaaatttaaaaaataaataaatcactacgtacgaaactacgaaaaataaaaattaaaaaacgcaataaatctaaataatacgaaaaacgtaaaaataaaaaaaaaaaaaaaataaattaaactaaata

SEQ ID NO: 4995 - DNA, 935 bp, Artificial Sequence
  chemically treated genomic DNA (Homo sapiens) CpG-island No: 4995
  misc_feature (665)..(665): n is either a, c, g or t
gagcgaggacgaatgatcgtgtgatagagtcgatgaggttgacgtgtaggttagaagtaggagagcggagtacgtagagggtgcggattggagtaacgagatcggtgaggcgtttagagtgagttgtgggtggcgattatgaggtcgatgcgattgttcggagagcggagagcgggtttttgagcggtaatttttaaggagacgagaggaatgggtgaggttagtagcgtagagataaggggtcgcgattgtgagagtgttaagcggtatagagaggtcggagacgtagtgaggcgtagcgatagtaggtggagagtaggtatgacgcgatgaagcgattaacgagtgagtagaggttgagaggatacgcgtgcgagaaattaagagacgagtgggggaaagggggggcgagagaatatagtgagggagcggtatgcgataaggacgagacggggagtacggaggggacgggcgggtggtagagagtaggaaggagtaagggaatgacgtggagtaagagtcggtataggagtgcggtagtagtgagtagatagcggaatgttaatgcgagaagacgttggtagagggtttgaagttcgcgagatagagtgcgatatatagcgtgacggtgaggagagaaaagggcgtgttggagcggtatgagnatggtaggaggcggggttgacgaagtagaagaagtgtttaaagttagcgggggggcggagaggtagggggcggttagggggagagtacgaggaagaggagggggtgtcggtaggcgcggttgagtggagaggatgagggtcggaagtttgaagggtgagtaggttattacgtacgaagttacggagaatggaggttggggaacgtagtggatttaggtggtgcgggggacgtgggagtagaaaaggggggggagtgggttaggttgggtg

SEQ ID NO: 4996 - DNA, 935 bp, Artificial Sequence
  chemically treated genomic DNA (Homo sapiens) CpG-island No: 4996
  misc_feature (271)..(271): n is either a, c, g or t
cacccaacctaacccactccccccccttttctactcccacgtcccccgcaccacctaaatccactacgttccccaacctccattctccgtaacttcgtacgtaataacctactcacccttcaaacttccgaccctcatcctctccactcaaccgcgcctaccgacaccccctcctcttcctcgtactctccccctaaccgccccctacctctccgcccccccgctaactttaaacacttcttctacttcgtcaaccccgcctcctaccatnctcataccgctccaacacgcccttttctctcctcaccgtcacgctatatatcgcactctatctcgcgaacttcaaaccctctaccaacgtcttctcgcattaacattccgctatctactcactactaccgcactcctataccgactcttactccacgtcattcccttactccttcctactctctaccacccgcccgtcccctccgtactccccgtctcgtccttatcgcataccgctccctcactatattctctcgccccccctttcccccactcgtctcttaatttctcgcacgcgtatcctctcaacctctactcactcgttaatcgcttcatcgcgtcatacctactctccacctactatcgctacgcctcactacgtctccgacctctctataccgcttaacactctcacaatcgcgaccccttatctctacgctactaacctcacccattcctctcgtctccttaaaaattaccgctcaaaaacccgctctccgctctccgaacaatcgcatcgacctcataatcgccacccacaactcactctaaacgcctcaccgatctcgttactccaatccgcaccctctacgtactccgctctcctacttctaacctacacgtcaacctcatcgactctatcacacgatcattcgtcctcgctc

SEQ ID NO: 4997 - DNA, 733 bp, Artificial Sequence
  chemically treated genomic DNA (Homo sapiens) CpG-island No: 4997
  misc_feature (390)..(390): n is either a, c, g or t
  misc_feature (531)..(531): n is either a, c, g or t
  misc_feature (593)..(593): n is either a, c, g or t
  misc_feature (718)..(718): n is either a, c, g or t
ttcgtcgtttttgtcggagttagtatcgttatcgggttgtttatggtaaaatatacgttcggatcgatgatataggcggaaattagcgttataatcgttacgaaggattttattaatattttatcgtagtcgataaagtacgtttgtttttcgttcgttagtattttcggcgtggttttagaagagattagcgtatggaagttagatatcgcgttataggcgatggtgataaataggaacgggaataggttatcggtttatatcgggttagtgttatcgataaatttggttagcgtaggtatggttagcgtcgggcgtataattaaaatgtttatcgttagatcgacgatagtttcgatttttaggaaggtagagaggtagttacgcggngttagtagtaattatatcggtagtatcgtcgttataaaatcgtaatttattagtatttaggttaattgtacgtcggtaaagttaaagtacggtgtttaggtcggattttttgttatttagtcgttagagataatggcgaanattaggaatattagatcgatgatcgatatttcgttaatacgtttcggacgtagatagcgtangtagatttttataaatagcgttagcggaatggtgaaacgtacggtatatgtttttttacggttatgagttagggtttttattacgattatcgttagtattggtaggataatgattatgattatanagtaggttattagcg

SEQ ID NO: 4998 - DNA, 733 bp, Artificial Sequence
  chemically treated genomic DNA (Homo sapiens) CpG-island No: 4998
  misc_feature (16)..(16): n is either a, c, g or t
  misc_feature (141)..(141): n is either a, c, g or t
  misc_feature (203)..(203): n is either a, c, g or t
  misc_feature (344)..(344): n is either a, c, g or t
cgctaataacctactntataatcataatcattatcctaccaatactaacgataatcgtaataaaaaccctaactcataaccgtaaaaaaacatataccgtacgtttcaccattccgctaacgctatttataaaaatctacntacgctatctacgtccgaaacgtattaacgaaatatcgatcatcgatctaatattcctaatnttcgccattatctctaacgactaaataacaaaaaatccgacctaaacaccgtactttaactttaccgacgtacaattaacctaaatactaataaattacgattttataacgacgatactaccgatataattactactaacnccgcgtaactacctctctaccttcctaaaaatcgaaactatcgtcgatctaacgataaacattttaattatacgcccgacgctaaccatacctacgctaaccaaatttatcgataacactaacccgatataaaccgataacctattcccgttcctatttatcaccatcgcctataacgcgatatctaacttccatacgctaatctcttctaaaaccacgccgaaaatactaacgaacgaaaaacaaacgtactttatcgactacgataaaatattaataaaatccttcgtaacgattataacgctaatttccgcctatatcatcgatccgaacgtatattttaccataaacaacccgataacgatactaactccgacaaaaacgacgaa

SEQ ID NO: 4999 - DNA, 733 bp, Artificial Sequence
  chemically treated genomic DNA (Homo sapiens) CpG-island No: 4999
  misc_feature (16)..(16): n is either a, c, g or t
  misc_feature (141)..(141): n is either a, c, g or t
  misc_feature (203)..(203): n is either a, c, g or t
  misc_feature (344)..(344): n is either a, c, g or t
cgttggtggtttgttntatgattatggttattattttgttagtgttggcgatgatcgtggtgaaagttttgatttatagtcgtgggggaatatatatcgtgcgttttattatttcgttggcgttgtttatggggatttatntgcgttatttgcgttcggggcgtattggcgaagtgtcggttatcggtttggtatttttgatnttcgttattatttttggcggttgggtggtagaaagttcgatttgggtatcgtattttgattttatcggcgtgtagttgatttggatgttggtgggttacggttttgtggcggcggtgttgtcggtgtggttattgttggtntcgcgtgattatttttttatttttttgaaaatcgggattatcgtcggtttggcggtaggtattttgattatgcgttcgacgttgattatgtttgcgttgattaaatttgtcgatggtattggttcggtatggatcggtaatttgttttcgtttttgtttattattatcgtttgtggcgcggtgtttggtttttatgcgttgattttttttgggattacgtcgaagatgttggcgaacgaagggtaggcgtgttttatcggttacggtgggatgttaatggaatttttcgtggcgattatggcgttggttttcgtttgtattatcgattcgggcgtgtattttgttatgaatagttcgatggcggtgttggtttcggtagggacggcgga

SEQ ID NO: 5000 - DNA, 733 bp, Artificial Sequence
  chemically treated genomic DNA (Homo sapiens) CpG-island No: 5000
  misc_feature (390)..(390): n is either a, c, g or t
  misc_feature (531)..(531): n is either a, c, g or t
  misc_feature (593)..(593): n is either a, c, g or t
  misc_feature (718)..(718): n is either a, c, g or t
tccgccgtccctaccgaaaccaacaccgccatcgaactattcataacaaaatacacgcccgaatcgataatacaaacgaaaaccaacgccataatcgccacgaaaaattccattaacatcccaccgtaaccgataaaacacgcctacccttcgttcgccaacatcttcgacgtaatcccaaaaaaaatcaacgcataaaaaccaaacaccgcgccacaaacgataataataaacaaaaacgaaaacaaattaccgatccataccgaaccaataccatcgacaaatttaatcaacgcaaacataatcaacgtcgaacgcataatcaaaatacctaccgccaaaccgacgataatcccgattttcaaaaaaataaaaaaataatcacgcganaccaacaataaccacaccgacaacaccgccgccacaaaaccgtaacccaccaacatccaaatcaactacacgccgataaaatcaaaatacgatacccaaatcgaactttctaccacccaaccgccaaaaataataacgaanatcaaaaataccaaaccgataaccgacacttcgccaatacgccccgaacgcaaataacgcanataaatccccataaacaacgccaacgaaataataaaacgcacgatatatattcccccacgactataaatcaaaactttcaccacgatcatcgccaacactaacaaaataataaccataatcatanaacaaaccaccaacg

SEQ ID NO: 5001 - DNA, 666 bp, Artificial Sequence
  chemically treated genomic DNA (Homo sapiens) CpG-island No: 5001
tatgtttatttagatagcgatttagttcgattattttcgtttatcgattttcgtattatagcggagtaagtagcgtcgggcgacgggcgttggcggaaatgcggtggtagattattttcggtggcgtatggcgatattattttttcggtagtgagcgtgtaattttttagtttaatatcgtttaaacgtttcgttttttaggttttcgttataatgttgttttttataatatgtagcggatgtagttttatgtcgtttacgtcggttttaattattcgttttagcgtttgtaaatatttagtttgtttttcgttaggtaggtcgataattaagtgggaatatatttttagttcgcgttgacgtgttagttgggttgtacgttgataataggtaaaattatggtcgcggttgatgcgatgtagtgttttgtcgtgggcggtttgtagttttagttttagttatatttcgtaattttggtttttatattcgtaaagtagatttagtatcgtattcggtacgtagttcgggcgggtatttatatataaatcgataatattggtttggtttatcgtttgttgatatatagaacgtagtatttgaattttcgtaaaggtgttggtatacgtttgaaagtaggttagatagcgtttagcgcggttaattaaa

SEQ ID NO: 5002 - DNA, 666 bp, Artificial Sequence
  chemically treated genomic DNA (Homo sapiens) CpG-island No: 5002
tttaattaaccgcgctaaacgctatctaacctactttcaaacgtataccaacacctttacgaaaattcaaatactacgttctatatatcaacaaacgataaaccaaaccaatattatcgatttatatataaatacccgcccgaactacgtaccgaatacgatactaaatctactttacgaatataaaaaccaaaattacgaaatataactaaaactaaaactacaaaccgcccacgacaaaacactacatcgcatcaaccgcgaccataattttacctattatcaacgtacaacccaactaacacgtcaacgcgaactaaaaatatattcccacttaattatcgacctacctaacgaaaaacaaactaaatatttacaaacgctaaaacgaataattaaaaccgacgtaaacgacataaaactacatccgctacatattataaaaaacaacattataacgaaaacctaaaaaacgaaacgtttaaacgatattaaactaaaaaattacacgctcactaccgaaaaaataatatcgccatacgccaccgaaaataatctaccaccgcatttccgccaacgcccgtcgcccgacgctacttactccgctataatacgaaaatcgataaacgaaaataatcgaactaaatcgctatctaaataaacata

SEQ ID NO: 5003 - DNA, 666 bp, Artificial Sequence
  chemically treated genomic DNA (Homo sapiens) CpG-island No: 5003
tttagttaatcgcgttaaacgttatttggtttatttttaggcgtatattagtatttttgcggaagtttaggtgttgcgttttatgtattagtaggcggtgagttaggttaatattgtcggtttgtgtgtgggtattcgttcggattgcgtgtcggatgcggtgttggatttgttttgcgaatataaggattagggttacgaagtgtggttggagttggggttataaatcgtttacgataaaatattgtatcgtattaatcgcggttatgattttgtttgttattagcgtataatttagttggtacgttagcgcgggttgaaggtgtgtttttatttaattgtcggtttgtttggcgaagggtaggttgaatgtttgtaaacgttggagcgagtggttgaaatcggcgtggacggtataaagttgtattcgttgtatattgtgaaaggtagtattatggcgaaagtttgggaagcggggcgtttgaacggtattgaattggaggattatacgtttattgtcggagaaatgatatcgttatacgttatcggaagtgatttattatcgtattttcgttagcgttcgtcgttcgacgttgtttgtttcgttgtggtgcgaaaatcgatggacgggaatggtcgagttggatcgttatttgaatgaatatg

SEQ ID NO: 5004 - DNA, 666 bp, Artificial Sequence
  chemically treated genomic DNA (Homo sapiens) CpG-island No: 5004
catattcattcaaataacgatccaactcgaccattcccgtccatcgattttcgcaccacaacgaaacaaacaacgtcgaacgacgaacgctaacgaaaatacgataataaatcacttccgataacgtataacgatatcatttctccgacaataaacgtataatcctccaattcaataccgttcaaacgccccgcttcccaaactttcgccataatactacctttcacaatatacaacgaatacaactttataccgtccacgccgatttcaaccactcgctccaacgtttacaaacattcaacctacccttcgccaaacaaaccgacaattaaataaaaacacaccttcaacccgcgctaacgtaccaactaaattatacgctaataacaaacaaaatcataaccgcgattaatacgatacaatattttatcgtaaacgatttataaccccaactccaaccacacttcgtaaccctaatccttatattcgcaaaacaaatccaacaccgcatccgacacgcaatccgaacgaatacccacacacaaaccgacaatattaacctaactcaccgcctactaatacataaaacgcaacacctaaacttccgcaaaaatactaatatacgcctaaaaataaaccaaataacgtttaacgcgattaactaaa

SEQ ID NO: 5005 - DNA, 569 bp, Artificial Sequence
  chemically treated genomic DNA (Homo sapiens) CpG-island No: 5005
tttttgatggtaaaattattttttattggtatcgtatgattaatcgtttgatgtggatttggcgcggtattgatttacgcgaaattttcgacgtttaggtacgtattgtgatgagcgatgtcgaacgtatcgacgatgatttatacgatacggtgattggttatcgtggcggtaattggatttatgagtgggttatttaggcgatggtgtggtaataaaaagtttgtgcggaagacgattcgtaatttagtggtcgttattggttgtatgcggttacgttgtataatattgtcgtttatttttatttgaaaggagatgatttggtcgagtaagcgtaggttttgttaaatcgcgtttatgaagaggtcgtttagcgtttatcgggtacgatgcggtagatggagtttatcgtattcggcggtgcgtttattatcggttttttgtatatgtcgaaaggcgatggttcgttttcgacggtattaatgtgtggtggtttggatgcgatgtagacggattattatagtttgtatgaacgttattttgcgtcgcgcggtattgcgatgttgatt

SEQ ID NO: 5006 - DNA, 569 bp, Artificial Sequence
  chemically treated genomic DNA (Homo sapiens) CpG-island No: 5006
aatcaacatcgcaataccgcgcgacgcaaaataacgttcatacaaactataataatccgtctacatcgcatccaaaccaccacacattaataccgtcgaaaacgaaccatcgcctttcgacatatacaaaaaaccgataataaacgcaccgccgaatacgataaactccatctaccgcatcgtacccgataaacgctaaacgacctcttcataaacgcgatttaacaaaacctacgcttactcgaccaaatcatctcctttcaaataaaaataaacgacaatattatacaacgtaaccgcatacaaccaataacgaccactaaattacgaatcgtcttccgcacaaactttttattaccacaccatcgcctaaataacccactcataaatccaattaccgccacgataaccaatcaccgtatcgtataaatcatcgtcgatacgttcgacatcgctcatcacaatacgtacctaaacgtcgaaaatttcgcgtaaatcaataccgcgccaaatccacatcaaacgattaatcatacgataccaataaaaaataattttaccatcaaaaa

SEQ ID NO: 5007 - DNA, 569 bp, Artificial Sequence
  chemically treated genomic DNA (Homo sapiens) CpG-island No: 5007
agttagtatcgtaatgtcgcgcggcgtaaaataacgtttatataggttgtaatagttcgtttgtatcgtatttagattattatatattaatatcgtcgggaacgggttatcgtttttcggtatatgtaaaaagtcggtgatgggcgtatcgtcgggtacggtaaattttatttgtcgtatcgtgttcggtagacgttgagcggtttttttataggcgcggtttgataaagtttgcgtttgttcggttaggttatttttttttagatgaggataggcggtaatgttgtataacgtagtcgtatgtagttagtgacgattattgagttgcggatcgtttttcgtataggttttttgttgttatattatcgtttgggtggtttatttataaatttagttgtcgttacggtagttaattatcgtatcgtataaattatcgtcggtacgttcggtatcgtttattataatacgtgtttggacgtcgaggatttcgcgtgggttaatgtcgcgttagatttatattagacggttaattatgcgatattagtgagggatggttttattattaagga

SEQ ID NO: 5008 - DNA, 569 bp, Artificial Sequence
  chemically treated genomic DNA (Homo sapiens) CpG-island No: 5008
tccttaataataaaaccatccctcactaatatcgcataattaaccgtctaatataaatctaacgcgacattaacccacgcgaaatcctcgacgtccaaacacgtattataataaacgataccgaacgtaccgacgataatttatacgatacgataattaactaccgtaacgacaactaaatttataaataaaccacccaaacgataatataacaacaaaaaacctatacgaaaaacgatccgcaactcaataatcgtcactaactacatacgactacgttatacaacattaccgcctatcctcatctaaaaaaaaataacctaaccgaacaaacgcaaactttatcaaaccgcgcctataaaaaaaccgctcaacgtctaccgaacacgatacgacaaataaaatttaccgtacccgacgatacgcccatcaccgactttttacatataccgaaaaacgataacccgttcccgacgatattaatatataataatctaaatacgatacaaacgaactattacaacctatataaacgttattttacgccgcgcgacattacgatactaact

SEQ ID NO: 5009 - DNA, 845 bp, Artificial Sequence
  chemically treated genomic DNA (Homo sapiens) CpG-island No: 5009
  misc_feature (266)..(266): n is either a, c, g or t
  misc_feature (411)..(411): n is either a, c, g or t
  misc_feature (425)..(425): n is either a, c, g or t
  misc_feature (435)..(435): n is either a, c, g or t
  misc_feature (445)..(445): n is either a, c, g or t
  misc_feature (464)..(464): n is either a, c, g or t
  misc_feature (467)..(467): n is either a, c, g or t
  misc_feature (481)..(481): n is either a, c, g or t
  misc_feature (488)..(488): n is either a, c, g or t
  misc_feature (494)..(494): n is either a, c, g or t
  misc_feature (499)..(499): n is either a, c, g or t
  misc_feature (506)..(506): n is either a, c, g or t
  misc_feature (515)..(515): n is either a, c, g or t
  misc_feature (522)..(522): n is either a, c, g or t
  misc_feature (531)..(532): n is either a, c, g or t
  misc_feature (538)..(538): n is either a, c, g or t
  misc_feature (545)..(545): n is either a, c, g or t
  misc_feature (656)..(656): n is either a, c, g or t
  misc_feature (735)..(735): n is either a, c, g or t
  misc_feature (753)..(753): n is either a, c, g or t
ttcgggtaaggtttgttattttttttttcggggtgtggtgggaggagcgcgaaggttttacgcgtttttagtagttggtaaaatttggaattagcgtcggtggtttaggcgggataggagcgggtcgggggcgtgggtaggttaggtaggggcggggagtgggcggggaacgggcgtgttttcgttgcggttacgtgtcgggagggatgttagttcgttaggaggatgcgcgttttaggggcgggttgcggggaggggcggcgttnatttcgcgtttcgtcgtggtttcggcgtcgggtttcggagatagacgttacgcgggttcgagcgttttcggggagtgttagttagagttggtgacgattattttttcgacgtggggcgggcggacgggaagtttggggtcgtggnttatcgtttcgggnagttttgggnagttcgggtngatcgcgtaggttagtttnttncgcggttgtttatngtttggnagtttngaggntcggttnttcgcgttngacgggnttttcgttnngggttngcgtttngggaggtttgttcgcgtttggttgggggtgggcgttttcgtttcgggcgttttagaggatggtcgggtcgtggcgcggcgacgtagggttgtagtcgagttcggttttttnggcggtcgttggttgttttagcgttgtaggaagttaggcgttaaaagtaataagatgttggcgtttgttgtattttttnattcgggtgttacgattnatgttggtgtcgtatgtattttttattagatttttagttgcgtgttttttcggtattttcgtgtgtttatgtgattttttaattttttttta

SEQ ID NO: 5010 - DNA, 845 bp, Artificial Sequence
  chemically treated genomic DNA (Homo sapiens) CpG-island No: 5010
  misc_feature (93)..(93): n is either a, c, g or t
  misc_feature (111)..(111): n is either a, c, g or t
  misc_feature (190)..(190): n is either a, c, g or t
  misc_feature (301)..(301): n is either a, c, g or t
  misc_feature (308)..(308): n is either a, c, g or t
  misc_feature (314)..(315): n is either a, c, g or t
  misc_feature (324)..(324): n is either a, c, g or t
  misc_feature (331)..(331): n is either a, c, g or t
  misc_feature (340)..(340): n is either a, c, g or t
  misc_feature (347)..(347): n is either a, c, g or t
  misc_feature (352)..(352): n is either a, c, g or t
  misc_feature (358)..(358): n is either a, c, g or t
  misc_feature (365)..(365): n is either a, c, g or t
  misc_feature (379)..(379): n is either a, c, g or t
  misc_feature (382)..(382): n is either a, c, g or t
  misc_feature (401)..(401): n is either a, c, g or t
  misc_feature (411)..(411): n is either a, c, g or t
  misc_feature (421)..(421): n is either a, c, g or t
  misc_feature (435)..(435): n is either a, c, g or t
  misc_feature (580)..(580): n is either a, c, g or t
taaaaaaaaattaaaaaatcacataaacacacgaaaataccgaaaaaacacgcaactaaaaatctaataaaaaatacatacgacaccaacatnaatcgtaacacccgaatnaaaaaatacaacaaacgccaacatcttattacttttaacgcctaacttcctacaacgctaaaacaaccaacgaccgccnaaaaaaccgaactcgactacaaccctacgtcgccgcgccacgacccgaccatcctctaaaacgcccgaaacgaaaacgcccacccccaaccaaacgcgaacaaacctcccnaaacgcnaacccnnaacgaaaancccgtcnaacgcgaanaaccgancctcnaaactnccaaacnataaacaaccgcgnaanaaactaacctacgcgatcnacccgaactncccaaaactncccgaaacgataanccacgaccccaaacttcccgtccgcccgccccacgtcgaaaaaataatcgtcaccaactctaactaacactccccgaaaacgctcgaacccgcgtaacgtctatctccgaaacccgacgccgaaaccacgacgaaacgcgaaatnaacgccgcccctccccgcaacccgcccctaaaacgcgcatcctcctaacgaactaacatccctcccgacacgtaaccgcaacgaaaacacgcccgttccccgcccactccccgcccctacctaacctacccacgcccccgacccgctcctatcccgcctaaaccaccgacgctaattccaaattttaccaactactaaaaacgcgtaaaaccttcgcgctcctcccaccacaccccgaaaaaaaaaataacaaaccttacccgaa

SEQ ID NO: 5011 - DNA, 845 bp, Artificial Sequence
  chemically treated genomic DNA (Homo sapiens) CpG-island No: 5011
  misc_feature (93)..(93): n is either a, c, g or t
  misc_feature (111)..(111): n is either a, c, g or t
  misc_feature (190)..(190): n is either a, c, g or t
  misc_feature (301)..(301): n is either a, c, g or t
  misc_feature (308)..(308): n is either a, c, g or t
  misc_feature (314)..(315): n is either a, c, g or t
  misc_feature (324)..(324): n is either a, c, g or t
  misc_feature (331)..(331): n is either a, c, g or t
  misc_feature (340)..(340): n is either a, c, g or t
  misc_feature (347)..(347): n is either a, c, g or t
  misc_feature (352)..(352): n is either a, c, g or t
  misc_feature (358)..(358): n is either a, c, g or t
  misc_feature (365)..(365): n is either a, c, g or t
  misc_feature (379)..(379): n is either a, c, g or t
  misc_feature (382)..(382): n is either a, c, g or t
  misc_feature (401)..(401): n is either a, c, g or t
  misc_feature (411)..(411): n is either a, c, g or t
  misc_feature (421)..(421): n is either a, c, g or t
  misc_feature (435)..(435): n is either a, c, g or t
  misc_feature (580)..(580): n is either a, c, g or t
taggaggaaattaaaaagttatatggatatacgaaagtatcgagaaggtacgtagttgaagatttggtaggggatgtatgcggtattagtatnggtcgtggtattcgagtngggaagtgtaataaacgttaatattttgttatttttaacgtttaattttttgtagcgttggagtagttagcggtcgttngggaagtcgagttcggttgtagttttgcgtcgtcgcgttacgattcgattattttttgagacgttcgggacgggagcgtttatttttaattaggcgcggatagattttttngagcgtnagtttnnggcgggaanttcgttnagcgcgggnaatcggnttttngaattnttaggtngtggatagtcgcgnagnaaattgatttacgcggttnattcgggttntttagagttnttcgaggcggtggnttacgattttaggtttttcgttcgttcgttttacgtcgaggaagtggtcgttattaattttggttggtatttttcgaggacgttcgagttcgcgtaacgtttgttttcgggattcggcgtcgggattacggcggagcgcgaggtnggcgtcgttttttttcgtagttcgtttttggaacgcgtatttttttggcgagttggtatttttttcgatacgtgatcgtagcggggatacgttcgtttttcgtttatttttcgtttttgtttggtttgtttacgttttcggttcgtttttgtttcgtttgggttatcggcgttggttttaggttttgttagttattagggacgcgtaaagttttcgcgttttttttattatatttcgagggaagaagtggtaggttttattcgga

SEQ ID NO: 5012 - DNA, 845 bp, Artificial Sequence
  chemically treated genomic DNA (Homo sapiens) CpG-island No: 5012
  misc_feature (266)..(266): n is either a, c, g or t
  misc_feature (411)..(411): n is either a, c, g or t
  misc_feature (425)..(425): n is either a, c, g or t
  misc_feature (435)..(435): n is either a, c, g or t
  misc_feature (445)..(445): n is either a, c, g or t
  misc_feature (464)..(464): n is either a, c, g or t
  misc_feature (467)..(467): n is either a, c, g or t
  misc_feature (481)..(481): n is either a, c, g or t
  misc_feature (488)..(488): n is either a, c, g or t
  misc_feature (494)..(494): n is either a, c, g or t
  misc_feature (499)..(499): n is either a, c, g or t
  misc_feature (506)..(506): n is either a, c, g or t
  misc_feature (515)..(515): n is either a, c, g or t
  misc_feature (522)..(522): n is either a, c, g or t
  misc_feature (531)..(532): n is either a, c, g or t
  misc_feature (538)..(538): n is either a, c, g or t
  misc_feature (545)..(545): n is either a, c, g or t
  misc_feature (656)..(656): n is either a, c, g or t
  misc_feature (735)..(735): n is either a, c, g or t
  misc_feature (753)..(753): n is either a, c, g or t
tccgaataaaacctaccacttcttccctcgaaatataataaaaaaaacgcgaaaactttacgcgtccctaataactaacaaaacctaaaaccaacgccgataacccaaacgaaacaaaaacgaaccgaaaacgtaaacaaaccaaacaaaaacgaaaaataaacgaaaaacgaacgtatccccgctacgatcacgtatcgaaaaaaataccaactcgccaaaaaaatacgcgttccaaaaacgaactacgaaaaaaaacgacgccnacctcgcgctccgccgtaatcccgacgccgaatcccgaaaacaaacgttacgcgaactcgaacgtcctcgaaaaataccaaccaaaattaataacgaccacttcctcgacgtaaaacgaacgaacgaaaaacctaaaatcgtaanccaccgcctcgaanaactctaaanaacccgaatnaaccgcgtaaatcaatttnctncgcgactatccacnacctaanaattcnaaaanccgattncccgcgctnaacgaanttcccgccnnaaactnacgctcnaaaaaatctatccgcgcctaattaaaaataaacgctcccgtcccgaacgtctcaaaaaataatcgaatcgtaacgcgacgacgcaaaactacaaccgaactcgacttcccnaacgaccgctaactactccaacgctacaaaaaattaaacgttaaaaataacaaaatattaacgtttattacacttcccnactcgaataccacgaccnatactaataccgcatacatcccctaccaaatcttcaactacgtaccttctcgatactttcgtatatccatataactttttaatttcctccta

SEQ ID NO: 5013 - DNA, 573 bp, Artificial Sequence
  chemically treated genomic DNA (Homo sapiens) CpG-island No: 5013
  misc_feature (25)..(25): n is either a, c, g or t
  misc_feature (32)..(32): n is either a, c, g or t
  misc_feature (42)..(42): n is either a, c, g or t
  misc_feature (58)..(58): n is either a, c, g or t
cgatttaaaaggttagcgttgtttntcggtgnatatcgagtncgtaaatttttaagtnttcgtttttcgggatacgattttttttcgttttcgcgtttttttttttttcgttaaggacggttgtcgtagcggatttttagtcgtagtagttcgttttaggaaaggaggttgtattttggacgcggggagtaggggtatgtagttagttacgattttttcgtttttttcgttcgcgttttttcgttttgttttttcgtatttagtattttttatttttttttatttagtttaatttttaacgttaaggttttatcggtttataaaattgatagcggaagtgacgttagaggtatttggcggcgcgtaaaattagttacgttatagttataggcgtcgcggttaataagcgtatcggtatacggggttttttcgttcgttaatgtttgatttaagcggggggaagggtcgggtaaggaatgtgaataatgaatttttttttttcgttttgttcgtgaggagttaggcgcgaaacggagggggttggagttacggagtatttatcggtagttttag

SEQ ID NO: 5014 - DNA, 573 bp, Artificial Sequence
  chemically treated genomic DNA (Homo sapiens) CpG-island No: 5014
  misc_feature (516)..(516): n is either a, c, g or t
  misc_feature (532)..(532): n is either a, c, g or t
  misc_feature (542)..(542): n is either a, c, g or t
  misc_feature (549)..(549): n is either a, c, g or t
ctaaaactaccgataaatactccgtaactccaaccccctccgtttcgcgcctaactcctcacgaacaaaacgaaaaaaaaaaattcattattcacattccttacccgacccttccccccgcttaaatcaaacattaacgaacgaaaaaaccccgtataccgatacgcttattaaccgcgacgcctataactataacgtaactaattttacgcgccgccaaatacctctaacgtcacttccgctatcaattttataaaccgataaaaccttaacgttaaaaattaaactaaataaaaaaaaataaaaaatactaaatacgaaaaaacaaaacgaaaaaacgcgaacgaaaaaaacgaaaaaatcgtaactaactacatacccctactccccgcgtccaaaatacaacctcctttcctaaaacgaactactacgactaaaaatccgctacgacaaccgtccttaacgaaaaaaaaaaaaacgcgaaaacgaaaaaaaatcgtatcccgaaaaacgaanacttaaaaatttacgnactcgatatncaccganaaacaacgctaaccttttaaatcg

SEQ ID NO: 5015 - DNA, 573 bp, Artificial Sequence
  chemically treated genomic DNA (Homo sapiens) CpG-island No: 5015
  misc_feature (516)..(516): n is either a, c, g or t
  misc_feature (532)..(532): n is either a, c, g or t
  misc_feature (542)..(542): n is either a, c, g or t
  misc_feature (549)..(549): n is either a, c, g or t
ttaggattatcggtgggtgtttcgtggttttaatttttttcgtttcgcgtttagttttttacggatagggcgggggaggggggtttattgtttatattttttattcggttttttttttcgtttgaattaaatattggcgggcgggaaggtttcgtgtgtcggtgcgtttgttggtcgcggcgtttgtgattgtggcgtgattggttttacgcgtcgttaggtgtttttgacgttattttcgttattaattttgtgggtcggtgagattttggcgttgggggttgggttgaatgagggaaggtaggaagtgttaggtgcggggggatagggcgggaaggcgcgggcggggagggcgggagagtcgtggttggttgtatgtttttgtttttcgcgtttagagtgtagtttttttttttgaagcgagttgttgcggttggaggttcgttgcggtagtcgtttttggcgagggggaggggaacgcgggagcgggaggaaatcgtatttcgggggacgggngtttggagatttgcgnattcggtgtntatcggnaaatagcgttggttttttgagtcg

SEQ ID NO: 5016 - DNA, 573 bp, Artificial Sequence
  chemically treated genomic DNA (Homo sapiens) CpG-island No: 5016
  misc_feature (25)..(25): n is either a, c, g or t
  misc_feature (32)..(32): n is either a, c, g or t
  misc_feature (42)..(42): n is either a, c, g or t
  misc_feature (58)..(58): n is either a, c, g or t
cgactcaaaaaaccaacgctatttnccgatanacaccgaatncgcaaatctccaaacncccgtcccccgaaatacgatttcctcccgctcccgcgttcccctccccctcgccaaaaacgactaccgcaacgaacctccaaccgcaacaactcgcttcaaaaaaaaaaactacactctaaacgcgaaaaacaaaaacatacaaccaaccacgactctcccgccctccccgcccgcgccttcccgccctatccccccgcacctaacacttcctaccttccctcattcaacccaacccccaacgccaaaatctcaccgacccacaaaattaataacgaaaataacgtcaaaaacacctaacgacgcgtaaaaccaatcacgccacaatcacaaacgccgcgaccaacaaacgcaccgacacacgaaaccttcccgcccgccaatatttaattcaaacgaaaaaaaaaaccgaataaaaaatataaacaataaacccccctcccccgccctatccgtaaaaaactaaacgcgaaacgaaaaaaattaaaaccacgaaacacccaccgataatcctaa

SEQ ID NO: 5017 - DNA, 622 bp, Artificial Sequence
  chemically treated genomic DNA (Homo sapiens) CpG-island No: 5017
acgttgtttcgcggtttttaagttcggttcgtttcgtttttgtatttcgatttttttttacgtcggttttttttcgtttttcgggcggcggaagtcgttggttgtttttttttgtttatatgagtttttttcggtgcgttcgtttttttcggtttttcggtcgagatttggtttttattttagggtttttaatgtgttttcggagggatatattttttttaatcgattacgttcggggttttagttttacgggttgtttttaattttagttttttatttttataattttgtttagtcgtttttttatattttttttttcgattggttcgtttttttcggtcggttaatgggggtttcgtttatttttttattttagggtcgtagaagggtaagacgtcgtttaatggttgttaagggtaacgcgggacgtcggttagcgaggttttttgttttttgggttggggttcgtcggttttagttttagggcgggaagagaggcgcggggggaggggaaggttggcgtttgcgtaaagtcgggggcgggggtagtggtttgagagtcgggataaaatacgagttttagttaatgtggaattataaatataatataagattttttatt

SEQ ID NO: 5018 - DNA, 622 bp, Artificial Sequence
  chemically treated genomic DNA (Homo sapiens) CpG-island No: 5018
aataaaaaatcttatattatatttataattccacattaactaaaactcgtattttatcccgactctcaaaccactacccccgcccccgactttacgcaaacgccaaccttcccctccccccgcgcctctcttcccgccctaaaactaaaaccgacgaaccccaacccaaaaaacaaaaaacctcgctaaccgacgtcccgcgttacccttaacaaccattaaacgacgtcttacccttctacgaccctaaaataaaaaaataaacgaaacccccattaaccgaccgaaaaaaacgaaccaatcgaaaaaaaaaatataaaaaaacgactaaacaaaattataaaaataaaaaactaaaattaaaaacaacccgtaaaactaaaaccccgaacgtaatcgattaaaaaaaatatatccctccgaaaacacattaaaaaccctaaaataaaaaccaaatctcgaccgaaaaaccgaaaaaaacgaacgcaccgaaaaaaactcatataaacaaaaaaaaacaaccaacgacttccgccgcccgaaaaacgaaaaaaaaccgacgtaaaaaaaaatcgaaatacaaaaacgaaacgaaccgaacttaaaaaccgcgaaacaacgt

SEQ ID NO: 5019 - DNA, 622 bp, Artificial Sequence
  chemically treated genomic DNA (Homo sapiens) CpG-island No: 5019
gatggggagttttgtgttgtatttatggttttatattagttaaaattcgtgttttgtttcggtttttaagttattgttttcgttttcggttttgcgtaggcgttagttttttttttttttcgcgttttttttttcgttttaaggttggagtcggcgagttttagtttagagaataaaaggtttcgttagtcggcgtttcgcgttgtttttggtaattattgagcggcgttttgtttttttgcgattttgagatgagagagtaaacggggtttttattggtcggtcggggaagacgggttaatcggagaagagggtatagggaggcggttgaataaggttgtgggggtaggaagttagggttagaggtaattcgtgaggttagaatttcgaacgtggtcggttggagaaaatatgttttttcggaggtatattgggaattttgaggtgagggttaggtttcggtcggagagtcggagggggcgggcgtatcggaaaaggtttatgtgggtagggaagagtagttagcgattttcgtcgttcggaaggcgggaaggggtcggcgtgaggaggggtcgggatgtaggggcggggcgggtcgggtttgggggtcgcggggtagcgt

SEQ ID NO: 5020 - DNA, 622 bp, Artificial Sequence
  chemically treated genomic DNA (Homo sapiens) CpG-island No: 5020
acgctaccccgcgacccccaaacccgacccgccccgcccctacatcccgacccctcctcacgccgaccccttcccgccttccgaacgacgaaaatcgctaactactcttccctacccacataaaccttttccgatacgcccgccccctccgactctccgaccgaaacctaaccctcacctcaaaattcccaatatacctccgaaaaaacatattttctccaaccgaccacgttcgaaattctaacctcacgaattacctctaaccctaacttcctacccccacaaccttattcaaccgcctccctataccctcttctccgattaacccgtcttccccgaccgaccaataaaaaccccgtttactctctcatctcaaaatcgcaaaaaaacaaaacgccgctcaataattaccaaaaacaacgcgaaacgccgactaacgaaaccttttattctctaaactaaaactcgccgactccaaccttaaaacgaaaaaaaaaacgcgaaaaaaaaaaaaaactaacgcctacgcaaaaccgaaaacgaaaacaataacttaaaaaccgaaacaaaacacgaattttaactaatataaaaccataaatacaacacaaaactccccatc

SEQ ID NO: 5021 - DNA, 621 bp, Artificial Sequence
  chemically treated genomic DNA (Homo sapiens) CpG-island No: 5021
tgcggcgatgggcgggttaggggcggggcgcgggtgggttttaaaagtcggtgtttattcgtttcgcgttgtcgcggtaattagtatatttcggtattttttttgcggtagttgcgtttcgtaagcgtagtgtcgtagcgtacgtcggagtggttgtagttgttcggcgcggcgtcgttttgcgcgggttgtgggttgcgggttgcgttttcgttgttggttagttttgtacggttgcgggttttgcggcgttcggtgttttgtaacgttgcggcgggcggtatgggataacgcggttatggtgcgtcgagatcgttttcgtaggtgagtgtgcggtgggaacgagggggtgtggttggcggttttgggattagggcgtaggcgagcggaggattgtgtgttcgtgttcgagttggggttgtttttgggcgaaaattttatcgataggcggtacgtatttcgcgttcgttttgtttatttgaggagggggtgttatttttgttcgtaatggaatgtttagaacgcgggatttttttgggttaggatttttagatttcgggatcgtcgtggtgagatttaggatttttggattttagcgttattttgatatgatttaggatt

SEQ ID NO: 5022 - DNA, 621 bp, Artificial Sequence
  chemically treated genomic DNA (Homo sapiens) CpG-island No: 5022
aatcctaaatcatatcaaaataacgctaaaatccaaaaatcctaaatctcaccacgacgatcccgaaatctaaaaatcctaacccaaaaaaatcccgcgttctaaacattccattacgaacaaaaataacaccccctcctcaaataaacaaaacgaacgcgaaatacgtaccgcctatcgataaaattttcgcccaaaaacaaccccaactcgaacacgaacacacaatcctccgctcgcctacgccctaatcccaaaaccgccaaccacaccccctcgttcccaccgcacactcacctacgaaaacgatctcgacgcaccataaccgcgttatcccataccgcccgccgcaacgttacaaaacaccgaacgccgcaaaacccgcaaccgtacaaaactaaccaacaacgaaaacgcaacccgcaacccacaacccgcgcaaaacgacgccgcgccgaacaactacaaccactccgacgtacgctacgacactacgcttacgaaacgcaactaccgcaaaaaaaataccgaaatatactaattaccgcgacaacgcgaaacgaataaacaccgacttttaaaacccacccgcgccccgcccctaacccgcccatcgccgca

SEQ ID NO: 5023 - DNA, 621 bp, Artificial Sequence
  chemically treated genomic DNA (Homo sapiens) CpG-island No: 5023
gattttaagttatattaagatgacgttggggtttagaaattttaaattttattacgacgatttcggggtttagaaattttaatttaaggaggtttcgcgttttgaatattttattgcgggtaggagtgatattttttttttaagtaggtagagcgggcgcggaatgcgtgtcgtttgtcggtagagttttcgtttagaggtagttttagttcggatacgggtatatagtttttcgttcgtttgcgttttagttttagggtcgttagttatattttttcgtttttatcgtatatttatttgcggaggcgatttcggcgtattatggtcgcgttattttatgtcgttcgtcgtagcgttgtagagtatcgggcgtcgtagagttcgtagtcgtgtagagttggttagtagcgggggcgtagttcgtagtttatagttcgcgtagggcggcgtcgcgtcgggtagttatagttatttcggcgtgcgttgcggtattgcgtttgcgaggcgtagttgtcgtagaggaggtgtcggggtgtgttggttgtcgcggtagcgcggagcgagtgggtatcgatttttagagtttattcgcgtttcgtttttagttcgtttatcgtcgta

SEQ ID NO: 5024 - DNA, 621 bp, Artificial Sequence
  chemically treated genomic DNA (Homo sapiens) CpG-island No: 5024
tacgacgataaacgaactaaaaacgaaacgcgaataaactctaaaaatcgatacccactcgctccgcgctaccgcgacaaccaacacaccccgacacctcctctacgacaactacgcctcgcaaacgcaataccgcaacgcacgccgaaataactataactacccgacgcgacgccgccctacgcgaactataaactacgaactacgcccccgctactaaccaactctacacgactacgaactctacgacgcccgatactctacaacgctacgacgaacgacataaaataacgcgaccataatacgccgaaatcgcctccgcaaataaatatacgataaaaacgaaaaaatataactaacgaccctaaaactaaaacgcaaacgaacgaaaaactatatacccgtatccgaactaaaactacctctaaacgaaaactctaccgacaaacgacacgcattccgcgcccgctctacctacttaaaaaaaaaatatcactcctacccgcaataaaatattcaaaacgcgaaacctccttaaattaaaatttctaaaccccgaaatcgtcgtaataaaatttaaaatttctaaaccccaacgtcatcttaatataacttaaaatc

SEQ ID NO: 5025 - DNA, 762 bp, Artificial Sequence
  chemically treated genomic DNA (Homo sapiens) CpG-island No: 5025
  misc_feature (61)..(61): n is either a, c, g or t
  misc_feature (135)..(135): n is either a, c, g or t
  misc_feature (232)..(232): n is either a, c, g or t
  misc_feature (238)..(238): n is either a, c, g or t
  misc_feature (313)..(313): n is either a, c, g or t
  misc_feature (315)..(315): n is either a, c, g or t
  misc_feature (324)..(324): n is either a, c, g or t
  misc_feature (333)..(333): n is either a, c, g or t
  misc_feature (337)..(337): n is either a, c, g or t
  misc_feature (451)..(451): n is either a, c, g or t
  misc_feature (478)..(478): n is either a, c, g or t
  misc_feature (481)..(481): n is either a, c, g or t
  misc_feature (501)..(501): n is either a, c, g or t
  misc_feature (504)..(504): n is either a, c, g or t
  misc_feature (560)..(560): n is either a, c, g or t
  misc_feature (574)..(574): n is either a, c, g or t
atatttttttgtttgcgttaagatagtttgattcgatttttggtgaattaatgcgtaaaantggcggttgtacgtttgtttttttatttcggcgtataattttgaggaaggacgttacgttattagggtaacgancgtttttgcgtaaaggttcggtttaagggaacgtttagggcgtttcggtttttttcgttgttgtttttgttaggtttagtgcgagattagagtacgnagcganttttcgtcgttttcggttaggtagatgttggtttagttttggcgcgaacgaagcgcgttatttttttgttttttntntaggttaangtttgtttntatnggtagggttcgtttcgggagcgagtatagatcggggtagcgaggttagttaggcgtcgacgaggttttcgaacgcgtacgcgtttcgtttagtttcgggtggcggtcgtcggangtagacgttagttatggaaatcgagangtntggttcgggcggggtcgcgngtngagttcgttattcggtcgtcgtagtttttttgttttcgtattcgggtattaattanatttttcggcgggnatcgtttagttcgggtttatttgtaaaaatgcggtttttgggatgttttcgcgtttttttttttttcgggtgatttgaggtacgttcgttgttcgacgtttatttcgggattttttcggtattttaatgtttaagtttgtgcggagagttaagttgttttaggggtttttattgttataagaaatata

SEQ ID NO: 5026 - DNA, 762 bp, Artificial Sequence
  chemically treated genomic DNA (Homo sapiens) CpG-island No: 5026
  misc_feature (189)..(189): n is either a, c, g or t
  misc_feature (203)..(203): n is either a, c, g or t
  misc_feature (259)..(259): n is either a, c, g or t
  misc_feature (262)..(262): n is either a, c, g or t
  misc_feature (282)..(282): n is either a, c, g or t
  misc_feature (285)..(285): n is either a, c, g or t
  misc_feature (312)..(312): n is either a, c, g or t
  misc_feature (426)..(426): n is either a, c, g or t
  misc_feature (430)..(430): n is either a, c, g or t
  misc_feature (439)..(439): n is either a, c, g or t
  misc_feature (448)..(448): n is either a, c, g or t
  misc_feature (450)..(450): n is either a, c, g or t
  misc_feature (525)..(525): n is either a, c, g or t
  misc_feature (531)..(531): n is either a, c, g or t
  misc_feature (628)..(628): n is either a, c, g or t
  misc_feature (702)..(702): n is either a, c, g or t
tatatttcttataacaataaaaacccctaaaacaacttaactctccgcacaaacttaaacattaaaataccgaaaaaatcccgaaataaacgtcgaacaacgaacgtacctcaaatcacccgaaaaaaaaaaaaacgcgaaaacatcccaaaaaccgcatttttacaaataaacccgaactaaacgatncccgccgaaaaatntaattaatacccgaatacgaaaacaaaaaaactacgacgaccgaataacgaactcnacncgcgaccccgcccgaaccanacntctcgatttccataactaacgtctacntccgacgaccgccacccgaaactaaacgaaacgcgtacgcgttcgaaaacctcgtcgacgcctaactaacctcgctaccccgatctatactcgctcccgaaacgaaccctaccnatanaaacaaacnttaacctananaaaaaacaaaaaaataacgcgcttcgttcgcgccaaaactaaaccaacatctacctaaccgaaaacgacgaaaantcgctncgtactctaatctcgcactaaacctaacaaaaacaacaacgaaaaaaaccgaaacgccctaaacgttcccttaaaccgaacctttacgcaaaaacgntcgttaccctaataacgtaacgtccttcctcaaaattatacgccgaaataaaaaaacaaacgtacaaccgccanttttacgcattaattcaccaaaaatcgaatcaaactatcttaacgcaaacaaaaaaatat

SEQ ID NO: 5027 - DNA, 762 bp, Artificial Sequence
  chemically treated genomic DNA (Homo sapiens) CpG-island No: 5027
  misc_feature (189)..(189): n is either a, c, g or t
  misc_feature (203)..(203): n is either a, c, g or t
  misc_feature (259)..(259): n is either a, c, g or t
  misc_feature (262)..(262): n is either a, c, g or t
  misc_feature (282)..(282): n is either a, c, g or t
  misc_feature (285)..(285): n is either a, c, g or t
  misc_feature (312)..(312): n is either a, c, g or t
  misc_feature (426)..(426): n is either a, c, g or t
  misc_feature (430)..(430): n is either a, c, g or t
  misc_feature (439)..(439): n is either a, c, g or t
  misc_feature (448)..(448): n is either a, c, g or t
  misc_feature (450)..(450): n is either a, c, g or t
  misc_feature (525)..(525): n is either a, c, g or t
  misc_feature (531)..(531): n is either a, c, g or t
  misc_feature (628)..(628): n is either a, c, g or t
  misc_feature (702)..(702): n is either a, c, g or t
tatgttttttgtggtaatgaaagtttttagaataatttggtttttcgtataggtttggatattaagatgtcgaagaagtttcgaggtggacgtcggataacgaacgtattttaagttattcgagggaagagaagacgcgaaggtattttagggatcgtatttttgtaggtaaattcgggttgggcgatnttcgtcgggaggtntggttagtgttcgaatgcggaggtagaaaagttgcggcggtcgaataacgagtttnatncgcggtttcgttcgggttangtntttcggtttttatggttaacgtttatnttcggcggtcgttattcggagttgaacggagcgcgtgcgcgttcggggatttcgtcggcgtttggttggtttcgttgtttcggtttgtgttcgttttcgaggcgggttttgttngtanaagtaggtnttggtttangnaggaagtagggaaatagcgcgtttcgttcgcgttaggattaggttaatatttgtttggtcggggacgacgggagntcgttncgtgttttggtttcgtattgggtttagtagaagtagtagcggggagagtcgagacgttttgaacgtttttttgggtcgggtttttacgtaagagcgntcgttgttttggtgacgtgacgtttttttttaggattgtgcgtcggggtggggaaatagacgtgtaatcgttanttttgcgtattaatttattagaggtcgggttaggttgttttaacgtaggtagaggggtgt

SEQ ID NO: 5028 - DNA, 762 bp, Artificial Sequence
  chemically treated genomic DNA (Homo sapiens) CpG-island No: 5028
  misc_feature (61)..(61): n is either a, c, g or t
  misc_feature (135)..(135): n is either a, c, g or t
  misc_feature (232)..(232): n is either a, c, g or t
  misc_feature (238)..(238): n is either a, c, g or t
  misc_feature (313)..(313): n is either a, c, g or t
  misc_feature (315)..(315): n is either a, c, g or t
  misc_feature (324)..(324): n is either a, c, g or t
  misc_feature (333)..(333): n is either a, c, g or t
  misc_feature (337)..(337): n is either a, c, g or t
  misc_feature (451)..(451): n is either a, c, g or t
  misc_feature (478)..(478): n is either a, c, g or t
  misc_feature (481)..(481): n is either a, c, g or t
  misc_feature (501)..(501): n is either a, c, g or t
  misc_feature (504)..(504): n is either a, c, g or t
  misc_feature (560)..(560): n is either a, c, g or t
  misc_feature (574)..(574): n is either a, c, g or t
acacccctctacctacgttaaaacaacctaacccgacctctaataaattaatacgcaaaantaacgattacacgtctatttccccaccccgacgcacaatcctaaaaaaaaacgtcacgtcaccaaaacaacgancgctcttacgtaaaaacccgacccaaaaaaacgttcaaaacgtctcgactctccccgctactacttctactaaacccaatacgaaaccaaaacacgnaacganctcccgtcgtccccgaccaaacaaatattaacctaatcctaacgcgaacgaaacgcgctatttccctacttcctncntaaaccaanacctacttntacnaacaaaacccgcctcgaaaacgaacacaaaccgaaacaacgaaaccaaccaaacgccgacgaaatccccgaacgcgcacgcgctccgttcaactccgaataacgaccgccgaanataaacgttaaccataaaaaccgaaanacntaacccgaacgaaaccgcgnatnaaactcgttattcgaccgccgcaacttttctacctccgcattcgaacactaaccanacctcccgacgaanatcgcccaacccgaatttacctacaaaaatacgatccctaaaataccttcgcgtcttctcttccctcgaataacttaaaatacgttcgttatccgacgtccacctcgaaacttcttcgacatcttaatatccaaacctatacgaaaaaccaaattattctaaaaactttcattaccacaaaaaacata

SEQ ID NO: 5029 - DNA, 675 bp, Artificial Sequence
  chemically treated genomic DNA (Homo sapiens) CpG-island No: 5029
  misc_feature (90)..(90): n is either a, c, g or t
  misc_feature (326)..(326): n is either a, c, g or t
  misc_feature (334)..(334): n is either a, c, g or t
  misc_feature (363)..(363): n is either a, c, g or t
  misc_feature (420)..(420): n is either a, c, g or t
  misc_feature (451)..(451): n is either a, c, g or t
ttcgagcgttcggtttttcgggaggagcgtcgcgaaagtaggcggggtaggggacggtggtatttgttattcgagcggtttttacggggntttcgggaggtttagcggtcgtcggtttgggagtcgggtgcgagttttttttcgtcgtttcgagttttgcgtcgagcgtcgggtcgcggtatttcgtgttttttgtttagcggtttcggttagtggggttcgtcgttttaggtcgagttttcgttattcgaggtcggggcgtcgaggggaagcgttgtcgagtcgttgtttacgttttcggggtgtcggagcggatattcgtaagngcgggttncgtttcgcgtatttatcgggtttttcgtngtcgtcggttcggtttttttttttttttttttttcgtcgtcgtttttttcgcggttntttcgggcggtcgtattgggcgttgggattnggtttgggttaagtgtcggtagagttgggggttaggttcgcgtcgggcggtggtcgcggtcggtttatagtttgggtattaacgggtatcgggggcgtcggggcggatagcgggaggtgaacgcggttgtaggatacggtgtaggggcgaggagagttaggttaaaaaaaaattcgtcgatcgaaaagggagaaaaaaaatatcggagaaagaaatcgtagaaa

SEQ ID NO: 5030 - DNA, 675 bp, Artificial Sequence
  chemically treated genomic DNA (Homo sapiens) CpG-island No: 5030
  misc_feature (225)..(225): n is either a, c, g or t
  misc_feature (256)..(256): n is either a, c, g or t
  misc_feature (313)..(313): n is either a, c, g or t
  misc_feature (342)..(342): n is either a, c, g or t
  misc_feature (350)..(350): n is either a, c, g or t
  misc_feature (586)..(586): n is either a, c, g or t
tttctacgatttctttctccgatattttttttctcccttttcgatcgacgaatttttttttaacctaactctcctcgcccctacaccgtatcctacaaccgcgttcacctcccgctatccgccccgacgcccccgatacccgttaatacccaaactataaaccgaccgcgaccaccgcccgacgcgaacctaacccccaactctaccgacacttaacccaaaccnaatcccaacgcccaatacgaccgcccgaaanaaccgcgaaaaaaacgacgacgaaaaaaaaaaaaaaaaaaaaaccgaaccgacgacnacgaaaaacccgataaatacgcgaaacgnaacccgcncttacgaatatccgctccgacaccccgaaaacgtaaacaacgactcgacaacgcttcccctcgacgccccgacctcgaataacgaaaactcgacctaaaacgacgaaccccactaaccgaaaccgctaaacaaaaaacacgaaataccgcgacccgacgctcgacgcaaaactcgaaacgacgaaaaaaaactcgcacccgactcccaaaccgacgaccgctaaacctcccgaaanccccgtaaaaaccgctcgaataacaaataccaccgtcccctaccccgcctactttcgcgacgctcctcccgaaaaaccgaacgctcgaa

SEQ ID NO: 5031 - DNA, 675 bp, Artificial Sequence
  chemically treated genomic DNA (Homo sapiens) CpG-island No: 5031
  misc_feature (225)..(225): n is either a, c, g or t
  misc_feature (256)..(256): n is either a, c, g or t
  misc_feature (313)..(313): n is either a, c, g or t
  misc_feature (342)..(342): n is either a, c, g or t
  misc_feature (350)..(350): n is either a, c, g or t
  misc_feature (586)..(586): n is either a, c, g or t
tttttgcggttttttttttcggtgtttttttttttttttttcggtcggcgggtttttttttagtttggtttttttcgtttttatatcgtattttgtagtcgcgtttatttttcgttgttcgtttcggcgttttcggtattcgttagtgtttaggttgtgggtcgatcgcgattatcgttcggcgcgagtttgatttttagttttgtcgatatttgatttagattnagttttaacgtttagtgcggtcgttcggggnagtcgcgggagaggcggcggcggggggaggagggagaggagggtcgaatcggcggtnacgggaggttcggtgagtacgcggagcgnggttcgtntttgcgggtgttcgtttcggtatttcggaggcgtaggtagcggttcgatagcgttttttttcggcgtttcggtttcgggtggcggggattcggtttgaggcgacgggttttattgatcggagtcgttgggtagagggtacgggatgtcgcggttcgacgttcggcgtaaggttcggggcggcggggagggattcgtattcgatttttaggtcggcgatcgttgagtttttcgagantttcgtgggggtcgttcgagtgataggtgttatcgttttttatttcgtttgttttcgcggcgtttttttcggggagtcgggcgttcgga

SEQ ID NO: 5032 - DNA, 675 bp, Artificial Sequence
  chemically treated genomic DNA (Homo sapiens) CpG-island No: 5032
  misc_feature (90)..(90): n is either a, c, g or t
  misc_feature (326)..(326): n is either a, c, g or t
  misc_feature (334)..(334): n is either a, c, g or t
  misc_feature (363)..(363): n is either a, c, g or t
  misc_feature (420)..(420): n is either a, c, g or t
  misc_feature (451)..(451): n is either a, c, g or t
tccgaacgcccgactccccgaaaaaaacgccgcgaaaacaaacgaaataaaaaacgataacacctatcactcgaacgacccccacgaaantctcgaaaaactcaacgatcgccgacctaaaaatcgaatacgaatccctccccgccgccccgaaccttacgccgaacgtcgaaccgcgacatcccgtaccctctacccaacgactccgatcaataaaacccgtcgcctcaaaccgaatccccgccacccgaaaccgaaacgccgaaaaaaaacgctatcgaaccgctacctacgcctccgaaataccgaaacgaacacccgcaaanacgaaccncgctccgcgtactcaccgaacctcccgtnaccgccgattcgaccctcctctccctcctccccccgccgccgcctctcccgcgactnccccgaacgaccgcactaaacgttaaaactnaatctaaatcaaatatcgacaaaactaaaaatcaaactcgcgccgaacgataatcgcgatcgacccacaacctaaacactaacgaataccgaaaacgccgaaacgaacaacgaaaaataaacgcgactacaaaatacgatataaaaacgaaaaaaaccaaactaaaaaaaaacccgccgaccgaaaaaaaaaaaaaaaaacaccgaaaaaaaaaaccgcaaaaa

SEQ ID NO: 5033 - DNA, 1106 bp, Artificial Sequence
  chemically treated genomic DNA (Homo sapiens) CpG-island No: 5033
  misc_feature (89)..(89): n is either a, c, g or t
  misc_feature (92)..(92): n is either a, c, g or t
  misc_feature (109)..(110): n is either a, c, g or t
  misc_feature (114)..(114): n is either a, c, g or t
  misc_feature (125)..(125): n is either a, c, g or t
  misc_feature (192)..(192): n is either a, c, g or t
  misc_feature (238)..(238): n is either a, c, g or t
  misc_feature (266)..(266): n is either a, c, g or t
  misc_feature (294)..(294): n is either a, c, g or t
  misc_feature (309)..(309): n is either a, c, g or t
  misc_feature (339)..(339): n is either a, c, g or t
  misc_feature (762)..(762): n is either a, c, g or t
  misc_feature (895)..(895): n is either a, c, g or t
  misc_feature (932)..(932): n is either a, c, g or t
  misc_feature (978)..(978): n is either a, c, g or t
  misc_feature (1082)..(1082): n is either a, c, g or t
  misc_feature (1096)..(1096): n is either a, c, g or t
ttcgtttcggagtcggaggcgtcgggaggtcggacgtcgcgaagttgttagtttaggaatgtgtcgtttaattcgtaggtcgcgggcgnaanagcggcgggcgcgttgnntggntttgcggcggngagcggggtagaggtacggttggcgtagggtaggttgtagcggcgggtcggacgcgacgtcgcgtantttgagagttcgggggcggggcgttagcggttacgattttttttancgcgcgacgcgtttttcgcgcgtcgttntcggtttttttcgttcgtgtttcggcgncgttcggtttttttntacgtttttggttttttttttttttttttnttttttttttttttttttttttttgttttgggaatgtttggaatttcgtatcgcgagtttgtcgcggtattttcgcgcggcggaagagcgcgcgttagtttcggtatatttgggagtcggattttagttttacgtttcgttttttataagtttttttaaggtaaggcgttcgtttatattcggttttttttacgttcggcgggatagttgggttttcgttttttttgcgaatcggttaggagtttcgcgtttcgttttgggagtggggttgtagttgacggggatttcggatcggcggtggttagagcgcggagtaggcgatacgacgagtcgataggtggcgggtttagttttagtatttcgatcgtcgtcggcgcggattttggtggggatggggcgggcgggtcgatttgggggtggggnttagttttttttttttttttttaggggcggcgatcgtcggggttcgtattgtaggtgcgtgggagaaattttgtagggtggggattcggcggttgttggtcggtagtgattggtgggcgcgttcgaggatttntaaggggcgtagttcgggggtagatttttgggtcggngcggggattttacgttttttttattcgtttttttttgttttttatntttagtttcgtcggttgttgtgggagcggcggtcgttttttttttggaggtcgttttttggtattttcggggtcgtaggaaggaagaggaggtagcggtcgganttttggtgggcggntttgaggtga

SEQ ID NO: 5034 - DNA, 1106 bp, Artificial Sequence
  chemically treated genomic DNA (Homo sapiens) CpG-island No: 5034
  misc_feature (11)..(11): n is either a, c, g or t
  misc_feature (25)..(25): n is either a, c, g or t
  misc_feature (129)..(129): n is either a, c, g or t
  misc_feature (175)..(175): n is either a, c, g or t
  misc_feature (212)..(212): n is either a, c, g or t
  misc_feature (345)..(345): n is either a, c, g or t
  misc_feature (768)..(768): n is either a, c, g or t
  misc_feature (798)..(798): n is either a, c, g or t
  misc_feature (813)..(813): n is either a, c, g or t
  misc_feature (841)..(841): n is either a, c, g or t
  misc_feature (869)..(869): n is either a, c, g or t
  misc_feature (915)..(915): n is either a, c, g or t
  misc_feature (982)..(982): n is either a, c, g or t
  misc_feature (993)..(993): n is either a, c, g or t
  misc_feature (997)..(998): n is either a, c, g or t
  misc_feature (1015)..(1015): n is either a, c, g or t
  misc_feature (1018)..(1018): n is either a, c, g or t
tcacctcaaanccgcccaccaaaantccgaccgctacctcctcttccttcctacgaccccgaaaataccaaaaaacgacctccaaaaaaaaaacgaccgccgctcccacaacaaccgacgaaactaaanataaaaaacaaaaaaaaacgaataaaaaaaacgtaaaatccccgcnccgacccaaaaatctacccccgaactacgccccttanaaatcctcgaacgcgcccaccaatcactaccgaccaacaaccgccgaatccccaccctacaaaatttctcccacgcacctacaatacgaaccccgacgatcgccgcccctaaaaaaaaaaaaaaaaaactaanccccacccccaaatcgacccgcccgccccatccccaccaaaatccgcgccgacgacgatcgaaatactaaaactaaacccgccacctatcgactcgtcgtatcgcctactccgcgctctaaccaccgccgatccgaaatccccgtcaactacaaccccactcccaaaacgaaacgcgaaactcctaaccgattcgcaaaaaaaacgaaaacccaactatcccgccgaacgtaaaaaaaaccgaatataaacgaacgccttaccttaaaaaaacttataaaaaacgaaacgtaaaactaaaatccgactcccaaatataccgaaactaacgcgcgctcttccgccgcgcgaaaataccgcgacaaactcgcgatacgaaattccaaacattcccaaaacaaaaaaaaaaaaaaaaaaaaaaaanaaaaaaaaaaaaaaaaaaccaaaaacgtanaaaaaaaccgaacgncgccgaaacacgaacgaaaaaaaccganaacgacgcgcgaaaaacgcgtcgcgcgntaaaaaaaatcgtaaccgctaacgccccgcccccgaactctcaaantacgcgacgtcgcgtccgacccgccgctacaacctaccctacgccaaccgtacctctaccccgctcnccgccgcaaanccanncaacgcgcccgccgctnttncgcccgcgacctacgaattaaacgacacattcctaaactaacaacttcgcgacgtccgacctcccgacgcctccgactccgaaacgaa

SEQ ID NO: 5035 - DNA, 1106 bp, Artificial Sequence
  chemically treated genomic DNA (Homo sapiens) CpG-island No: 5035
  misc_feature (11)..(11): n is either a, c, g or t
  misc_feature (25)..(25): n is either a, c, g or t
  misc_feature (129)..(129): n is either a, c, g or t
  misc_feature (175)..(175): n is either a, c, g or t
  misc_feature (212)..(212): n is either a, c, g or t
  misc_feature (345)..(345): n is either a, c, g or t
  misc_feature (768)..(768): n is either a, c, g or t
  misc_feature (798)..(798): n is either a, c, g or t
  misc_feature (813)..(813): n is either a, c, g or t
  misc_feature (841)..(841): n is either a, c, g or t
  misc_feature (869)..(869): n is either a, c, g or t
  misc_feature (915)..(915): n is either a, c, g or t
  misc_feature (982)..(982): n is either a, c, g or t
  misc_feature (993)..(993): n is either a, c, g or t
  misc_feature (997)..(998): n is either a, c, g or t
  misc_feature (1015)..(1015): n is either a, c, g or t
  misc_feature (1018)..(1018): n is either a, c, g or t
ttattttaggntcgtttattagggnttcggtcgttgttttttttttttttttgcggtttcgaggatgttaggagacgatttttaggagagggacggtcgtcgtttttatagtagtcggcggggttgagngtgaaagataaaagggggcgggtaagggaagcgtaagattttcgtntcgatttaagggtttgttttcgggttgcgttttttgngagttttcgagcgcgtttattagttattatcggttagtagtcgtcgggtttttattttgtaaagttttttttacgtatttatagtacggatttcgacgatcgtcgtttttagaagggaggagagaggattganttttatttttaagtcggttcgttcgttttatttttattaaggttcgcgtcggcggcggtcgagatattagggttagattcgttatttgtcggttcgtcgtatcgtttgtttcgcgttttagttatcgtcggttcgaggttttcgttagttataattttatttttaaggcgaggcgcggagtttttagtcggttcgtagaggaggcggggatttagttgtttcgtcgagcgtggaaaggatcgggtgtgagcgagcgttttattttggaggagtttgtaggggacgaggcgtagggttgggattcggtttttaggtgtgtcgaagttggcgcgcgttttttcgtcgcgcgaaagtgtcgcggtaaattcgcggtgcggagttttaggtatttttaggataggagggagggagaagaaggagggnagggagggagggagggagttaggggcgtgnaagggagtcgagcgncgtcgaagtacgagcggaaaaggtcganggcggcgcgcgaggggcgcgtcgcgcgntgggaagggtcgtggtcgttgacgtttcgttttcgggtttttaggntgcgcggcgtcgcgttcggttcgtcgttgtagtttgttttgcgttagtcgtgtttttgtttcgtttntcgtcgtaganttanntagcgcgttcgtcgttnttncgttcgcggtttgcgagttagacggtatatttttgggttagtagtttcgcggcgttcggtttttcggcgttttcgatttcggggcggg

SEQ ID NO: 5036 - DNA, 1106 bp, Artificial Sequence
  chemically treated genomic DNA (Homo sapiens) CpG-island No: 5036
  misc_feature (89)..(89): n is either a, c, g or t
  misc_feature (92)..(92): n is either a, c, g or t
  misc_feature (109)..(110): n is either a, c, g or t
  misc_feature (114)..(114): n is either a, c, g or t
  misc_feature (125)..(125): n is either a, c, g or t
  misc_feature (192)..(192): n is either a, c, g or t
  misc_feature (238)..(238): n is either a, c, g or t
  misc_feature (266)..(266): n is either a, c, g or t
  misc_feature (294)..(294): n is either a, c, g or t
  misc_feature (309)..(309): n is either a, c, g or t
  misc_feature (339)..(339): n is either a, c, g or t
  misc_feature (762)..(762): n is either a, c, g or t
  misc_feature (895)..(895): n is either a, c, g or t
  misc_feature (932)..(932): n is either a, c, g or t
  misc_feature (978)..(978): n is either a, c, g or t
  misc_feature (1082)..(1082): n is either a, c, g or t
  misc_feature (1096)..(1096): n is either a, c, g or t
cccgccccgaaatcgaaaacgccgaaaaaccgaacgccgcgaaactactaacccaaaaatataccgtctaactcgcaaaccgcgaacgnaanaacgacgaacgcgctanntaantctacgacganaaacgaaacaaaaacacgactaacgcaaaacaaactacaacgacgaaccgaacgcgacgccgcgcancctaaaaacccgaaaacgaaacgtcaacgaccacgacccttcccancgcgcgacgcgcccctcgcgcgccgccntcgaccttttccgctcgtacttcgacgncgctcgactcccttncacgcccctaactccctccctccctccctnccctccttcttctccctccctcctatcctaaaaatacctaaaactccgcaccgcgaatttaccgcgacactttcgcgcgacgaaaaaacgcgcgccaacttcgacacacctaaaaaccgaatcccaaccctacgcctcgtcccctacaaactcctccaaaataaaacgctcgctcacacccgatcctttccacgctcgacgaaacaactaaatccccgcctcctctacgaaccgactaaaaactccgcgcctcgccttaaaaataaaattataactaacgaaaacctcgaaccgacgataactaaaacgcgaaacaaacgatacgacgaaccgacaaataacgaatctaaccctaatatctcgaccgccgccgacgcgaaccttaataaaaataaaacgaacgaaccgacttaaaaataaaantcaatcctctctcctcccttctaaaaacgacgatcgtcgaaatccgtactataaatacgtaaaaaaaactttacaaaataaaaacccgacgactactaaccgataataactaataaacgcgctcgaaaactcncaaaaaacgcaacccgaaaacaaacccttaaatcganacgaaaatcttacgcttcccttacccgcccccttttatctttcacnctcaaccccgccgactactataaaaacgacgaccgtccctctcctaaaaatcgtctcctaacatcctcgaaaccgcaaaaaaaaaaaaaaaacaacgaccgaanccctaataaacgancctaaaataa

SEQ ID NO: 5037 - DNA, 521 bp, Artificial Sequence
  chemically treated genomic DNA (Homo sapiens) CpG-island No: 5037
  misc_feature (115)..(115): n is either a, c, g or t
  misc_feature (128)..(128): n is either a, c, g or t
  misc_feature (131)..(131): n is either a, c, g or t
  misc_feature (153)..(153): n is either a, c, g or t
  misc_feature (159)..(159): n is either a, c, g or t
  misc_feature (180)..(180): n is either a, c, g or t
  misc_feature (182)..(182): n is either a, c, g or t
  misc_feature (204)..(204): n is either a, c, g or t
  misc_feature (218)..(218): n is either a, c, g or t
  misc_feature (224)..(224): n is either a, c, g or t
  misc_feature (233)..(233): n is either a, c, g or t
  misc_feature (250)..(250): n is either a, c, g or t
  misc_feature (256)..(256): n is either a, c, g or t
  misc_feature (298)..(298): n is either a, c, g or t
  misc_feature (331)..(331): n is either a, c, g or t
  misc_feature (340)..(340): n is either a, c, g or t
  misc_feature (350)..(350): n is either a, c, g or t
  misc_feature (370)..(371): n is either a, c, g or t
  misc_feature (399)..(399): n is either a, c, g or t
  misc_feature (427)..(427): n is either a, c, g or t
  misc_feature (443)..(443): n is either a, c, g or t
  misc_feature (454)..(454): n is either a, c, g or t
gttcgatcggtttttttgggaatatggcgatcggtggttatcggattagtagcggtttcggcggtagtattatagattttttggaggagtggaaggcgaaacgcgagaatgatgncgcgttaagtagnaanttttttcgggttcggttttttncgggangggaattagtagtaacgtcgntntgggaagtttttcgcgggattntttgggtatttcgngcggtncgtcgttgnttaacgagtttaataantaattntttcgggcggcgcgtcggtcgtattcgtgttcgttttcggtnttcggggcggtgaattgcgcggttcgcgtacgnttatgttgnatgcggcgtngttttcggttcgcgtcggtnncggaggacgagtttttagtcgtttttgntttcgattatatcgtcgttttagcgtgnacgaggaggagacggnacgattttttnagagaagggtaagagttcgggttttattgtaagaaaaggtaagagtattaaaatgaagtgaaagttt

SEQ ID NO: 5038 - DNA, 521 bp, Artificial Sequence
  chemically treated genomic DNA (Homo sapiens) CpG-island No: 5038
  misc_feature (68)..(68): n is either a, c, g or t
  misc_feature (79)..(79): n is either a, c, g or t
  misc_feature (95)..(95): n is either a, c, g or t
  misc_feature (123)..(123): n is either a, c, g or t
  misc_feature (151)..(152): n is either a, c, g or t
  misc_feature (172)..(172): n is either a, c, g or t
  misc_feature (182)..(182): n is either a, c, g or t
  misc_feature (191)..(191): n is either a, c, g or t
  misc_feature (224)..(224): n is either a, c, g or t
  misc_feature (266)..(266): n is either a, c, g or t
  misc_feature (272)..(272): n is either a, c, g or t
  misc_feature (289)..(289): n is either a, c, g or t
  misc_feature (298)..(298): n is either a, c, g or t
  misc_feature (304)..(304): n is either a, c, g or t
  misc_feature (318)..(318): n is either a, c, g or t
  misc_feature (340)..(340): n is either a, c, g or t
  misc_feature (342)..(342): n is either a, c, g or t
  misc_feature (363)..(363): n is either a, c, g or t
  misc_feature (369)..(369): n is either a, c, g or t
  misc_feature (391)..(391): n is either a, c, g or t
  misc_feature (394)..(394): n is either a, c, g or t
  misc_feature (407)..(407): n is either a, c, g or t
aaactttcacttcattttaatactcttaccttttcttacaataaaacccgaactcttacccttctctnaaaaaatcgtnccgtctcctcctcgtncacgctaaaacgacgatataatcgaaancaaaaacgactaaaaactcgtcctccgnnaccgacgcgaaccgaaaacnacgccgcatncaacataancgtacgcgaaccgcgcaattcaccgccccgaanaccgaaaacgaacacgaatacgaccgacgcgccgcccgaaanaattanttattaaactcgttaancaacgacgnaccgcncgaaatacccaaanaatcccgcgaaaaacttcccanancgacgttactactaattcccntcccgnaaaaaaccgaacccgaaaaaanttnctacttaacgcgncatcattctcgcgtttcgccttccactcctccaaaaaatctataatactaccgccgaaaccgctactaatccgataaccaccgatcgccatattcccaaaaaaaccgatcgaac

SEQ ID NO: 5039 - DNA, 521 bp, Artificial Sequence
  chemically treated genomic DNA (Homo sapiens) CpG-island No: 5039
  misc_feature (68)..(68): n is either a, c, g or t
  misc_feature (79)..(79): n is either a, c, g or t
  misc_feature (95)..(95): n is either a, c, g or t
  misc_feature (123)..(123): n is either a, c, g or t
  misc_feature (151)..(152): n is either a, c, g or t
  misc_feature (172)..(172): n is either a, c, g or t
  misc_feature (182)..(182): n is either a, c, g or t
  misc_feature (191)..(191): n is either a, c, g or t
  misc_feature (224)..(224): n is either a, c, g or t
  misc_feature (266)..(266): n is either a, c, g or t
  misc_feature (272)..(272): n is either a, c, g or t
  misc_feature (289)..(289): n is either a, c, g or t
  misc_feature (298)..(298): n is either a, c, g or t
  misc_feature (304)..(304): n is either a, c, g or t
  misc_feature (318)..(318): n is either a, c, g or t
  misc_feature (340)..(340): n is either a, c, g or t
  misc_feature (342)..(342): n is either a, c, g or t
  misc_feature (363)..(363): n is either a, c, g or t
  misc_feature (369)..(369): n is either a, c, g or t
  misc_feature (391)..(391): n is either a, c, g or t
  misc_feature (394)..(394): n is either a, c, g or t
  misc_feature (407)..(407): n is either a, c, g or t
aagtttttattttattttaatgtttttgtttttttttgtaatggggttcgagtttttgtttttttttngggaagtcgtntcgtttttttttcgtntacgttggggcggcggtgtagtcgaggntagaggcggttgagggttcgtttttcgnnatcgacgcgggtcgggggtngcgtcgtatntagtatggncgtgcgcgagtcgcgtagtttatcgtttcgggnatcgggaacggatacggatgcggtcggcgcgtcgttcggganggttgnttattgagttcgttggntagcggcgngtcgtncggggtgtttaganggtttcgcggggggttttttangncggcgttgttgttgatttttntttcgnggggagtcgggttcgggggganttnttgtttggcgcgntattattttcgcgtttcgttttttatttttttaggaagtttgtggtgttgtcgtcgaggtcgttgttggttcggtagttatcggtcgttatatttttaaaggggtcggtcgggt

SEQ ID NO: 5040 - DNA, 521 bp, Artificial Sequence
  chemically treated genomic DNA (Homo sapiens) CpG-island No: 5040
  misc_feature (115)..(115): n is either a, c, g or t
  misc_feature (128)..(128): n is either a, c, g or t
  misc_feature (131)..(131): n is either a, c, g or t
  misc_feature (153)..(153): n is either a, c, g or t
  misc_feature (159)..(159): n is either a, c, g or t
  misc_feature (180)..(180): n is either a, c, g or t
  misc_feature (182)..(182): n is either a, c, g or t
  misc_feature (204)..(204): n is either a, c, g or t
  misc_feature (218)..(218): n is either a, c, g or t
  misc_feature (224)..(224): n is either a, c, g or t
  misc_feature (233)..(233): n is either a, c, g or t
  misc_feature (250)..(250): n is either a, c, g or t
  misc_feature (256)..(256): n is either a, c, g or t
  misc_feature (298)..(298): n is either a, c, g or t
  misc_feature (331)..(331): n is either a, c, g or t
  misc_feature (340)..(340): n is either a, c, g or t
  misc_feature (350)..(350): n is either a, c, g or t
  misc_feature (370)..(371): n is either a, c, g or t
  misc_feature (399)..(399): n is either a, c, g or t
  misc_feature (427)..(427): n is either a, c, g or t
  misc_feature (443)..(443): n is either a, c, g or t
  misc_feature (454)..(454): n is either a, c, g or t
acccgaccgacccctttaaaaatataacgaccgataactaccgaaccaacaacgacctcgacgacaacaccacaaacttcctaaaaaaataaaaaacgaaacgcgaaaataatancgcgccaaacaanaantccccccgaacccgactccccncgaaanaaaaatcaacaacaacgccgncntaaaaaaccccccgcgaaaccntctaaacaccccgnacgacncgccgctanccaacgaactcaataancaaccntcccgaacgacgcgccgaccgcatccgtatccgttcccgatncccgaaacgataaactacgcgactcgcgcacgnccatactanatacgacgcnacccccgacccgcgtcgatnncgaaaaacgaaccctcaaccgcctctancctcgactacaccgccgccccaacgtanacgaaaaaaaaacganacgacttcccnaaaaaaaaacaaaaactcgaaccccattacaaaaaaaaacaaaaacattaaaataaaataaaaactt

SEQ ID NO: 5041 - DNA, 523 bp, Artificial Sequence
  chemically treated genomic DNA (Homo sapiens) CpG-island No: 5041
tttggtgtcgtttttagtcgggcgttcggtcgacggcggttgcgtttcgagtttttgcgttaaagaaagtacgggttttcggacgtcgggttttttcgttcgtcgtttttcggcgtttcgtttcgtagaacgtgtaatttcgagattcgggttttgtagttatttttagaattggaggttttcgtttttttaggtcggttttttttcgtttcgttttcgggttcgttttcgtttagttcgcggggtggggtttcggcgagttttagttggtggcgtagagttcggttgtgtttcgaagtgatttttttagttacgtcgttttttcggtttcgggaagggtggggcgtcgagtagggtatttcgggtcgttcgcggcgttttttgcggtgggcggaggatattgaatttatgtggtgcggattattcggtggtttcgtggtaaaaattcggtcgtttcgtaaagtgtaaagaagaattttaaaatttttcgggtagataggtatcgtggtttttattttatata

SEQ ID NO: 5042 - DNA, 523 bp, Artificial Sequence
  chemically treated genomic DNA (Homo sapiens) CpG-island No: 5042
tatataaaataaaaaccacgatacctatctacccgaaaaattttaaaattcttctttacactttacgaaacgaccgaatttttaccacgaaaccaccgaataatccgcaccacataaattcaatatcctccgcccaccgcaaaaaacgccgcgaacgacccgaaataccctactcgacgccccacccttcccgaaaccgaaaaaacgacgtaactaaaaaaatcacttcgaaacacaaccgaactctacgccaccaactaaaactcgccgaaaccccaccccgcgaactaaacgaaaacgaacccgaaaacgaaacgaaaaaaaaccgacctaaaaaaacgaaaacctccaattctaaaaataactacaaaacccgaatctcgaaattacacgttctacgaaacgaaacgccgaaaaacgacgaacgaaaaaacccgacgtccgaaaacccgtactttctttaacgcaaaaactcgaaacgcaaccgccgtcgaccgaacgcccgactaaaaacgacaccaaa

SEQ ID NO: 5043 - DNA, 523 bp, Artificial Sequence
  chemically treated genomic DNA (Homo sapiens) CpG-island No: 5043
tgtataaaatgagggttacggtgtttgtttgttcgagaggttttaaagtttttttttatattttgcggagcggtcggatttttattacgaagttatcgagtagttcgtattatataggtttagtatttttcgtttatcgtaggaaacgtcgcggacggttcggggtgttttgttcggcgttttatttttttcggggtcggggaagcggcgtgattaggaaagttatttcggaatatagtcggattttgcgttattagttggagttcgtcgggattttatttcgcgggttgggcgggggcggattcgggggcggggcggggaggggtcggtttggaaaggcggaagtttttagttttaggggtggttgtagaattcggatttcggagttatacgttttacggagcggggcgtcgggagacggcgggcgagaaaattcggcgttcggaagttcgtgttttttttgacgtaagggttcgagacgtagtcgtcgtcggtcgagcgttcggttagaagcgatattaga

SEQ ID NO: 5044 - DNA, 523 bp, Artificial Sequence
  chemically treated genomic DNA (Homo sapiens) CpG-island No: 5044
tctaatatcgcttctaaccgaacgctcgaccgacgacgactacgtctcgaacccttacgtcaaaaaaaacacgaacttccgaacgccgaattttctcgcccgccgtctcccgacgccccgctccgtaaaacgtataactccgaaatccgaattctacaaccacccctaaaactaaaaacttccgcctttccaaaccgacccctccccgccccgcccccgaatccgcccccgcccaacccgcgaaataaaatcccgacgaactccaactaataacgcaaaatccgactatattccgaaataactttcctaatcacgccgcttccccgaccccgaaaaaaataaaacgccgaacaaaacaccccgaaccgtccgcgacgtttcctacgataaacgaaaaatactaaacctatataatacgaactactcgataacttcgtaataaaaatccgaccgctccgcaaaatataaaaaaaaactttaaaacctctcgaacaaacaaacaccgtaaccctcattttataca

SEQ ID NO: 5045 - DNA, 910 bp, Artificial Sequence
  chemically treated genomic DNA (Homo sapiens) CpG-island No: 5045
tcgcgatgttagttacgttttgtaggtcgggttttttttaggttattatagcggttggcggagggagcgcgcgttttgttggtttggagggggcgggggtcgtggcggttttaaagcgtttagtttaggcgtcgcggggtggggcggttttggcggttgcggggcgtagggcgtagcggttaagcggggttttcggaagtatagttggggtgtttttatttacgattggtcgcgcgttttttttttttcgcgttagggaaggagcggttgcggttttcgtcgggcggaggtacggggggcgtacgaggggcggaggggatcgcgtcgcggaggagatggcgcggtacgtgcggtgacggtattcgagttttgagggttttagtttcgcgtttcgcgttttcgggatagtatggagcgttcggagttcgagttgattcggtagagttggcgggtagtgagtcgtagttcgttggagtacggtatcgttttgtttgttaggtgagggttatacgagcgttcggggatgcgggtggaggttgtttcggcgggaaaggggttacgcggtaggatcggtttcgaaggagggaaaattggtcgttgtcggggcgttggggcgtttgttagatgtgcgttagaggagcggggcgcggcgacgggtggtatagtttttttgtttttttttcgatcgtgggcgtttgttgttaattagcgtcgtatattatttttttagcggggtttatcgggtcgggcgggattttttttcgcggatttttttatatttgggcgggtggattttcgtttttgcgcggcgtttttatttcgttttgtgttttttgcgttttttttaggtagcgattgtaggggtgtatttcgttgtcggtattagggtattggggtgtttcgagagtcg

SEQ ID NO: 5046 - DNA, 910 bp, Artificial Sequence
  chemically treated genomic DNA (Homo sapiens) CpG-island No: 5046
cgactctcgaaacaccccaataccctaataccgacaacgaaatacacccctacaatcgctacctaaaaaaaacgcaaaaaacacaaaacgaaataaaaacgccgcgcaaaaacgaaaatccacccgcccaaatataaaaaaatccgcgaaaaaaaatcccgcccgacccgataaaccccgctaaaaaaataatatacgacgctaattaacaacaaacgcccacgatcgaaaaaaaaacaaaaaaactataccacccgtcgccgcgccccgctcctctaacgcacatctaacaaacgccccaacgccccgacaacgaccaattttccctccttcgaaaccgatcctaccgcgtaacccctttcccgccgaaacaacctccacccgcatccccgaacgctcgtataaccctcacctaacaaacaaaacgataccgtactccaacgaactacgactcactacccgccaactctaccgaatcaactcgaactccgaacgctccatactatcccgaaaacgcgaaacgcgaaactaaaaccctcaaaactcgaataccgtcaccgcacgtaccgcgccatctcctccgcgacgcgatcccctccgcccctcgtacgccccccgtacctccgcccgacgaaaaccgcaaccgctccttccctaacgcgaaaaaaaaaaaacgcgcgaccaatcgtaaataaaaacaccccaactatacttccgaaaaccccgcttaaccgctacgccctacgccccgcaaccgccaaaaccgccccaccccgcgacgcctaaactaaacgctttaaaaccgccacgacccccgccccctccaaaccaacaaaacgcgcgctccctccgccaaccgctataataacctaaaaaaaacccgacctacaaaacgtaactaacatcgcga

SEQ ID NO: 5047 - DNA, 910 bp, Artificial Sequence
  chemically treated genomic DNA (Homo sapiens) CpG-island No: 5047
cggttttcggggtattttagtattttgatatcggtagcggggtgtatttttgtagtcgttatttaaggaagacgtaggaggtataaggcggggtggaggcgtcgcgtagggacggaggtttattcgtttagatgtggggagattcgcgggaggggatttcgttcggttcggtgagtttcgttgggagagtggtgtgcggcgttggttggtaataggcgtttacggtcgagagagaggtagaggggttgtgttattcgtcgtcgcgtttcgtttttttggcgtatatttggtaggcgttttagcgtttcggtagcggttagttttttttttttcggggtcggttttgtcgcgtgatttttttttcgtcgaggtagtttttattcgtattttcgggcgttcgtgtagtttttatttggtaaataggacggtgtcgtgttttagcgggttgcggtttattgttcgttagttttgtcggattagttcgggtttcgggcgttttatgttgtttcggggacgcggagcgcggggttgggatttttagggttcgggtgtcgttatcgtacgtgtcgcgttatttttttcgcgacgcggtttttttcgtttttcgtacgtttttcgtgttttcgttcggcgggggtcgtagtcgttttttttttggcgcgggagagaaaaggcgcgcggttagtcgtaggtggagatattttagttgtgttttcggggatttcgtttggtcgttgcgttttgcgtttcgtagtcgttagagtcgttttatttcgcgacgtttgggttgggcgttttaaagtcgttacggttttcgttttttttaggttagtaaggcgcgcgtttttttcgttagtcgttatggtggtttgggaaaggttcggtttgtagaacgtaattgatatcgcgg

SEQ ID NO: 5048 - DNA, 910 bp, Artificial Sequence
  chemically treated genomic DNA (Homo sapiens) CpG-island No: 5048
ccgcgatatcaattacgttctacaaaccgaacctttcccaaaccaccataacgactaacgaaaaaaacgcgcgccttactaacctaaaaaaaacgaaaaccgtaacgactttaaaacgcccaacccaaacgtcgcgaaataaaacgactctaacgactacgaaacgcaaaacgcaacgaccaaacgaaatccccgaaaacacaactaaaatatctccacctacgactaaccgcgcgccttttctctcccgcgccaaaaaaaaaacgactacgacccccgccgaacgaaaacacgaaaaacgtacgaaaaacgaaaaaaaccgcgtcgcgaaaaaaataacgcgacacgtacgataacgacacccgaaccctaaaaatcccaaccccgcgctccgcgtccccgaaacaacataaaacgcccgaaacccgaactaatccgacaaaactaacgaacaataaaccgcaacccgctaaaacacgacaccgtcctatttaccaaataaaaactacacgaacgcccgaaaatacgaataaaaactacctcgacgaaaaaaaaatcacgcgacaaaaccgaccccgaaaaaaaaaaaactaaccgctaccgaaacgctaaaacgcctaccaaatatacgccaaaaaaacgaaacgcgacgacgaataacacaacccctctacctctctctcgaccgtaaacgcctattaccaaccaacgccgcacaccactctcccaacgaaactcaccgaaccgaacgaaatcccctcccgcgaatctccccacatctaaacgaataaacctccgtccctacgcgacgcctccaccccgccttatacctcctacgtcttccttaaataacgactacaaaaatacaccccgctaccgatatcaaaatactaaaataccccgaaaaccg

SEQ ID NO: 5049 - DNA, 991 bp, Artificial Sequence
  chemically treated genomic DNA (Homo sapiens) CpG-island No: 5049
  misc_feature (35)..(35): n is either a, c, g or t
  misc_feature (61)..(61): n is either a, c, g or t
  misc_feature (98)..(98): n is either a, c, g or t
  misc_feature (111)..(111): n is either a, c, g or t
  misc_feature (129)..(129): n is either a, c, g or t
  misc_feature (277)..(277): n is either a, c, g or t
  misc_feature (290)..(290): n is either a, c, g or t
  misc_feature (297)..(297): n is either a, c, g or t
  misc_feature (311)..(311): n is either a, c, g or t
  misc_feature (321)..(321): n is either a, c, g or t
  misc_feature (340)..(340): n is either a, c, g or t
  misc_feature (532)..(532): n is either a, c, g or t
  misc_feature (611)..(611): n is either a, c, g or t
  misc_feature (626)..(626): n is either a, c, g or t
cggtagtggcgcgtgtggttagtttcgcgcgcgtngtcgcgagggtcggggtagggcgtgnggtttatttcggtcgagtcgttatttttttttcgggncggcggtaggttncgtttcggcgtttttagngattcggttttcgtcgttcggtgttttcgaaggacgagagttaaaaggtttagagttcggaagtcgggcgttcgtttttttttcgttttcggttcgttttcggtttttttttttttcgttaagtcgggacgttagtagtttcggggangttaggcggcggncgttttngtgttcgggcgggntgggttcgtnttttcgcgggcggtcggangacgtgcgggcgcgggggtttttgggtttcgggtattgcggggggttgcgggttcggcgttcgggaaaggcgggttatgggcgcgggtgcgggcgttttagtcggtcgcgatcgcggggtgagttttgtttttcggcgttttagtaggattttcgcgcgggttgcgagtagggtgttttttttgtcgcgggntaaataagtttgtgtagacgcggttgggagcgcggcggggttgtatttgtttcggttgtagggcgggtttgtcgggggntattttttcgggggnttcggggcggttcggtcggggtaggggagagtgagcgggtgcgtgtaggggttgtgggggggcggggacggcgttcggcgcggtcgggatggggtgggggtgcgcgaggcgtcgtacgagtcgcgttttttttcggagttttgagagttcgttcgttattcgggagggcgttgcggttggtttcggggagggggcgagggtagggtgtggggtgcgtatagttttttttttaggcggcgacgtttatttagaagtagttttttttcgtttcgttattaagagaggttttcggttagcggagggtttgtttcgttttttggtgaatttgaatagaggtagaggtaaaagtaaaacgtatgtatttt

SEQ ID NO: 5050 - DNA, 991 bp, Artificial Sequence
  chemically treated genomic DNA (Homo sapiens) CpG-island No: 5050
  misc_feature (366)..(366): n is either a, c, g or t
  misc_feature (381)..(381): n is either a, c, g or t
  misc_feature (460)..(460): n is either a, c, g or t
  misc_feature (652)..(652): n is either a, c, g or t
  misc_feature (671)..(671): n is either a, c, g or t
  misc_feature (681)..(681): n is either a, c, g or t
  misc_feature (695)..(695): n is either a, c, g or t
  misc_feature (702)..(702): n is either a, c, g or t
  misc_feature (715)..(715): n is either a, c, g or t
  misc_feature (863)..(863): n is either a, c, g or t
  misc_feature (881)..(881): n is either a, c, g or t
  misc_feature (894)..(894): n is either a, c, g or t
  misc_feature (931)..(931): n is either a, c, g or t
  misc_feature (957)..(957): n is either a, c, g or t
aaaatacatacgttttacttttacctctacctctattcaaattcaccaaaaaacgaaacaaaccctccgctaaccgaaaacctctcttaataacgaaacgaaaaaaaactacttctaaataaacgtcgccgcctaaaaaaaaaactatacgcaccccacaccctaccctcgccccctccccgaaaccaaccgcaacgccctcccgaataacgaacgaactctcaaaactccgaaaaaaaacgcgactcgtacgacgcctcgcgcacccccaccccatcccgaccgcgccgaacgccgtccccgcccccccacaacccctacacgcacccgctcactctcccctaccccgaccgaaccgccccgaancccccgaaaaaatancccccgacaaacccgccctacaaccgaaacaaatacaaccccgccgcgctcccaaccgcgtctacacaaacttatttancccgcgacaaaaaaaacaccctactcgcaacccgcgcgaaaatcctactaaaacgccgaaaaacaaaactcaccccgcgatcgcgaccgactaaaacgcccgcacccgcgcccataacccgcctttcccgaacgccgaacccgcaaccccccgcaatacccgaaacccaaaaacccccgcgcccgcacgtcntccgaccgcccgcgaaaanacgaacccancccgcccgaacacnaaaacgnccgccgcctaacntccccgaaactactaacgtcccgacttaacgaaaaaaaaaaaaaccgaaaacgaaccgaaaacgaaaaaaaaacgaacgcccgacttccgaactctaaaccttttaactctcgtccttcgaaaacaccgaacgacgaaaaccgaatcnctaaaaacgccgaaacgnaacctaccgccgncccgaaaaaaaaataacgactcgaccgaaataaaccncacgccctaccccgaccctcgcgacnacgcgcgcgaaactaaccacacgcgccactaccg

SEQ ID NO: 5051 - DNA, 991 bp, Artificial Sequence
  chemically treated genomic DNA (Homo sapiens) CpG-island No: 5051
  misc_feature (366)..(366): n is either a, c, g or t
  misc_feature (381)..(381): n is either a, c, g or t
  misc_feature (460)..(460): n is either a, c, g or t
  misc_feature (652)..(652): n is either a, c, g or t
  misc_feature (671)..(671): n is either a, c, g or t
  misc_feature (681)..(681): n is either a, c, g or t
  misc_feature (695)..(695): n is either a, c, g or t
  misc_feature (702)..(702): n is either a, c, g or t
  misc_feature (715)..(715): n is either a, c, g or t
  misc_feature (863)..(863): n is either a, c, g or t
  misc_feature (881)..(881): n is either a, c, g or t
  misc_feature (894)..(894): n is either a, c, g or t
  misc_feature (931)..(931): n is either a, c, g or t
  misc_feature (957)..(957): n is either a, c, g or t
aaaatatatacgttttgtttttgtttttgtttttgtttaagtttattaagagacggagtaaatttttcgttgatcggaagttttttttggtagcggaacgagagggagttgtttttgggtaaacgtcgtcgtttaggagggaagttgtgcgtattttatattttgttttcgtttttttttcgggattaatcgtagcgttttttcgggtgacggacgggtttttaggatttcggagggggacgcggttcgtgcggcgtttcgcgtatttttattttatttcggtcgcgtcgagcgtcgttttcgtttttttataatttttgtacgtattcgtttatttttttttgtttcggtcgagtcgtttcgggnttttcgggaaggtgnttttcggtaagttcgttttgtagtcggagtaggtgtagtttcgtcgcgtttttaatcgcgtttgtataaatttgtttgnttcgcggtaaggggaatattttgttcgtagttcgcgcgggggttttgttggagcgtcgagagataggatttatttcgcgatcgcggtcggttggggcgttcgtattcgcgtttatggttcgtttttttcgggcgtcgagttcgtagtttttcgtagtgttcggagtttagaagttttcgcgttcgtacgttnttcggtcgttcgcgggaangcggatttanttcgttcgggtatnagggcgntcgtcgtttggtnttttcggggttgttggcgtttcggtttaacgggggggaggagggtcgggggcggatcgagggcggggggggggcgggcgttcggttttcgggttttgggttttttagttttcgtttttcggggatatcgggcggcgggggtcgggttnttagaggcgtcggagcgngatttgtcgtcgnttcgggggaggggtggcggttcggtcggagtgggttntacgttttgtttcggttttcgcgatnacgcgcgcggggttggttatacgcgttattgtcg

SEQ ID NO: 5052 - DNA, 991 bp, Artificial Sequence
  chemically treated genomic DNA (Homo sapiens) CpG-island No: 5052
  misc_feature (35)..(35): n is either a, c, g or t
  misc_feature (61)..(61): n is either a, c, g or t
  misc_feature (98)..(98): n is either a, c, g or t
  misc_feature (111)..(111): n is either a, c, g or t
  misc_feature (129)..(129): n is either a, c, g or t
  misc_feature (277)..(277): n is either a, c, g or t
  misc_feature (290)..(290): n is either a, c, g or t
  misc_feature (297)..(297): n is either a, c, g or t
  misc_feature (311)..(311): n is either a, c, g or t
  misc_feature (321)..(321): n is either a, c, g or t
  misc_feature (340)..(340): n is either a, c, g or t
  misc_feature (532)..(532): n is either a, c, g or t
  misc_feature (611)..(611): n is either a, c, g or t
  misc_feature (626)..(626): n is either a, c, g or t
cgacaataacgcgtataaccaaccccgcgcgcgtnatcgcgaaaaccgaaacaaaacgtanaacccactccgaccgaaccgccacccctcccccgaancgacgacaaatcncgctccgacgcctctaanaacccgacccccgccgcccgatatccccgaaaaacgaaaactaaaaaacccaaaacccgaaaaccgaacgcccgccccccccccgccctcgatccgcccccgaccctcctcccccccgttaaaccgaaacgccaacaaccccgaaaanaccaaacgacgancgccctnatacccgaacgaantaaatccgcnttcccgcgaacgaccgaanaacgtacgaacgcgaaaacttctaaactccgaacactacgaaaaactacgaactcgacgcccgaaaaaaacgaaccataaacgcgaatacgaacgccccaaccgaccgcgatcgcgaaataaatcctatctctcgacgctccaacaaaacccccgcgcgaactacgaacaaaatattccccttaccgcgaancaaacaaatttatacaaacgcgattaaaaacgcgacgaaactacacctactccgactacaaaacgaacttaccgaaaancaccttcccgaaaancccgaaacgactcgaccgaaacaaaaaaaaataaacgaatacgtacaaaaattataaaaaaacgaaaacgacgctcgacgcgaccgaaataaaataaaaatacgcgaaacgccgcacgaaccgcgtccccctccgaaatcctaaaaacccgtccgtcacccgaaaaaacgctacgattaatcccgaaaaaaaaacgaaaacaaaatataaaatacgcacaacttccctcctaaacgacgacgtttacccaaaaacaactccctctcgttccgctaccaaaaaaaacttccgatcaacgaaaaatttactccgtctcttaataaacttaaacaaaaacaaaaacaaaaacaaaacgtatatatttt

SEQ ID NO: 5053 - DNA, 1153 bp, Artificial Sequence
  chemically treated genomic DNA (Homo sapiens) CpG-island No: 5053
ttacgaagtttatttaggattgaggaagtaaaaacgggataattagaggcgcgttcgatattttagaataagtacggattattttgggttaggaatagtcgcggggtagttttggcgtgagtgtgaggggtagagcgcgggcgttataaattgcggggtcggcggtcgatagggagaggtcgcgggtacgtttttttcgtaaacgttcggaaagttcgagggcggtttgcgcgtttaggagatttggtttaggcgtaggttaggcgcggagtggggaatttcgcggtagggatttagcggtgtttgttcggcggtttcggcgtttaggtgcgcgtttaggacgagtagcgttttttggtcgcggcgtcggtataggtaattttataattttaagcggcgtattttaacgataagaattatattttaggattttagtttttcgttcgttttagtcggcgtcgcgagtcggaggcggtgggggaagggcgtttggagggggggtggggttgcggttgcggcgcgattttcgttagtcgtatagatttggtttcggattttcgggtcgttttgagtggttgtttatgtttggtcgattcgggtattagtcggtttgtcggtttcggatcgggtgtttatcgtgtcgagttcgcgttggtttcggttggcgaggcggttgcgttcggcgggttcgttttagttaaagaaaggatcgggcgttttttagtttttagtagttgtcggcggagtcgttgttttttcgcgttcgtgggtttcgtttttttatttgtattaagttcgttttcgcggttcgttttttttatttgtattttgtcggattattttaattgtatatcgttcgttaggcgcggttcgttttcgttatttgtatattgttcgtttattttatttgtattttttttttggttgttagaaggtttcgcgtcgtgggcgggacgtatcggttgatcggttgtaggttttcgttcgcggatgttgagaatcgtagttgtataaggtaggttggaaaaattttattgcggtgaggcggaagtttagtgtcgtcggaaaggtaaaattttgttcgtgtgaagttagatttattaggataagagaaatttaggattagcgtaggataggcgtttaataagtattt

SEQ ID NO: 5054 - DNA, 1153 bp, Artificial Sequence
  chemically treated genomic DNA (Homo sapiens) CpG-island No: 5054
aaatacttattaaacgcctatcctacgctaatcctaaatttctcttatcctaataaatctaacttcacacgaacaaaattttacctttccgacgacactaaacttccgcctcaccgcaataaaatttttccaacctaccttatacaactacgattctcaacatccgcgaacgaaaacctacaaccgatcaaccgatacgtcccgcccacgacgcgaaaccttctaacaaccaaaaaaaaaatacaaataaaataaacgaacaatatacaaataacgaaaacgaaccgcgcctaacgaacgatatacaattaaaataatccgacaaaatacaaataaaaaaaacgaaccgcgaaaacgaacttaatacaaataaaaaaacgaaacccacgaacgcgaaaaaacaacgactccgccgacaactactaaaaactaaaaaacgcccgatcctttctttaactaaaacgaacccgccgaacgcaaccgcctcgccaaccgaaaccaacgcgaactcgacacgataaacacccgatccgaaaccgacaaaccgactaatacccgaatcgaccaaacataaacaaccactcaaaacgacccgaaaatccgaaaccaaatctatacgactaacgaaaatcgcgccgcaaccgcaaccccaccccccctccaaacgcccttcccccaccgcctccgactcgcgacgccgactaaaacgaacgaaaaactaaaatcctaaaatataattcttatcgttaaaatacgccgcttaaaattataaaattacctataccgacgccgcgaccaaaaaacgctactcgtcctaaacgcgcacctaaacgccgaaaccgccgaacaaacaccgctaaatccctaccgcgaaattccccactccgcgcctaacctacgcctaaaccaaatctcctaaacgcgcaaaccgccctcgaactttccgaacgtttacgaaaaaaacgtacccgcgacctctccctatcgaccgccgaccccgcaatttataacgcccgcgctctacccctcacactcacgccaaaactaccccgcgactattcctaacccaaaataatccgtacttattctaaaatatcgaacgcgcctctaattatcccgtttttacttcctcaatcctaaataaacttcgtaa

SEQ ID NO: 5055 - DNA, 1153 bp, Artificial Sequence
  chemically treated genomic DNA (Homo sapiens) CpG-island No: 5055
aaatgtttattaagcgtttgttttgcgttagttttaggttttttttgttttgataggtttagttttatacgagtaggattttgttttttcggcggtattaggttttcgttttatcgtagtggggtttttttagtttattttgtgtagttgcggtttttagtattcgcgggcggaggtttgtagtcggttagtcggtgcgtttcgtttacggcgcggggttttttggtagttaagaaggaaatatagatgaggtgggcggatagtatgtagatgacgggggcgggtcgcgtttggcgggcggtgtgtagttgaggtggttcggtaggatgtagatgaagggggcgggtcgcgagggcgggtttgatgtagatgagggggcggggtttacgggcgcgggagagtagcggtttcgtcggtagttgttgggaattggaaggcgttcggttttttttttgattggagcggattcgtcggacgtaatcgtttcgttagtcggagttagcgcgagttcggtacggtggatattcggttcgaggtcggtaagtcggttggtgttcgagtcggttaagtatgggtaattatttaggacggttcgaggattcggaattaggtttgtgcggttggcgggggtcgcgtcgtagtcgtaattttattttttttttaggcgttttttttttatcgttttcggttcgcggcgtcgattggggcgagcgaaaggttaaggttttggggtgtgatttttgtcgttggaatgcgtcgtttgggattgtgaaattatttgtgtcgacgtcgcgattagaaaacgttgttcgttttgaacgcgtatttgggcgtcggggtcgtcgggtaggtatcgttgggtttttgtcgcggggttttttatttcgcgtttggtttgcgtttagattaggttttttgagcgcgtaggtcgttttcggatttttcgggcgtttgcggggagggcgtgttcgcggtttttttttgtcggtcgtcggtttcgtagtttgtggcgttcgcgttttgttttttatatttacgttagggttgtttcgcgattgtttttaatttagaatagttcgtgtttgttttggggtgtcgggcgcgtttttggttatttcgtttttatttttttagttttgagtgagtttcgtgg

SEQ ID NO: 5056 - DNA, 1153 bp, Artificial Sequence
  chemically treated genomic DNA (Homo sapiens) CpG-island No: 5056
ccacgaaactcactcaaaactaaaaaaataaaaacgaaataaccaaaaacgcgcccgacaccccaaaacaaacacgaactattctaaattaaaaacaatcgcgaaacaaccctaacgtaaatataaaaaacaaaacgcgaacgccacaaactacgaaaccgacgaccgacaaaaaaaaaccgcgaacacgccctccccgcaaacgcccgaaaaatccgaaaacgacctacgcgctcaaaaaacctaatctaaacgcaaaccaaacgcgaaataaaaaaccccgcgacaaaaacccaacgatacctacccgacgaccccgacgcccaaatacgcgttcaaaacgaacaacgttttctaatcgcgacgtcgacacaaataatttcacaatcccaaacgacgcattccaacgacaaaaatcacaccccaaaaccttaacctttcgctcgccccaatcgacgccgcgaaccgaaaacgataaaaaaaaaacgcctaaaaaaaaaataaaattacgactacgacgcgacccccgccaaccgcacaaacctaattccgaatcctcgaaccgtcctaaataattacccatacttaaccgactcgaacaccaaccgacttaccgacctcgaaccgaatatccaccgtaccgaactcgcgctaactccgactaacgaaacgattacgtccgacgaatccgctccaatcaaaaaaaaaaccgaacgccttccaattcccaacaactaccgacgaaaccgctactctcccgcgcccgtaaaccccgccccctcatctacatcaaacccgccctcgcgacccgcccccttcatctacatcctaccgaaccacctcaactacacaccgcccgccaaacgcgacccgcccccgtcatctacatactatccgcccacctcatctatatttccttcttaactaccaaaaaaccccgcgccgtaaacgaaacgcaccgactaaccgactacaaacctccgcccgcgaatactaaaaaccgcaactacacaaaataaactaaaaaaaccccactacgataaaacgaaaacctaataccgccgaaaaaacaaaatcctactcgtataaaactaaacctatcaaaacaaaaaaaacctaaaactaacgcaaaacaaacgcttaataaacattt

SEQ ID NO: 5057 - DNA, 925 bp, Artificial Sequence
  chemically treated genomic DNA (Homo sapiens) CpG-island No: 5057
attagagcgtcgcgttggagttcgaggcgtcgtcgcgaattgttggcgtttcgggttcgcggtgggtcgttcggggacggtttcgagttggatttcgacgtgttgtagcgtttcgagcgggttcggttgagcgagaatattcggttggttattcgttacgtcgtgcgtatttttcgggagtatttgagcgagaaggcgtagagttcggatttcgagattatggataagggggcgttgtgtcgcgtgttgcgttttttttatgtcgaggttcgttttaaaagcggttagttttatagtaagtcgtcgtttattagtattcgtagtttttttaatcgttattttaatgagttttcgtattgtcgtacgttcgattttattaaggatttcgagttgcgtagcgttaatttgacgttggtcgcggttattcgtaagttcgaggagtagggcgtcgggtcggtggtgtagaagtaagttattacgcgcgtcgatttgcgtaagttgtatatttttagcgtttttagtattaatacgtttttcggttgtttaataaggtttggttcgagacgtgtatgtatttttgtattcgcggtcgcgagaattagcgtgagttggaggaggatttttttgggttggttatggacgaggacggtcgtaagttcgtttattttaagtttttcgggttttattataagtcgcgttcgtcgtcgtggagtaagaagcgcgtcgagagtagcgacgaggagaatttgtttcgtatgtatgagacgggtatcgagttttgtttttacgttagtttcgttaagtatttgtcgaaacgtaattttttttgtaaggcgtttttttagcggtttcgggattattgtagcgagggcgatgtgatttggtacgagaataaagttatcggtaagaatttgttaggtattcg

SEQ ID NO: 5058 - DNA, 925 bp, Artificial Sequence
  chemically treated genomic DNA (Homo sapiens) CpG-island No: 5058
cgaatacctaacaaattcttaccgataactttattctcgtaccaaatcacatcgccctcgctacaataatcccgaaaccgctaaaaaaacgccttacaaaaaaaattacgtttcgacaaatacttaacgaaactaacgtaaaaacaaaactcgatacccgtctcatacatacgaaacaaattctcctcgtcgctactctcgacgcgcttcttactccacgacgacgaacgcgacttataataaaacccgaaaaacttaaaataaacgaacttacgaccgtcctcgtccataaccaacccaaaaaaatcctcctccaactcacgctaattctcgcgaccgcgaatacaaaaatacatacacgtctcgaaccaaaccttattaaacaaccgaaaaacgtattaatactaaaaacgctaaaaatatacaacttacgcaaatcgacgcgcgtaataacttacttctacaccaccgacccgacgccctactcctcgaacttacgaataaccgcgaccaacgtcaaattaacgctacgcaactcgaaatccttaataaaatcgaacgtacgacaatacgaaaactcattaaaataacgattaaaaaaactacgaatactaataaacgacgacttactataaaactaaccgcttttaaaacgaacctcgacataaaaaaaacgcaacacgcgacacaacgcccccttatccataatctcgaaatccgaactctacgccttctcgctcaaatactcccgaaaaatacgcacgacgtaacgaataaccaaccgaatattctcgctcaaccgaacccgctcgaaacgctacaacacgtcgaaatccaactcgaaaccgtccccgaacgacccaccgcgaacccgaaacgccaacaattcgcgacgacgcctcgaactccaacgcgacgctctaat

SEQ ID NO: 5059 - DNA, 925 bp, Artificial Sequence
  chemically treated genomic DNA (Homo sapiens) CpG-island No: 5059
cgagtgtttagtaagtttttgtcgatggttttgttttcgtattaggttatatcgttttcgttgtagtggtttcggggtcgttggaagaacgttttgtagagagggttgcgtttcgataggtatttgacgaagttggcgtaggggtagaattcggtgttcgttttatatatgcggggtaagtttttttcgtcgttgttttcggcgcgttttttgttttacgacgacgagcgcgatttgtggtagggttcgagggatttgaagtagacgaatttgcgatcgttttcgtttatggttagtttaaaagagtttttttttaatttacgttggttttcgcggtcgcgggtatagaagtatatgtacgtttcgaattagattttgttgagtagtcgaagggcgtgttggtgttgaagacgttggaggtgtatagtttgcgtaggtcggcgcgcgtgatggtttgtttttgtattatcggttcggcgttttgtttttcgagtttgcggatgatcgcggttagcgttaggttggcgttgcgtagttcggggtttttggtgaggtcgagcgtgcggtagtacgggggtttattgaggtagcggttgagggagttgcggatgttgatgagcgacgatttgttgtagagttggtcgtttttggagcgggtttcggtatagaaggagcgtagtacgcggtatagcgtttttttgtttatggtttcgaagttcgggttttgcgttttttcgtttaggtattttcggaagatgcgtacggcgtagcgggtggttagtcgggtgttttcgtttagtcgggttcgttcggggcgttgtagtacgtcggggtttagttcggagtcgttttcgggcggtttatcgcgggttcggggcgttagtagttcgcggcggcgtttcgggttttagcgcggcgttttggt

SEQ ID NO: 5060 - DNA, 925 bp, Artificial Sequence
  chemically treated genomic DNA (Homo sapiens) CpG-island No: 5060
accaaaacgccgcgctaaaacccgaaacgccgccgcgaactactaacgccccgaacccgcgataaaccgcccgaaaacgactccgaactaaaccccgacgtactacaacgccccgaacgaacccgactaaacgaaaacacccgactaaccacccgctacgccgtacgcatcttccgaaaatacctaaacgaaaaaacgcaaaacccgaacttcgaaaccataaacaaaaaaacgctataccgcgtactacgctccttctataccgaaacccgctccaaaaacgaccaactctacaacaaatcgtcgctcatcaacatccgcaactccctcaaccgctacctcaataaacccccgtactaccgcacgctcgacctcaccaaaaaccccgaactacgcaacgccaacctaacgctaaccgcgatcatccgcaaactcgaaaaacaaaacgccgaaccgataatacaaaaacaaaccatcacgcgcgccgacctacgcaaactatacacctccaacgtcttcaacaccaacacgcccttcgactactcaacaaaatctaattcgaaacgtacatatacttctatacccgcgaccgcgaaaaccaacgtaaattaaaaaaaaactcttttaaactaaccataaacgaaaacgatcgcaaattcgtctacttcaaatccctcgaaccctaccacaaatcgcgctcgtcgtcgtaaaacaaaaaacgcgccgaaaacaacgacgaaaaaaacttaccccgcatatataaaacgaacaccgaattctacccctacgccaacttcgtcaaatacctatcgaaacgcaaccctctctacaaaacgttcttccaacgaccccgaaaccactacaacgaaaacgatataacctaatacgaaaacaaaaccatcgacaaaaacttactaaacactcg

SEQ ID NO: 5061 - DNA, 656 bp, Artificial Sequence
  chemically treated genomic DNA (Homo sapiens) CpG-island No: 5061
  misc_feature (198)..(198): n is either a, c, g or t
  misc_feature (384)..(384): n is either a, c, g or t
cggagttgcggaggttagacgggggattttagttgagggggtcggcgtcggagaatttgcgacgtcggatcgggacggcgagaaatagtttgtaatgtcggggtgacggatagcgagcggtagcgattgaaagtaatacgggtaacgatatgcgaggagtcgtggcgcggcgtcgggcgcgggattgatagttttagntttcgtttttagattttcggtttcgttttttttttggacgcgcggtttgtttcgtttttttcgtttatcgtcggggttaaattgggtttatcggttcggacggcggggatgttcgttttcgattggttttaaaggtgttcgtttcgtttatttttcgttttttttttggtagggaagaaagcgcgntgcgtcgtggttgcgggagggtagcggttacgttgagcgtcggcgttgttggttttcgatttttggtattcgggtatcgtttttttatttcgggtagttgggatttcgggatgatttaaggaataaggatttagacgtagattttacggtgaattggttttatttacgtgtgaacgaacgtttaggagaaaattaaattcgaatgggttaggttttaattagaggagattttaaaattgtgatttgtattagaaaacgaattagttagtcgg

SEQ ID NO: 5062 - DNA, 656 bp, Artificial Sequence
  chemically treated genomic DNA (Homo sapiens) CpG-island No: 5062
  misc_feature (273)..(273): n is either a, c, g or t
  misc_feature (459)..(459): n is either a, c, g or t
ccgactaactaattcgttttctaatacaaatcacaattttaaaatctcctctaattaaaacctaacccattcgaatttaattttctcctaaacgttcgttcacacgtaaataaaaccaattcaccgtaaaatctacgtctaaatccttattccttaaatcatcccgaaatcccaactacccgaaataaaaaaacgatacccgaataccaaaaatcgaaaaccaacaacgccgacgctcaacgtaaccgctaccctcccgcaaccacgacgcancgcgctttcttccctaccaaaaaaaaaacgaaaaataaacgaaacgaacacctttaaaaccaatcgaaaacgaacatccccgccgtccgaaccgataaacccaatttaaccccgacgataaacgaaaaaaacgaaacaaaccgcgcgtccaaaaaaaaaacgaaaccgaaaatctaaaaacgaaanctaaaactatcaatcccgcgcccgacgccgcgccacgactcctcgcatatcgttacccgtattactttcaatcgctaccgctcgctatccgtcaccccgacattacaaactatttctcgccgtcccgatccgacgtcgcaaattctccgacgccgaccccctcaactaaaatcccccgtctaacctccgcaactccg

SEQ ID NO: 5063 - DNA, 656 bp, Artificial Sequence
  chemically treated genomic DNA (Homo sapiens) CpG-island No: 5063
  misc_feature (273)..(273): n is either a, c, g or t
  misc_feature (459)..(459): n is either a, c, g or t
tcggttggttggttcgttttttgatgtagattatagttttggggttttttttggttagagtttggtttattcgggtttggtttttttttggacgttcgtttatacgtgaataaggttaatttatcgtggagtttgcgtttgaatttttgttttttaggttatttcggggttttagttgttcgggatgaaaaaacgatgttcgggtattaggggtcggggattagtaacgtcggcgtttagcgtaatcgttattttttcgtagttacggcgtancgcgtttttttttttgttaaggaaggggcggggagtaggcggggcgggtatttttgaggttaatcgaaagcgagtattttcgtcgttcgggtcgatggatttagtttgatttcggcggtgggcggaggaggcggggtaagtcgcgcgtttaggaagggggcggggtcgggggtttggaggcggggnttggggttgttagtttcgcgttcggcgtcgcgttacggtttttcgtatgtcgttgttcgtgttgtttttagtcgttgtcgttcgttgttcgttatttcggtattgtaagttgtttttcgtcgtttcggttcggcgtcgtaggtttttcggcgtcggtttttttagttggggtttttcgtttggttttcgtagtttcg

SEQ ID NO: 5064 - DNA, 656 bp, Artificial Sequence
  chemically treated genomic DNA (Homo sapiens) CpG-island No: 5064
  misc_feature (198)..(198): n is either a, c, g or t
  misc_feature (384)..(384): n is either a, c, g or t
cgaaactacgaaaaccaaacgaaaaaccccaactaaaaaaaccgacgccgaaaaacctacgacgccgaaccgaaacgacgaaaaacaacttacaataccgaaataacgaacaacgaacgacaacgactaaaaacaacacgaacaacgacatacgaaaaaccgtaacgcgacgccgaacgcgaaactaacaaccccaanccccgcctccaaacccccgaccccgcccccttcctaaacgcgcgacttaccccgcctcctccgcccaccgccgaaatcaaactaaatccatcgacccgaacgacgaaaatactcgctttcgattaacctcaaaaatacccgccccgcctactccccgccccttccttaacaaaaaaaaaaacgcgntacgccgtaactacgaaaaaataacgattacgctaaacgccgacgttactaatccccgacccctaatacccgaacatcgttttttcatcccgaacaactaaaaccccgaaataacctaaaaaacaaaaattcaaacgcaaactccacgataaattaaccttattcacgtataaacgaacgtccaaaaaaaaaccaaacccgaataaaccaaactctaaccaaaaaaaaccccaaaactataatctacatcaaaaaacgaaccaaccaaccga

SEQ ID NO: 5065 - DNA, 542 bp, Artificial Sequence
  chemically treated genomic DNA (Homo sapiens) CpG-island No: 5065
ttttttcggttgtattcgaggttttttagaggtcggcgcgcgttcgggcgtatattcgtatatttgttcgcgcgtatatattcgcgtttggtttcgcgcgcgtacgtttcgcgatttcgtaggttcgcggttcgtaatcggtagggtaggagtttttattaattttttcgttttacgttttttgtttaaatatagaaatcgatttttttgttttagagttcggagcggcggtcgttttttttcgttgggttttcgaggcggcgttttttaggcgggcgcggggacggttttgtttggttttattagtacgtggggcgttgtttgcgttttagtcgcggtattttggtattttggtattttggtatcgatcgttcggtcgtttttttttcggtcgcgtagtttttcggttagcgggttttgtttttatttaggttttttggtcgcgatttagtagcggcgtttcgtttcggaataggttttattcggagaggggttgatattgatcgtgttttttgggggttggggcgtatttaaggtaattt

SEQ ID NO: 5066 - DNA, 542 bp, Artificial Sequence
  chemically treated genomic DNA (Homo sapiens) CpG-island No: 5066
aaattaccttaaatacgccccaacccccaaaaaacacgatcaatatcaacccctctccgaataaaacctattccgaaacgaaacgccgctactaaatcgcgaccaaaaaacctaaataaaaacaaaacccgctaaccgaaaaactacgcgaccgaaaaaaaaacgaccgaacgatcgataccaaaataccaaaataccaaaataccgcgactaaaacgcaaacaacgccccacgtactaataaaaccaaacaaaaccgtccccgcgcccgcctaaaaaacgccgcctcgaaaacccaacgaaaaaaaacgaccgccgctccgaactctaaaacaaaaaaatcgatttctatatttaaacaaaaaacgtaaaacgaaaaaattaataaaaactcctaccctaccgattacgaaccgcgaacctacgaaatcgcgaaacgtacgcgcgcgaaaccaaacgcgaatatatacgcgcgaacaaatatacgaatatacgcccgaacgcgcgccgacctctaaaaaacctcgaatacaaccgaaaaaa

SEQ ID NO: 5067 - DNA, 542 bp, Artificial Sequence
  chemically treated genomic DNA (Homo sapiens) CpG-island No: 5067
aggttattttgaatgcgttttagtttttagggggtacgattagtgttagttttttttcgggtggggtttgtttcggggcgaggcgtcgttgttgagtcgcggttagagaatttgggtggggataaggttcgttggtcgaggggttgcgcgatcgggagagagacgatcgggcggtcggtgttagggtgttagggtgttagggtgtcgcggttggagcgtaggtagcgttttacgtgttggtgaggttagatagggtcgttttcgcgttcgtttggggagcgtcgtttcgggagtttagcgagggagggcggtcgtcgtttcgagttttaggataaggaagtcggtttttatatttgggtaggaggcgtgaggcgaggggattggtggaagtttttgttttgtcggttgcgggtcgcgaatttgcgaggtcgcgggacgtgcgcgcgcggggttaggcgcgggtgtgtgcgcgcgggtaggtgtgcgagtgtgcgttcgggcgcgcgtcggtttttggggagtttcggatgtagtcggagaaa

SEQ ID NO: 5068 - DNA, 542 bp, Artificial Sequence
  chemically treated genomic DNA (Homo sapiens) CpG-island No: 5068
tttctccgactacatccgaaactccccaaaaaccgacgcgcgcccgaacgcacactcgcacacctacccgcgcgcacacacccgcgcctaaccccgcgcgcgcacgtcccgcgacctcgcaaattcgcgacccgcaaccgacaaaacaaaaacttccaccaatcccctcgcctcacgcctcctacccaaatataaaaaccgacttccttatcctaaaactcgaaacgacgaccgccctccctcgctaaactcccgaaacgacgctccccaaacgaacgcgaaaacgaccctatctaacctcaccaacacgtaaaacgctacctacgctccaaccgcgacaccctaacaccctaacaccctaacaccgaccgcccgatcgtctctctcccgatcgcgcaacccctcgaccaacgaaccttatccccacccaaattctctaaccgcgactcaacaacgacgcctcgccccgaaacaaaccccacccgaaaaaaaactaacactaatcgtaccccctaaaaactaaaacgcattcaaaataacct

SEQ ID NO: 5069 - DNA, 943 bp, Artificial Sequence
  chemically treated genomic DNA (Homo sapiens) CpG-island No: 5069
  misc_feature (522)..(523): n is either a, c, g or t
ttacggcgttttcgttttcgttttttggatttttagcgtttagcgattttcgaggcgatattttttaagaaggggaagggggtttttgttttatagaggggatagcgttcgtggcgtttcgagggtcggttgttgcggggtcgcgggaaggcgaaggtagtttcggacgcggagggcgaggggcggttgttcgcggttcgggatggcgttgcgtcgcggtcggagttcgtttgtcggcgttcgggacgggttttggtaggttcgtcgttttttttttttcgttttttttttttttttgcggcggcggcggcggcgaagcgggggggcgggggcggggaggcggttcgtattgcggcggcggcgggcggtgagcggtcgcggaaggggcggattcgggcgtttagcggggaaggttcgggggttcggtcggcgcggcgaggttgggcgtattgggcgttcgtacggggttatggcgagcgtcgagttttcgtttttgtagagtttcgcgtcgtcggcggggannataaagcggtcgttttatttcggatttcgttgcgggtcgtagggttaagtcgggggaagaggggaggttgcggcgggcggcgcgtttcgcgttcgggcgattcggcggattagcgcgtttggcggcggcgagcgcggcgatatcgcgggagcggaggttcggtttagagggcgggcggtagagggtaaggatcgggtttggggagttttcgggcggtggtcgttgagggttcggacgcgttattttcgagttcggggtgcggttttttttcgggcgttttcggcgtggggcgcgcgttttcggggttttttggggaagagtcggtttttcgcgtcgtacgttgggagtttgatttgttttttttagattatgtgggttttttatttgtatattttcgaattatagatgaaaacgtattta

SEQ ID NO: 5070 - DNA, 943 bp, Artificial Sequence
  chemically treated genomic DNA (Homo sapiens) CpG-island No: 5070
  misc_feature (421)..(422): n is either a, c, g or t
taaatacgttttcatctataattcgaaaatatacaaataaaaaacccacataatctaaaaaaaacaaatcaaactcccaacgtacgacgcgaaaaaccgactcttccccaaaaaaccccgaaaacgcgcgccccacgccgaaaacgcccgaaaaaaaaccgcaccccgaactcgaaaataacgcgtccgaaccctcaacgaccaccgcccgaaaactccccaaacccgatccttaccctctaccgcccgccctctaaaccgaacctccgctcccgcgatatcgccgcgctcgccgccgccaaacgcgctaatccgccgaatcgcccgaacgcgaaacgcgccgcccgccgcaacctcccctcttcccccgacttaaccctacgacccgcaacgaaatccgaaataaaacgaccgctttatnntccccgccgacgacgcgaaactctacaaaaacgaaaactcgacgctcgccataaccccgtacgaacgcccaatacgcccaacctcgccgcgccgaccgaacccccgaaccttccccgctaaacgcccgaatccgccccttccgcgaccgctcaccgcccgccgccgccgcaatacgaaccgcctccccgcccccgcccccccgcttcgccgccgccgccgccgcaaaaaaaaaaaaaaaacgaaaaaaaaaaaacgacgaacctaccaaaacccgtcccgaacgccgacaaacgaactccgaccgcgacgcaacgccatcccgaaccgcgaacaaccgcccctcgccctccgcgtccgaaactaccttcgccttcccgcgaccccgcaacaaccgaccctcgaaacgccacgaacgctatcccctctataaaacaaaaacccccttccccttcttaaaaaatatcgcctcgaaaatcgctaaacgctaaaaatccaaaaaacgaaaacgaaaacgccgtaa

SEQ ID NO: 5071 - DNA, 943 bp, Artificial Sequence
  chemically treated genomic DNA (Homo sapiens) CpG-island No: 5071
  misc_feature (421)..(422): n is either a, c, g or t
tggatacgtttttatttataattcggaaatatgtaaatgaaaggtttatatggtttgaaaggggtaaattaagtttttagcgtgcggcgcggggaatcggtttttttttagggagtttcggaggcgcgcgttttacgtcgagggcgttcggggaggaatcgtatttcgggttcgggagtagcgcgttcgggtttttagcggttatcgttcgggggttttttaggttcggtttttgttttttgtcgttcgttttttaggtcgagttttcgttttcgcgatgtcgtcgcgttcgtcgtcgttaggcgcgttggttcgtcgggtcgttcgggcgcggggcgcgtcgttcgtcgtagtttttttttttttttcggtttggttttgcggttcgtagcggggttcggggtagagcggtcgttttgtnnttttcgtcgacggcgcggggttttgtaaaggcggaagttcggcgttcgttatgatttcgtgcggacgtttagtgcgtttagtttcgtcgcgtcggtcgagttttcgggtttttttcgttgagcgttcgaattcgtttttttcgcggtcgtttatcgttcgtcgtcgtcgtagtacgagtcgttttttcgttttcgttttttcgtttcgtcgtcgtcgtcgtcgtaggagagggagggaggcggagggagggaggcggcgggtttgttagagttcgtttcgggcgtcggtaagcgagtttcggtcgcggcgtagcgttatttcgggtcgcgggtagtcgtttttcgtttttcgcgttcggaattgttttcgttttttcgcgatttcgtagtagtcggttttcggggcgttacgaacgttgttttttttgtggagtagagattttttttttttttttagggggtgtcgtttcggggatcgttgagcgttaggggtttaggaggcggggacgggagcgtcgtga

SEQ ID NO: 5072 - DNA, 943 bp, Artificial Sequence
  chemically treated genomic DNA (Homo sapiens) CpG-island No: 5072
  misc_feature (522)..(523): n is either a, c, g or t
tcacgacgctcccgtccccgcctcctaaacccctaacgctcaacgatccccgaaacgacaccccctaaaaaaaaaaaaaaaatctctactccacaaaaaaaacaacgttcgtaacgccccgaaaaccgactactacgaaatcgcgaaaaaacgaaaacaattccgaacgcgaaaaacgaaaaacgactacccgcgacccgaaataacgctacgccgcgaccgaaactcgcttaccgacgcccgaaacgaactctaacaaacccgccgcctccctccctccgcctccctccctctcctacgacgacgacgacgacgaaacgaaaaaacgaaaacgaaaaaacgactcgtactacgacgacgacgaacgataaacgaccgcgaaaaaaacgaattcgaacgctcaacgaaaaaaacccgaaaactcgaccgacgcgacgaaactaaacgcactaaacgtccgcacgaaatcataacgaacgccgaacttccgcctttacaaaaccccgcgccgtcgacgaaaannacaaaacgaccgctctaccccgaaccccgctacgaaccgcaaaaccaaaccgaaaaaaaaaaaaaaactacgacgaacgacgcgccccgcgcccgaacgacccgacgaaccaacgcgcctaacgacgacgaacgcgacgacatcgcgaaaacgaaaactcgacctaaaaaacgaacgacaaaaaacaaaaaccgaacctaaaaaacccccgaacgataaccgctaaaaacccgaacgcgctactcccgaacccgaaatacgattcctccccgaacgccctcgacgtaaaacgcgcgcctccgaaactccctaaaaaaaaaccgattccccgcgccgcacgctaaaaacttaatttacccctttcaaaccatataaacctttcatttacatatttccgaattataaataaaaacgtatcca

SEQ ID NO: 5073 - DNA, 542 bp, Artificial Sequence
  chemically treated genomic DNA (Homo sapiens) CpG-island No: 5073
cgtcggcgttttacgtttttttcgggaggggtttcgattcgattcggttgcggatcgtttcgttttttttttgggtaggttcggggcggagtcggggttttttttgagcgtcgtaatttttcgttcgggtagtcgtcgtcggcgtcgggttttacgagagggcgggcgggggagggggggtacgaaggtcgtagattttcgggttcgcgtatagagttaggcgttcgacgcgggttcgggtcgggcggcgcggggggcgcgggatcggtttttttggcgtcggataaaggttaagggaggcgtaggagggtttaggtcgggtacggaggtgggggttcgttcggttgggggttattcgcgtgcggcgcggagggcgggggggtcggaatcgttggtgtttaggattcgttttcggttttttaattcggatcggttcggttcggattagtagtgatcggtgtaaatatattagtgaaatcgcgtgttttttcgcgagatttgtacggttgggaggcggggggggttttgggggggtgggggaa

SEQ ID NO: 5074 - DNA, 542 bp, Artificial Sequence
  chemically treated genomic DNA (Homo sapiens) CpG-island No: 5074
ttcccccacccccccaaaaccccccccgcctcccaaccgtacaaatctcgcgaaaaaacacgcgatttcactaatatatttacaccgatcactactaatccgaaccgaaccgatccgaattaaaaaaccgaaaacgaatcctaaacaccaacgattccgacccccccgccctccgcgccgcacgcgaataacccccaaccgaacgaacccccacctccgtacccgacctaaaccctcctacgcctcccttaacctttatccgacgccaaaaaaaccgatcccgcgccccccgcgccgcccgacccgaacccgcgtcgaacgcctaactctatacgcgaacccgaaaatctacgaccttcgtaccccccctcccccgcccgccctctcgtaaaacccgacgccgacgacgactacccgaacgaaaaattacgacgctcaaaaaaaaccccgactccgccccgaacctacccaaaaaaaaaacgaaacgatccgcaaccgaatcgaatcgaaacccctcccgaaaaaaacgtaaaacgccgacg

SEQ ID NO: 5075 - DNA, 542 bp, Artificial Sequence
  chemically treated genomic DNA (Homo sapiens) CpG-island No: 5075
tttttttatttttttaggatttttttcgttttttagtcgtgtaaatttcgcgaggaaatacgcggttttattagtgtgtttatatcgattattattaattcggatcgaatcgattcggattaaggggtcggaggcgggttttgggtattagcggtttcgattttttcgtttttcgcgtcgtacgcgagtggtttttagtcgagcgggtttttattttcgtgttcggtttgggtttttttgcgttttttttggtttttgttcggcgttaggagagtcggtttcgcgtttttcgcgtcgttcggttcgggttcgcgtcgggcgtttggttttgtacgcgagttcggggatttgcggttttcgtgttttttttttttcgttcgttttttcgtggagttcggcgtcggcggcggttgttcgggcggggggttgcggcgtttaggagaggtttcggtttcgtttcgggtttgtttagggggagagcggagcggttcgtagtcgggtcgggtcggggtttttttcgggaggagcgtggagcgtcggcg

SEQ ID NO: 5076 - DNA, 542 bp, Artificial Sequence
  chemically treated genomic DNA (Homo sapiens) CpG-island No: 5076
cgccgacgctccacgctcctcccgaaaaaaaccccgacccgacccgactacgaaccgctccgctctccccctaaacaaacccgaaacgaaaccgaaacctctcctaaacgccgcaaccccccgcccgaacaaccgccgccgacgccgaactccacgaaaaaacgaacgaaaaaaaaaaaacacgaaaaccgcaaatccccgaactcgcgtacaaaaccaaacgcccgacgcgaacccgaaccgaacgacgcgaaaaacgcgaaaccgactctcctaacgccgaacaaaaaccaaaaaaaacgcaaaaaaacccaaaccgaacacgaaaataaaaacccgctcgactaaaaaccactcgcgtacgacgcgaaaaacgaaaaaatcgaaaccgctaatacccaaaacccgcctccgaccccttaatccgaatcgattcgatccgaattaataataatcgatataaacacactaataaaaccgcgtatttcctcgcgaaatttacacgactaaaaaacgaaaaaaatcctaaaaaaataaaaaaa

SEQ ID NO: 5077 - DNA, 578 bp, Artificial Sequence
  chemically treated genomic DNA (Homo sapiens) CpG-island No: 5077
ggcggcggtttttgttcgtcgatagacgtttttagagattacgcggtatttttaggtgataggtcgaggttcgcggcggattcggtttaggaggtttagttcgtacgttttcggatcgggattcgttgaattcgggtgttcgagggagtttggcggtcgttttaggcgggatcgttgggggtttcggtcgttttggttttttttttttttcgggtcgtatttatcgaattttatttagttttattcgttgagcgcgtttatgttgcggtataggtcgtttagtatttaggagggtagttggtagatgtagtaggttatggtacgttacggggtcggtttcggcgcgggacgattgggtcggatattgcgggttgcggtttttttagttaggggcggatcggcggggaagtgggcggggcgggagggtattagcgtttttagcggttacgggcggtacgacggtttcgtcggttttattttagcgtcggttagagaatcggaattgcgaggggaaattgaggttttggtgggagaaggttatacgggaattttgtcgtagcggtaggaggttttttgat

SEQ ID NO: 5078 - DNA, 578 bp, Artificial Sequence
  chemically treated genomic DNA (Homo sapiens) CpG-island No: 5078
atcaaaaaacctcctaccgctacgacaaaattcccgtataaccttctcccaccaaaacctcaatttcccctcgcaattccgattctctaaccgacgctaaaataaaaccgacgaaaccgtcgtaccgcccgtaaccgctaaaaacgctaataccctcccgccccgcccacttccccgccgatccgcccctaactaaaaaaaccgcaacccgcaatatccgacccaatcgtcccgcgccgaaaccgaccccgtaacgtaccataacctactacatctaccaactaccctcctaaatactaaacgacctataccgcaacataaacgcgctcaacgaataaaactaaataaaattcgataaatacgacccgaaaaaaaaaaaaaaccaaaacgaccgaaacccccaacgatcccgcctaaaacgaccgccaaactccctcgaacacccgaattcaacgaatcccgatccgaaaacgtacgaactaaacctcctaaaccgaatccgccgcgaacctcgacctatcacctaaaaataccgcgtaatctctaaaaacgtctatcgacgaacaaaaaccgccgcc

SEQ ID NO: 5079 - DNA, 578 bp, Artificial Sequence
  chemically treated genomic DNA (Homo sapiens) CpG-island No: 5079
gttagaaggttttttgtcgttgcggtagaattttcgtgtggtttttttttattagggttttagttttttttcgtagtttcgattttttggtcggcgttggggtggagtcggcggggtcgtcgtgtcgttcgtggtcgttggggacgttggtgttttttcgtttcgtttattttttcgtcggttcgtttttggttagagaagtcgtagttcgtagtgttcgatttagtcgtttcgcgtcggagtcggtttcgtagcgtgttatggtttgttatatttattagttgtttttttgggtgttggacgatttgtgtcgtaatatggacgcgtttagcgagtgggattggatggagttcggtgagtgcggttcggggaggggaggggattagggcgatcggagtttttagcgatttcgtttggagcggtcgttaagttttttcgggtattcgggtttagcgggtttcgattcgagggcgtgcgagttgagttttttggatcgggttcgtcgcggatttcggtttgttatttgaaggtgtcgcgtggtttttgaggacgtttgtcgacgagtaggggtcgtcgtt

SEQ ID NO: 5080 - DNA, 578 bp, Artificial Sequence
  chemically treated genomic DNA (Homo sapiens) CpG-island No: 5080
aacgacgacccctactcgtcgacaaacgtcctcaaaaaccacgcgacaccttcaaataacaaaccgaaatccgcgacgaacccgatccaaaaaactcaactcgcacgccctcgaatcgaaacccgctaaacccgaatacccgaaaaaacttaacgaccgctccaaacgaaatcgctaaaaactccgatcgccctaatcccctcccctccccgaaccgcactcaccgaactccatccaatcccactcgctaaacgcgtccatattacgacacaaatcgtccaacacccaaaaaaacaactaataaatataacaaaccataacacgctacgaaaccgactccgacgcgaaacgactaaatcgaacactacgaactacgacttctctaaccaaaaacgaaccgacgaaaaaataaacgaaacgaaaaaacaccaacgtccccaacgaccacgaacgacacgacgaccccgccgactccaccccaacgccgaccaaaaaatcgaaactacgaaaaaaaactaaaaccctaataaaaaaaaaccacacgaaaattctaccgcaacgacaaaaaaccttctaac

SEQ ID NO: 5081 - DNA, 603 bp, Artificial Sequence
  chemically treated genomic DNA (Homo sapiens) CpG-island No: 5081
cgtatagttttcggtcggttattttcgcgagcgcgttttattttttatcgagcgcgcgcgaagattacggaggtcgattcgggagcgcgtacgtagtttcgtttcgcgttcgattcgcggatttcgcggcgttcggttcgggtggtttggatcgcggagggaatgtttcggagggcggagaattgggacgaggtcgaggtaggcgcggaggaggtaggcgtcgaagagtacggttttgaagaagacggcggggaggagtcgggcgtcgaggagttcggttcggaagagttcggttcggaggaattgggcgtcgaggaggagatggaggtcgggcggtcgcggttcgtgttgcgttcggtgaattcgcgcgagtttttttaggttattttttgtaatcgtagttcgcgcgtcgtgttgttcgtatggtttaatttcgacggcgagtcgtagttttatttaagcgttgtcgtttggtacgggtcgtcgtatttatagttatcgaggtacgggttcggcgtttaggttcgatttagtagggacgatagtacggtttgaagtttttttatcgtttcggggtttattttgtagacggggaattgaggt

SEQ ID NO: 5082 - DNA, 603 bp, Artificial Sequence
  chemically treated genomic DNA (Homo sapiens) CpG-island No: 5082
acctcaattccccgtctacaaaataaaccccgaaacgataaaaaaacttcaaaccgtactatcgtccctactaaatcgaacctaaacgccgaacccgtacctcgataactataaatacgacgacccgtaccaaacgacaacgcttaaataaaactacgactcgccgtcgaaattaaaccatacgaacaacacgacgcgcgaactacgattacaaaaaataacctaaaaaaactcgcgcgaattcaccgaacgcaacacgaaccgcgaccgcccgacctccatctcctcctcgacgcccaattcctccgaaccgaactcttccgaaccgaactcctcgacgcccgactcctccccgccgtcttcttcaaaaccgtactcttcgacgcctacctcctccgcgcctacctcgacctcgtcccaattctccgccctccgaaacattccctccgcgatccaaaccacccgaaccgaacgccgcgaaatccgcgaatcgaacgcgaaacgaaactacgtacgcgctcccgaatcgacctccgtaatcttcgcgcgcgctcgataaaaaataaaacgcgctcgcgaaaataaccgaccgaaaactatacg

SEQ ID NO: 5083 - DNA, 603 bp, Artificial Sequence
  chemically treated genomic DNA (Homo sapiens) CpG-island No: 5083
gttttagtttttcgtttgtaaaatggatttcggggcggtagaggggttttagatcgtgttatcgtttttgttgggtcgggtttaagcgtcgggttcgtatttcggtagttgtggatgcggcggttcgtgttaggcggtagcgtttgggtagggttgcggttcgtcgtcgaagttgagttatacgggtagtacgacgcgcggattgcgattgtagaagatgatttgggagggttcgcgcgagtttatcgagcgtagtacgggtcgcggtcgttcggtttttatttttttttcggcgtttagttttttcgggtcggattttttcgggtcggatttttcggcgttcgattttttttcgtcgttttttttagggtcgtatttttcgacgtttgtttttttcgcgtttatttcggtttcgttttagtttttcgtttttcggggtatttttttcgcgatttagattattcgggtcggacgtcgcgggattcgcgggtcggacgcggggcggagttgcgtgcgcgttttcgagtcgattttcgtagttttcgcgcgcgttcggtagaggatggaacgcgttcgcggaaatagtcggtcggaggttgtgcg

SEQ ID NO: 5084 - DNA, 603 bp, Artificial Sequence
  chemically treated genomic DNA (Homo sapiens) CpG-island No: 5084
cgcacaacctccgaccgactatttccgcgaacgcgttccatcctctaccgaacgcgcgcgaaaactacgaaaatcgactcgaaaacgcgcacgcaactccgccccgcgtccgacccgcgaatcccgcgacgtccgacccgaataatctaaatcgcgaaaaaaataccccgaaaaacgaaaaactaaaacgaaaccgaaataaacgcgaaaaaaacaaacgtcgaaaaatacgaccctaaaaaaaacgacgaaaaaaaatcgaacgccgaaaaatccgacccgaaaaaatccgacccgaaaaaactaaacgccgaaaaaaaaataaaaaccgaacgaccgcgacccgtactacgctcgataaactcgcgcgaaccctcccaaatcatcttctacaatcgcaatccgcgcgtcgtactacccgtataactcaacttcgacgacgaaccgcaaccctacccaaacgctaccgcctaacacgaaccgccgcatccacaactaccgaaatacgaacccgacgcttaaacccgacccaacaaaaacgataacacgatctaaaacccctctaccgccccgaaatccattttacaaacgaaaaactaaaac

SEQ ID NO: 5085 - DNA, 612 bp, Artificial Sequence
  chemically treated genomic DNA (Homo sapiens) CpG-island No: 5085
gcgggcggggattcgtggcgaaagtgtagtttagtagcgtcgcggcgttacgtttattttgcgtagacgtcgtcgtcgtcgttgttgtcgtcgtcgttgttatagtttttgtcgttacggttttcgtcgtcgttgttttcgcgttgtttttgggagtttttattgttttagtagcgttcggtttcgagatcgggtattttgggggttcgcgaaacgggcggcggtcgacggagttgagattttagggcgtcggcgggattaggagcggtaggggttagtttaggaatttcggggagtcgggattaaagcgtggggcggtagggggtcggggtggcgaggtttacggttttcggagttggggtttttttttttcggttcgatttttttcgtcgatttttttaagtggggtcggagtttcggcgggcgttttcggcgatgagttcggattcgaggtggtcggtgagtgcgggtttgggattagggcgggagtggtcggtagggaaggggtaggttacgttcgtgggacgcgtattgagtcgcgtggttcgggaatttttttggtaattttagttgggagaattgatagtgtattgttttttagtaggtattttg

SEQ ID NO: 5086 - DNA, 612 bp, Artificial Sequence
  chemically treated genomic DNA (Homo sapiens) CpG-island No: 5086
caaaatacctactaaaaaacaatacactatcaattctcccaactaaaattaccaaaaaaattcccgaaccacgcgactcaatacgcgtcccacgaacgtaacctaccccttccctaccgaccactcccgccctaatcccaaacccgcactcaccgaccacctcgaatccgaactcatcgccgaaaacgcccgccgaaactccgaccccacttaaaaaaatcgacgaaaaaaatcgaaccgaaaaaaaaaaaccccaactccgaaaaccgtaaacctcgccaccccgaccccctaccgccccacgctttaatcccgactccccgaaattcctaaactaacccctaccgctcctaatcccgccgacgccctaaaatctcaactccgtcgaccgccgcccgtttcgcgaacccccaaaatacccgatctcgaaaccgaacgctactaaaacaataaaaactcccaaaaacaacgcgaaaacaacgacgacgaaaaccgtaacgacaaaaactataacaacgacgacgacaacaacgacgacgacgacgtctacgcaaaataaacgtaacgccgcgacgctactaaactacactttcgccacgaatccccgcccgc

SEQ ID NO: 5087 - DNA, 612 bp, Artificial Sequence
  chemically treated genomic DNA (Homo sapiens) CpG-island No: 5087
taggatgtttgttgggaagtaatgtattgttagtttttttaattggagttgttagagaggttttcgggttacgcggtttagtgcgcgttttacgaacgtagtttattttttttttgtcggttattttcgttttggttttaggttcgtatttatcggttatttcgagttcgggtttatcgtcgggggcgttcgtcggggtttcgattttatttggggaggtcggcggggaaagtcgggtcgggaagggggagttttaatttcggagatcgtagatttcgttatttcggttttttgtcgttttacgttttggtttcggtttttcgggatttttgagttgatttttgtcgtttttggtttcgtcggcgttttggggttttaatttcgtcggtcgtcgttcgtttcgcgagtttttaagatgttcggtttcgggatcgggcgttgttggaataatggaggtttttagaggtagcgcgaggatagcggcggcggagatcgtggcggtaaaggttgtggtagcggcggcggtagtagcggcggcgacggcgtttgcgtagggtaaacgtggcgtcgcggcgttattgagttgtattttcgttacggattttcgttcgt

SEQ ID NO: 5088 - DNA, 612 bp, Artificial Sequence
  chemically treated genomic DNA (Homo sapiens) CpG-island No: 5088
acgaacgaaaatccgtaacgaaaatacaactcaataacgccgcgacgccacgtttaccctacgcaaacgccgtcgccgccgctactaccgccgccgctaccacaacctttaccgccacgatctccgccgccgctatcctcgcgctacctctaaaaacctccattattccaacaacgcccgatcccgaaaccgaacatcttaaaaactcgcgaaacgaacgacgaccgacgaaattaaaaccccaaaacgccgacgaaaccaaaaacgacaaaaatcaactcaaaaatcccgaaaaaccgaaaccaaaacgtaaaacgacaaaaaaccgaaataacgaaatctacgatctccgaaattaaaactcccccttcccgacccgactttccccgccgacctccccaaataaaatcgaaaccccgacgaacgcccccgacgataaacccgaactcgaaataaccgataaatacgaacctaaaaccaaaacgaaaataaccgacaaaaaaaaaataaactacgttcgtaaaacgcgcactaaaccgcgtaacccgaaaacctctctaacaactccaattaaaaaaactaacaatacattacttcccaacaaacatccta

SEQ ID NO: 5089 - DNA, 507 bp, Artificial Sequence
  chemically treated genomic DNA (Homo sapiens) CpG-island No: 5089
  misc_feature (168)..(168): n is either a, c, g or t
tacgatgaaggttagtacgatgatgaaagttattttgatcgtgcggattttggttttggagatgagtttgacgttgttgatacgcgttagggttacgcgttttttatcgttagtcgtcgcgttttttggcgtttcggtcgtcgtcgttgtagcggttttgagtcgtanattttgttagattttgaagttgataagggtcgtagtaggtatgcgagtacgatgatcggtacgatgtagatagttagcgtgatttatgtgatgtaggttttgggtttttagggttggatgaagacggtttagtagtcgaagacgtcgttagttatttcgcgtagagagaagatgtgtatttgcggcgcgttggttattaggtagtcgagttacgtggcgagtattgttaggcggtcggtgcggcggcgtatcgagcgtagcggttggtagatggttaggtagcggtttagggatatgagtagtagtaggtaggtggaggcgaatatgtttattatttgt

SEQ ID NO: 5090 - DNA, 507 bp, Artificial Sequence
  chemically treated genomic DNA (Homo sapiens) CpG-island No: 5090
  misc_feature (340)..(340): n is either a, c, g or t
acaaataataaacatattcgcctccacctacctactactactcatatccctaaaccgctacctaaccatctaccaaccgctacgctcgatacgccgccgcaccgaccgcctaacaatactcgccacgtaactcgactacctaataaccaacgcgccgcaaatacacatcttctctctacgcgaaataactaacgacgtcttcgactactaaaccgtcttcatccaaccctaaaaacccaaaacctacatcacataaatcacgctaactatctacatcgtaccgatcatcgtactcgcatacctactacgacccttatcaacttcaaaatctaacaaaatntacgactcaaaaccgctacaacgacgacgaccgaaacgccaaaaaacgcgacgactaacgataaaaaacgcgtaaccctaacgcgtatcaacaacgtcaaactcatctccaaaaccaaaatccgcacgatcaaaataactttcatcatcgtactaaccttcatcgta

SEQ ID NO: 5091 - DNA, 507 bp, Artificial Sequence
  chemically treated genomic DNA (Homo sapiens) CpG-island No: 5091
  misc_feature (340)..(340): n is either a, c, g or t
gtaggtggtgggtatgttcgtttttatttatttgttgttgtttatgtttttggatcgttgtttggttatttgttagtcgttgcgttcgatgcgtcgtcgtatcgatcgtttggtagtgttcgttacgtggttcggttgtttggtggttagcgcgtcgtaggtgtatattttttttttgcgcgaggtggttgacggcgttttcgattgttgggtcgtttttatttagttttggggatttaaggtttatattatatggattacgttagttgtttatatcgtgtcggttatcgtgttcgtatgtttgttacggtttttattagttttaagatttggtagaatntgcggtttaagatcgttgtagcggcggcggtcgaggcgttagagggcgcggcggttggcgatggggggcgcgtggttttggcgcgtgttagtagcgttaagtttatttttaaggttaagattcgtacggttaagatgatttttattatcgtgttggtttttatcgtg

SEQ ID NO: 5092 - DNA, 507 bp, Artificial Sequence
  chemically treated genomic DNA (Homo sapiens) CpG-island No: 5092
  misc_feature (168)..(168): n is either a, c, g or t
cacgataaaaaccaacacgataataaaaatcatcttaaccgtacgaatcttaaccttaaaaataaacttaacgctactaacacgcgccaaaaccacgcgccccccatcgccaaccgccgcgccctctaacgcctcgaccgccgccgctacaacgatcttaaaccgcanattctaccaaatcttaaaactaataaaaaccgtaacaaacatacgaacacgataaccgacacgatataaacaactaacgtaatccatataatataaaccttaaatccccaaaactaaataaaaacgacccaacaatcgaaaacgccgtcaaccacctcgcgcaaaaaaaaaatatacacctacgacgcgctaaccaccaaacaaccgaaccacgtaacgaacactaccaaacgatcgatacgacgacgcatcgaacgcaacgactaacaaataaccaaacaacgatccaaaaacataaacaacaacaaataaataaaaacgaacatacccaccacctac

SEQ ID NO: 5093 - DNA, 558 bp, Artificial Sequence
  chemically treated genomic DNA (Homo sapiens) CpG-island No: 5093
gtcggcgatgtttaggtgttttatgaagaagaagaggcgcgagtgtttttggcgtgtggtgcgtagcgttagtagtatatacgtattttcgtttagcgttaggagtaggatgagatatagtatcgttatttttacgcgcgttagggtttcgttgcgtcgcgggggttcggcggtgcggttgttttcggttttcggcggcgcggcgttggcgttggttgtttcggcgttttagttggttgcgagcgcgttttttatgattttggcggtagcggtgcgtttcggttttcgagttttttacggtttggcgcggttgggtcggattcggcgtgtcggagggtgtaggggcgttcggggttttatttttggagattttacggacggatttgttgagtttattttgaaataaatcgggagggtcgtgaggagatcgtagcgtttttttttcgacgcgggtagggcgtgtttgttttatttttaggaatttaatttatttgaaataatagggtataatcgtcggtttcgggttgtttagtcgttattttagaaattttcgttgga

SEQ ID NO: 5094 - DNA, 558 bp, Artificial Sequence
  chemically treated genomic DNA (Homo sapiens) CpG-island No: 5094
tccaacgaaaatttctaaaataacgactaaacaacccgaaaccgacgattataccctattatttcaaataaattaaattcctaaaaataaaacaaacacgccctacccgcgtcgaaaaaaaaacgctacgatctcctcacgaccctcccgatttatttcaaaataaactcaacaaatccgtccgtaaaatctccaaaaataaaaccccgaacgcccctacaccctccgacacgccgaatccgacccaaccgcgccaaaccgtaaaaaactcgaaaaccgaaacgcaccgctaccgccaaaatcataaaaaacgcgctcgcaaccaactaaaacgccgaaacaaccaacgccaacgccgcgccgccgaaaaccgaaaacaaccgcaccgccgaacccccgcgacgcaacgaaaccctaacgcgcgtaaaaataacgatactatatctcatcctactcctaacgctaaacgaaaatacgtatatactactaacgctacgcaccacacgccaaaaacactcgcgcctcttcttcttcataaaacacctaaacatcgccgac

SEQ ID NO: 5095 - DNA, 558 bp, Artificial Sequence
  chemically treated genomic DNA (Homo sapiens) CpG-island No: 5095
tttaacggggatttttggggtggcggttgagtaattcgaggtcggcggttgtgttttgttgttttagatgagttgggtttttgggaatgggataagtacgttttattcgcgtcggaagagaaacgttgcggtttttttacggttttttcggtttgttttagggtggatttagtagattcgttcgtggagtttttaggagtggagtttcgggcgtttttatatttttcgatacgtcggattcggtttagtcgcgttaagtcgtaaagggttcgaaggtcggggcgtatcgttgtcgttagggttatggagggcgcgttcgtagttaattggagcgtcgaggtagttaacgttagcgtcgcgtcgtcgggggtcgagggtaatcgtatcgtcggattttcgcggcgtaacgaggttttggcgcgcgtggaggtggcggtgttgtgttttattttgtttttggcgttgagcgggaatgcgtgtgtgttgttggcgttgcgtattatacgttagaagtattcgcgtttttttttttttatgaagtatttaagtatcgtcgat

SEQ ID NO: 5096 - DNA, 558 bp, Artificial Sequence
  chemically treated genomic DNA (Homo sapiens) CpG-island No: 5096
atcgacgatacttaaatacttcataaaaaaaaaaaaacgcgaatacttctaacgtataatacgcaacgccaacaacacacacgcattcccgctcaacgccaaaaacaaaataaaacacaacaccgccacctccacgcgcgccaaaacctcgttacgccgcgaaaatccgacgatacgattaccctcgacccccgacgacgcgacgctaacgttaactacctcgacgctccaattaactacgaacgcgccctccataaccctaacgacaacgatacgccccgaccttcgaaccctttacgacttaacgcgactaaaccgaatccgacgtatcgaaaaatataaaaacgcccgaaactccactcctaaaaactccacgaacgaatctactaaatccaccctaaaacaaaccgaaaaaaccgtaaaaaaaccgcaacgtttctcttccgacgcgaataaaacgtacttatcccattcccaaaaacccaactcatctaaaacaacaaaacacaaccgccgacctcgaattactcaaccgccaccccaaaaatccccgttaaa

SEQ ID NO: 5097 - DNA, 941 bp, Artificial Sequence
  chemically treated genomic DNA (Homo sapiens) CpG-island No: 5097
gcgtagagaaaatgcgaggagtacgcggggaggtttggtatttttgttacggcgattttaggttgaggtcgttcgtacgttcgtttttttacgtcgggtattgtcgttttcggtacgcgtataggtcggatacgattcgtttcggtttttatttttaacggcggtacggcggtacggcggtacgtattaagatagtgcgagagtcgtttttttttttgtatcgattttaagtcggttttattttcggtttttttgaatttcgtttggaaattttgtttaagtcgtttattgtttaaggttttcgtataaaatggcggcgaggtttgaggaattaattatagagacgttcgtcggtcgcggatagagcgtaggtttttgagcgttggtttcgtttcgcgtcggtttggtttttcggcgggggcggggaaagggcgtatttttaagggtttttttaggagaatagcgtgcggtttttatggtgtcgggttattcgagtcgggttacgtggttggcgaaagtcgtcgcggaggcgtggggaggagaaatgggcgggaggttgtggggatagcgagatatttagcgacgacgaggttgttatggtgtcgcggggtcgtgttcgcgtatgcgttatttgatttataggtcggtcgtggagttgcgatttcggttttaggtgagaaagggagggttcggttcgggaggaggggagtagggatgacggcgggagagggattgggcgaggagcgtggggaaaggaggtggaagtaggggagagaggaagaggagcgagtaggtaagaggggtaaatcgggattttcggaggacggagagttaaatggtgggagtagggttttggtttgttgtgaggggcgtgggagagggaatcgcgggtgaggagggggttgcgtgtggggaggaggtttgtgtgaggggtaggtggg

SEQ ID NO: 5098 - DNA, 941 bp, Artificial Sequence
  chemically treated genomic DNA (Homo sapiens) CpG-island No: 5098
cccacctacccctcacacaaacctcctccccacacgcaaccccctcctcacccgcgattccctctcccacgcccctcacaacaaaccaaaaccctactcccaccatttaactctccgtcctccgaaaatcccgatttacccctcttacctactcgctcctcttcctctctcccctacttccacctcctttccccacgctcctcgcccaatccctctcccgccgtcatccctactcccctcctcccgaaccgaaccctccctttctcacctaaaaccgaaatcgcaactccacgaccgacctataaatcaaataacgcatacgcgaacacgaccccgcgacaccataacaacctcgtcgtcgctaaatatctcgctatccccacaacctcccgcccatttctcctccccacgcctccgcgacgactttcgccaaccacgtaacccgactcgaataacccgacaccataaaaaccgcacgctattctcctaaaaaaacccttaaaaatacgccctttccccgcccccgccgaaaaaccaaaccgacgcgaaacgaaaccaacgctcaaaaacctacgctctatccgcgaccgacgaacgtctctataattaattcctcaaacctcgccgccattttatacgaaaaccttaaacaataaacgacttaaacaaaatttccaaacgaaattcaaaaaaaccgaaaataaaaccgacttaaaatcgatacaaaaaaaaaaacgactctcgcactatcttaatacgtaccgccgtaccgccgtaccgccgttaaaaataaaaaccgaaacgaatcgtatccgacctatacgcgtaccgaaaacgacaatacccgacgtaaaaaaacgaacgtacgaacgacctcaacctaaaatcgccgtaacaaaaataccaaacctccccgcgtactcctcgcattttctctacgc

SEQ ID NO: 5099 - DNA, 941 bp, Artificial Sequence
  chemically treated genomic DNA (Homo sapiens) CpG-island No: 5099
tttatttgttttttatataagttttttttttatacgtagttttttttttattcgcgatttttttttttacgttttttatagtaaattaaagttttgtttttattatttggtttttcgtttttcgaaagtttcggtttgttttttttgtttattcgttttttttttttttttttttatttttattttttttttttacgtttttcgtttaatttttttttcgtcgttatttttgttttttttttttcggatcgagtttttttttttttatttagggtcggggtcgtagttttacgatcggtttgtgggttaggtggcgtatgcgcgagtacggtttcgcggtattatgataatttcgtcgtcgttgggtgtttcgttatttttatagtttttcgtttattttttttttttacgttttcgcgacggttttcgttagttacgtgattcgattcggatgattcggtattatggagatcgtacgttgtttttttagaagggtttttggaaatgcgtttttttttcgttttcgtcggaagattaggtcggcgcggggcggggttagcgtttagaggtttacgttttgttcgcggtcggcgggcgtttttatggttggttttttaggtttcgtcgttattttgtacgggggttttgagtaatgagcggtttgggtaaggtttttaggcggggtttagaggagtcgggggtggggtcggtttggagtcgatatagagagaggagcgattttcgtattgttttggtgcgtgtcgtcgtgtcgtcgtgtcgtcgttgggggtgggggtcggggcgagtcgtgttcggtttgtgcgcgtgtcgggagcgatagtgttcggcgtgggagagcgggcgtgcgggcggttttagtttggagtcgtcgtgataggggtgttagattttttcgcgtgtttttcgtattttttttacgt

SEQ ID NO: 5100 - DNA, 941 bp, Artificial Sequence
  chemically treated genomic DNA (Homo sapiens) CpG-island No: 5100
acgtaaaaaaaatacgaaaaacacgcgaaaaaatctaacacccctatcacgacgactccaaactaaaaccgcccgcacgcccgctctcccacgccgaacactatcgctcccgacacgcgcacaaaccgaacacgactcgccccgacccccacccccaacgacgacacgacgacacgacgacacgcaccaaaacaatacgaaaatcgctcctctctctatatcgactccaaaccgaccccacccccgactcctctaaaccccgcctaaaaaccttacccaaaccgctcattactcaaaacccccgtacaaaataacgacgaaacctaaaaaaccaaccataaaaacgcccgccgaccgcgaacaaaacgtaaacctctaaacgctaaccccgccccgcgccgacctaatcttccgacgaaaacgaaaaaaaaacgcatttccaaaaacccttctaaaaaaacaacgtacgatctccataataccgaatcatccgaatcgaatcacgtaactaacgaaaaccgtcgcgaaaacgtaaaaaaaaaaaataaacgaaaaactataaaaataacgaaacacccaacgacgacgaaattatcataataccgcgaaaccgtactcgcgcatacgccacctaacccacaaaccgatcgtaaaactacgaccccgaccctaaataaaaaaaaaaaaactcgatccgaaaaaaaaaaaacaaaaataacgacgaaaaaaaaattaaacgaaaaacgtaaaaaaaaaaaataaaaataaaaaaaaaaaaaaaaaaaacgaataaacaaaaaaaacaaaccgaaactttcgaaaaacgaaaaaccaaataataaaaacaaaactttaatttactataaaaaacgtaaaaaaaaaaatcgcgaataaaaaaaaaactacgtataaaaaaaaaacttatataaaaaacaaataaa

SEQ ID NO: 5101 - DNA, 904 bp, Artificial Sequence
  chemically treated genomic DNA (Homo sapiens) CpG-island No: 5101
atcggttcgttttagtcgcgggggaaggcgttttatcgttaaagtgcgtttcggcggtttcggttcgttttgcgggtcgtcgtcggagggagtgcgggggcgtttcgaagtcgtttaggtcgtattcgttggatgttgcgttttttttttcggcgtcggtcgtttcgggtcggcggtagttgattgcggtcgtgagttcgcggagcggcgagagttaagaggaggtgttcgcggcgttttcgttttttttagatatatatttttttttttttcgttttttttcggagggtggaagagataaaaacggggggttagttttttagttcgtcggttgtcggtacgcggggcggcgtttcgttcggttttcgaggattagcggcgtggcggttgcgttcggattcggttcgtcggtcggaggagcgcgcggcgttcgcggtcgcgttcgtatcgtaggtttttttagagagttcgggggcgggcgcgggttcggcggcggcggcggtcgtagttttcggcggcgcgtaatcgttcgtcgtcgttcgtcgttgttcggttttcggcgcgtcgtcggtttcggttttgtgcggagggagcgagttcgcggtttcggttttcggcgtttttagtggtcgcgtcgttagcggattgttgtagcggcgtgagtagcgggggtcgcggttgcgggaaacgtttcggagtttaggaatatagttttcgttggttagcggcggtagtagtagtagcggggtttttgcgcgcggcgtttatcgtttttttttcgcgtcgggttcgcggtgttgtaggcggtagttacgtagattgtttttttatttttttgttttttagttagaacgtgaatgtattgttgacgtatattgttttgggagaagattagcgtgatgta

SEQ ID NO: 5102 - DNA, 904 bp, Artificial Sequence
  chemically treated genomic DNA (Homo sapiens) CpG-island No: 5102
tacatcacgctaatcttctcccaaaacaatatacgtcaacaatacattcacgttctaactaaaaaacaaaaaaataaaaaaacaatctacgtaactaccgcctacaacaccgcgaacccgacgcgaaaaaaaaacgataaacgccgcgcgcaaaaaccccgctactactactaccgccgctaaccaacgaaaactatattcctaaactccgaaacgtttcccgcaaccgcgacccccgctactcacgccgctacaacaatccgctaacgacgcgaccactaaaaacgccgaaaaccgaaaccgcgaactcgctccctccgcacaaaaccgaaaccgacgacgcgccgaaaaccgaacaacgacgaacgacgacgaacgattacgcgccgccgaaaactacgaccgccgccgccgccgaacccgcgcccgcccccgaactctctaaaaaaacctacgatacgaacgcgaccgcgaacgccgcgcgctcctccgaccgacgaaccgaatccgaacgcaaccgccacgccgctaatcctcgaaaaccgaacgaaacgccgccccgcgtaccgacaaccgacgaactaaaaaactaaccccccgtttttatctcttccaccctccgaaaaaaaacgaaaaaaaaaaaaatatatatctaaaaaaaacgaaaacgccgcgaacacctcctcttaactctcgccgctccgcgaactcacgaccgcaatcaactaccgccgacccgaaacgaccgacgccgaaaaaaaaaacgcaacatccaacgaatacgacctaaacgacttcgaaacgcccccgcactccctccgacgacgacccgcaaaacgaaccgaaaccgccgaaacgcactttaacgataaaacgccttcccccgcgactaaaacgaaccgat

SEQ ID NO: 5103 - DNA, 904 bp, Artificial Sequence
  chemically treated genomic DNA (Homo sapiens) CpG-island No: 5103
tgtattacgttaatttttttttagaatagtatgcgttagtagtatatttacgttttgattgaaggataaaaggatgagagagtagtttgcgtggttgtcgtttgtaatatcgcgagttcggcgcgaggaggagacggtgggcgtcgcgcgtaggggtttcgttgttgttgttgtcgtcgttagttagcggggattatgtttttgggtttcggagcgtttttcgtagtcgcgattttcgttgtttacgtcgttgtagtagttcgttggcggcgcggttattgagggcgtcgggagtcgaagtcgcgaattcgtttttttcgtataaagtcggagtcggcggcgcgtcgggggtcgggtagcggcgggcggcgacgggcggttgcgcgtcgtcgggggttgcggtcgtcgtcgtcgtcggattcgcgttcgttttcggattttttgaaggggtttgcggtgcgggcgcgatcgcgggcgtcgcgcgttttttcggtcggcggatcgggttcgagcgtagtcgttacgtcgttggttttcgggggtcggacggagcgtcgtttcgcgtgtcggtagtcggcggattggagaattgatttttcgtttttgttttttttatttttcgagaagaggcgaggagaaagggggtgtgtgtttggggagggcgaaggcgtcgcgaatatttttttttaattttcgtcgtttcgcgagtttacgatcgtaattagttgtcgtcggttcggagcggtcgacgtcgggagagggagcgtagtatttagcgagtgcggtttgggcggtttcggggcgttttcgtatttttttcggcggcggttcgtagagcgggtcggggtcgtcggagcgtattttggcgatgaagcgttttttttcgcggttggagcgagtcggt

SEQ ID NO: 5104 - DNA, 904 bp, Artificial Sequence
  chemically treated genomic DNA (Homo sapiens) CpG-island No: 5104
accgactcgctccaaccgcgaaaaaaaacgcttcatcgccaaaatacgctccgacgaccccgacccgctctacgaaccgccgccgaaaaaaatacgaaaacgccccgaaaccgcccaaaccgcactcgctaaatactacgctccctctcccgacgtcgaccgctccgaaccgacgacaactaattacgatcgtaaactcgcgaaacgacgaaaattaaaaaaaaatattcgcgacgccttcgccctccccaaacacacaccccctttctcctcgcctcttctcgaaaaataaaaaaaacaaaaacgaaaaatcaattctccaatccgccgactaccgacacgcgaaacgacgctccgtccgacccccgaaaaccaacgacgtaacgactacgctcgaacccgatccgccgaccgaaaaaacgcgcgacgcccgcgatcgcgcccgcaccgcaaaccccttcaaaaaatccgaaaacgaacgcgaatccgacgacgacgacgaccgcaacccccgacgacgcgcaaccgcccgtcgccgcccgccgctacccgacccccgacgcgccgccgactccgactttatacgaaaaaaacgaattcgcgacttcgactcccgacgccctcaataaccgcgccgccaacgaactactacaacgacgtaaacaacgaaaatcgcgactacgaaaaacgctccgaaacccaaaaacataatccccgctaactaacgacgacaacaacaacaacgaaacccctacgcgcgacgcccaccgtctcctcctcgcgccgaactcgcgatattacaaacgacaaccacgcaaactactctctcatccttttatccttcaatcaaaacgtaaatatactactaacgcatactattctaaaaaaaaattaacgtaataca

SEQ ID NO: 5105 - DNA, 647 bp, Artificial Sequence
  chemically treated genomic DNA (Homo sapiens) CpG-island No: 5105
ttttcgtcgtttgtttcgcggggttaacgtcggcgttttttagcgtcgcgtcggtcggcgtcgcgtagtttcgcgttttcggtcgttcgtttttttttttttttttttttttttttttttttttttttttttttttttttttttttttttttcgggtcgtttttttttcgttttttttagacgagcggagcggggttagggcgagcgggcgagcgagtcggagtgagcgttaagtgaggggtcgcgcgtaagtcgtaggcgttcgtagttattttgggtcggtcggagggagtagttgggtggtcgttgataggttggagcggcgcggggttgcggcgggagagttcgcgtcggttttcgtttttcggttcgtattcggggttttttggttttgaagagcggggtttaggggttcggcggttcgcggcggggttgttgtatttggtttgtttttcgttcggttcgcgttatttttattttcgttgattgttgacggggcgcggattcgcgttcggagttcggaattgcgtggtggggattcgggggacggcggtcggggttacgaggtttttaggatcgagagttcgggtttcgttgttgtattgtcgttagtttttttttcgttttgttttattttttttgtgttt

SEQ ID NO: 5106 - DNA, 647 bp, Artificial Sequence
  chemically treated genomic DNA (Homo sapiens) CpG-island No: 5106
aaacacaaaaaaaataaaacaaaacgaaaaaaaaactaacgacaatacaacaacgaaacccgaactctcgatcctaaaaacctcgtaaccccgaccgccgtcccccgaatccccaccacgcaattccgaactccgaacgcgaatccgcgccccgtcaacaatcaacgaaaataaaaataacgcgaaccgaacgaaaaacaaaccaaatacaacaaccccgccgcgaaccgccgaacccctaaaccccgctcttcaaaaccaaaaaaccccgaatacgaaccgaaaaacgaaaaccgacgcgaactctcccgccgcaaccccgcgccgctccaacctatcaacgaccacccaactactccctccgaccgacccaaaataactacgaacgcctacgacttacgcgcgacccctcacttaacgctcactccgactcgctcgcccgctcgccctaaccccgctccgctcgtctaaaaaaaacgaaaaaaaaacgacccgaaaaaaaaaaaaaaaaaaaaaaaaaaaaaaaaaaaaaaaaaaaaaaaaaaaaaaaaaaaaaaacgaacgaccgaaaacgcgaaactacgcgacgccgaccgacgcgacgctaaaaaacgccgacgttaaccccgcgaaacaaacgacgaaaa

SEQ ID NO: 5107 - DNA, 647 bp, Artificial Sequence
  chemically treated genomic DNA (Homo sapiens) CpG-island No: 5107
gagtataggaggggtgaggtaaagcgaaggaggggttggcggtagtgtagtagcgaagttcgggttttcggttttgggagtttcgtggtttcggtcgtcgtttttcgagtttttattacgtagtttcgaatttcgaacgcgagttcgcgtttcgttagtagttagcgggggtgaggatgacgcgggtcgggcgagaggtaggttaaatgtagtagtttcgtcgcgggtcgtcgggtttttgagtttcgttttttagagttagggggtttcgggtgcgggtcggagggcgggggtcggcgcgggttttttcgtcgtagtttcgcgtcgttttagtttattagcggttatttaattgtttttttcgatcggtttaaaatagttgcgaacgtttgcgatttgcgcgcggttttttatttgacgtttatttcggttcgttcgttcgttcgttttggtttcgtttcgttcgtttagagggggcggggaggaagcggttcggggaggggggaggggggagggggagagaggaagagaggaggaaggaaggaggaaagaggaagacgggcggtcggaggcgcggggttgcgcggcgtcggtcggcgcggcgttggaaggcgtcggcgttaatttcgcgaggtaggcgacggagg

SEQ ID NO: 5108 - DNA, 647 bp, Artificial Sequence
  chemically treated genomic DNA (Homo sapiens) CpG-island No: 5108
cctccgtcgcctacctcgcgaaattaacgccgacgccttccaacgccgcgccgaccgacgccgcgcaaccccgcgcctccgaccgcccgtcttcctctttcctccttccttcctcctctcttcctctctccccctcccccctcccccctccccgaaccgcttcctccccgccccctctaaacgaacgaaacgaaaccaaaacgaacgaacgaacgaaccgaaataaacgtcaaataaaaaaccgcgcgcaaatcgcaaacgttcgcaactattttaaaccgatcgaaaaaaacaattaaataaccgctaataaactaaaacgacgcgaaactacgacgaaaaaacccgcgccgacccccgccctccgacccgcacccgaaaccccctaactctaaaaaacgaaactcaaaaacccgacgacccgcgacgaaactactacatttaacctacctctcgcccgacccgcgtcatcctcacccccgctaactactaacgaaacgcgaactcgcgttcgaaattcgaaactacgtaataaaaactcgaaaaacgacgaccgaaaccacgaaactcccaaaaccgaaaacccgaacttcgctactacactaccgccaacccctccttcgctttacctcacccctcctatactc

SEQ ID NO: 5109 - DNA, 714 bp, Artificial Sequence
  chemically treated genomic DNA (Homo sapiens) CpG-island No: 5109
atttttcggggatagacgtttttcggggcgttattattttggtcggggtgttgggttcggcgggagtttttttgaggagtttgtttttaggtaaaagggtagacgttgttttcgattttttcggagtttgcggtcggaaaagcgttttcgttttatggtttcggttcgaggcggagaacggagttgttcgtgcggggtgcgcgttaaggcgggggataggacgggttcggcgtttgtcgagatttaggttgttcgtatttcgttcgcggttttttttttgtttttcgttttagcggcgtcggagtcgcgttggttttcgtttcgttcggtagttttcgcgagttagagttcggtgtttttagatcgcgggtagtcggggttttatttcgggttagagtaggaaagagttcgatttattttttcggtttttttagggaattttttttcggagggcgttttgggttttcgcgttatatttttggtttttcgttttcggtgatttcggttttttgggttatttcgggagaggcggttattttagttgtaggggtttcgttggggcgcggggggcgcggagggggataaacggtagcgaagggggtcgtttatttatcggggtcggggttggaggcgacgagttggttgttaaggttggtggttggtagttcgtatttattgcgcggagttgtttttttagttgggatgggaagtggt

SEQ ID NO: 5110 - DNA, 714 bp, Artificial Sequence
  chemically treated genomic DNA (Homo sapiens) CpG-island No: 5110
accacttcccatcccaactaaaaaaacaactccgcgcaataaatacgaactaccaaccaccaaccttaacaaccaactcgtcgcctccaaccccgaccccgataaataaacgacccccttcgctaccgtttatccccctccgcgccccccgcgccccaacgaaacccctacaactaaaataaccgcctctcccgaaataacccaaaaaaccgaaatcaccgaaaacgaaaaaccaaaaatataacgcgaaaacccaaaacgccctccgaaaaaaaattccctaaaaaaaccgaaaaaataaatcgaactctttcctactctaacccgaaataaaaccccgactacccgcgatctaaaaacaccgaactctaactcgcgaaaactaccgaacgaaacgaaaaccaacgcgactccgacgccgctaaaacgaaaaacaaaaaaaaaaccgcgaacgaaatacgaacaacctaaatctcgacaaacgccgaacccgtcctatcccccgccttaacgcgcaccccgcacgaacaactccgttctccgcctcgaaccgaaaccataaaacgaaaacgcttttccgaccgcaaactccgaaaaaatcgaaaacaacgtctacccttttacctaaaaacaaactcctcaaaaaaactcccgccgaacccaacaccccgaccaaaataataacgccccgaaaaacgtctatccccgaaaaat

SEQ ID NO: 5111 - DNA, 714 bp, Artificial Sequence
  chemically treated genomic DNA (Homo sapiens) CpG-island No: 5111
attattttttattttagttagagagatagtttcgcgtagtaagtgcggattgttagttattagttttggtagttagttcgtcgtttttagtttcgatttcggtaagtgaacggtttttttcgttgtcgtttgttttttttcgcgtttttcgcgttttagcgggatttttgtaattgggatggtcgtttttttcggaatgatttagggagtcggagttatcgggagcgggggattaggaatatggcgcggaggtttagggcgtttttcgagaaggggttttttggaagaatcgaggaggtgggtcgggtttttttttgttttggttcggaatgaggtttcgattgttcgcggtttgggggtatcgggttttgattcgcgggagttgtcgggcggggcgggggttagcgcggtttcggcgtcgttagagcgggaggtagaaggggagtcgcgagcggaatgcgggtagtttaggtttcggtagacgtcgggttcgttttgtttttcgttttggcgcgtatttcgtacgggtagtttcgtttttcgtttcggatcgagattatgaaacggagacgttttttcggtcgtagatttcggggaggtcgggagtaacgtttgtttttttatttgggagtaaattttttaaagggattttcgtcgagtttagtatttcgattaggatggtggcgtttcgaggggcgtttgttttcggagagt

SEQ ID NO: 5112 - DNA, 714 bp, Artificial Sequence
  chemically treated genomic DNA (Homo sapiens) CpG-island No: 5112
actctccgaaaacaaacgcccctcgaaacgccaccatcctaatcgaaatactaaactcgacgaaaatccctttaaaaaatttactcccaaataaaaaaacaaacgttactcccgacctccccgaaatctacgaccgaaaaaacgtctccgtttcataatctcgatccgaaacgaaaaacgaaactacccgtacgaaatacgcgccaaaacgaaaaacaaaacgaacccgacgtctaccgaaacctaaactacccgcattccgctcgcgactccccttctacctcccgctctaacgacgccgaaaccgcgctaacccccgccccgcccgacaactcccgcgaatcaaaacccgatacccccaaaccgcgaacaatcgaaacctcattccgaaccaaaacaaaaaaaaacccgacccacctcctcgattcttccaaaaaaccccttctcgaaaaacgccctaaacctccgcgccatattcctaatcccccgctcccgataactccgactccctaaatcattccgaaaaaaacgaccatcccaattacaaaaatcccgctaaaacgcgaaaaacgcgaaaaaaaacaaacgacaacgaaaaaaaccgttcacttaccgaaatcgaaactaaaaacgacgaactaactaccaaaactaataactaacaatccgcacttactacgcgaaactatctctctaactaaaataaaaaataat

SEQ ID NO: 5113 - DNA, 573 bp, Artificial Sequence
  chemically treated genomic DNA (Homo sapiens) CpG-island No: 5113
gggttagcggtcggatattgtcgtttatatttgcgaacggcgttcgtttcgcggattgtttagcggatggttcggagatttcgtttcgttcggtcgttttttcgttagtttatatcgttatttcggtttcgtcgcgcgggtttttcgtatttggtcggcggcggttgcggttgcggttgtagcgttgttttttacgtattcgtttcgtattttttcgttcgttacgtagttattcgttcgtatcgtgcggcggtagtagtagttttcgggtttcggtcgtatttttttggtagtattaggcgtaaggtaggttttgtaggcggtggtagcggcggcggttgttttaagtttcgtttcgtattttatttattttttcgaaatcggaaatggttgtagcgtcgtcgttaattttcgggcgggtttttatagagggcggggtttttttcgtagaggatcggtttcggttaaggttacgtagcgaagggaaaaagcggcggggatttgtcgagagggatgtggttttgaggatcgttgattaatttggaagagaaggaggcggattttatgttgttg

SEQ ID NO: 5114 - DNA, 573 bp, Artificial Sequence
  chemically treated genomic DNA (Homo sapiens) CpG-island No: 5114
caacaacataaaatccgcctccttctcttccaaattaatcaacgatcctcaaaaccacatccctctcgacaaatccccgccgctttttcccttcgctacgtaaccttaaccgaaaccgatcctctacgaaaaaaaccccgccctctataaaaacccgcccgaaaattaacgacgacgctacaaccatttccgatttcgaaaaaataaataaaatacgaaacgaaacttaaaacaaccgccgccgctaccaccgcctacaaaacctaccttacgcctaatactaccaaaaaaatacgaccgaaacccgaaaactactactaccgccgcacgatacgaacgaataactacgtaacgaacgaaaaaatacgaaacgaatacgtaaaaaacaacgctacaaccgcaaccgcaaccgccgccgaccaaatacgaaaaacccgcgcgacgaaaccgaaataacgatataaactaacgaaaaaacgaccgaacgaaacgaaatctccgaaccatccgctaaacaatccgcgaaacgaacgccgttcgcaaatataaacgacaatatccgaccgctaaccc

SEQ ID NO: 5115 - DNA, 573 bp, Artificial Sequence
  chemically treated genomic DNA (Homo sapiens) CpG-island No: 5115
tagtagtatggggttcgttttttttttttttagattggttagcggtttttaggattatatttttttcggtaggttttcgtcgtttttttttttcgttgcgtggttttggtcgagatcggttttttgcggagagggtttcgttttttgtgaaggttcgttcgggaattggcggcggcgttgtagttattttcggtttcggggaggtgggtggggtgcggagcgggatttggagtagtcgtcgtcgttgttatcgtttatagagtttgttttgcgtttggtgttgttaggaagatgcggtcggagttcggaggttgttgttgtcgtcgtacggtgcgggcgaatggttgcgtggcgaacggggaagtacggaacgggtacgtgaggagtagcgttgtagtcgtagtcgtagtcgtcgtcggttaggtacgaggggttcgcgcggcggggtcggggtggcggtgtggattggcggaggggcggtcgggcggggcgaggttttcgggttattcgttgggtaattcgcggggcgggcgtcgttcgtaggtgtgggcggtagtgttcggtcgttggttt

SEQ ID NO: 5116 - DNA, 573 bp, Artificial Sequence
  chemically treated genomic DNA (Homo sapiens) CpG-island No: 5116
aaaccaacgaccgaacactaccgcccacacctacgaacgacgcccgccccgcgaattacccaacgaataacccgaaaacctcgccccgcccgaccgcccctccgccaatccacaccgccaccccgaccccgccgcgcgaacccctcgtacctaaccgacgacgactacgactacgactacaacgctactcctcacgtacccgttccgtacttccccgttcgccacgcaaccattcgcccgcaccgtacgacgacaacaacaacctccgaactccgaccgcatcttcctaacaacaccaaacgcaaaacaaactctataaacgataacaacgacgacgactactccaaatcccgctccgcaccccacccacctccccgaaaccgaaaataactacaacgccgccgccaattcccgaacgaaccttcacaaaaaacgaaaccctctccgcaaaaaaccgatctcgaccaaaaccacgcaacgaaaaaaaaaaacgacgaaaacctaccgaaaaaaatataatcctaaaaaccgctaaccaatctaaaaaaaaaaaaaacgaaccccatactacta

SEQ ID NO: 5117 - DNA, 750 bp, Artificial Sequence
  chemically treated genomic DNA (Homo sapiens) CpG-island No: 5117
tgtaacggaggggtaggagcggttattgttttgtaacggagggggaagagcgggttatcgttttgtaacggagggggaggagagggttatcgttttgtaacggaggggtaggagcggttattgttttgtaacggagggggaagagcgggttatcgttttgtaacggagggggaggagagggttatcgttttgtaacggagggggaggagagggttatcgttttgtaacggaggggtaggagcgggttatcgttttgtaacggaggggtaggagtgggttatcgttttgtaacggagggggaggagtgggttatcgttttgtaacggagggggaggggcgggttatcgttttgtaacggaggggtaggggcgggttatcgttttgtaacggagggggaggggcgggttatcgttttgtaacggaggggtaggagcggttatcgttttgtaacggagggggaagagcgggttatcgttttgtaacggagggggaggagcgggttatcgttttgtaacggaggggtaggagcgggttatcgttttgtaacggagggggaggagcgggttatcgttttgtaacggaggggtaggagcggttatcgttttgtaacggaggggtaggagcggttatcgttttgtaacggagggggaggagcgggttatcgttttgtaacggagggggaggagcgggttatcgttttgtaacggaggggtaggagcgggtttttaatagtgttagttgtattgtggg

SEQ ID NO: 5118 - DNA, 750 bp, Artificial Sequence
  chemically treated genomic DNA (Homo sapiens) CpG-island No: 5118
cccacaatacaactaacactattaaaaacccgctcctacccctccgttacaaaacgataacccgctcctccccctccgttacaaaacgataacccgctcctccccctccgttacaaaacgataaccgctcctacccctccgttacaaaacgataaccgctcctacccctccgttacaaaacgataacccgctcctccccctccgttacaaaacgataacccgctcctacccctccgttacaaaacgataacccgctcctccccctccgttacaaaacgataacccgctcttccccctccgttacaaaacgataaccgctcctacccctccgttacaaaacgataacccgcccctccccctccgttacaaaacgataacccgcccctacccctccgttacaaaacgataacccgcccctccccctccgttacaaaacgataacccactcctccccctccgttacaaaacgataacccactcctacccctccgttacaaaacgataacccgctcctacccctccgttacaaaacgataaccctctcctccccctccgttacaaaacgataaccctctcctccccctccgttacaaaacgataacccgctcttccccctccgttacaaaacaataaccgctcctacccctccgttacaaaacgataaccctctcctccccctccgttacaaaacgataacccgctcttccccctccgttacaaaacaataaccgctcctacccctccgttaca

SEQ ID NO: 5119 - DNA, 750 bp, Artificial Sequence
  chemically treated genomic DNA (Homo sapiens) CpG-island No: 5119
tttatagtgtagttgatattattgagggttcgtttttgttttttcgttataggacggtggttcgttttttttttttcgttataggacggtggttcgttttttttttttcgttataggacggtggtcgtttttgttttttcgttataggacggtggtcgtttttgttttttcgttataggacggtggttcgttttttttttttcgttataggacggtggttcgtttttgttttttcgttataggacggtggttcgttttttttttttcgttataggacggtggttcgttttttttttttcgttataggacggtggtcgtttttgttttttcgttataggacggtggttcgttttttttttttcgttataggacggtggttcgtttttgttttttcgttataggacggtggttcgttttttttttttcgttataggacggtggtttattttttttttttcgttataggacggtggtttatttttgttttttcgttataggacggtggttcgtttttgttttttcgttataggacggtggttttttttttttttttcgttataggacggtggttttttttttttttttcgttataggacggtggttcgttttttttttttcgttataggatagtggtcgtttttgttttttcgttataggacggtggttttttttttttttttcgttataggacggtggttcgttttttttttttcgttataggatagtggtcgtttttgttttttcgttata

SEQ ID NO: 5120 - DNA, 750 bp, Artificial Sequence
  chemically treated genomic DNA (Homo sapiens) CpG-island No: 5120
tataacgaaaaaacaaaaacgaccactatcctataacgaaaaaaaaaaaacgaaccaccgtcctataacgaaaaaaaaaaaaaaaaccaccgtcctataacgaaaaaacaaaaacgaccactatcctataacgaaaaaaaaaaaacgaaccaccgtcctataacgaaaaaaaaaaaaaaaaccaccgtcctataacgaaaaaaaaaaaaaaaaccaccgtcctataacgaaaaaacaaaaacgaaccaccgtcctataacgaaaaaacaaaaataaaccaccgtcctataacgaaaaaaaaaaaataaaccaccgtcctataacgaaaaaaaaaaaacgaaccaccgtcctataacgaaaaaacaaaaacgaaccaccgtcctataacgaaaaaaaaaaaacgaaccaccgtcctataacgaaaaaacaaaaacgaccaccgtcctataacgaaaaaaaaaaaacgaaccaccgtcctataacgaaaaaaaaaaaacgaaccaccgtcctataacgaaaaaacaaaaacgaaccaccgtcctataacgaaaaaaaaaaaacgaaccaccgtcctataacgaaaaaacaaaaacgaccaccgtcctataacgaaaaaacaaaaacgaccaccgtcctataacgaaaaaaaaaaaacgaaccaccgtcctataacgaaaaaaaaaaaacgaaccaccgtcctataacgaaaaaacaaaaacgaaccctcaataatatcaactacactataaa

SEQ ID NO: 5121 - DNA, 576 bp, Artificial Sequence
  chemically treated genomic DNA (Homo sapiens) CpG-island No: 5121
tttgtcgttttttttcgtttttagtttttcggaaatgaattcggtcgggtttttagtttggcgggcgagttaggttcgatagtttcgcgtcgggcgagcggaggatttatcgttcgttcgtcgtttatttcgggggttttattcggttcgattgtagtttttttttttggtataggcggttgaggaaggatttttgttcgcggtatagcgtttgtcgggtggttaggaatatcgtgttttttacgttgagtcgtatttatttgttttagtcgtttgcggcgcggtcgttcgttttcgtcggcggcgttgttttttcggtttttatttttatcgtcggtcgcggcgtttgtatttttttttcgggcgttgggggcgggcggggatcgtacgcggggtaggtcgggagttgtagttcgcgttttttggtttcgcgtgggtcgcgggtagggtttcgtttcgcgttgttttcgttttcggtttcgtttcgtttcgttttttttcgtaggttcgtagtttggggtggtgaagatgttttttggttaaattattgtgtatggggaaggtcgaattttcggt

SEQ ID NO: 5122 - DNA, 576 bp, Artificial Sequence
  chemically treated genomic DNA (Homo sapiens) CpG-island No: 5122
accgaaaattcgaccttccccatacacaataatttaaccaaaaaacatcttcaccaccccaaactacgaacctacgaaaaaaaacgaaacgaaacgaaaccgaaaacgaaaacaacgcgaaacgaaaccctacccgcgacccacgcgaaaccaaaaaacgcgaactacaactcccgacctaccccgcgtacgatccccgcccgcccccaacgcccgaaaaaaaaatacaaacgccgcgaccgacgataaaaataaaaaccgaaaaaacaacgccgccgacgaaaacgaacgaccgcgccgcaaacgactaaaacaaataaatacgactcaacgtaaaaaacacgatattcctaaccacccgacaaacgctataccgcgaacaaaaatccttcctcaaccgcctataccaaaaaaaaaaactacaatcgaaccgaataaaacccccgaaataaacgacgaacgaacgataaatcctccgctcgcccgacgcgaaactatcgaacctaactcgcccgccaaactaaaaacccgaccgaattcatttccgaaaaactaaaaacgaaaaaaaacgacaaa

SEQ ID NO: 5123 - DNA, 576 bp, Artificial Sequence
  chemically treated genomic DNA (Homo sapiens) CpG-island No: 5123
gtcgggagttcgattttttttatatatagtgatttggttagagggtatttttattattttagattgcgggtttgcggggaagggcgaagcggggcgggatcgggggcgggagtagcgcggggcgggattttattcgcggtttacgcggagttaggaggcgcggattatagttttcggtttgtttcgcgtgcggttttcgttcgtttttagcgttcgggaggaggatgtagacgtcgcggtcggcgatgaggatggaggtcggggaggtagcgtcgtcggcgggggcgggcggtcgcgtcgtaggcggttggggtaagtgggtgcggtttaacgtggggggtacggtgtttttgattattcggtagacgttgtgtcgcgagtagaagtttttttttagtcgtttgtgttagggggaagagttgtagtcggatcgggtgaggttttcggggtgggcggcgagcgggcggtgggtttttcgttcgttcgacgcggggttgtcgggtttggttcgttcgttaggttggggattcggtcgggtttattttcgaggaattggaggcgggaagaagcggtagg

SEQ ID NO: 5124 - DNA, 576 bp, Artificial Sequence
  chemically treated genomic DNA (Homo sapiens) CpG-island No: 5124
cctaccgcttcttcccgcctccaattcctcgaaaataaacccgaccgaatccccaacctaacgaacgaaccaaacccgacaaccccgcgtcgaacgaacgaaaaacccaccgcccgctcgccgcccaccccgaaaacctcacccgatccgactacaactcttccccctaacacaaacgactaaaaaaaaacttctactcgcgacacaacgtctaccgaataatcaaaaacaccgtaccccccacgttaaaccgcacccacttaccccaaccgcctacgacgcgaccgcccgcccccgccgacgacgctacctccccgacctccatcctcatcgccgaccgcgacgtctacatcctcctcccgaacgctaaaaacgaacgaaaaccgcacgcgaaacaaaccgaaaactataatccgcgcctcctaactccgcgtaaaccgcgaataaaatcccgccccgcgctactcccgcccccgatcccgccccgcttcgcccttccccgcaaacccgcaatctaaaataataaaaataccctctaaccaaatcactatatataaaaaaaatcgaactcccgac

SEQ ID NO: 5125 - DNA, 741 bp, Artificial Sequence
  chemically treated genomic DNA (Homo sapiens) CpG-island No: 5125
cgcgttgttagtatttcgtagcgcgtggtcgtgtatttcggaatttgtagtagttgtatatttgaggggggttttttttgttcgcgtcgttttcgtttttcgtgtttttgggtgtgtggagggttttagtgcgcggcgttttcgttttttcgtaatttttcgtttcgcgttcggattcgtttcgcgttattaagatggttatttagaaagagaagaagagttgcgggtaggtggttgaggagtggaaggagttcgtgtggaattcgaggacgtattagtttatgggtcgtatcgggattagttggggtacgtagggtcggtacgtaaggggcgggggaaagtcgcggggcgacgtttcgggggcgtagggtttcgtcgacgcggttttagtttttttttcgggttttcggcgtttagtttttttgtcgggttttgggttgggagggggtcgaatcgttagtttaattttttcggttggtcgtgcggaggcggagaaagtaggttatagtcgttttttcgtttttcgcggagttttttcgggcggggggtcgttagtttcgtttgcgtgttcgcgtcgcggcgtttatattttttttcggggtttgttcgttttatacgggcgttttttatttttaaagagcgtttttttttttttttcggtttttattagtttcgtagtttcgtttatttttagttcgtgtttattttttggattttgggaacgtttatgagggggcgggt

SEQ ID NO: 5126 - DNA, 741 bp, Artificial Sequence
  chemically treated genomic DNA (Homo sapiens) CpG-island No: 5126
acccgccccctcataaacgttcccaaaatccaaaaaataaacacgaactaaaaataaacgaaactacgaaactaataaaaaccgaaaaaaaaaaaaaaacgctctttaaaaataaaaaacgcccgtataaaacgaacaaaccccgaaaaaaaatataaacgccgcgacgcgaacacgcaaacgaaactaacgaccccccgcccgaaaaaactccgcgaaaaacgaaaaaacgactataacctactttctccgcctccgcacgaccaaccgaaaaaattaaactaacgattcgaccccctcccaacccaaaacccgacaaaaaaactaaacgccgaaaacccgaaaaaaaaactaaaaccgcgtcgacgaaaccctacgcccccgaaacgtcgccccgcgactttcccccgccccttacgtaccgaccctacgtaccccaactaatcccgatacgacccataaactaatacgtcctcgaattccacacgaactccttccactcctcaaccacctacccgcaactcttcttctctttctaaataaccatcttaataacgcgaaacgaatccgaacgcgaaacgaaaaattacgaaaaaacgaaaacgccgcgcactaaaaccctccacacacccaaaaacacgaaaaacgaaaacgacgcgaacaaaaaaaacccccctcaaatatacaactactacaaattccgaaatacacgaccacgcgctacgaaatactaacaacgcg

SEQ ID NO: 5127 - DNA, 741 bp, Artificial Sequence
  chemically treated genomic DNA (Homo sapiens) CpG-island No: 5127
attcgtttttttatgaacgtttttagggtttagggggtgggtacgagttaaaaatagacggggttgcggagttagtgagagtcggagggagggaaggggcgttttttggaggtgggggacgttcgtgtggagcggataggtttcgagagggagtgtgagcgtcgcggcgcggatacgtaggcggagttggcgatttttcgttcgagggggtttcgcggggggcgggaaggcggttgtgatttatttttttcgttttcgtacggttagtcggggagattagattggcgattcggtttttttttagtttagagttcggtagggaggttggacgtcggggattcgggaggggagttggggtcgcgtcggcgggattttgcgttttcgaggcgtcgtttcgcggttttttttcgttttttgcgtgtcggttttgcgtattttagttggtttcggtgcggtttataaattggtgcgttttcgggttttatacgaattttttttattttttaattatttgttcgtagttttttttttttttttggatgattattttggtggcgcggggcgagttcgggcgcggggcggggggttgcggagaagcgggggcgtcgcgtattgaagttttttatatatttaaaagtacggggagcgaaggcggcgcgggtaaaggagattttttttagatatgtagttgttgtagatttcggggtgtacgattacgcgttgcggggtgttggtagcgcg

SEQ ID NO: 5128 - DNA, 741 bp, Artificial Sequence
  chemically treated genomic DNA (Homo sapiens) CpG-island No: 5128
cgcgctaccaacaccccgcaacgcgtaatcgtacaccccgaaatctacaacaactacatatctaaaaaaaatctcctttacccgcgccgccttcgctccccgtacttttaaatatataaaaaacttcaatacgcgacgcccccgcttctccgcaaccccccgccccgcgcccgaactcgccccgcgccaccaaaataatcatccaaaaaaaaaaaaaaaactacgaacaaataattaaaaaataaaaaaaattcgtataaaacccgaaaacgcaccaatttataaaccgcaccgaaaccaactaaaatacgcaaaaccgacacgcaaaaaacgaaaaaaaaccgcgaaacgacgcctcgaaaacgcaaaatcccgccgacgcgaccccaactcccctcccgaatccccgacgtccaacctccctaccgaactctaaactaaaaaaaaaccgaatcgccaatctaatctccccgactaaccgtacgaaaacgaaaaaaataaatcacaaccgccttcccgccccccgcgaaaccccctcgaacgaaaaatcgccaactccgcctacgtatccgcgccgcgacgctcacactccctctcgaaacctatccgctccacacgaacgtcccccacctccaaaaaacgccccttccctccctccgactctcactaactccgcaaccccgtctatttttaactcgtacccaccccctaaaccctaaaaacgttcataaaaaaacgaat

SEQ ID NO: 5129 - DNA, 732 bp, Artificial Sequence
  chemically treated genomic DNA (Homo sapiens) CpG-island No: 5129
ggcgtttttagtcggcgcgtcgttttattttgtagaaggtttcgttggagtcgcgtatttcgacgggtagtttcggttttatattttttttagaggttaggtcgtttatggcgtcgttatcgttttcgattttttcggcggcggttgtagtagtagtttgagtgcgggtcgggttaggttttcggcgttttttcggaggaggagtcggagggggagtcgcggggggcgggagtcgggtcggttttacggcggttttgttatagttaacgagtagggggtcggggtcgggtcgtttttcgttcgtcgtcgtcgttttggttttcgttatcgtgagggaaacggtcgtcgtcgtcgttgttttcgttattttagttttcgttcgtcgtcgttttcgttgttgttttagtttcgggattcgttgttgtcgttgtcgttttatagtttttatttttttttgttatcgtcgtttattgcgtaggcgtatcgggtattcgttcgttgcgcgcggggtttcgagggttatcgcgtaggcgttaaggttagagttttagttagcgttagttagcgtatcggggtttttatatttttttttatttttttatttttttttttggtcgtttgttagcgtttgcgtagaataagattagttttttttttttatcgttttatcgtttagttatttcgttttttttttttttcgttttataatattgagaattaattaattagggg

SEQ ID NO: 5130 - DNA, 732 bp, Artificial Sequence
  chemically treated genomic DNA (Homo sapiens) CpG-island No: 5130
cccctaattaattaattctcaatattataaaacgaaaaaaaaaaaaaacgaaataactaaacgataaaacgataaaaaaaaaaaactaatcttattctacgcaaacgctaacaaacgaccaaaaaaaaaaataaaaaaataaaaaaaaatataaaaaccccgatacgctaactaacgctaactaaaactctaaccttaacgcctacgcgataaccctcgaaaccccgcgcgcaacgaacgaatacccgatacgcctacgcaataaacgacgataacaaaaaaaaataaaaactataaaacgacaacgacaacaacgaatcccgaaactaaaacaacaacgaaaacgacgacgaacgaaaactaaaataacgaaaacaacgacgacgacgaccgtttccctcacgataacgaaaaccaaaacgacgacgacgaacgaaaaacgacccgaccccgaccccctactcgttaactataacaaaaccgccgtaaaaccgacccgactcccgccccccgcgactccccctccgactcctcctccgaaaaaacgccgaaaacctaacccgacccgcactcaaactactactacaaccgccgccgaaaaaatcgaaaacgataacgacgccataaacgacctaacctctaaaaaaaatataaaaccgaaactacccgtcgaaatacgcgactccaacgaaaccttctacaaaataaaacgacgcgccgactaaaaacgcc

SEQ ID NO: 5131 - DNA, 732 bp, Artificial Sequence
  chemically treated genomic DNA (Homo sapiens) CpG-island No: 5131
tttttgattggttggtttttagtgttgtggggcggggaaaggaagagacggggtggttgggcggtggagcggtgaagaaagaaggttaattttgttttgcgtaagcgttagtaagcgattaggagggggagtgagagagtgaaagggaatgtggaagtttcgatgcgttagttggcgttagttggggttttaattttgacgtttgcgcggtggttttcggggtttcgcgcgtagcgggcgggtgttcggtgcgtttgcgtagtaggcggcggtggtagggggaggtggaggttgtggagcggtagcggtagtagcgggtttcgggattgaggtagtagcgggggcggcggcgggcggaagttgaggtgacgaaggtagcggcggcggcggtcgttttttttacggtggcggagattaaggcggcggcggcggacggggagcggttcggtttcggttttttgttcgttggttgtggtagggtcgtcgtggggtcggttcggttttcgtttttcgcggtttttttttcggtttttttttcggggagacgtcgggggtttggttcggttcgtatttagattgttgttgtagtcgtcgtcgggggagtcggaggcggtggcggcgttatgggcggtttggtttttgggggggatgtggagtcgggattgttcgtcgaggtgcgcggttttaacggggttttttataaggtgagacggcgcgtcgattggggacgtt

SEQ ID NO: 5132 - DNA, 732 bp, Artificial Sequence
  chemically treated genomic DNA (Homo sapiens) CpG-island No: 5132
aacgtccccaatcgacgcgccgtctcaccttataaaaaaccccgttaaaaccgcgcacctcgacgaacaatcccgactccacatcccccccaaaaaccaaaccgcccataacgccgccaccgcctccgactcccccgacgacgactacaacaacaatctaaatacgaaccgaaccaaacccccgacgtctccccgaaaaaaaaaccgaaaaaaaaaccgcgaaaaacgaaaaccgaaccgaccccacgacgaccctaccacaaccaacgaacaaaaaaccgaaaccgaaccgctccccgtccgccgccgccgccttaatctccgccaccgtaaaaaaaacgaccgccgccgccgctaccttcgtcacctcaacttccgcccgccgccgcccccgctactacctcaatcccgaaacccgctactaccgctaccgctccacaacctccacctccccctaccaccgccgcctactacgcaaacgcaccgaacacccgcccgctacgcgcgaaaccccgaaaaccaccgcgcaaacgtcaaaattaaaaccccaactaacgccaactaacgcatcgaaacttccacattccctttcactctctcactccccctcctaatcgcttactaacgcttacgcaaaacaaaattaaccttctttcttcaccgctccaccgcccaaccaccccgtctcttcctttccccgccccacaacactaaaaaccaaccaatcaaaaa

SEQ ID NO: 5133 - DNA, 671 bp, Artificial Sequence
  chemically treated genomic DNA (Homo sapiens) CpG-island No: 5133
  misc_feature (3)..(3): n is either a, c, g or t
  misc_feature (8)..(8): n is either a, c, g or t
  misc_feature (19)..(19): n is either a, c, g or t
  misc_feature (30)..(30): n is either a, c, g or t
  misc_feature (47)..(47): n is either a, c, g or t
  misc_feature (135)..(135): n is either a, c, g or t
  misc_feature (152)..(152): n is either a, c, g or t
  misc_feature (162)..(162): n is either a, c, g or t
  misc_feature (178)..(178): n is either a, c, g or t
  misc_feature (189)..(189): n is either a, c, g or t
  misc_feature (256)..(256): n is either a, c, g or t
  misc_feature (427)..(427): n is either a, c, g or t
tantttgncggtcgaggtngcggtttattnttgagatagtcgttttntcgagcgtagtttttttatttttcgtagtagttttttttttttcgtcgttggtacgagtcgagattgttcgtttaggttgggtttttntgggggtttcggggatntggtcgtttncggtggcgagcgtttntcggatatttnttcgttacgtcgggtttcgcgaaatttttcgaaatttcgttcgggatgtttcggttttcgggatagngcgttcgcggcgagaggcgcggtcgacggagcgttgggggtttagggttgttcggcggcgtttttcgggttgcggggttcggcgtcggcgtttttcgtgggggtttacggtcgttggagttcgtgtcggattcggcgtcgttgttggcggtagggagtaagcgttgttcgntcggataggggtttcgaggggtagttagagaggtcggagttgttgttcgtgtggttgatgcgcgagtaagcgcgggggattcggttatcgaggttatcgcgagggttacggtagggattcgggcgatcggggacggggggtagaaagtgcgggcggatggcgttcgggagttagcgaatggttttgcggttttattgtttagaagtgaagatattgaggtaagttgtttgtttaaggatagttg

SEQ ID NO: 5134 - DNA, 671 bp, Artificial Sequence
  chemically treated genomic DNA (Homo sapiens) CpG-island No: 5134
  misc_feature (245)..(245): n is either a, c, g or t
  misc_feature (416)..(416): n is either a, c, g or t
  misc_feature (483)..(483): n is either a, c, g or t
  misc_feature (494)..(494): n is either a, c, g or t
  misc_feature (510)..(510): n is either a, c, g or t
  misc_feature (520)..(520): n is either a, c, g or t
  misc_feature (537)..(537): n is either a, c, g or t
  misc_feature (625)..(625): n is either a, c, g or t
  misc_feature (642)..(642): n is either a, c, g or t
  misc_feature (653)..(653): n is either a, c, g or t
  misc_feature (664)..(664): n is either a, c, g or t
  misc_feature (669)..(669): n is either a, c, g or t
caactatccttaaacaaacaacttacctcaatatcttcacttctaaacaataaaaccgcaaaaccattcgctaactcccgaacgccatccgcccgcactttctaccccccgtccccgatcgcccgaatccctaccgtaaccctcgcgataacctcgataaccgaatcccccgcgcttactcgcgcatcaaccacacgaacaacaactccgacctctctaactacccctcgaaacccctatccgancgaacaacgcttactccctaccgccaacaacgacgccgaatccgacacgaactccaacgaccgtaaacccccacgaaaaacgccgacgccgaaccccgcaacccgaaaaacgccgccgaacaaccctaaacccccaacgctccgtcgaccgcgcctctcgccgcgaacgcnctatcccgaaaaccgaaacatcccgaacgaaatttcgaaaaatttcgcgaaacccgacgtaacgaanaaatatccganaaacgctcgccaccgnaaacgaccanatccccgaaacccccanaaaaacccaacctaaacgaacaatctcgactcgtaccaacgacgaaaaaaaaaaaactactacgaaaaataaaaaaactacgctcganaaaacgactatctcaanaataaaccgcnacctcgaccgncaaanta

SEQ ID NO: 5135 - DNA, 671 bp, Artificial Sequence
  chemically treated genomic DNA (Homo sapiens) CpG-island No: 5135
  misc_feature (245)..(245): n is either a, c, g or t
  misc_feature (416)..(416): n is either a, c, g or t
  misc_feature (483)..(483): n is either a, c, g or t
  misc_feature (494)..(494): n is either a, c, g or t
  misc_feature (510)..(510): n is either a, c, g or t
  misc_feature (520)..(520): n is either a, c, g or t
  misc_feature (537)..(537): n is either a, c, g or t
  misc_feature (625)..(625): n is either a, c, g or t
  misc_feature (642)..(642): n is either a, c, g or t
  misc_feature (653)..(653): n is either a, c, g or t
  misc_feature (664)..(664): n is either a, c, g or t
  misc_feature (669)..(669): n is either a, c, g or t
tagttgtttttaggtaagtagtttattttagtgtttttatttttaggtagtagggtcgtaaagttattcgttggttttcgggcgttattcgttcgtattttttgtttttcgttttcggtcgttcggatttttgtcgtgattttcgcggtgatttcggtggtcgggtttttcgcgtttgttcgcgtattagttatacggatagtagtttcgatttttttgattgtttttcggaatttttgttcgancgagtagcgtttgttttttgtcgttagtagcgacgtcgaattcggtacgggttttagcgatcgtgaatttttacgaggagcgtcgacgtcgagtttcgtagttcgaggagcgtcgtcgggtagttttgagtttttagcgtttcgtcgatcgcgtttttcgtcgcgggcgtnttgtttcgggggtcggagtatttcgagcggggtttcggggggtttcgcggggttcggcgtggcgganggatgttcggngggcgttcgttatcgngagcgattangttttcgggatttttanaggagtttagtttgggcgagtagtttcggttcgtgttagcggcggaggaagaagagttgttgcgggagatggaggagttgcgttcggnagaacgattattttaanggtgagtcgtngtttcggtcgntaggntg

SEQ ID NO: 5136 - DNA, 671 bp, Artificial Sequence
  chemically treated genomic DNA (Homo sapiens) CpG-island No: 5136
  misc_feature (3)..(3): n is either a, c, g or t
  misc_feature (8)..(8): n is either a, c, g or t
  misc_feature (19)..(19): n is either a, c, g or t
  misc_feature (30)..(30): n is either a, c, g or t
  misc_feature (47)..(47): n is either a, c, g or t
  misc_feature (135)..(135): n is either a, c, g or t
  misc_feature (152)..(152): n is either a, c, g or t
  misc_feature (162)..(162): n is either a, c, g or t
  misc_feature (178)..(178): n is either a, c, g or t
  misc_feature (189)..(189): n is either a, c, g or t
  misc_feature (256)..(256): n is either a, c, g or t
  misc_feature (427)..(427): n is either a, c, g or t
cancctancgaccgaaacnacgactcaccnttaaaataatcgttctnccgaacgcaactcctccatctcccgcaacaactcttcttcctccgccgctaacacgaaccgaaactactcgcccaaactaaactcctntaaaaatcccgaaaacntaatcgctcncgataacgaacgcccnccgaacatccntccgccacgccgaaccccgcgaaaccccccgaaaccccgctcgaaatactccgacccccgaaacaanacgcccgcgacgaaaaacgcgatcgacgaaacgctaaaaactcaaaactacccgacgacgctcctcgaactacgaaactcgacgtcgacgctcctcgtaaaaattcacgatcgctaaaacccgtaccgaattcgacgtcgctactaacgacaaaaaacaaacgctactcgntcgaacaaaaattccgaaaaacaatcaaaaaaatcgaaactactatccgtataactaatacgcgaacaaacgcgaaaaacccgaccaccgaaatcaccgcgaaaatcacgacaaaaatccgaacgaccgaaaacgaaaaacaaaaaatacgaacgaataacgcccgaaaaccaacgaataactttacgaccctactacctaaaaataaaaacactaaaataaactacttacctaaaaacaacta

SEQ ID NO: 5137 - DNA, 657 bp, Artificial Sequence
  chemically treated genomic DNA (Homo sapiens) CpG-island No: 5137
cgttttttttttttaggaagtttttcgggatagtgttttttttttgcggattttattagaatcggatggattaggtttttaggtagtttcggttcggcgcgttttcggttttggttttcggggtttcgcgaaggttcgggggacgtggtgttcgtagtcgggcggggattttggtagtgttagggggtgatttcggcggggcgcgagggttagggcgcggtagaggtgtcgcgggttcgagttttgcggggatcgggtaggagtagttcgtggagcgtagagttgtggtcgagaggcgaatttagttagttttgtgttttcggggattttttcgcggcgttatacgtggtatcggtcggcggggaggtggaggggcgcggtggggcgggggttcgggtttcggggcgagtgcggaagtagcgggattcggtcgcgtcgtcggttcggggttcgggcgatgggacgcgcggttttttttttgtaggcgttcggagaggtggggttggatatcggttttggggggtttgcgttttttcgggttggcggggggcggcgcgggacgttacgtttcggcgttttttttttttttcgttggttttgggtttgagttttttggttttgttttattgttttttgttagtttggtttttgaatttt

SEQ ID NO: 5138 - DNA, 657 bp, Artificial Sequence
  chemically treated genomic DNA (Homo sapiens) CpG-island No: 5138
aaaattcaaaaaccaaactaacaaaaaacaataaaacaaaaccaaaaaactcaaacccaaaaccaacgaaaaaaaaaaaaaacgccgaaacgtaacgtcccgcgccgccccccgccaacccgaaaaaacgcaaaccccccaaaaccgatatccaaccccacctctccgaacgcctacaaaaaaaaaaccgcgcgtcccatcgcccgaaccccgaaccgacgacgcgaccgaatcccgctacttccgcactcgccccgaaacccgaacccccgccccaccgcgcccctccacctccccgccgaccgataccacgtataacgccgcgaaaaaatccccgaaaacacaaaactaactaaattcgcctctcgaccacaactctacgctccacgaactactcctacccgatccccgcaaaactcgaacccgcgacacctctaccgcgccctaaccctcgcgccccgccgaaatcaccccctaacactaccaaaatccccgcccgactacgaacaccacgtcccccgaaccttcgcgaaaccccgaaaaccaaaaccgaaaacgcgccgaaccgaaactacctaaaaacctaatccatccgattctaataaaatccgcaaaaaaaaaacactatcccgaaaaacttcctaaaaaaaaaaaacg

SEQ ID NO: 5139 - DNA, 657 bp, Artificial Sequence
  chemically treated genomic DNA (Homo sapiens) CpG-island No: 5139
aggatttaggaattagattaatagagggtaatgaaataaaattagagaatttaggtttagagttagcgagggagaggaaggacgtcgaagcgtagcgtttcgcgtcgtttttcgttaattcgggaggacgtagattttttagagtcggtgtttagttttattttttcgggcgtttgtaggaggggaatcgcgcgttttatcgttcggatttcgggtcggcggcgcggtcgagtttcgttgttttcgtattcgtttcgggattcggattttcgttttatcgcgtttttttattttttcgtcggtcggtgttacgtgtaacgtcgcgggggaattttcggggatatagggttggttggattcgtttttcggttatagttttgcgttttacgagttgtttttgttcggttttcgtaggattcgaattcgcgatatttttgtcgcgttttagttttcgcgtttcgtcggagttattttttgatattgttaggattttcgttcggttgcgggtattacgtttttcgggttttcgcggggtttcgagggttaagatcgaggacgcgtcgagtcgaggttgtttggggatttggtttattcggttttgatggggttcgtagggaaaaggtattatttcggaaagttttttggaggaggggagcg

SEQ ID NO: 5140 - DNA, 657 bp, Artificial Sequence
  chemically treated genomic DNA (Homo sapiens) CpG-island No: 5140
cgctcccctcctccaaaaaactttccgaaataataccttttccctacgaaccccatcaaaaccgaataaaccaaatccccaaacaacctcgactcgacgcgtcctcgatcttaaccctcgaaaccccgcgaaaacccgaaaaacgtaatacccgcaaccgaacgaaaatcctaacaatatcaaaaaataactccgacgaaacgcgaaaactaaaacgcgacaaaaatatcgcgaattcgaatcctacgaaaaccgaacaaaaacaactcgtaaaacgcaaaactataaccgaaaaacgaatccaaccaaccctatatccccgaaaattcccccgcgacgttacacgtaacaccgaccgacgaaaaaataaaaaaacgcgataaaacgaaaatccgaatcccgaaacgaatacgaaaacaacgaaactcgaccgcgccgccgacccgaaatccgaacgataaaacgcgcgattcccctcctacaaacgcccgaaaaaataaaactaaacaccgactctaaaaaatctacgtcctcccgaattaacgaaaaacgacgcgaaacgctacgcttcgacgtccttcctctccctcgctaactctaaacctaaattctctaattttatttcattaccctctattaatctaattcctaaatcct

SEQ ID NO: 5141 - DNA, 977 bp, Artificial Sequence
  chemically treated genomic DNA (Homo sapiens) CpG-island No: 5141
tcgtgattcgggttattttgacgtatcgggatgcggtttatttgatattcggtattaatttttgttaggaaggaaaattaatttcgcgaaaataaaatgggttttcgaggaggcgtgcgggtgtttttagagtttttttttgtttatatttcgaaagcgagggggttacgtttatttcgattttcgtcggcgttcgttatttgttagacgaggtcgcggttagggattcgggttcggtcgtaaggaaggggtagtttagtttaggttttttcggcgtttgtttcggttcggtagtagaggaaggaattcggggtcggaggttttcgtttcgtacggtcgagttcgttaggggtttagttcgggggtcgttcgtattttcgaggattcgtttttatcgtgcggagcgtatagtcgttttagttcgattcgtagagttttcgggtagcgggcgcggcgttcgtatttgtttcgcgttttgttgtagtttcgttagcggttttatttatttggcgttttcgtcgcgtttttcgttcgttatagcgcgatttcgcgttttttagtatcggtagtttgggcgcgggtaggcgcggggagattttgttttgtcgtcgtcgtcgttattgtagttggtttggtcgttaggtcgtcgttcgcgaatttgttgcgtagtttgttatagtcgtttagggtttcgtcgcgtcgttttagttttataataatatggcggtcgcggttttcgtaggaagtcggggggcggggaggtaggcgtcgggtcgggtagttgacggtcgttcgttgtcgggtatcgattttttatttttcggagttcgaaattgttcgggcgtggtttttcgttttaggagtttcggggtattgaattttgaaggtttgtttcgagtcggtcgggttcgaagcgtttttttttgttttcggggaggtttcgaagttttagatttggtagttttttttggagttgt

SEQ ID NO: 5142 - DNA, 977 bp, Artificial Sequence
  chemically treated genomic DNA (Homo sapiens) CpG-island No: 5142
acaactccaaaaaaaactaccaaatctaaaacttcgaaacctccccgaaaacaaaaaaaaacgcttcgaacccgaccgactcgaaacaaaccttcaaaattcaataccccgaaactcctaaaacgaaaaaccacgcccgaacaatttcgaactccgaaaaataaaaaatcgatacccgacaacgaacgaccgtcaactacccgacccgacgcctacctccccgccccccgacttcctacgaaaaccgcgaccgccatattattataaaactaaaacgacgcgacgaaaccctaaacgactataacaaactacgcaacaaattcgcgaacgacgacctaacgaccaaaccaactacaataacgacgacgacgacaaaacaaaatctccccgcgcctacccgcgcccaaactaccgatactaaaaaacgcgaaatcgcgctataacgaacgaaaaacgcgacgaaaacgccaaataaataaaaccgctaacgaaactacaacaaaacgcgaaacaaatacgaacgccgcgcccgctacccgaaaactctacgaatcgaactaaaacgactatacgctccgcacgataaaaacgaatcctcgaaaatacgaacgacccccgaactaaacccctaacgaactcgaccgtacgaaacgaaaacctccgaccccgaattccttcctctactaccgaaccgaaacaaacgccgaaaaaacctaaactaaactaccccttccttacgaccgaacccgaatccctaaccgcgacctcgtctaacaaataacgaacgccgacgaaaatcgaaataaacgtaaccccctcgctttcgaaatataaacaaaaaaaaactctaaaaacacccgcacgcctcctcgaaaacccattttattttcgcgaaattaattttccttcctaacaaaaattaataccgaatatcaaataaaccgcatcccgatacgtcaaaataacccgaatcacga

SEQ ID NO: 5143 - DNA, 977 bp, Artificial Sequence
  chemically treated genomic DNA (Homo sapiens) CpG-island No: 5143
gtaattttaggaagggttgttaggtttggggtttcggggttttttcgagggtagagaggagcgtttcggattcgatcgattcggagtagatttttagggtttaatgtttcggaatttttggggcgaggagttacgttcgggtagtttcgggtttcggagggtggggagtcggtgttcggtagcgggcggtcgttagttgttcggttcggcgtttattttttcgtttttcggttttttgcggaggtcgcggtcgttatgttgttgtggggttgaggcggcgcggcggagttttgagcggttgtgataggttacgtaataggttcgcgggcggcggtttgacgattaagttagttgtagtggcggcgacggcggtagagtagggttttttcgcgtttgttcgcgtttaggttgtcggtgttgagggacgcggagtcgcgttgtgacgagcgggaggcgcggcgagggcgttaggtgggtgaagtcgttagcggggttgtagtaaggcgcggggtaggtgcgggcgtcgcgttcgttgttcggaggttttgcgggtcgggttgaggcggttgtgcgtttcgtacgatggggacgggttttcgggagtacgggcggttttcgagttaggtttttggcgggttcggtcgtgcggggcggaaattttcggtttcgggtttttttttttgttgtcgggtcgggatagacgtcgagggggtttgggttgggttgttttttttttgcggtcgagttcgggtttttggtcgcggtttcgtttggtaggtggcggacgtcggcgagggtcggggtgggcgtggttttttcgttttcggggtgtgagtagaagagagttttgggggtattcgtacgttttttcggggatttattttattttcgcggagttggtttttttttttggtaagggttggtgtcgaatgttaggtgagtcgtatttcggtgcgttaaagtagttcgagttacga

SEQ ID NO: 5144 - DNA, 977 bp, Artificial Sequence
  chemically treated genomic DNA (Homo sapiens) CpG-island No: 5144
tcgtaactcgaactactttaacgcaccgaaatacgactcacctaacattcgacaccaacccttaccaaaaaaaaaaaccaactccgcgaaaataaaataaatccccgaaaaaacgtacgaatacccccaaaactctcttctactcacaccccgaaaacgaaaaaaccacgcccaccccgaccctcgccgacgtccgccacctaccaaacgaaaccgcgaccaaaaacccgaactcgaccgcaaaaaaaaaacaacccaacccaaaccccctcgacgtctatcccgacccgacaacaaaaaaaaaaacccgaaaccgaaaatttccgccccgcacgaccgaacccgccaaaaacctaactcgaaaaccgcccgtactcccgaaaacccgtccccatcgtacgaaacgcacaaccgcctcaacccgacccgcaaaacctccgaacaacgaacgcgacgcccgcacctaccccgcgccttactacaaccccgctaacgacttcacccacctaacgccctcgccgcgcctcccgctcgtcacaacgcgactccgcgtccctcaacaccgacaacctaaacgcgaacaaacgcgaaaaaaccctactctaccgccgtcgccgccactacaactaacttaatcgtcaaaccgccgcccgcgaacctattacgtaacctatcacaaccgctcaaaactccgccgcgccgcctcaaccccacaacaacataacgaccgcgacctccgcaaaaaaccgaaaaacgaaaaaataaacgccgaaccgaacaactaacgaccgcccgctaccgaacaccgactccccaccctccgaaacccgaaactacccgaacgtaactcctcgccccaaaaattccgaaacattaaaccctaaaaatctactccgaatcgatcgaatccgaaacgctcctctctaccctcgaaaaaaccccgaaaccccaaacctaacaacccttcctaaaattac

SEQ ID NO: 5145 - DNA, 769 bp, Artificial Sequence
  chemically treated genomic DNA (Homo sapiens) CpG-island No: 5145
tcggattcggataggttcgtttttttcgtttcggttttcgttatcgtttaatggtcgagggtagggttcgttgagtaagtcgcggtagttcgtcgggttttcgttttgttttcggttttcgagtcggtttcggaggtttttaaatgttgtttagggtcgacgcgtacggttttcgttattttttttggtcgggtagcggtagcggtagcggtagtaagtagtttcgtcggttcgggttcggggtcgttttgggtcgcggtaagtattttcgtttttttagttcgcgttgtttttttttttttttttttttttaggttttgtttgttaggtcggcgtcgggtttcggcgatcggtcgtttttcgtgtgtgcgcgcgttcgtcgttagttcggattcgcgttttcgttttttttcgcgtaggatagtttcgggatttttcgttcgcgtcgcgttttacgtatttcgtcgcgtcgggtaagaagatggcgggattagtggtcgatagcgatgtcgtggtggtgagtgtggtagggcgcgcgcgagcgttttttttcgtcgtttcgtatttcgtcgtcgtttgttttagtagtgttggggtgttgagtagtcgtaggttcggtcggcgttcgcgcgtgggaaggcgttcggtatttgttagtagtcgttgttgcgcgcggtcggtgttaggggttggagaggttttcgggttgcggggttttgggttggggagggagtttggggaggatggcgggtagggacgttcgatagtt

SEQ ID NO: 5146 - DNA, 769 bp, Artificial Sequence
  chemically treated genomic DNA (Homo sapiens) CpG-island No: 5146
aactatcgaacgtccctacccgccatcctccccaaactccctccccaacccaaaaccccgcaacccgaaaacctctccaacccctaacaccgaccgcgcgcaacaacgactactaacaaataccgaacgccttcccacgcgcgaacgccgaccgaacctacgactactcaacaccccaacactactaaaacaaacgacgacgaaatacgaaacgacgaaaaaaaacgctcgcgcgcgccctaccacactcaccaccacgacatcgctatcgaccactaatcccgccatcttcttacccgacgcgacgaaatacgtaaaacgcgacgcgaacgaaaaatcccgaaactatcctacgcgaaaaaaaacgaaaacgcgaatccgaactaacgacgaacgcgcgcacacacgaaaaacgaccgatcgccgaaacccgacgccgacctaacaaacaaaacctaaaaaaaaaaaaaaaaaaaaaaacaacgcgaactaaaaaaacgaaaatacttaccgcgacccaaaacgaccccgaacccgaaccgacgaaactacttactaccgctaccgctaccgctacccgaccaaaaaaaataacgaaaaccgtacgcgtcgaccctaaacaacatttaaaaacctccgaaaccgactcgaaaaccgaaaacaaaacgaaaacccgacgaactaccgcgacttactcaacgaaccctaccctcgaccattaaacgataacgaaaaccgaaacgaaaaaaacgaacctatccgaatccga

SEQ ID NO: 5147 - DNA, 769 bp, Artificial Sequence
  chemically treated genomic DNA (Homo sapiens) CpG-island No: 5147
ggttgtcgggcgtttttattcgttattttttttaaattttttttttagtttagagtttcgtagttcgggagtttttttagtttttaatatcggtcgcgcgtagtagcggttgttaataggtatcgggcgtttttttacgcgcgggcgtcggtcgggtttgcggttgtttagtattttagtattgttggagtaggcggcggcggagtgcgggacggcggggaggggcgttcgcgcgcgttttgttatatttattattacggtatcgttgtcggttattgatttcgttatttttttgttcggcgcggcggggtacgtgggacgcggcgcgggcgggggatttcggggttgttttgcgcgggggggggcgggggcgcgggttcgagttggcggcgggcgcgcgtatatacgaggggcggtcggtcgtcggggttcggcgtcgatttggtaggtagagtttgggaggaggggaggggagggaggtagcgcgagttgggagggcgaaggtgtttgtcgcggtttagaacggtttcggattcgggtcgacggggttgtttgttgtcgttgtcgttgtcgttgttcgattaagaaaagtggcgagggtcgtgcgcgtcggttttgggtagtatttaaaggttttcggggtcggttcgggaatcgggaatagggcggggattcggcgggttgtcgcggtttgtttagcgggttttgttttcggttattggacggtggcggaggtcggggcgggagggacgggtttgttcgggttcgg

SEQ ID NO: 5148 - DNA, 769 bp, Artificial Sequence
  chemically treated genomic DNA (Homo sapiens) CpG-island No: 5148
ccgaacccgaacaaacccgtccctcccgccccgacctccgccaccgtccaataaccgaaaacaaaacccgctaaacaaaccgcgacaacccgccgaatccccgccctattcccgattcccgaaccgaccccgaaaacctttaaatactacccaaaaccgacgcgcacgaccctcgccacttttcttaatcgaacaacgacaacgacaacgacaacaaacaaccccgtcgacccgaatccgaaaccgttctaaaccgcgacaaacaccttcgccctcccaactcgcgctacctccctcccctcccctcctcccaaactctacctaccaaatcgacgccgaaccccgacgaccgaccgcccctcgtatatacgcgcgcccgccgccaactcgaacccgcgcccccgcccccccccgcgcaaaacaaccccgaaatcccccgcccgcgccgcgtcccacgtaccccgccgcgccgaacaaaaaaataacgaaatcaataaccgacaacgataccgtaataataaatataacaaaacgcgcgcgaacgcccctccccgccgtcccgcactccgccgccgcctactccaacaatactaaaatactaaacaaccgcaaacccgaccgacgcccgcgcgtaaaaaaacgcccgatacctattaacaaccgctactacgcgcgaccgatattaaaaactaaaaaaactcccgaactacgaaactctaaactaaaaaaaaaatttaaaaaaaataacgaataaaaacgcccgacaacc

SEQ ID NO: 5149 - DNA, 891 bp, Artificial Sequence
  chemically treated genomic DNA (Homo sapiens) CpG-island No: 5149
tattcggtcggtgttcgggatggcgaggagggggtcgtgcgtttcgggcgttattagcggcgttttcgtattcgtcgtagaagagagtagagtcgggagttcgtaggttcgtagagttagtttcgtttttatagttttcggtttcgcggcgggtagatgttttcggttcgggtgagggtttggttgttgggtcgggtttggttttcgtatttttttttttcggcgtagttaggggagcggagcggcggcgtttatttggttttttcggggcggttgcgatgggtatggtttaggggttcggggaggaattgatttttcggggaaggatcgtttatttcgacgcggaattggtgagagcggaaggtcggttgtttatagttttgttagcgtagtagtattatggacgtttattcggagttttatcgttgtcgcgggatttttattttattatttttcgttttttttcgtcgtcgtcgtcgttttttttatttttttcgcggagatttttcgtttattttatatatttttttattatgtagcgggggaatcgttgtcgtcgatacgttattttcgggcgtaggtggttaggtcgggatcgggcgttggtgggtgttgtggggtgggggaggatattttaggggaattggtgttatagaacgtttatttttgcgtaggcgttgtcgtgtagagcgtcgatcgttattttgggtgcgggtaagttgttttttttttttatttttttgcgagttatagagttgtagggggatagacgttttttcgtatttaggcgtcggttgaggttgcgtttttggcgaaggataggtgttttttttagtcggttaacgtttagtttaagatcggattaagttttttgttttttaaataaaattg

SEQ ID NO: 5150 - DNA, 891 bp, Artificial Sequence
  chemically treated genomic DNA (Homo sapiens) CpG-island No: 5150
caattttatttaaaaaacaaaaaacttaatccgatcttaaactaaacgttaaccgactaaaaaaaacacctatccttcgccaaaaacgcaacctcaaccgacgcctaaatacgaaaaaacgtctatccccctacaactctataactcgcaaaaaaataaaaaaaaaaaacaacttacccgcacccaaaataacgatcgacgctctacacgacaacgcctacgcaaaaataaacgttctataacaccaattcccctaaaatatcctcccccaccccacaacacccaccaacgcccgatcccgacctaaccacctacgcccgaaaataacgtatcgacgacaacgattcccccgctacataataaaaaaatatataaaataaacgaaaaatctccgcgaaaaaaataaaaaaaacgacgacgacgacgaaaaaaaacgaaaaataataaaataaaaatcccgcgacaacgataaaactccgaataaacgtccataatactactacgctaacaaaactataaacaaccgaccttccgctctcaccaattccgcgtcgaaataaacgatccttccccgaaaaatcaattcctccccgaacccctaaaccatacccatcgcaaccgccccgaaaaaaccaaataaacgccgccgctccgctcccctaactacgccgaaaaaaaaaaatacgaaaaccaaacccgacccaacaaccaaaccctcacccgaaccgaaaacatctacccgccgcgaaaccgaaaactataaaaacgaaactaactctacgaacctacgaactcccgactctactctcttctacgacgaatacgaaaacgccgctaataacgcccgaaacgcacgaccccctcctcgccatcccgaacaccgaccgaata

SEQ ID NO: 5151 - DNA, 891 bp, Artificial Sequence
  chemically treated genomic DNA (Homo sapiens) CpG-island No: 5151
taattttatttggagagtaagagatttaattcggttttgagttgaacgttaatcggttgaaaggagtatttgtttttcgttaggagcgtagttttaatcggcgtttgagtgcgggaagacgtttatttttttatagttttatgattcgtaaggaagtaaaaggaaagggtagtttgttcgtatttaaaatggcggtcggcgttttgtacgatagcgtttgcgtagggataagcgttttgtgatattaatttttttggagtgtttttttttattttatagtatttattagcgttcggtttcgatttagttatttgcgttcggaagtgacgtgtcggcggtagcggttttttcgttgtatgatgggagagtgtgtggagtgggcggggggttttcgcggaggaggtggaggaggcggcggcggcggcggaagagggcggagggtagtgggatgggggtttcgcggtagcggtgaaatttcgggtgggcgtttatggtgttgttgcgttgatagggttgtgagtagtcggtttttcgtttttattagtttcgcgtcggaatagacggttttttttcggggagttagttttttttcgggtttttgagttatgtttatcgtagtcgtttcgaaggagttaggtaagcgtcgtcgtttcgtttttttagttgcgtcggggaaagagggtgcggggattaggttcggtttagtagttagatttttattcgggtcgggagtatttgttcgtcgcggagtcgggagttgtgaggacggagttggttttgcgggtttgcgggttttcggttttgtttttttttgcggcgagtgcgggaacgtcgttggtggcgttcgaagcgtacggtttttttttcgttatttcgggtatcggtcgggta

SEQ ID NO: 5152 - DNA, 891 bp, Artificial Sequence
  chemically treated genomic DNA (Homo sapiens) CpG-island No: 5152
tacccgaccgatacccgaaataacgaaaaaaaaaccgtacgcttcgaacgccaccaacgacgttcccgcactcgccgcaaaaaaaaacaaaaccgaaaacccgcaaacccgcaaaaccaactccgtcctcacaactcccgactccgcgacgaacaaatactcccgacccgaataaaaatctaactactaaaccgaacctaatccccgcaccctctttccccgacgcaactaaaaaaacgaaacgacgacgcttacctaactccttcgaaacgactacgataaacataactcaaaaacccgaaaaaaaactaactccccgaaaaaaaaccgtctattccgacgcgaaactaataaaaacgaaaaaccgactactcacaaccctatcaacgcaacaacaccataaacgcccacccgaaatttcaccgctaccgcgaaacccccatcccactaccctccgccctcttccgccgccgccgccgcctcctccacctcctccgcgaaaaccccccgcccactccacacactctcccatcatacaacgaaaaaaccgctaccgccgacacgtcacttccgaacgcaaataactaaatcgaaaccgaacgctaataaatactataaaataaaaaaaaacactccaaaaaaattaatatcacaaaacgcttatccctacgcaaacgctatcgtacaaaacgccgaccgccattttaaatacgaacaaactaccctttccttttacttccttacgaatcataaaactataaaaaaataaacgtcttcccgcactcaaacgccgattaaaactacgctcctaacgaaaaacaaatactcctttcaaccgattaacgttcaactcaaaaccgaattaaatctcttactctccaaataaaatta

SEQ ID NO: 5153 - DNA, 1646 bp, Artificial Sequence
  chemically treated genomic DNA (Homo sapiens) CpG-island No: 5153
cgggaagttcggggatttgggtagcggatttagatgtttttatagttgtgttttcgtcgtttcgtttcgggggtcgagaattagtaagattaacgcgaggaggcgttacggtatttgatatttcgtttttaggaggttcggacgaggtttcgtcggcgagcggtcggggtttgtttttcgaggtgtttgcgagcgttttatgtttttttttatcggttttaatttcgtttcgttttattcgatcgcgggttttgtttattcgtcgcggtgcggttttttttagttttcgatagttttttttcgttttttttgtcggttttattttttaggcggcggagcgggtcggggagggaagggttaattcgcggtttttttcggcgcggagggattcggaggcgagtcgagcgcggtggtgaggtcgttttagcgaaaaaaatgttcgtttgaagagatttataagttttattcggggggatcgatagttcgtttcgggaggaaggggcggttaggttcgaaagtcgttttttttttttagattcgagagttcgtgcggggtaaagtgaatcgagtcgttgggcggtgtaaggggaagtttaagttcgttttttcggttaaagtgaattttaatcggggtggttggatgcggagacggggcggtaggtaattgcgggttagcgagcgggagtggggcggcgcggcggggttgggggttgcggggtttcgtcgcgtttttgtcggagtgggggcgttttcgtttttcgttttaatttcgcgtttttttgtatagcgcgaaattcggggttttttttaagttggggagcggagtgggggcggaggttcgagtcgcgggcgtttaggttcgttggcggcgcgttcggtttgtgcgtttcgttcggtgttcgattcgggtcggcgtttaggtttcggggcgcgcgggagatcgggcggtttcggtcgcggagttaggtttattgttcggtaggttcggggtagggtagtaaaagtgggaggaggtcgagtttggggaggaggacgtcggtcgagagcgagattagttgtcggggtttttgttttttgtttaaaaacgttttttggatgagttgggggtgtttttcgattttttgggttcgtcggggacgttcgggcggcggcggtcgtagacgcgggtttgcgagcggcgcgttttttgtaatttgttagttttattgttgtcgagcgagtgagttatttcgtattttcgttcgtcgtcgtttcgttcgttggacgtcgaattgttttttatttcgtttttcgagattttagtcgcggtcgggttcggcgcgcggagtattcggcggcggcgcggagtagggggcgtcgaggaggtggtagagattggttcggaaatttgggggagaggcggcgagttgcgggagtcgtcgcgtcgatttcgggtcgcggcgaggaacgcgtggatttcgggattcggcgcgggtattgagttttttcgttttttgttcgcgtcgcggtgggagcgagtcggggttttggaagttatttcggcgtttttagcgtttttgcgtaattttttttagtatttttttttgtttttttatatattttgggtttcggtggtttttcgttgagttcgttttttttgttttagg

SEQ ID NO: 5154 - DNA, 1646 bp, Artificial Sequence
  chemically treated genomic DNA (Homo sapiens) CpG-island No: 5154
cctaaaacaaaaaaaacgaactcaacgaaaaaccaccgaaacccaaaatatataaaaaaacaaaaaaaaatactaaaaaaaattacgcaaaaacgctaaaaacgccgaaataacttccaaaaccccgactcgctcccaccgcgacgcgaacaaaaaacgaaaaaactcaatacccgcgccgaatcccgaaatccacgcgttcctcgccgcgacccgaaatcgacgcgacgactcccgcaactcgccgcctctcccccaaatttccgaaccaatctctaccacctcctcgacgccccctactccgcgccgccgccgaatactccgcgcgccgaacccgaccgcgactaaaatctcgaaaaacgaaataaaaaacaattcgacgtccaacgaacgaaacgacgacgaacgaaaatacgaaataactcactcgctcgacaacaataaaactaacaaattacaaaaaacgcgccgctcgcaaacccgcgtctacgaccgccgccgcccgaacgtccccgacgaacccaaaaaatcgaaaaacacccccaactcatccaaaaaacgtttttaaacaaaaaacaaaaaccccgacaactaatctcgctctcgaccgacgtcctcctccccaaactcgacctcctcccacttttactaccctaccccgaacctaccgaacaataaacctaactccgcgaccgaaaccgcccgatctcccgcgcgccccgaaacctaaacgccgacccgaatcgaacaccgaacgaaacgcacaaaccgaacgcgccgccaacgaacctaaacgcccgcgactcgaacctccgcccccactccgctccccaacttaaaaaaaaccccgaatttcgcgctatacaaaaaaacgcgaaattaaaacgaaaaacgaaaacgcccccactccgacaaaaacgcgacgaaaccccgcaacccccaaccccgccgcgccgccccactcccgctcgctaacccgcaattacctaccgccccgtctccgcatccaaccaccccgattaaaattcactttaaccgaaaaaacgaacttaaacttccccttacaccgcccaacgactcgattcactttaccccgcacgaactctcgaatctaaaaaaaaaaaacgactttcgaacctaaccgccccttcctcccgaaacgaactatcgatccccccgaataaaacttataaatctcttcaaacgaacatttttttcgctaaaacgacctcaccaccgcgctcgactcgcctccgaatccctccgcgccgaaaaaaaccgcgaattaacccttccctccccgacccgctccgccgcctaaaaaataaaaccgacaaaaaaaacgaaaaaaaactatcgaaaactaaaaaaaaccgcaccgcgacgaataaacaaaacccgcgatcgaataaaacgaaacgaaattaaaaccgataaaaaaaaacataaaacgctcgcaaacacctcgaaaaacaaaccccgaccgctcgccgacgaaacctcgtccgaacctcctaaaaacgaaatatcaaataccgtaacgcctcctcgcgttaatcttactaattctcgacccccgaaacgaaacgacgaaaacacaactataaaaacatctaaatccgctacccaaatccccgaacttcccg

SEQ ID NO: 5155 - DNA, 1646 bp, Artificial Sequence
  chemically treated genomic DNA (Homo sapiens) CpG-island No: 5155
tttagggtagaggaaacgggtttagcgagagattatcgaggtttaaagtgtgtgagggaatagagagaggtattggggaagattacgtaagagcgttgggggcgtcgggatgatttttaggatttcgattcgtttttatcgcggcgcgagtaaggggcgggagggtttagtgttcgcgtcgggtttcggaatttacgcgtttttcgtcgcggttcgagatcgacgcggcggttttcgtaattcgtcgttttttttttaagttttcgagttagtttttgttattttttcggcgttttttgtttcgcgtcgtcgtcgggtgtttcgcgcgtcgggttcggtcgcggttggggtttcgaggagcggggtgaggggtaattcggcgtttagcgagcggagcggcggcgagcggagatgcgaagtgatttattcgttcggtaataatagaattgataagttgtagggaacgcgtcgttcgtaggttcgcgtttgcggtcgtcgtcgttcggacgttttcggcgggtttaggaggtcggaaagtatttttagtttatttaaggggcgtttttaaatagaaaatagaaatttcgataattagtttcgttttcggtcggcgtttttttttttaggttcggtttttttttatttttgttgttttgtttcggatttgtcgaataatgagtttggtttcgcggtcgaagtcgttcgatttttcgcgcgtttcggagtttgggcgtcggttcgagtcgggtatcgaacggggcgtataggtcgagcgcgtcgttagcgggtttgagcgttcgcgattcgagttttcgtttttatttcgttttttaatttggaggggatttcgggtttcgcgttgtataaaggggcgcggagttgaggcgggggacgggggcgtttttatttcggtagggacgcggcggggtttcgtagtttttagtttcgtcgcgtcgttttattttcgttcgttagttcgtaattatttgtcgtttcgttttcgtatttaattatttcgattaaagtttattttggtcgggagaacgggtttgggtttttttttgtatcgtttagcggttcggtttattttgtttcgtacgagttttcgggtttgggagggggaggcggttttcgggtttggtcgtttttttttttcggggcgggttgtcggttttttcgaatagaatttgtgggtttttttaggcggatatttttttcgttgaggcggttttattatcgcgttcggttcgttttcggattttttcgcgtcgggaagagtcgcgggttaattttttttttttcgattcgtttcgtcgtttaggaagtggggtcggtagagggggcggggaggagttgtcggggattgggaggagtcgtatcgcggcgggtggataaagttcgcggtcgggtgaggcgggacggagttggggtcggtggggaggggtatgaggcgttcgtaggtatttcgagaagtaggtttcgatcgttcgtcgacgaagtttcgttcgggttttttgggagcggggtgttaggtatcgtggcgttttttcgcgttggttttgttggttttcggttttcgaagcggagcgacggagatatagttgtggaagtatttggattcgttgtttaggttttcgagtttttcg

SEQ ID NO: 5156 - DNA, 1646 bp, Artificial Sequence
  chemically treated genomic DNA (Homo sapiens) CpG-island No: 5156
cgaaaaactcgaaaacctaaacaacgaatccaaatacttccacaactatatctccgtcgctccgcttcgaaaaccgaaaaccaacaaaaccaacgcgaaaaaacgccacgatacctaacaccccgctcccaaaaaacccgaacgaaacttcgtcgacgaacgatcgaaacctacttctcgaaatacctacgaacgcctcatacccctccccaccgaccccaactccgtcccgcctcacccgaccgcgaactttatccacccgccgcgatacgactcctcccaatccccgacaactcctccccgccccctctaccgaccccacttcctaaacgacgaaacgaatcgaaaaaaaaaaaattaacccgcgactcttcccgacgcgaaaaaatccgaaaacgaaccgaacgcgataataaaaccgcctcaacgaaaaaaatatccgcctaaaaaaacccacaaattctattcgaaaaaaccgacaacccgccccgaaaaaaaaaaacgaccaaacccgaaaaccgcctccccctcccaaacccgaaaactcgtacgaaacaaaataaaccgaaccgctaaacgatacaaaaaaaaacccaaacccgttctcccgaccaaaataaactttaatcgaaataattaaatacgaaaacgaaacgacaaataattacgaactaacgaacgaaaataaaacgacgcgacgaaactaaaaactacgaaaccccgccgcgtccctaccgaaataaaaacgcccccgtcccccgcctcaactccgcgcccctttatacaacgcgaaacccgaaatcccctccaaattaaaaaacgaaataaaaacgaaaactcgaatcgcgaacgctcaaacccgctaacgacgcgctcgacctatacgccccgttcgatacccgactcgaaccgacgcccaaactccgaaacgcgcgaaaaatcgaacgacttcgaccgcgaaaccaaactcattattcgacaaatccgaaacaaaacaacaaaaataaaaaaaaaccgaacctaaaaaaaaaaacgccgaccgaaaacgaaactaattatcgaaatttctattttctatttaaaaacgccccttaaataaactaaaaatactttccgacctcctaaacccgccgaaaacgtccgaacgacgacgaccgcaaacgcgaacctacgaacgacgcgttccctacaacttatcaattctattattaccgaacgaataaatcacttcgcatctccgctcgccgccgctccgctcgctaaacgccgaattacccctcaccccgctcctcgaaaccccaaccgcgaccgaacccgacgcgcgaaacacccgacgacgacgcgaaacaaaaaacgccgaaaaaataacaaaaactaactcgaaaacttaaaaaaaaaacgacgaattacgaaaaccgccgcgtcgatctcgaaccgcgacgaaaaacgcgtaaattccgaaacccgacgcgaacactaaaccctcccgccccttactcgcgccgcgataaaaacgaatcgaaatcctaaaaatcatcccgacgcccccaacgctcttacgtaatcttccccaatacctctctctattccctcacacactttaaacctcgataatctctcgctaaacccgtttcctctaccctaaa

SEQ ID NO: 5157 - DNA, 510 bp, Artificial Sequence
  chemically treated genomic DNA (Homo sapiens) CpG-island No: 5157
  misc_feature (491)..(491): n is either a, c, g or t
  misc_feature (495)..(495): n is either a, c, g or t
  misc_feature (505)..(505): n is either a, c, g or t
cgttttaacgttgtattatcgtgggttttcgagtcgtgttcgtagtcgttgagattttcggtgcggagaagatgtgtttttttaatttttaggtcgtgattttttttatttagattcggttaattatttcgttcgaggcgagcgggaggatgcggttttaggaatcgtgaagcgtcgttaagagcgcgcgtcgtatcggtttcgtttcggtggtttttcgtttcggtaggtgaagcggcgtcggttatattttttgtcggtaggtgaagcggttcggtagtttatttttcgttcgttatggttgcgggggtttttcgtatagcgttcgttttttttttttagttcgtttttcggggttggagtgttcggcggcggcggcggcgaaattgcggtttgcgcgtacggggagcgatagtagaagttcgaaaagcgtcgagattaaagttatggtattaaatttttttaaaataataaattttttggtttcggtnggtnttgtagattngattt

SEQ ID NO: 5158 - DNA, 510 bp, Artificial Sequence
  chemically treated genomic DNA (Homo sapiens) CpG-island No: 5158
  misc_feature (6)..(6): n is either a, c, g or t
  misc_feature (16)..(16): n is either a, c, g or t
  misc_feature (20)..(20): n is either a, c, g or t
aaatcnaatctacaanaccnaccgaaaccaaaaaatttattattttaaaaaaatttaataccataactttaatctcgacgcttttcgaacttctactatcgctccccgtacgcgcaaaccgcaatttcgccgccgccgccgccgaacactccaaccccgaaaaacgaactaaaaaaaaaaaacgaacgctatacgaaaaacccccgcaaccataacgaacgaaaaataaactaccgaaccgcttcacctaccgacaaaaaatataaccgacgccgcttcacctaccgaaacgaaaaaccaccgaaacgaaaccgatacgacgcgcgctcttaacgacgcttcacgattcctaaaaccgcatcctcccgctcgcctcgaacgaaataattaaccgaatctaaataaaaaaaatcacgacctaaaaattaaaaaaacacatcttctccgcaccgaaaatctcaacgactacgaacacgactcgaaaacccacgataatacaacgttaaaacg

SEQ ID NO: 5159 - DNA, 510 bp, Artificial Sequence
  chemically treated genomic DNA (Homo sapiens) CpG-island No: 5159
  misc_feature (6)..(6): n is either a, c, g or t
  misc_feature (16)..(16): n is either a, c, g or t
  misc_feature (20)..(20): n is either a, c, g or t
aagttnagtttgtagngttngtcggggttagaaggtttgttgttttggagggatttagtgttatggttttggtttcggcgtttttcgaatttttgttgtcgtttttcgtgcgcgtaaatcgtagtttcgtcgtcgtcgtcgtcgggtattttagtttcggggggcgggttggagggagggggcgggcgttgtgcgggggattttcgtaattatggcgggcggggagtgggttgtcgagtcgttttatttgtcgatagagggtgtggtcggcgtcgttttatttgtcggagcgggaggttatcgaggcgaggtcgatgcggcgcgcgtttttggcggcgttttacggtttttagaatcgtattttttcgttcgtttcgggcgaggtgattggtcgggtttgggtgaaggggattacggtttggggattggaggggtatatttttttcgtatcgaggattttagcgattgcgagtacggttcggagatttacggtggtgtagcgttggggcg

SEQ ID NO: 5160 - DNA, 510 bp, Artificial Sequence
  chemically treated genomic DNA (Homo sapiens) CpG-island No: 5160
  misc_feature (491)..(491): n is either a, c, g or t
  misc_feature (495)..(495): n is either a, c, g or t
  misc_feature (505)..(505): n is either a, c, g or t
cgccccaacgctacaccaccgtaaatctccgaaccgtactcgcaatcgctaaaatcctcgatacgaaaaaaatatacccctccaatccccaaaccgtaatccccttcacccaaacccgaccaatcacctcgcccgaaacgaacgaaaaaatacgattctaaaaaccgtaaaacgccgccaaaaacgcgcgccgcatcgacctcgcctcgataacctcccgctccgacaaataaaacgacgccgaccacaccctctatcgacaaataaaacgactcgacaacccactccccgcccgccataattacgaaaatcccccgcacaacgcccgccccctccctccaacccgccccccgaaactaaaatacccgacgacgacgacgacgaaactacgatttacgcgcacgaaaaacgacaacaaaaattcgaaaaacgccgaaaccaaaaccataacactaaatccctccaaaacaacaaaccttctaaccccgacnaacnctacaaactnaactt

SEQ ID NO: 5161 - DNA, 511 bp, Artificial Sequence
  chemically treated genomic DNA (Homo sapiens) CpG-island No: 5161
  misc_feature (47)..(47): n is either a, c, g or t
  misc_feature (59)..(59): n is either a, c, g or t
  misc_feature (132)..(132): n is either a, c, g or t
  misc_feature (198)..(198): n is either a, c, g or t
  misc_feature (200)..(200): n is either a, c, g or t
  misc_feature (211)..(211): n is either a, c, g or t
  misc_feature (213)..(213): n is either a, c, g or t
  misc_feature (215)..(215): n is either a, c, g or t
  misc_feature (221)..(221): n is either a, c, g or t
  misc_feature (229)..(229): n is either a, c, g or t
  misc_feature (244)..(244): n is either a, c, g or t
  misc_feature (246)..(246): n is either a, c, g or t
  misc_feature (419)..(419): n is either a, c, g or t
  misc_feature (436)..(436): n is either a, c, g or t
tttacggacggggtcgtttcgatgggacgtcgcgtttcggtttttgncgcgtcgatgangtcgagcgtttttcgttgtcgagattatcgtcgatatcgttagacgttgatttttcgatttcgttcgggtcgnggagtttcgttttcgtttttcggaaagttggattttcgaggttggaggcgtatggtcggttgggtngngggattataantngnggtaancgcggttnggaagcgtagagtangnttcgcgggtttcgtcgcgtcgttttttaagtagttcgcgttttttaagtagtcgatgttcgcggtcggagagttggaggagaggtttaatcgcgttttggtgagtgcgattcggaggcgggtcggacgcgggcggggggcggtaggggttcggtaggggttgggcgcgcgttntttcgttttcggggatnttaggtgtcgtttggagattttcggttcggtagttgttttttttaggaggtgggagcgatagtggtttttttttt

SEQ ID NO: 5162 - DNA, 511 bp, Artificial Sequence
  chemically treated genomic DNA (Homo sapiens) CpG-island No: 5162
  misc_feature (76)..(76): n is either a, c, g or t
  misc_feature (93)..(93): n is either a, c, g or t
  misc_feature (266)..(266): n is either a, c, g or t
  misc_feature (268)..(268): n is either a, c, g or t
  misc_feature (283)..(283): n is either a, c, g or t
  misc_feature (291)..(291): n is either a, c, g or t
  misc_feature (297)..(297): n is either a, c, g or t
  misc_feature (299)..(299): n is either a, c, g or t
  misc_feature (301)..(301): n is either a, c, g or t
  misc_feature (312)..(312): n is either a, c, g or t
  misc_feature (314)..(314): n is either a, c, g or t
  misc_feature (380)..(380): n is either a, c, g or t
  misc_feature (453)..(453): n is either a, c, g or t
  misc_feature (465)..(465): n is either a, c, g or t
aaaaaaaaaaccactatcgctcccacctcctaaaaaaaacaactaccgaaccgaaaatctccaaacgacacctaanatccccgaaaacgaaanaacgcgcgcccaacccctaccgaacccctaccgccccccgcccgcgtccgacccgcctccgaatcgcactcaccaaaacgcgattaaacctctcctccaactctccgaccgcgaacatcgactacttaaaaaacgcgaactacttaaaaaacgacgcgacgaaacccgcgaancntactctacgcttccnaaccgcgnttaccncnanttataatcccncnacccaaccgaccatacgcctccaacctcgaaaatccaactttccgaaaaacgaaaacgaaactccncgacccgaacgaaatcgaaaaatcaacgtctaacgatatcgacgataatctcgacaacgaaaaacgctcgacntcatcgacgcgncaaaaaccgaaacgcgacgtcccatcgaaacgaccccgtccgtaaa

SEQ ID NO: 5163 - DNA, 511 bp, Artificial Sequence
  chemically treated genomic DNA (Homo sapiens) CpG-island No: 5163
  misc_feature (76)..(76): n is either a, c, g or t
  misc_feature (93)..(93): n is either a, c, g or t
  misc_feature (266)..(266): n is either a, c, g or t
  misc_feature (268)..(268): n is either a, c, g or t
  misc_feature (283)..(283): n is either a, c, g or t
  misc_feature (291)..(291): n is either a, c, g or t
  misc_feature (297)..(297): n is either a, c, g or t
  misc_feature (299)..(299): n is either a, c, g or t
  misc_feature (301)..(301): n is either a, c, g or t
  misc_feature (312)..(312): n is either a, c, g or t
  misc_feature (314)..(314): n is either a, c, g or t
  misc_feature (380)..(380): n is either a, c, g or t
  misc_feature (453)..(453): n is either a, c, g or t
  misc_feature (465)..(465): n is either a, c, g or t
gaaaaaaaggttattgtcgtttttattttttggagggggtagttgtcggatcggggatttttaagcggtatttgangttttcgggggcgggangacgcgcgtttagtttttgtcgggtttttgtcgtttttcgttcgcgttcgattcgttttcgggtcgtatttattagggcgcggttgaattttttttttagtttttcggtcgcgggtatcggttgtttgggaggcgcgggttgtttggggggcggcgcggcggggttcgcgggntntgttttgcgtttttnggtcgcgnttgttntnanttgtggttttntnatttagtcggttatgcgtttttagtttcggaaatttagtttttcgggggacggggacgaggttttncggttcgggcggggtcgaggggttagcgtttggcggtgtcggcggtggtttcggtagcggggggcgttcggtnttatcggcgcgntaggggtcggagcgcggcgttttatcggggcggtttcgttcgtggg

SEQ ID NO: 5164 - DNA, 511 bp, Artificial Sequence
  chemically treated genomic DNA (Homo sapiens) CpG-island No: 5164
  misc_feature (47)..(47): n is either a, c, g or t
  misc_feature (59)..(59): n is either a, c, g or t
  misc_feature (132)..(132): n is either a, c, g or t
  misc_feature (198)..(198): n is either a, c, g or t
  misc_feature (200)..(200): n is either a, c, g or t
  misc_feature (211)..(211): n is either a, c, g or t
  misc_feature (213)..(213): n is either a, c, g or t
  misc_feature (215)..(215): n is either a, c, g or t
  misc_feature (221)..(221): n is either a, c, g or t
  misc_feature (229)..(229): n is either a, c, g or t
  misc_feature (244)..(244): n is either a, c, g or t
  misc_feature (246)..(246): n is either a, c, g or t
  misc_feature (419)..(419): n is either a, c, g or t
  misc_feature (436)..(436): n is either a, c, g or t
cccacgaacgaaaccgccccgataaaacgccgcgctccgacccctancgcgccgataanaccgaacgccccccgctaccgaaaccaccgccgacaccgccaaacgctaacccctcgaccccgcccgaaccgnaaaacctcgtccccgtcccccgaaaaactaaatttccgaaactaaaaacgcataaccgactaaatnanaaaaccacaantnanaacaancgcgaccnaaaaacgcaaaacanancccgcgaaccccgccgcgccgccccccaaacaacccgcgcctcccaaacaaccgatacccgcgaccgaaaaactaaaaaaaaaattcaaccgcgccctaataaatacgacccgaaaacgaatcgaacgcgaacgaaaaacgacaaaaacccgacaaaaactaaacgcgcgtcntcccgcccccgaaaacntcaaataccgcttaaaaatccccgatccgacaactaccccctccaaaaaataaaaacgacaataacctttttttc

SEQ ID NO: 5165 - DNA, 1010 bp, Artificial Sequence
  chemically treated genomic DNA (Homo sapiens) CpG-island No: 5165
ggttttcgggaaagtcgttttttgaggtcggggcggtgggcgtatttcggtttgagaggtttttcgtttcgtttttcgtttgtgaagtttacgttttcggagttttttaaatacgtttttaaatttatatttttttagttttttttcgttttaggttttcgcgtcgggcggtcggggttgcgatgggggtacgttgtcgagcgggggtgagggtagaggggatttacgcgggcggtcgtggtgcggggttcgggttgcgcgtcgtcgtggttttttttaggcgtcggcgagtcgggcgggttttcgaaatgcgcggggttgcggattattggagtttagggtaggggtgggagcgggttgtagcgtcggagggtcggcgaattcgggaaggttttttttttagtttcgatatttttacggtcggggaggcggtcggttatttaggtggagagttcgtttgcggagaggagtgggagttttcgttgtttttttagcgtagaggagaggaggagggaggaaagtttttgagaaatcgtttagttcggttgcgcggcggaggcgcggtcgttcgggcgcgggaattgcgcgcgacgacggcgatagtgcggggggttgtacgttatagatgagggagtaatatttgatggttttttcgtttcgaggtattagttagttcgatttcgtaattgtcgcggcgggcgggcgcggaattgcggggtagtttggggagacgacggcgtagtggtttgggtagtggggtaaggggtggcgggcgacggcggtcgtaatttcgtaaagggacgtttacggcgaaggacgagttgaattgcgggttattttgggaggtttgatataggcgggtaaaggacgaaggatacggtgattcggggttgcgtttttgtggacgtgtttggcgcggcgagtatttatttttttttggttcgtataattaaaacgtaattttttaaaattttgtttaaagagatttttttaggaaaggagattggggt

SEQ ID NO: 5166 - DNA, 1010 bp, Artificial Sequence
  chemically treated genomic DNA (Homo sapiens) CpG-island No: 5166
accccaatctcctttcctaaaaaaatctctttaaacaaaattttaaaaaattacgttttaattatacgaaccaaaaaaaaataaatactcgccgcgccaaacacgtccacaaaaacgcaaccccgaatcaccgtatccttcgtcctttacccgcctatatcaaacctcccaaaataacccgcaattcaactcgtccttcgccgtaaacgtccctttacgaaattacgaccgccgtcgcccgccaccccttaccccactacccaaaccactacgccgtcgtctccccaaactaccccgcaattccgcgcccgcccgccgcgacaattacgaaatcgaactaactaatacctcgaaacgaaaaaaccatcaaatattactccctcatctataacgtacaaccccccgcactatcgccgtcgtcgcgcgcaattcccgcgcccgaacgaccgcgcctccgccgcgcaaccgaactaaacgatttctcaaaaactttcctccctcctcctctcctctacgctaaaaaaacaacgaaaactcccactcctctccgcaaacgaactctccacctaaataaccgaccgcctccccgaccgtaaaaatatcgaaactaaaaaaaaaaccttcccgaattcgccgaccctccgacgctacaacccgctcccacccctaccctaaactccaataatccgcaaccccgcgcatttcgaaaacccgcccgactcgccgacgcctaaaaaaaaccacgacgacgcgcaacccgaaccccgcaccacgaccgcccgcgtaaatcccctctaccctcacccccgctcgacaacgtacccccatcgcaaccccgaccgcccgacgcgaaaacctaaaacgaaaaaaaactaaaaaaatataaatttaaaaacgtatttaaaaaactccgaaaacgtaaacttcacaaacgaaaaacgaaacgaaaaacctctcaaaccgaaatacgcccaccgccccgacctcaaaaaacgactttcccgaaaacc

SEQ ID NO: 5167 - DNA, 1010 bp, Artificial Sequence
  chemically treated genomic DNA (Homo sapiens) CpG-island No: 5167
attttagtttttttttttaaagaggtttttttaaatagaattttgagagattgcgttttagttatgcgggttagggagaagtggatgttcgtcgcgttaggtacgtttataggaacgtagtttcgagttatcgtgtttttcgttttttattcgtttgtgttaagttttttaaaatgattcgtagtttagttcgtttttcgtcgtgaacgtttttttgcggggttgcggtcgtcgtcgttcgttattttttgttttattatttaagttattgcgtcgtcgtttttttaaattgtttcgtagtttcgcgttcgttcgtcgcggtagttgcggggtcgggttggttggtgtttcgggacgagaaggttattaagtgttgtttttttatttgtaacgtgtagtttttcgtattgtcgtcgtcgtcgcgcgtagttttcgcgttcgggcggtcgcgttttcgtcgcgtagtcgggttgggcggttttttagaaattttttttttttttttttttttttgcgttgagaaagtagcgaaagtttttattttttttcgtaaacggattttttatttgagtaatcggtcgttttttcggtcgtggggatatcggagttaaggggagagttttttcgagttcgtcgatttttcggcgttgtagttcgtttttatttttattttgggttttaatgattcgtagtttcgcgtatttcgaaagttcgttcggttcgtcggcgtttggggagggttacggcggcgcgtagttcgggtttcgtattacggtcgttcgcgtgggttttttttgtttttattttcgttcggtaacgtgtttttatcgtaatttcggtcgttcggcgcgggggtttgggacggggaagaattggggaaatgtgggtttgggggcgtgtttgggggatttcgggagcgtgggttttataggcgaggagcggggcgagaggttttttaggtcggggtgcgtttatcgtttcggttttagggagcgattttttcggaggtt

SEQ ID NO: 5168 - DNA, 1010 bp, Artificial Sequence
  chemically treated genomic DNA (Homo sapiens) CpG-island No: 5168
aacctccgaaaaaatcgctccctaaaaccgaaacgataaacgcaccccgacctaaaaaacctctcgccccgctcctcgcctataaaacccacgctcccgaaatcccccaaacacgcccccaaacccacatttccccaattcttccccgtcccaaacccccgcgccgaacgaccgaaattacgataaaaacacgttaccgaacgaaaataaaaacaaaaaaaacccacgcgaacgaccgtaatacgaaacccgaactacgcgccgccgtaaccctccccaaacgccgacgaaccgaacgaactttcgaaatacgcgaaactacgaatcattaaaacccaaaataaaaataaaaacgaactacaacgccgaaaaatcgacgaactcgaaaaaactctccccttaactccgatatccccacgaccgaaaaaacgaccgattactcaaataaaaaatccgtttacgaaaaaaaataaaaactttcgctactttctcaacgcaaaaaaaaaaaaaaaaaaaaaaaatttctaaaaaaccgcccaacccgactacgcgacgaaaacgcgaccgcccgaacgcgaaaactacgcgcgacgacgacgacaatacgaaaaactacacgttacaaataaaaaaacaacacttaataaccttctcgtcccgaaacaccaaccaacccgaccccgcaactaccgcgacgaacgaacgcgaaactacgaaacaatttaaaaaaacgacgacgcaataacttaaataataaaacaaaaaataacgaacgacgacgaccgcaaccccgcaaaaaaacgttcacgacgaaaaacgaactaaactacgaatcattttaaaaaacttaacacaaacgaataaaaaacgaaaaacacgataactcgaaactacgttcctataaacgtacctaacgcgacgaacatccacttctccctaacccgcataactaaaacgcaatctctcaaaattctatttaaaaaaacctctttaaaaaaaaaaactaaaat

SEQ ID NO: 5169 - DNA, 550 bp, Artificial Sequence
  chemically treated genomic DNA (Homo sapiens) CpG-island No: 5169
gtttggcgtttattcgttttaggttagggttttcgttagatattcgtacgtttgatatttttttttcgggtttgtacgatcgtttttttcgtatttttaaaaaaataaaatcgaataaaataaagcgtttttacgtagttcgaatttttttcggaagtttagcgattgttttcggagttaaaagatatagatttcgacgagttacggttcgagttttaggagcgcgtaggggttgcggggaagtttcggttcggtcgtcgagttttcgttgattaaatggattggcgagcgggagggcggagaggagaggggattaggtaagcggagagggtggtaaagttcgttcgagtttgggcgggtgtaagttcgcgggtttcgcgaatttagtcgttttttaaattttgtcggcgtcggagtcgtagagtcgtgagtaagcggggataggggagggggagaaaaatatttcgaaaagacgagttttttttttttagtggtttaatatggcggtggaagggaggttgacgaagaagaaaatgattgatacggcgag

SEQ ID NO: 5170 - DNA, 550 bp, Artificial Sequence
  chemically treated genomic DNA (Homo sapiens) CpG-island No: 5170
ctcgccgtatcaatcattttcttcttcgtcaacctcccttccaccgccatattaaaccactaaaaaaaaaaaactcgtcttttcgaaatatttttctccccctcccctatccccgcttactcacgactctacgactccgacgccgacaaaatttaaaaaacgactaaattcgcgaaacccgcgaacttacacccgcccaaactcgaacgaactttaccaccctctccgcttacctaatcccctctcctctccgccctcccgctcgccaatccatttaatcaacgaaaactcgacgaccgaaccgaaacttccccgcaacccctacgcgctcctaaaactcgaaccgtaactcgtcgaaatctatatcttttaactccgaaaacaatcgctaaacttccgaaaaaaattcgaactacgtaaaaacgctttattttattcgattttatttttttaaaaatacgaaaaaaacgatcgtacaaacccgaaaaaaaaatatcaaacgtacgaatatctaacgaaaaccctaacctaaaacgaataaacgccaaac

SEQ ID NO: 5171 - DNA, 550 bp, Artificial Sequence
  chemically treated genomic DNA (Homo sapiens) CpG-island No: 5171
ttcgtcgtgttaattattttttttttcgttagttttttttttatcgttatattgggttattaaaaaaagggggttcgttttttcggggtgttttttttttttttttttgttttcgtttgtttacggttttgcgatttcgacgtcggtaaggtttggagagcggttgggttcgcgggattcgcgggtttgtattcgtttagattcggacgggttttgttatttttttcgtttgtttggttttttttttttttcgttttttcgttcgttagtttatttgattagcggagattcggcggtcgggtcggggttttttcgtagtttttgcgcgtttttagagttcgggtcgtggttcgtcggggtttgtgttttttggtttcgagggtagtcgttgggttttcgagaggggttcgggttgcgtaggggcgttttgttttgttcggttttgtttttttgagagtgcgagagaggcggtcgtgtagattcgggagaaagatgttaaacgtgcgagtgtttaacgggagttttagtttggagcggatggacgttaggt

SEQ ID NO: 5172 - DNA, 550 bp, Artificial Sequence
  chemically treated genomic DNA (Homo sapiens) CpG-island No: 5172
acctaacgtccatccgctccaaactaaaactcccgttaaacactcgcacgtttaacatctttctcccgaatctacacgaccgcctctctcgcactctcaaaaaaacaaaaccgaacaaaacaaaacgcccctacgcaacccgaacccctctcgaaaacccaacgactaccctcgaaaccaaaaaacacaaaccccgacgaaccacgacccgaactctaaaaacgcgcaaaaactacgaaaaaaccccgacccgaccgccgaatctccgctaatcaaataaactaacgaacgaaaaaacgaaaaaaaaaaaaaaccaaacaaacgaaaaaaataacaaaacccgtccgaatctaaacgaatacaaacccgcgaatcccgcgaacccaaccgctctccaaaccttaccgacgtcgaaatcgcaaaaccgtaaacaaacgaaaacaaaaaaaaaaaaaaaaaacaccccgaaaaaacgaaccccctttttttaataacccaatataacgataaaaaaaaaactaacgaaaaaaaaaataattaacacgacgaa

SEQ ID NO: 5173 - DNA, 1291 bp, Artificial Sequence
  chemically treated genomic DNA (Homo sapiens) CpG-island No: 5173
tgatcgtcgtgtggtaaattgatgaatttcgattttgatgaatatgagatgatcgtcgtgtggtaaattgatgaatttcgattttgattaatatgagatgatcgtcgtgtggtaaattgatgaatttcgattttgattaatatgagatgatcgtcgtgtggtaaattgatgaatttcgattttgatgaacgtgagatgatcgtcgtgtcgtaaattgatgaatttcgattttgatgaacgtgagatggtcgtcgtgtggtaaattgatgaatttcgattttgatgaacgtgagatggtcgtcgtgtggtaaattgatgaatttcgattttgatgaacgtgagatggtcgtcgtgtggtaaattgatgaatttcgattttgatgaacgtgagatgatcgtcgtgtggtaaattgatgaatttcgattttgatgaacgtgagatggtcgtcgtgtggtaaattgatgaatttcgattttgattaacgtgagatggtcgtcgtgtggtaaattgatgaatttcgattttgatgaatatgagatggtcgtcgtgtggtaaattgatgaatttcgattttgatgaacgtgagatgatcgtcgtgtggtaaattgatgaatttcgattttgatgaacgtgagatgatcgtcgtgtggtaaattgatgaatttcgattttgattaacgtgagatggtcgtcgtgtggtaaattgatgaatttcgattttgatgaacgtgagatggtcgtcgtgtggtaaattgatgaatttcgattttgatgaacgtgagatggtcgtcgtgtggtaaattgatgaatttcgattttgatgaacgtgagatggtcgtcgtgtggtaaattgatgaatttcgattttgattaacgtgagatggtcgtcgtgtggtaaattgatgaatttcgattttgatgaacgtgagatggtcgtcgtgtggtaaattgatgaatttcgattttgatgaacgtgagatggtcgtcgtgtggtaaattgatgaatttcgattttgattaacgtgagatggtcgtcgtgtggtaaattgatgaatttcgattttgatgaacgtgagatggtcgtcgtgtggtaaattgatgaatttcgattttgatgaacgtgagatggtcgtcgtgtggtaaattgatgaatttcgattttgatgaacgtgagatggtcgtcgtgtggtaaattgatgaatttcgattttgatgaacgtgagatggtcgtcgtgtggtaaattgatgaatttcgattttgattaacgtgagatgatcgtcgtgtggtaa

SEQ ID NO: 5174 - DNA, 1291 bp, Artificial Sequence
  chemically treated genomic DNA (Homo sapiens) CpG-island No: 5174
ttaccacacgacgatcatctcacgttaatcaaaatcgaaattcatcaatttaccacacgacgaccatctcacgttcatcaaaatcgaaattcatcaatttaccacacgacgaccatctcacgttcatcaaaatcgaaattcatcaatttaccacacgacgaccatctcacgttcatcaaaatcgaaattcatcaatttaccacacgacgaccatctcacgttcatcaaaatcgaaattcatcaatttaccacacgacgaccatctcacgttaatcaaaatcgaaattcatcaatttaccacacgacgaccatctcacgttcatcaaaatcgaaattcatcaatttaccacacgacgaccatctcacgttcatcaaaatcgaaattcatcaatttaccacacgacgaccatctcacgttaatcaaaatcgaaattcatcaatttaccacacgacgaccatctcacgttcatcaaaatcgaaattcatcaatttaccacacgacgaccatctcacgttcatcaaaatcgaaattcatcaatttaccacacgacgaccatctcacgttcatcaaaatcgaaattcatcaatttaccacacgacgaccatctcacgttaatcaaaatcgaaattcatcaatttaccacacgacgatcatctcacgttcatcaaaatcgaaattcatcaatttaccacacgacgatcatctcacgttcatcaaaatcgaaattcatcaatttaccacacgacgaccatctcatattcatcaaaatcgaaattcatcaatttaccacacgacgaccatctcacgttaatcaaaatcgaaattcatcaatttaccacacgacgaccatctcacgttcatcaaaatcgaaattcatcaatttaccacacgacgatcatctcacgttcatcaaaatcgaaattcatcaatttaccacacgacgaccatctcacgttcatcaaaatcgaaattcatcaatttaccacacgacgaccatctcacgttcatcaaaatcgaaattcatcaatttaccacacgacgaccatctcacgttcatcaaaatcgaaattcatcaatttacgacacgacgatcatctcacgttcatcaaaatcgaaattcatcaatttaccacacgacgatcatctcatattaatcaaaatcgaaattcatcaatttaccacacgacgatcatctcatattaatcaaaatcgaaattcatcaatttaccacacgacgatcatctcatattcatcaaaatcgaaattcatcaatttaccacacgacgatca

SEQ ID NO: 5175 - DNA, 1291 bp, Artificial Sequence
  chemically treated genomic DNA (Homo sapiens) CpG-island No: 5175
ttattatacggcggttattttacgttgattagggtcggggtttattagtttattatacggcggttattttacgtttattagggtcggggtttattagtttattatacggcggttattttacgtttattagggtcggggtttattagtttattatacggcggttattttacgtttattagggtcggggtttattagtttattatacggcggttattttacgtttattagggtcggggtttattagtttattatacggcggttattttacgttgattagggtcggggtttattagtttattatacggcggttattttacgtttattagggtcggggtttattagtttattatacggcggttattttacgtttattagggtcggggtttattagtttattatacggcggttattttacgttgattagggtcggggtttattagtttattatacggcggttattttacgtttattagggtcggggtttattagtttattatacggcggttattttacgtttattagggtcggggtttattagtttattatacggcggttattttacgtttattagggtcggggtttattagtttattatacggcggttattttacgttgattagggtcggggtttattagtttattatacggcggttattttacgtttattagggtcggggtttattagtttattatacggcggttattttacgtttattagggtcggggtttattagtttattatacggcggttattttatgtttattagggtcggggtttattagtttattatacggcggttattttacgttgattagggtcggggtttattagtttattatacggcggttattttacgtttattagggtcggggtttattagtttattatacggcggttattttacgtttattagggtcggggtttattagtttattatacggcggttattttacgtttattagggtcggggtttattagtttattatacggcggttattttacgtttattagggtcggggtttattagtttattatacggcggttattttacgtttattagggtcggggtttattagtttacgatacggcggttattttacgtttattagggtcggggtttattagtttattatacggcggttattttatgttgattagggtcggggtttattagtttattatacggcggttattttatgttgattagggtcggggtttattagtttattatacggcggttattttatgtttattagggtcggggtttattagtttattatacggcggtta

SEQ ID NO: 5176 - DNA, 1291 bp, Artificial Sequence
  chemically treated genomic DNA (Homo sapiens) CpG-island No: 5176
taaccgccgtataataaactaataaaccccgaccctaataaacataaaataaccgccgtataataaactaataaaccccgaccctaatcaacataaaataaccgccgtataataaactaataaaccccgaccctaatcaacataaaataaccgccgtataataaactaataaaccccgaccctaataaacgtaaaataaccgccgtatcgtaaactaataaaccccgaccctaataaacgtaaaataaccgccgtataataaactaataaaccccgaccctaataaacgtaaaataaccgccgtataataaactaataaaccccgaccctaataaacgtaaaataaccgccgtataataaactaataaaccccgaccctaataaacgtaaaataaccgccgtataataaactaataaaccccgaccctaataaacgtaaaataaccgccgtataataaactaataaaccccgaccctaatcaacgtaaaataaccgccgtataataaactaataaaccccgaccctaataaacataaaataaccgccgtataataaactaataaaccccgaccctaataaacgtaaaataaccgccgtataataaactaataaaccccgaccctaataaacgtaaaataaccgccgtataataaactaataaaccccgaccctaatcaacgtaaaataaccgccgtataataaactaataaaccccgaccctaataaacgtaaaataaccgccgtataataaactaataaaccccgaccctaataaacgtaaaataaccgccgtataataaactaataaaccccgaccctaataaacgtaaaataaccgccgtataataaactaataaaccccgaccctaatcaacgtaaaataaccgccgtataataaactaataaaccccgaccctaataaacgtaaaataaccgccgtataataaactaataaaccccgaccctaataaacgtaaaataaccgccgtataataaactaataaaccccgaccctaatcaacgtaaaataaccgccgtataataaactaataaaccccgaccctaataaacgtaaaataaccgccgtataataaactaataaaccccgaccctaataaacgtaaaataaccgccgtataataaactaataaaccccgaccctaataaacgtaaaataaccgccgtataataaactaataaaccccgaccctaataaacgtaaaataaccgccgtataataaactaataaaccccgaccctaatcaacgtaaaataaccgccgtataataa

SEQ ID NO: 5177 - DNA, 909 bp, Artificial Sequence
  chemically treated genomic DNA (Homo sapiens) CpG-island No: 5177
agatggtcgtcgtgtggtaaattgatgaatttcgattttgatgaacgtgagatggtcgtcgtgtggtaaattgatgaatttcgattttgattaacgtgagatggtcgtcgtgtggtaaattgatgaatttcgattttgatgaacgtgagatggtcgtcgtgtggtaaattgatgaatttcgattttgatgaacgtgagatggtcgtcgtgtggtaaattgatgaatttcgattttgatgaacgtgagatggtcgtcgtgtggtaaattgatgaatttcgattttgatgaacgtgagatggtcgtcgtgtggtaaattgatgaatttcgattttgatgaacgtgagatggtcgtcgtgtggtaaattgatgaatttcgattttgattaacgtgagatgatcgtcgtgtggtaaattgatgaatttcgattttgattaacgtgagatgatcgtcgtgtggtaaattgatgaatttcgattttgattaacgtgagatggtcgtcgtgtggtaaattgatgaatttcgattttgatgaacgtgagatggtcgtcgtgtggtaaattgatgaatttcgattttgattaatatgagatgatcgtcgtgtggtaaattgatgaatttcgattttgatgaatatgagatggttgtcgtgtggtaaattgatgaatttcgattttgatgaatatgagatgatcgtcgtgtggtaaattgatgaatttcgattttgatgaatatgagatggtcgtcgtgtggtaaattgatgaatttcgattttgatgaacgtgagatggtcgtcgtgtggtaaattgatgaatttcgattttgattaatatgagatgattgtcgtgtggtaaattgatgaatttcgatattgattaatatgagatggtcgttgtgtggtaaattgatg

SEQ ID NO: 5178 - DNA, 909 bp, Artificial Sequence
  chemically treated genomic DNA (Homo sapiens) CpG-island No: 5178
catcaatttaccacacaacgaccatctcatattaatcaatatcgaaattcatcaatttaccacacgacaatcatctcatattaatcaaaatcgaaattcatcaatttaccacacgacgaccatctcacgttcatcaaaatcgaaattcatcaatttaccacacgacgaccatctcatattcatcaaaatcgaaattcatcaatttaccacacgacgatcatctcatattcatcaaaatcgaaattcatcaatttaccacacgacaaccatctcatattcatcaaaatcgaaattcatcaatttaccacacgacgatcatctcatattaatcaaaatcgaaattcatcaatttaccacacgacgaccatctcacgttcatcaaaatcgaaattcatcaatttaccacacgacgaccatctcacgttaatcaaaatcgaaattcatcaatttaccacacgacgatcatctcacgttaatcaaaatcgaaattcatcaatttaccacacgacgatcatctcacgttaatcaaaatcgaaattcatcaatttaccacacgacgaccatctcacgttcatcaaaatcgaaattcatcaatttaccacacgacgaccatctcacgttcatcaaaatcgaaattcatcaatttaccacacgacgaccatctcacgttcatcaaaatcgaaattcatcaatttaccacacgacgaccatctcacgttcatcaaaatcgaaattcatcaatttaccacacgacgaccatctcacgttcatcaaaatcgaaattcatcaatttaccacacgacgaccatctcacgttaatcaaaatcgaaattcatcaatttaccacacgacgaccatctcacgttcatcaaaatcgaaattcatcaatttaccacacgacgaccatct

SEQ ID NO: 5179 - DNA, 909 bp, Artificial Sequence
  chemically treated genomic DNA (Homo sapiens) CpG-island No: 5179
tattagtttattatatagcggttattttatgttgattagtgtcggggtttattagtttattatacggtagttattttatgttgattagggtcggggtttattagtttattatacggcggttattttacgtttattagggtcggggtttattagtttattatacggcggttattttatgtttattagggtcggggtttattagtttattatacggcggttattttatgtttattagggtcggggtttattagtttattatacggtagttattttatgtttattagggtcggggtttattagtttattatacggcggttattttatgttgattagggtcggggtttattagtttattatacggcggttattttacgtttattagggtcggggtttattagtttattatacggcggttattttacgttgattagggtcggggtttattagtttattatacggcggttattttacgttgattagggtcggggtttattagtttattatacggcggttattttacgttgattagggtcggggtttattagtttattatacggcggttattttacgtttattagggtcggggtttattagtttattatacggcggttattttacgtttattagggtcggggtttattagtttattatacggcggttattttacgtttattagggtcggggtttattagtttattatacggcggttattttacgtttattagggtcggggtttattagtttattatacggcggttattttacgtttattagggtcggggtttattagtttattatacggcggttattttacgttgattagggtcggggtttattagtttattatacggcggttattttacgtttattagggtcggggtttattagtttattatacggcggttattt

SEQ ID NO: 5180 - DNA, 909 bp, Artificial Sequence
  chemically treated genomic DNA (Homo sapiens) CpG-island No: 5180
aaataaccgccgtataataaactaataaaccccgaccctaataaacgtaaaataaccgccgtataataaactaataaaccccgaccctaatcaacgtaaaataaccgccgtataataaactaataaaccccgaccctaataaacgtaaaataaccgccgtataataaactaataaaccccgaccctaataaacgtaaaataaccgccgtataataaactaataaaccccgaccctaataaacgtaaaataaccgccgtataataaactaataaaccccgaccctaataaacgtaaaataaccgccgtataataaactaataaaccccgaccctaataaacgtaaaataaccgccgtataataaactaataaaccccgaccctaatcaacgtaaaataaccgccgtataataaactaataaaccccgaccctaatcaacgtaaaataaccgccgtataataaactaataaaccccgaccctaatcaacgtaaaataaccgccgtataataaactaataaaccccgaccctaataaacgtaaaataaccgccgtataataaactaataaaccccgaccctaatcaacataaaataaccgccgtataataaactaataaaccccgaccctaataaacataaaataactaccgtataataaactaataaaccccgaccctaataaacataaaataaccgccgtataataaactaataaaccccgaccctaataaacataaaataaccgccgtataataaactaataaaccccgaccctaataaacgtaaaataaccgccgtataataaactaataaaccccgaccctaatcaacataaaataactaccgtataataaactaataaaccccgacactaatcaacataaaataaccgctatataataaactaata

SEQ ID NO: 5181 - DNA, 938 bp, Artificial Sequence
  chemically treated genomic DNA (Homo sapiens) CpG-island No: 5181
tgaggtcgcgcgcgataggatgggcggacggtgaagagaattagggtggaagggtcggataggggcgattttagtgacggaatcggatatagacgtagatttggtagttgggcgataggtttcggagtattttcgggcgtcgcgggatttttcgtcgataggagggcggttgtcgagtttgtgatattcgcggagattagtagatttcgggtgtggaggacgtcgtaggaagggaattgcgtggttgggtttggttataaaaagcggagggtatttattcgagcggatttcggtttcggagaattcgttttcgggttaataaaaaacgtcgcgcgaggggcggggttcgtacgtgtagggaggggaggtagagaaaaaggcggggtcgggtcggggcggggtttcgggtaggggcggggagtttatcgatttttcgttttcgttgcgcgcgtttttggttttgttagtgttttcgtcggttgaaagcgcgtgtttgcgtcgggttttgttggagtgcgttcggtgtgtcgtgggttcgcgttgtttttatttaattttttgttaggtaagaggcgcgtgaggtttttgtgtcgggggcggtgttgttttcgagtcggcgcgcggcggggacgcgagttcgtaggtgttggcgggagcgagagtcgggtggggattttcgcgagttcgtatttcgtttttgggtagtagttttttcggttttatacggcgtgacgcgcgttcgggtttcgcgttcgcgtcgaggtagaggcgtagtaggggtcgggtttagggttggaggggtcgggatcgggcggggtgtcgttttggatatcgcgtcggtagttgtttcgcgcgggtttatgttatttttatttttaatttgttttgtttcgtatttgagatgatttataaattcggtatttttgggataggcgtgg

SEQ ID NO: 5182 - DNA, 938 bp, Artificial Sequence
  chemically treated genomic DNA (Homo sapiens) CpG-island No: 5182
ccacgcctatcccaaaaataccgaatttataaatcatctcaaatacgaaacaaaacaaattaaaaataaaaataacataaacccgcgcgaaacaactaccgacgcgatatccaaaacgacaccccgcccgatcccgacccctccaaccctaaacccgacccctactacgcctctacctcgacgcgaacgcgaaacccgaacgcgcgtcacgccgtataaaaccgaaaaaactactacccaaaaacgaaatacgaactcgcgaaaatccccacccgactctcgctcccgccaacacctacgaactcgcgtccccgccgcgcgccgactcgaaaacaacaccgcccccgacacaaaaacctcacgcgcctcttacctaacaaaaaattaaataaaaacaacgcgaacccacgacacaccgaacgcactccaacaaaacccgacgcaaacacgcgctttcaaccgacgaaaacactaacaaaaccaaaaacgcgcgcaacgaaaacgaaaaatcgataaactccccgcccctacccgaaaccccgccccgacccgaccccgcctttttctctacctcccctccctacacgtacgaaccccgcccctcgcgcgacgttttttattaacccgaaaacgaattctccgaaaccgaaatccgctcgaataaataccctccgctttttataaccaaacccaaccacgcaattcccttcctacgacgtcctccacacccgaaatctactaatctccgcgaatatcacaaactcgacaaccgccctcctatcgacgaaaaatcccgcgacgcccgaaaatactccgaaacctatcgcccaactaccaaatctacgtctatatccgattccgtcactaaaatcgcccctatccgacccttccaccctaattctcttcaccgtccgcccatcctatcgcgcgcgacctca

SEQ ID NO: 5183 - DNA, 938 bp, Artificial Sequence
  chemically treated genomic DNA (Homo sapiens) CpG-island No: 5183
ttacgtttgttttaaaggtatcgaatttataaattattttaggtgcggagtaggataggttgaaaataggaatgatatgaattcgcgcggaatagttgtcggcgcggtgtttagggcggtatttcgttcggtttcggtttttttagttttgggttcgatttttattacgtttttgtttcgacgcgaacgcggagttcgagcgcgcgttacgtcgtgtggggtcgaagaggttgttatttagaggcggagtgcgggttcgcgagggtttttattcgattttcgttttcgttagtatttacggattcgcgttttcgtcgcgcgtcgattcgggagtagtatcgttttcggtataggagttttacgcgttttttatttaataggaagttgggtggaagtagcgcggatttacggtatatcgaacgtattttaatagaattcgacgtagatacgcgtttttaatcggcggagatattggtagggttagaaacgcgcgtagcgggggcgggaggtcggtaagtttttcgtttttgttcgagatttcgtttcggttcggtttcgtttttttttttgttttttttttttgtacgtacgggtttcgtttttcgcgcgacgttttttgttgattcggaaacggatttttcggagtcgaggttcgttcgggtgagtgtttttcgttttttgtggttaaatttagttacgtagttttttttttgcggcgttttttatattcggggtttgttggttttcgcggatgttataggttcggtaatcgtttttttgtcggcggggagtttcgcgacgttcggaaatgtttcgaagtttgtcgtttagttgttagatttgcgtttgtgttcggtttcgttattgaggtcgtttttgttcggtttttttattttagttttttttatcgttcgtttattttatcgcgcgcggtttta

SEQ ID NO: 5184 - DNA, 938 bp, Artificial Sequence
  chemically treated genomic DNA (Homo sapiens) CpG-island No: 5184
taaaaccgcgcgcgataaaataaacgaacgataaaaaaaactaaaataaaaaaaccgaacaaaaacgacctcaataacgaaaccgaacacaaacgcaaatctaacaactaaacgacaaacttcgaaacatttccgaacgtcgcgaaactccccgccgacaaaaaaacgattaccgaacctataacatccgcgaaaaccaacaaaccccgaatataaaaaacgccgcaaaaaaaaaactacgtaactaaatttaaccacaaaaaacgaaaaacactcacccgaacgaacctcgactccgaaaaatccgtttccgaatcaacaaaaaacgtcgcgcgaaaaacgaaacccgtacgtacaaaaaaaaaaaacaaaaaaaaaaacgaaaccgaaccgaaacgaaatctcgaacaaaaacgaaaaacttaccgacctcccgcccccgctacgcgcgtttctaaccctaccaatatctccgccgattaaaaacgcgtatctacgtcgaattctattaaaatacgttcgatataccgtaaatccgcgctacttccacccaacttcctattaaataaaaaacgcgtaaaactcctataccgaaaacgatactactcccgaatcgacgcgcgacgaaaacgcgaatccgtaaatactaacgaaaacgaaaatcgaataaaaaccctcgcgaacccgcactccgcctctaaataacaacctcttcgaccccacacgacgtaacgcgcgctcgaactccgcgttcgcgtcgaaacaaaaacgtaataaaaatcgaacccaaaactaaaaaaaccgaaaccgaacgaaataccgccctaaacaccgcgccgacaactattccgcgcgaattcatatcattcctattttcaacctatcctactccgcacctaaaataatttataaattcgatacctttaaaacaaacgtaa

SEQ ID NO: 5185 - DNA, 934 bp, Artificial Sequence
  chemically treated genomic DNA (Homo sapiens) CpG-island No: 5185
gcgtaggcgcgaggtgacgtcgcggtagggtcggaaggagtgtagcggttgttacggagttcgtagttgcggtttttgaggagtaagcggcgcggtagcgaaggtcgtcgaatttgtttggttagtcggcgatttgagtgacgagtgagtgtcggttgcggggcgcgttcgagtttttgggcgggtttgtgaggcgacgcggtttttttgaggggcgtttttgtggagtttcgggggtgggggcgggggcgcgggtcgtgagggtcgtcgagttgaggggcgcgggtcgaggttcgggcgggatcgggttaaggggttgggttgggcgtttcgagttcggtgcggtggcgaggttggagcgataaaggcgttgagcggtcgggtggttttttttcgttatttcgcgaagtttcgcgggtcggtttttcgggtttgttgcgcgagggtaatagttcgggagatcgcgtttttttttttcgggttcgaggtcgtcgcggaggcggtgttcgtgtattcgagcgcggtttggaggagcggcgggaggcgggtcgtgtttgtgaattttagtttaggcgggcggcgtttttttttttttttttttatatttggagcgcgtgtttcgcgaaagttggcgattgttattcggtattcgcgagggcgtcgtaagtgcgttaaatttttttgcggggcgttgggggttggttcggttcgggtgttcgggcgttgggtagcgagcgaggtcgttgttttcgcgtcgaggtggttttgttttcggtggaataggattagggatttaagattttgggttatttgtaattaattttggagcgtgcgcggcgtgcgggttatagaaatttttgataaattcgatagggttttgtaaatttttaagggtttgggtagtagttgttttaggtatttagatcgtgtaaag

SEQ ID NO: 5186 - DNA, 934 bp, Artificial Sequence
  chemically treated genomic DNA (Homo sapiens) CpG-island No: 5186
ctttacacgatctaaatacctaaaacaactactacccaaacccttaaaaatttacaaaaccctatcgaatttatcaaaaatttctataacccgcacgccgcgcacgctccaaaattaattacaaataacccaaaatcttaaatccctaatcctattccaccgaaaacaaaaccacctcgacgcgaaaacaacgacctcgctcgctacccaacgcccgaacacccgaaccgaaccaacccccaacgccccgcaaaaaaatttaacgcacttacgacgccctcgcgaataccgaataacaatcgccaactttcgcgaaacacgcgctccaaatataaaaaaaaaaaaaaaaaaacgccgcccgcctaaactaaaattcacaaacacgacccgcctcccgccgctcctccaaaccgcgctcgaatacacgaacaccgcctccgcgacgacctcgaacccgaaaaaaaaaaacgcgatctcccgaactattaccctcgcgcaacaaacccgaaaaaccgacccgcgaaacttcgcgaaataacgaaaaaaaaccacccgaccgctcaacgcctttatcgctccaacctcgccaccgcaccgaactcgaaacgcccaacccaaccccttaacccgatcccgcccgaacctcgacccgcgcccctcaactcgacgaccctcacgacccgcgcccccgcccccacccccgaaactccacaaaaacgcccctcaaaaaaaccgcgtcgcctcacaaacccgcccaaaaactcgaacgcgccccgcaaccgacactcactcgtcactcaaatcgccgactaaccaaacaaattcgacgaccttcgctaccgcgccgcttactcctcaaaaaccgcaactacgaactccgtaacaaccgctacactccttccgaccctaccgcgacgtcacctcgcgcctacgc

SEQ ID NO: 5187 - DNA, 934 bp, Artificial Sequence
  chemically treated genomic DNA (Homo sapiens) CpG-island No: 5187
ttttgtacgatttaagtatttaggatagttgttatttaggtttttagggatttatagagttttgtcggatttgttagaaatttttgtaattcgtacgtcgcgtacgttttagggttggttgtaagtggtttagagttttggatttttggttttgttttatcgggagtagaattatttcgacgcggggatagcggtttcgttcgttgtttagcgttcggatattcgagtcgggttagtttttagcgtttcgtagaagggtttgacgtatttgcggcgttttcgcgagtgtcgggtgatagtcgttaattttcgcggaatacgcgttttagatgtgagggaagaggaggaaaaacgtcgttcgtttgggttggggtttataggtacggttcgtttttcgtcgtttttttaggtcgcgttcgggtgtacggatatcgttttcgcggcggtttcgggttcgggggagggaagcgcggtttttcgggttgttgttttcgcgtagtagattcgaggggtcggttcgcgaaatttcgcgaagtggcgagagggggttattcggtcgtttagcgtttttgtcgttttagtttcgttatcgtatcgggttcgagacgtttagtttagttttttggttcgatttcgttcgggtttcggttcgcgttttttagttcggcggtttttacggttcgcgttttcgtttttattttcggagttttatagaggcgttttttagagaggtcgcgtcgttttatagattcgtttaggagttcgagcgcgtttcgtagtcgatatttattcgttatttaagtcgtcggttagttaggtaggttcggcggttttcgttatcgcgtcgtttattttttagaagtcgtagttgcgagtttcgtggtagtcgttgtatttttttcggttttgtcgcggcgttatttcgcgtttgcgt

SEQ ID NO: 5188 - DNA, 934 bp, Artificial Sequence
  chemically treated genomic DNA (Homo sapiens) CpG-island No: 5188
acgcaaacgcgaaataacgccgcgacaaaaccgaaaaaaatacaacgactaccacgaaactcgcaactacgacttctaaaaaataaacgacgcgataacgaaaaccgccgaacctacctaactaaccgacgacttaaataacgaataaatatcgactacgaaacgcgctcgaactcctaaacgaatctataaaacgacgcgacctctctaaaaaacgcctctataaaactccgaaaataaaaacgaaaacgcgaaccgtaaaaaccgccgaactaaaaaacgcgaaccgaaacccgaacgaaatcgaaccaaaaaactaaactaaacgtctcgaacccgatacgataacgaaactaaaacgacaaaaacgctaaacgaccgaataaccccctctcgccacttcgcgaaatttcgcgaaccgacccctcgaatctactacgcgaaaacaacaacccgaaaaaccgcgcttccctcccccgaacccgaaaccgccgcgaaaacgatatccgtacacccgaacgcgacctaaaaaaacgacgaaaaacgaaccgtacctataaaccccaacccaaacgaacgacgtttttcctcctcttccctcacatctaaaacgcgtattccgcgaaaattaacgactatcacccgacactcgcgaaaacgccgcaaatacgtcaaacccttctacgaaacgctaaaaactaacccgactcgaatatccgaacgctaaacaacgaacgaaaccgctatccccgcgtcgaaataattctactcccgataaaacaaaaccaaaaatccaaaactctaaaccacttacaaccaaccctaaaacgtacgcgacgtacgaattacaaaaatttctaacaaatccgacaaaactctataaatccctaaaaacctaaataacaactatcctaaatacttaaatcgtacaaaa

SEQ ID NO: 5189 - DNA, 735 bp, Artificial Sequence
  chemically treated genomic DNA (Homo sapiens) CpG-island No: 5189
  misc_feature (340)..(340): n is either a, c, g or t
  misc_feature (576)..(576): n is either a, c, g or t
gttttttcgtttttgtttttttcggcggtacgattacgttattcggttttacgtcgttttgttcgcgtagtattggcggaacgcgttcggtgttcggacgtttgttattatttaaggttttcgtttatcgtttggtcggttacggttatggcgtttagatgtagtaggtcgaggtcgcgtacgtggagtattattttcggtatgtcgttcgttaggtaggcgcgtacggtcgggtgatagttcgggtcgttgggtagtacgtttattagacgcggtattttacggttgatgcgcgtttagtgtttaacgttcggtatcgtgtagttcgtcgcgtgggtantggtcggattgtgtagagtaaattcgtggagtcgtcgaacgtcgcgtggtttattatcgcgttttatatggttttattcggataggatatttcgcgtggtgatgtcgcggttatttagttcgttgatcgttcgttacgattggcgggcgatttttagttatatcgtttgttcggacggcgttatcgcgagtgcggtaggttagatttagcgtttttggattatatgttaggtcgtngtcgtgcgaggaatgatatcgttgcgggaggtgtagcggatagtagttcggggtttttgaggagattttggtgagaatcggttatggtttattttcgtttttcgaggtgcggagttttcgtcgtaaaatatggaggttatacgtaataatatgggggat

SEQ ID NO: 5190 - DNA, 735 bp, Artificial Sequence
  chemically treated genomic DNA (Homo sapiens) CpG-island No: 5190
  misc_feature (160)..(160): n is either a, c, g or t
  misc_feature (396)..(396): n is either a, c, g or t
atcccccatattattacgtataacctccatattttacgacgaaaactccgcacctcgaaaaacgaaaataaaccataaccgattctcaccaaaatctcctcaaaaaccccgaactactatccgctacacctcccgcaacgatatcattcctcgcacgacnacgacctaacatataatccaaaaacgctaaatctaacctaccgcactcgcgataacgccgtccgaacaaacgatataactaaaaatcgcccgccaatcgtaacgaacgatcaacgaactaaataaccgcgacatcaccacgcgaaatatcctatccgaataaaaccatataaaacgcgataataaaccacgcgacgttcgacgactccacgaatttactctacacaatccgaccantacccacgcgacgaactacacgataccgaacgttaaacactaaacgcgcatcaaccgtaaaataccgcgtctaataaacgtactacccaacgacccgaactatcacccgaccgtacgcgcctacctaacgaacgacataccgaaaataatactccacgtacgcgacctcgacctactacatctaaacgccataaccgtaaccgaccaaacgataaacgaaaaccttaaataataacaaacgtccgaacaccgaacgcgttccgccaatactacgcgaacaaaacgacgtaaaaccgaataacgtaatcgtaccgccgaaaaaaacaaaaacgaaaaaac

SEQ ID NO: 5191 - DNA, 735 bp, Artificial Sequence
  chemically treated genomic DNA (Homo sapiens) CpG-island No: 5191
  misc_feature (160)..(160): n is either a, c, g or t
  misc_feature (396)..(396): n is either a, c, g or t
attttttatattgttgcgtatagtttttatattttacggcgggaatttcgtatttcgaaaagcgaaagtgaattatggtcggtttttattagaatttttttagagatttcgaattgttgttcgttgtatttttcgtagcggtgttatttttcgtacggtngcgatttggtatgtggtttagaggcgttgggtttggtttgtcgtattcgcgatggcgtcgttcgggtaggcggtgtggttggagatcgttcgttagtcgtggcgggcggttagcgagttggatagtcgcggtattattacgcgggatattttgttcggataaagttatgtaaaacgcgatggtgagttacgcggcgttcggcggttttacgaatttattttgtatagttcggttantgtttacgcggcgggttgtacgatgtcggacgttgagtattggacgcgtattaatcgtaaagtgtcgcgtttggtgagcgtgttgtttaacggttcggattattattcgatcgtgcgcgtttgtttggcgggcggtatgtcggaggtgatgttttacgtgcgcgatttcggtttgttgtatttggacgttatgatcgtgatcggttagacggtgggcgagaattttgaatggtggtaggcgttcgagtatcgggcgcgtttcgttagtgttgcgcgagtaggacggcgtagagtcggatgacgtgatcgtgtcgtcggagaaggtaaaagcgaaagggt

SEQ ID NO: 5192 - DNA, 735 bp, Artificial Sequence
  chemically treated genomic DNA (Homo sapiens) CpG-island No: 5192
  misc_feature (340)..(340): n is either a, c, g or t
  misc_feature (576)..(576): n is either a, c, g or t
accctttcgcttttaccttctccgacgacacgatcacgtcatccgactctacgccgtcctactcgcgcaacactaacgaaacgcgcccgatactcgaacgcctaccaccattcaaaattctcgcccaccgtctaaccgatcacgatcataacgtccaaatacaacaaaccgaaatcgcgcacgtaaaacatcacctccgacataccgcccgccaaacaaacgcgcacgatcgaataataatccgaaccgttaaacaacacgctcaccaaacgcgacactttacgattaatacgcgtccaatactcaacgtccgacatcgtacaacccgccgcgtaaacantaaccgaactatacaaaataaattcgtaaaaccgccgaacgccgcgtaactcaccatcgcgttttacataactttatccgaacaaaatatcccgcgtaataataccgcgactatccaactcgctaaccgcccgccacgactaacgaacgatctccaaccacaccgcctacccgaacgacgccatcgcgaatacgacaaaccaaacccaacgcctctaaaccacataccaaatcgcnaccgtacgaaaaataacaccgctacgaaaaatacaacgaacaacaattcgaaatctctaaaaaaattctaataaaaaccgaccataattcactttcgcttttcgaaatacgaaattcccgccgtaaaatataaaaactatacgcaacaatataaaaaat

SEQ ID NO: 5193 - DNA, 547 bp, Artificial Sequence
  chemically treated genomic DNA (Homo sapiens) CpG-island No: 5193
  misc_feature (80)..(80): n is either a, c, g or t
  misc_feature (85)..(85): n is either a, c, g or t
  misc_feature (91)..(91): n is either a, c, g or t
  misc_feature (93)..(93): n is either a, c, g or t
  misc_feature (96)..(96): n is either a, c, g or t
gcgtaggttgtttcgtcgtttcgtcggcgcgttggtagttgaagtaggtttttgttatgtttaggtggtcgaggggtagncgggntttcgntnggncgggtttttgaagtagtagaggtagtagcggcgttcgtttaatacgaatcgacggttgcggtagttacgtagtcgcgttggttttcgcgcggtattcgtttcgggttttgtagtttttttatcgtcgtcgttgtttttttttgttcgggtttcggtttcggtatggttgtttgcgcgttaatcgtttgtttttcggttttcgcgttttcgcgttgcggttgttgcgttttttgttttcgcggtgtttttttttcgtcgtttcgttttttttttaggttcgcgttaaagtggtttggaatttgtagaacgtttttttttaagttcgttggtagttgttttagttcgttggtttttgttttcgttcgttggtcgttgttttcgcgacgtttcggaagttaggttttgtttttcgtatttgttaagttttcgttttgtcggagtttcgttttgt

SEQ ID NO: 5194 - DNA, 547 bp, Artificial Sequence
  chemically treated genomic DNA (Homo sapiens) CpG-island No: 5194
  misc_feature (452)..(452): n is either a, c, g or t
  misc_feature (455)..(455): n is either a, c, g or t
  misc_feature (457)..(457): n is either a, c, g or t
  misc_feature (463)..(463): n is either a, c, g or t
  misc_feature (468)..(468): n is either a, c, g or t
acaaaacgaaactccgacaaaacgaaaacttaacaaatacgaaaaacaaaacctaacttccgaaacgtcgcgaaaacaacgaccaacgaacgaaaacaaaaaccaacgaactaaaacaactaccaacgaacttaaaaaaaaacgttctacaaattccaaaccactttaacgcgaacctaaaaaaaaaacgaaacgacgaaaaaaaaacaccgcgaaaacaaaaaacgcaacaaccgcaacgcgaaaacgcgaaaaccgaaaaacaaacgattaacgcgcaaacaaccataccgaaaccgaaacccgaacaaaaaaaaacaacgacgacgataaaaaaactacaaaacccgaaacgaataccgcgcgaaaaccaacgcgactacgtaactaccgcaaccgtcgattcgtattaaacgaacgccgctactacctctactacttcaaaaacccgnccnancgaaancccgnctacccctcgaccacctaaacataacaaaaacctacttcaactaccaacgcgccgacgaaacgacgaaacaacctacgc

SEQ ID NO: 5195 - DNA, 547 bp, Artificial Sequence
  chemically treated genomic DNA (Homo sapiens) CpG-island No: 5195
  misc_feature (452)..(452): n is either a, c, g or t
  misc_feature (455)..(455): n is either a, c, g or t
  misc_feature (457)..(457): n is either a, c, g or t
  misc_feature (463)..(463): n is either a, c, g or t
  misc_feature (468)..(468): n is either a, c, g or t
atagagcgagatttcggtagggcggggatttggtaggtgcgggaggtaggatttggttttcggggcgtcgcgggggtaacggttagcgggcgggggtaagggttagcgggttaggataattgttaacgggtttggaggggggcgttttataaattttaggttattttgacgcgggtttgagagaggagcggggcggcgggaagggggtatcgcgggggtagggagcgtagtagtcgtagcgcgaaggcgcgggggtcggggaataaacggttggcgcgtaggtagttatatcggggtcggaattcgggtagaggagggtagcgacggcgatggggaggttgtagagttcggggcgggtatcgcgcgggaattagcgcgattgcgtggttatcgtagtcgtcggttcgtgttggacgggcgtcgttgttgtttttgttattttaagaattcgnttnancggganttcgnttgtttttcggttatttggatatagtagaagtttgttttagttattagcgcgtcgacgaggcggcggagtagtttgcgt

SEQ ID NO: 5196 - DNA, 547 bp, Artificial Sequence
  chemically treated genomic DNA (Homo sapiens) CpG-island No: 5196
  misc_feature (80)..(80): n is either a, c, g or t
  misc_feature (85)..(85): n is either a, c, g or t
  misc_feature (91)..(91): n is either a, c, g or t
  misc_feature (93)..(93): n is either a, c, g or t
  misc_feature (96)..(96): n is either a, c, g or t
acgcaaactactccgccgcctcgtcgacgcgctaataactaaaacaaacttctactatatccaaataaccgaaaaacaancgaantcccgntnaancgaattcttaaaataacaaaaacaacaacgacgcccgtccaacacgaaccgacgactacgataaccacgcaatcgcgctaattcccgcgcgatacccgccccgaactctacaacctccccatcgccgtcgctaccctcctctacccgaattccgaccccgatataactacctacgcgccaaccgtttattccccgacccccgcgccttcgcgctacgactactacgctccctacccccgcgatacccccttcccgccgccccgctcctctctcaaacccgcgtcaaaataacctaaaatttataaaacgcccccctccaaacccgttaacaattatcctaacccgctaacccttacccccgcccgctaaccgttacccccgcgacgccccgaaaaccaaatcctacctcccgcacctaccaaatccccgccctaccgaaatctcgctctat

SEQ ID NO: 5197 - DNA, 578 bp, Artificial Sequence
  chemically treated genomic DNA (Homo sapiens) CpG-island No: 5197
gatacgtaggattttttttttaatatttagaatattttgagcggtatcggtttttggtagacgtataacgttcgtattatcgcgaacgacggtttttaggtcgttaatattttattcggaatttagcgcgttgatacgtataatggttttaatatcgcgatatagcggatgttgtagcgcgtggtaaattatgcggcgggcggtgttttttttacgtaatgttacggagttttcgaggttaaatattagggtattagtcgggtagatgaaggagttgttgattatcgcggtattggtattaggtataaataatatgttgcggcgggtgttgtttttacgttgttgtagcgaagggaattttattggtaatttttttatggtagagtcgggatatcgttggcgcgtgttagtagggtttttagtcgtgtacgtaaaatgtagtttagtgcgtttttgttatcgatatttagttgtacgtcgcgtacgttgtagcgggcgagaacgtttagaatggtggttgcgaattgtatcgttaaattgttttttaacgttgttattgatttgtaggtcgatatttt

SEQ ID NO: 5198 - DNA, 578 bp, Artificial Sequence
  chemically treated genomic DNA (Homo sapiens) CpG-island No: 5198
aaaatatcgacctacaaatcaataacaacgttaaaaaacaatttaacgatacaattcgcaaccaccattctaaacgttctcgcccgctacaacgtacgcgacgtacaactaaatatcgataacaaaaacgcactaaactacattttacgtacacgactaaaaaccctactaacacgcgccaacgatatcccgactctaccataaaaaaattaccaataaaattcccttcgctacaacaacgtaaaaacaacacccgccgcaacatattatttatacctaataccaataccgcgataatcaacaactccttcatctacccgactaataccctaatatttaacctcgaaaactccgtaacattacgtaaaaaaaacaccgcccgccgcataatttaccacgcgctacaacatccgctatatcgcgatattaaaaccattatacgtatcaacgcgctaaattccgaataaaatattaacgacctaaaaaccgtcgttcgcgataatacgaacgttatacgtctaccaaaaaccgataccgctcaaaatattctaaatattaaaaaaaaaatcctacgtatc

SEQ ID NO: 5199 - DNA, 578 bp, Artificial Sequence
  chemically treated genomic DNA (Homo sapiens) CpG-island No: 5199
aagatatcgatttgtaaattaatagtagcgttgagaaatagtttggcgatgtaattcgtaattattattttggacgttttcgttcgttataacgtgcgcggcgtatagttgaatgtcgatgataaaggcgtattggattgtattttacgtgtacgattggaagttttgttggtacgcgttagcggtatttcggttttgttatgggaggattgttaataaaatttttttcgttgtaataacgtaaaaatagtattcgtcgtagtatgttgtttgtgtttggtgttaatgtcgcgatggttagtaatttttttatttattcggttgatgttttgatgtttgatttcgaagatttcgtagtattgcgtgaaaaagatatcgttcgtcgtatggtttattacgcgttgtaatattcgttgtatcgcgatattgaaattattgtgcgtgttaacgcgttggatttcgaatggggtgttaacgatttggaagtcgtcgttcgcggtggtgcggacgttgtgcgtttgttaaaaatcgatatcgtttaggatgttttggatattgaaaaagagattttgcgtatt

SEQ ID NO: 5200 - DNA, 578 bp, Artificial Sequence
  chemically treated genomic DNA (Homo sapiens) CpG-island No: 5200
aatacgcaaaatctctttttcaatatccaaaacatcctaaacgatatcgatttttaacaaacgcacaacgtccgcaccaccgcgaacgacgacttccaaatcgttaacaccccattcgaaatccaacgcgttaacacgcacaataatttcaatatcgcgatacaacgaatattacaacgcgtaataaaccatacgacgaacgatatctttttcacgcaatactacgaaatcttcgaaatcaaacatcaaaacatcaaccgaataaataaaaaaattactaaccatcgcgacattaacaccaaacacaaacaacatactacgacgaatactatttttacgttattacaacgaaaaaaattttattaacaatcctcccataacaaaaccgaaataccgctaacgcgtaccaacaaaacttccaatcgtacacgtaaaatacaatccaatacgcctttatcatcgacattcaactatacgccgcgcacgttataacgaacgaaaacgtccaaaataataattacgaattacatcgccaaactatttctcaacgctactattaatttacaaatcgatatctt

SEQ ID NO: 5201 - DNA, 768 bp, Artificial Sequence
  chemically treated genomic DNA (Homo sapiens) CpG-island No: 5201
ggggttgcgttgcgatgtttgttatcgcgattgttcgaaaattgatgaggttattattttggagttggagcgtaatacgcgtatcggtaagtacgttcgttttttgtcgacggtttatagcgacgtttgtatcggttgcggtaagtgcgaaaaagtatgcgtgttggaataatcggtaattaaggtgttatcgttgttattggcgaaaggggagtttggttattattatcgtttcggttggttggaggggaattttggtaaatcgtaaacgtgacgtcgggcgcgaggcgttggagaaaaaaggttggtggcgtagttatcgttggttggtgttttttcgtttttgttagtttttcgtgttggggatgtttttgagcggtttatggtttggtgtgtggattttgtacggtaattatagtagtagtttgttattcgatatcgtttcgttgatcgattcgttgatgacgttgtaaagttttgttagtggttattttgtttgtacggtggcgttgatcggtgcggtgattattatcgtgttttacgttttggcgggaaagcgattattttgtagttgggtttgttcgttgaattcgaatatcgatttagcgaatttggttacgcgggcgtttttgatttttaattaagtttgcgacgaatttttcgtaatattcggttacgtgttgtttggtggttaatttcgggtggggatttagtttttaaattggtaacgtttttatttgggggaattggattaaattttcggtgttt

SEQ ID NO: 5202 - DNA, 768 bp, Artificial Sequence
  chemically treated genomic DNA (Homo sapiens) CpG-island No: 5202
aaacaccgaaaatttaatccaattcccccaaataaaaacgttaccaatttaaaaactaaatccccacccgaaattaaccaccaaacaacacgtaaccgaatattacgaaaaattcgtcgcaaacttaattaaaaatcaaaaacgcccgcgtaaccaaattcgctaaatcgatattcgaattcaacgaacaaacccaactacaaaataatcgctttcccgccaaaacgtaaaacacgataataatcaccgcaccgatcaacgccaccgtacaaacaaaataaccactaacaaaactttacaacgtcatcaacgaatcgatcaacgaaacgatatcgaataacaaactactactataattaccgtacaaaatccacacaccaaaccataaaccgctcaaaaacatccccaacacgaaaaactaacaaaaacgaaaaaacaccaaccaacgataactacgccaccaaccttttttctccaacgcctcgcgcccgacgtcacgtttacgatttaccaaaattcccctccaaccaaccgaaacgataataataaccaaactcccctttcgccaataacaacgataacaccttaattaccgattattccaacacgcatactttttcgcacttaccgcaaccgatacaaacgtcgctataaaccgtcgacaaaaaacgaacgtacttaccgatacgcgtattacgctccaactccaaaataataacctcatcaattttcgaacaatcgcgataacaaacatcgcaacgcaacccc

SEQ ID NO: 5203 - DNA, 768 bp, Artificial Sequence
  chemically treated genomic DNA (Homo sapiens) CpG-island No: 5203
agatatcgggggtttgatttaatttttttaaatggaagcgttgttagtttaaaggttgaatttttattcggaattgattattaaatagtacgtagtcgaatgttgcgaaggattcgtcgtaggtttgattggaggttaaaggcgttcgcgtaattaagttcgttaagtcggtattcgggtttagcgggtagatttagttgtaaaataatcgttttttcgttagggcgtagagtacggtgataattatcgtatcggttaacgttatcgtgtaggtaagatgattattggtaagattttgtagcgttattagcggatcggttagcggaacggtgtcgaataataggttattgttgtagttgtcgtgtaagatttatatattaaattatggatcgtttaaaaatatttttagtacgaagaattgataaaggcgaagagatattagttaacggtgattgcgttattagttttttttttttagcgtttcgcgttcggcgttacgtttacgatttgttaaagtttttttttagttagtcgaagcggtaatggtgattaaatttttttttcgttagtgatagcggtaatattttgattgtcggttgttttagtacgtatattttttcgtatttatcgtaatcggtataggcgtcgttgtgaatcgtcggtagaaagcgggcgtgtttatcggtacgcgtgttgcgttttagttttagggtgatggttttattaattttcgggtaatcgcgataataaatatcgtagcgtagtttt

SEQ ID NO: 5204 - DNA, 768 bp, Artificial Sequence
  chemically treated genomic DNA (Homo sapiens) CpG-island No: 5204
aaaactacgctacgatatttattatcgcgattacccgaaaattaataaaaccatcaccctaaaactaaaacgcaacacgcgtaccgataaacacgcccgctttctaccgacgattcacaacgacgcctataccgattacgataaatacgaaaaaatatacgtactaaaacaaccgacaatcaaaatattaccgctatcactaacgaaaaaaaaatttaatcaccattaccgcttcgactaactaaaaaaaaactttaacaaatcgtaaacgtaacgccgaacgcgaaacgctaaaaaaaaaaaactaataacgcaatcaccgttaactaatatctcttcgcctttatcaattcttcgtactaaaaatatttttaaacgatccataatttaatatataaatcttacacgacaactacaacaataacctattattcgacaccgttccgctaaccgatccgctaataacgctacaaaatcttaccaataatcatcttacctacacgataacgttaaccgatacgataattatcaccgtactctacgccctaacgaaaaaacgattattttacaactaaatctacccgctaaacccgaataccgacttaacgaacttaattacgcgaacgcctttaacctccaatcaaacctacgacgaatccttcgcaacattcgactacgtactatttaataatcaattccgaataaaaattcaacctttaaactaacaacgcttccatttaaaaaaattaaatcaaacccccgatatct

SEQ ID NO: 5205 - DNA, 1035 bp, Artificial Sequence
  chemically treated genomic DNA (Homo sapiens) CpG-island No: 5205
ttcgggggggcggtcgtataattttttttttttttttttttcgtttttttgttgtcggatttttcgtattttttttttttattgtcgttttcgtttttttttgcggttcgttttcgttttgtgttttcgttcgtcggtttttttttttttggtttttttttgttttcgttttttgtgtttgtcgttttcggtcgtgtcgcgtggtttttcgttttttcgtcgggtttttgcgtttcggttttttggtatttttcgcgttttttgttcgtggttgtttcggtgtgtttgcgttgtttatttttcgattttttttttgttttagggtttttttcgagcgggattgcgtttgcgtcgtcggttttttttgaggcgtggtgcgatgagtttgtgtttgcgttatttcgcggtcgttttttttttgttgttttttcggcgttggcgggttattttgattttttttgtttttttgttcgcgtttttttgttttcgtgttttttcggtttttttttcgtttcgtcgcgtcgttgtcggtttttttttttttttttcgttttgtttcgttgggtttttttcgtcgttttcgttttgtttcgttttttttggttcgttttttttcggtttttgttttttggcgcgcgtttttttttttttttttcgcgtttgaggtttttttcgagtttttttcgggtttgttttttgtcgttttttcgtcgttcgttttgtcgttttttttttttttttttttcgggtttttttgcgttgcgtttcgttttcgttttggttttttttttttttttttttttttttggtttttttcgttttttttcggttttcgtttcggtttttcgcgttcgtttttttttgtttacgttttttcgttcgcgttttttttttttttattaggttaagttgttttatcgtacgtaatgttagttttagtttatcgttgcgatttatatgtttaatattattacgtttttcggtcgttattttttttgtttgatgggtaatattttttatcgggcgtataatttg

SEQ ID NO: 5206 - DNA, 1035 bp, Artificial Sequence
  chemically treated genomic DNA (Homo sapiens) CpG-island No: 5206
caaattatacgcccgataaaaaatattacccatcaaacaaaaaaaataacgaccgaaaaacgtaataatattaaacatataaatcgcaacgataaactaaaactaacattacgtacgataaaacaacttaacctaataaaaaaaaaaaaaacgcgaacgaaaaaacgtaaacaaaaaaaaacgaacgcgaaaaaccgaaacgaaaaccgaaaaaaaacgaaaaaaaccaaaaaaaaaaaaaaaaaaaaaaaaaaccaaaacgaaaacgaaacgcaacgcaaaaaaacccgaaaaaaaaaaaaaaaaaaaacgacaaaacgaacgacgaaaaaacgacaaaaaacaaacccgaaaaaaactcgaaaaaaacctcaaacgcgaaaaaaaaaaaaaaaaacgcgcgccaaaaaacaaaaaccgaaaaaaaacgaaccaaaaaaaacgaaacaaaacgaaaacgacgaaaaaaacccaacgaaacaaaacgaaaaaaaaaaaaaaaaaccgacaacgacgcgacgaaacgaaaaaaaaaccgaaaaaacacgaaaacaaaaaaacgcgaacaaaaaaacaaaaaaaatcaaaataacccgccaacgccgaaaaaacaacaaaaaaaaaacgaccgcgaaataacgcaaacacaaactcatcgcaccacgcctcaaaaaaaaccgacgacgcaaacgcaatcccgctcgaaaaaaaccctaaaacaaaaaaaaaatcgaaaaataaacaacgcaaacacaccgaaacaaccacgaacaaaaaacgcgaaaaataccaaaaaaccgaaacgcaaaaacccgacgaaaaaacgaaaaaccacgcgacacgaccgaaaacgacaaacacaaaaaacgaaaacaaaaaaaaaccaaaaaaaaaaaaaccgacgaacgaaaacacaaaacgaaaacgaaccgcaaaaaaaaacgaaaacgacaataaaaaaaaaaaatacgaaaaatccgacaacaaaaaaacgaaaaaaaaaaaaaaaaaaaattatacgaccgcccccccgaa

SEQ ID NO: 5207 - DNA, 1035 bp, Artificial Sequence
  chemically treated genomic DNA (Homo sapiens) CpG-island No: 5207
tagattgtgcgttcgatagaaaatgttgtttattaggtaaagaaggtggcgatcggagaacgtaatagtgttgagtatatgaatcgtagcgatgagttggggttgatattacgtgcggtagggtaatttggtttgatggagagggaaagaacgcgagcggggagacgtaagtagggaagggcgggcgcggagaatcgaaacgaggatcgagaaagagcggagggggttaagaagggagaaggggggagagagggttagggcggggacgaggcgtaacgtagagaagttcgagggggggaaagggagggagcggtagggcggacggcgaaggggcggtaggggataggttcgaaaagggttcgggaggggttttaagcgcggaggggagagggagaagcgcgcgttaaagagtaggagtcgaaaggaggcggattagggggaacgaagtaaggcgagagcggcgggagggatttagcgaggtagagcgaaggggggagagggggatcgatagcgacgcgacggaacggggagagagtcgaggaagtacgggagtaggggagcgcgaataggagaataggagggattagaatagttcgttagcgtcgagaaagtagtaggaggagaacgatcgcgggatgacgtaagtatagatttatcgtattacgttttaggaggagtcggcggcgtaagcgtagtttcgttcggagaggattttaggataaaggagagatcggagggtgggtagcgtagatatatcggggtagttacgaatagggagcgcggagggtgttagaagatcgagacgtaagagttcggcggaaaaacgaagagttacgcggtacgatcgaggacgataaatataagaaacgggagtaggaaagggttagaaaggaaggggtcgacggacgagggtataaggcggaagcgggtcgtaggaaaagacgaaagcgatagtgaaaagaggagatgcggaaaattcggtagtaggagagcgggggggaaaaaaaaagggggttgtgcggtcgttttttcggg

SEQ ID NO: 5208 - DNA, 1035 bp, Artificial Sequence
  chemically treated genomic DNA (Homo sapiens) CpG-island No: 5208
cccgaaaaaacgaccgcacaaccccctttttttttcccccccgctctcctactaccgaattttccgcatctcctcttttcactatcgctttcgtcttttcctacgacccgcttccgccttataccctcgtccgtcgaccccttcctttctaaccctttcctactcccgtttcttatatttatcgtcctcgatcgtaccgcgtaactcttcgtttttccgccgaactcttacgtctcgatcttctaacaccctccgcgctccctattcgtaactaccccgatatatctacgctacccaccctccgatctctcctttatcctaaaatcctctccgaacgaaactacgcttacgccgccgactcctcctaaaacgtaatacgataaatctatacttacgtcatcccgcgatcgttctcctcctactactttctcgacgctaacgaactattctaatccctcctattctcctattcgcgctcccctactcccgtacttcctcgactctctccccgttccgtcgcgtcgctatcgatccccctctccccccttcgctctacctcgctaaatccctcccgccgctctcgccttacttcgttccccctaatccgcctcctttcgactcctactctttaacgcgcgcttctccctctcccctccgcgcttaaaacccctcccgaacccttttcgaacctatcccctaccgccccttcgccgtccgccctaccgctccctccctttccccccctcgaacttctctacgttacgcctcgtccccgccctaaccctctctccccccttctcccttcttaaccccctccgctctttctcgatcctcgtttcgattctccgcgcccgcccttccctacttacgtctccccgctcgcgttctttccctctccatcaaaccaaattaccctaccgcacgtaatatcaaccccaactcatcgctacgattcatatactcaacactattacgttctccgatcgccaccttctttacctaataaacaacattttctatcgaacgcacaatcta

SEQ ID NO: 5209 - DNA, 540 bp, Artificial Sequence
  chemically treated genomic DNA (Homo sapiens) CpG-island No: 5209
attagagtaatttttgtgaagtttgttttcgatttttcgcgtttttttgatcgtacgttttgtatacgggtatttttattagttcgcggtttcgtaaattttgtatttcgagttcggtagtttttcgttatttcgtatttgatgtttttttcgttttgtgttttcgtaattcgtttgttttagagttttatttgttttcgtttttcggtttgttattttgttcgcgcggcgtgggggcggttcgtagtttgtgtgcgttttttttcggggggggggtaaaaaaaaaaatttttttttttttttttttatcgtaatttgtttgtgttgcgtaagtttttttcgttttttcgcgtcgtcgttttttcgatcgtttttttcgtttttttgatttagtttttttttattatttcgttttttttttcggtttttttagtttttttttatcgttttttttttttattcgttttttttttttattattttatttttttttttttttattttttttttttattattatttgttttttttttatttttt

SEQ ID NO: 5210 - DNA, 540 bp, Artificial Sequence
  chemically treated genomic DNA (Homo sapiens) CpG-island No: 5210
aaaaaataaaaaaaaaacaaataataataaaaaaaaaaaataaaaaaaaaaaaaaataaaataataaaaaaaaaaaacgaataaaaaaaaaaaacgataaaaaaaaactaaaaaaaccgaaaaaaaaaacgaaataataaaaaaaaactaaatcaaaaaaacgaaaaaaacgatcgaaaaaacgacgacgcgaaaaaacgaaaaaaacttacgcaacacaaacaaattacgataaaaaaaaaaaaaaaaaaatttttttttttaccccccccccgaaaaaaaacgcacacaaactacgaaccgcccccacgccgcgcgaacaaaataacaaaccgaaaaacgaaaacaaataaaactctaaaacaaacgaattacgaaaacacaaaacgaaaaaaacatcaaatacgaaataacgaaaaactaccgaactcgaaatacaaaatttacgaaaccgcgaactaataaaaatacccgtatacaaaacgtacgatcaaaaaaacgcgaaaaatcgaaaacaaacttcacaaaaattactctaat

SEQ ID NO: 5211 - DNA, 540 bp, Artificial Sequence
  chemically treated genomic DNA (Homo sapiens) CpG-island No: 5211
ggagagtaagaaagaggtagataatgatgaaggaggggaatagggggaaagagaggtgagatggtggagaaaaggggcgagtaggggaagagagcgatgggagagggttgggaaagtcggggggaggaacggggtggtgagaaaaaattgggttagaagggcggaagaggcggtcgaagagacgacgacgcggaggagcggaggaagtttgcgtagtatagataggttacgatggagggggaaaaaaaaaaatttttttttttgtttttttttcgggggggggcgtatatagattgcgaatcgtttttacgtcgcgcgggtaaaatagtaaatcgagaagcgaaggtaggtgggattttgaagtaggcgaattacgagagtataggacggaaagagtattagatgcgaggtggcgagggattgtcggattcggggtgtagggtttacgaggtcgcgggttggtagaggtgttcgtgtgtagagcgtgcggttaggggggcgcgggagatcgggagtaagttttataggggttattttggt

SEQ ID NO: 5212 - DNA, 540 bp, Artificial Sequence
  chemically treated genomic DNA (Homo sapiens) CpG-island No: 5212
accaaaataacccctataaaacttactcccgatctcccgcgcccccctaaccgcacgctctacacacgaacacctctaccaacccgcgacctcgtaaaccctacaccccgaatccgacaatccctcgccacctcgcatctaatactctttccgtcctatactctcgtaattcgcctacttcaaaatcccacctaccttcgcttctcgatttactattttacccgcgcgacgtaaaaacgattcgcaatctatatacgcccccccccgaaaaaaaaacaaaaaaaaaaatttttttttttccccctccatcgtaacctatctatactacgcaaacttcctccgctcctccgcgtcgtcgtctcttcgaccgcctcttccgcccttctaacccaattttttctcaccaccccgttcctccccccgactttcccaaccctctcccatcgctctcttcccctactcgccccttttctccaccatctcacctctctttccccctattcccctccttcatcattatctacctctttcttactctcc

SEQ ID NO: 5213 - DNA, 708 bp, Artificial Sequence
  chemically treated genomic DNA (Homo sapiens) CpG-island No: 5213
gggttgggcgtattttacgagcgtttcggcggttggcgaagcggacggggtgtagttttttcggtgcgaggaacggttttcgttgatagatatttttttttcggtcgcgttattcgggaggcggatttcgtgggtttgaggaggtttttttcgttcggtttgttttttttttttcgttggcgttgtcgcgagtttatcgagcggtttttgaggagtagtcgtaggaggaggaggaggtcgtcgggggcggcgggcggagatcgcgttttcgttttttcggcggcggtaagggtaggataatggaggtggcggtggagaaggcggtggcggcggcggtagcggtttcggttgcggttttcggggggttttcggcggcgttagtcggggagaacgaggtcgagagtttgtagggttcggatttcgagcgtcgcggcgaggcggttcggtttaatttgttggatatttgcgtcgtgttttatagaatatttatatcgggttttaagttttgtttgttttattttttgtacgtttttttcggtttacgtattatgtgtttttatttggtcgttaatcgtatttttgtcggttcgtaggtttgttttatagtaacgcggttttgatataaagtaaggcgttttggattttattcgcggttgggagtataattttgttaatacgttgttgttaattattttttttttttttttt

SEQ ID NO: 5214 - DNA, 708 bp, Artificial Sequence
  chemically treated genomic DNA (Homo sapiens) CpG-island No: 5214
aaaaaaaaaaaaaaaaataattaacaacaacgtattaacaaaattatactcccaaccgcgaataaaatccaaaacgccttactttatatcaaaaccgcgttactataaaacaaacctacgaaccgacaaaaatacgattaacgaccaaataaaaacacataatacgtaaaccgaaaaaaacgtacaaaaaataaaacaaacaaaacttaaaacccgatataaatattctataaaacacgacgcaaatatccaacaaattaaaccgaaccgcctcgccgcgacgctcgaaatccgaaccctacaaactctcgacctcgttctccccgactaacgccgccgaaaaccccccgaaaaccgcaaccgaaaccgctaccgccgccgccaccgccttctccaccgccacctccattatcctacccttaccgccgccgaaaaaacgaaaacgcgatctccgcccgccgcccccgacgacctcctcctcctcctacgactactcctcaaaaaccgctcgataaactcgcgacaacgccaacgaaaaaaaaaaaacaaaccgaacgaaaaaaacctcctcaaacccacgaaatccgcctcccgaataacgcgaccgaaaaaaaaatatctatcaacgaaaaccgttcctcgcaccgaaaaaactacaccccgtccgcttcgccaaccgccgaaacgctcgtaaaatacgcccaaccc

SEQ ID NO: 5215 - DNA, 708 bp, Artificial Sequence
  chemically treated genomic DNA (Homo sapiens) CpG-island No: 5215
aggaaaaagaggaagggtggttgataataacgtattagtaaaattgtgtttttagtcgcggataaggtttaaagcgttttgttttgtgttaaggtcgcgttattgtgaagtagatttacggatcggtagaggtgcggttggcgattagatgggggtatatagtacgtgggtcgggaggagcgtgtagaagatgaggtaggtagagtttggggttcggtatggatgttttgtgggatacggcgtaagtgtttaataggttgagtcgggtcgtttcgtcgcggcgttcggagttcgggttttgtagattttcggtttcgtttttttcgattggcgtcgtcgagggtttttcggaggtcgtagtcgaggtcgttgtcgtcgtcgttatcgttttttttatcgttatttttattgttttgtttttgtcgtcgtcggggaagcgagagcgcggttttcgttcgtcgttttcgacgatttttttttttttttgcggttgttttttagaggtcgttcggtggattcgcggtagcgttagcgagggagggaaagtaaatcgggcgggggaagtttttttaggtttacgggattcgtttttcgagtggcgcggtcggaaggagggtatttgttagcggagatcgtttttcgtatcggggaggttgtatttcgttcgtttcgttaatcgtcgaggcgttcgtggaatacgtttagttt

SEQ ID NO: 5216 - DNA, 708 bp, Artificial Sequence
  chemically treated genomic DNA (Homo sapiens) CpG-island No: 5216
aaactaaacgtattccacgaacgcctcgacgattaacgaaacgaacgaaatacaacctccccgatacgaaaaacgatctccgctaacaaataccctccttccgaccgcgccactcgaaaaacgaatcccgtaaacctaaaaaaacttcccccgcccgatttactttccctccctcgctaacgctaccgcgaatccaccgaacgacctctaaaaaacaaccgcaaaaaaaaaaaaaaatcgtcgaaaacgacgaacgaaaaccgcgctctcgcttccccgacgacgacaaaaacaaaacaataaaaataacgataaaaaaaacgataacgacgacgacaacgacctcgactacgacctccgaaaaaccctcgacgacgccaatcgaaaaaaacgaaaccgaaaatctacaaaacccgaactccgaacgccgcgacgaaacgacccgactcaacctattaaacacttacgccgtatcccacaaaacatccataccgaaccccaaactctacctacctcatcttctacacgctcctcccgacccacgtactatatacccccatctaatcgccaaccgcacctctaccgatccgtaaatctacttcacaataacgcgaccttaacacaaaacaaaacgctttaaaccttatccgcgactaaaaacacaattttactaatacgttattatcaaccacccttcctctttttcct

SEQ ID NO: 5217 - DNA, 748 bp, Artificial Sequence
  chemically treated genomic DNA (Homo sapiens) CpG-island No: 5217
ttattggttggagattttagtcgttcgcgggtatagttataagtttcggaggtattggttcgcgttgtgtacgtcgggagttgtagttttttttattttttttcgtcgttcgcgggttttcgtcgtacgagcgtttttagcggcgcgtaggtttcgtgaagcgtagcgcgcgcggatttcgggggtagttttttagtaatcggcggagcggttacgttacggtggtaggttttaagcgttgttgggtatcgtaaggtcgtcgtgtgtattttttagtagttacgggttggtggaagcgttgtttatagttagtgtcggtacgttttcgttcgtttttattttttttattttgttttaggtagcggagagtcgtttttcgtcgcgttttcgttatcgaggttcgggttagaggttagaggtcgttcgtttttgcgcggtttttttttttgagttcgcggagttcgtcgtttcgggtttcggggcgacgatgttggagtttattcgcgtgacgggtgagtgtcgggaagggttggtcgcggcgggggtgcggggcggatcggggtttcgtcgttcggggtttaggtaatggtagttatcggttgggcgcgtcgttcgggattttattttgcgtttcgattttttcggggcgcgtaggaggcgttcgcgaaaaatttgtggagggaagagagaaatcggttttttattttttcgttatttattattagtaagtatttgttgtggaatttcg

SEQ ID NO: 5218 - DNA, 748 bp, Artificial Sequence
  chemically treated genomic DNA (Homo sapiens) CpG-island No: 5218
cgaaattccacaacaaatacttactaataataaataacgaaaaaataaaaaaccgatttctctcttccctccacaaatttttcgcgaacgcctcctacgcgccccgaaaaaatcgaaacgcaaaataaaatcccgaacgacgcgcccaaccgataactaccattacctaaaccccgaacgacgaaaccccgatccgccccgcacccccgccgcgaccaacccttcccgacactcacccgtcacgcgaataaactccaacatcgtcgccccgaaacccgaaacgacgaactccgcgaactcaaaaaaaaaaaccgcgcaaaaacgaacgacctctaacctctaacccgaacctcgataacgaaaacgcgacgaaaaacgactctccgctacctaaaacaaaataaaaaaaataaaaacgaacgaaaacgtaccgacactaactataaacaacgcttccaccaacccgtaactactaaaaaatacacacgacgaccttacgatacccaacaacgcttaaaacctaccaccgtaacgtaaccgctccgccgattactaaaaaactacccccgaaatccgcgcgcgctacgcttcacgaaacctacgcgccgctaaaaacgctcgtacgacgaaaacccgcgaacgacgaaaaaaaataaaaaaaactacaactcccgacgtacacaacgcgaaccaatacctccgaaacttataactatacccgcgaacgactaaaatctccaaccaataa

SEQ ID NO: 5219 - DNA, 748 bp, Artificial Sequence
  chemically treated genomic DNA (Homo sapiens) CpG-island No: 5219
cgagattttatagtaggtatttattgataataagtgacgaaaggataaggggtcgattttttttttttttttataggtttttcgcgagcgttttttgcgcgtttcgaaggggtcggggcgtagggtggagtttcgagcggcgcgtttagtcggtggttattattatttgagtttcgggcggcgggatttcggttcgtttcgtattttcgtcgcggttagtttttttcggtatttattcgttacgcgaatggattttagtatcgtcgtttcgaggttcggggcggcgggtttcgcgggtttaggggaaagggtcgcgtaggggcgggcggtttttagtttttgattcgggtttcggtggcgggggcgcggcgggaggcggtttttcgttatttggagtaggataaggagggtaagggcggacgaagacgtatcgatattgattgtgagtagcgtttttattagttcgtagttattggaaggtatatacggcggttttacggtgtttagtagcgtttagaatttgttatcgtgacgtagtcgtttcgtcggttgttaggaaattgttttcggggttcgcgcgcgttgcgttttacggagtttgcgcgtcgttgggggcgttcgtgcgacgaaggttcgcgggcggcgagagagagtgggaggaattataattttcggcgtgtatagcgcgggttagtgttttcggggtttgtggttgtgttcgcgagcggttggggtttttagttagtgg

SEQ ID NO: 5220 - DNA, 748 bp, Artificial Sequence
  chemically treated genomic DNA (Homo sapiens) CpG-island No: 5220
ccactaactaaaaaccccaaccgctcgcgaacacaaccacaaaccccgaaaacactaacccgcgctatacacgccgaaaattataattcctcccactctctctcgccgcccgcgaaccttcgtcgcacgaacgcccccaacgacgcgcaaactccgtaaaacgcaacgcgcgcgaaccccgaaaacaatttcctaacaaccgacgaaacgactacgtcacgataacaaattctaaacgctactaaacaccgtaaaaccgccgtatataccttccaataactacgaactaataaaaacgctactcacaatcaatatcgatacgtcttcgtccgcccttaccctccttatcctactccaaataacgaaaaaccgcctcccgccgcgcccccgccaccgaaacccgaatcaaaaactaaaaaccgcccgcccctacgcgaccctttcccctaaacccgcgaaacccgccgccccgaacctcgaaacgacgatactaaaatccattcgcgtaacgaataaataccgaaaaaaactaaccgcgacgaaaatacgaaacgaaccgaaatcccgccgcccgaaactcaaataataataaccaccgactaaacgcgccgctcgaaactccaccctacgccccgaccccttcgaaacgcgcaaaaaacgctcgcgaaaaacctataaaaaaaaaaaaaaaatcgaccccttatcctttcgtcacttattatcaataaatacctactataaaatctcg

SEQ ID NO: 5221 - DNA, 989 bp, Artificial Sequence
  chemically treated genomic DNA (Homo sapiens) CpG-island No: 5221
ttcggttgcgttttttttatataatgatcgcggaattcggggaggttcggttacgttttttttacgaaaggaacgcgggattcgggaaggttcggaaggttggattgcgttttttttacgtaaggaacgcgggattcgggaaggttcggaaggtttggttgcgttttttttacgtaaggaacgcgggcgtttgggaggttcggttgcgttttttttacggaaggaacgcgggatttcggaaggttcggaaggtttggttgcgttttttttacggaaggaacgcgggcgtttgggaggttcggttgcgttcgttttacggaaggaacgcgggattcgggaaggttcggaaggtttggttgcgttttttttaaggaaggaacgcggacgtttgggaggttcggttgcgttcgttttatagaaggaacgcgggatttgggaaggtcggaaggttcggttgcgttttttttacgtaggaacgcgggcgtttgggaggttcggttgcgttttttttatagaaggaacgcgggattcgggaaggtcggaagttcggaaggttcggttgcgttttttttacgtaaggaacgcgggcgtttgggaggttcggttgcgttcgttttacgtaaggaacgcgggattcgggaaggttcggaaggttcggttgcgttttttttacgtaaggaacgcgggcgtttgggaggttcggttgcgttcgttttatagaaggaacgcgggattcgggaaggttcggaaggtttggttgcgttttttttacggaaggaacgcgggattcgaggaggttcggttgcgttcgttttatagaaggaacgcgggattcgggaaggttcggaaggtttggttgcgttttttttatagaaggaacgcgggattcgaggaggttcggttgcgttttttttacgtgtggaggttaattaggtgaatatattagtttgtacgttatataatttgtggtgagttatttatatttgaat

SEQ ID NO: 5222 - DNA, 989 bp, Artificial Sequence
  chemically treated genomic DNA (Homo sapiens) CpG-island No: 5222
attcaaatataaataactcaccacaaattatataacgtacaaactaatatattcacctaattaacctccacacgtaaaaaaaacgcaaccgaacctcctcgaatcccgcgttccttctataaaaaaaacgcaaccaaaccttccgaaccttcccgaatcccgcgttccttctataaaacgaacgcaaccgaacctcctcgaatcccgcgttccttccgtaaaaaaaacgcaaccaaaccttccgaaccttcccgaatcccgcgttccttctataaaacgaacgcaaccgaacctcccaaacgcccgcgttccttacgtaaaaaaaacgcaaccgaaccttccgaaccttcccgaatcccgcgttccttacgtaaaacgaacgcaaccgaacctcccaaacgcccgcgttccttacgtaaaaaaaacgcaaccgaaccttccgaacttccgaccttcccgaatcccgcgttccttctataaaaaaaacgcaaccgaacctcccaaacgcccgcgttcctacgtaaaaaaaacgcaaccgaaccttccgaccttcccaaatcccgcgttccttctataaaacgaacgcaaccgaacctcccaaacgtccgcgttccttccttaaaaaaaacgcaaccaaaccttccgaaccttcccgaatcccgcgttccttccgtaaaacgaacgcaaccgaacctcccaaacgcccgcgttccttccgtaaaaaaaacgcaaccaaaccttccgaaccttccgaaatcccgcgttccttccgtaaaaaaaacgcaaccgaacctcccaaacgcccgcgttccttacgtaaaaaaaacgcaaccaaaccttccgaaccttcccgaatcccgcgttccttacgtaaaaaaaacgcaatccaaccttccgaaccttcccgaatcccgcgttcctttcgtaaaaaaaacgtaaccgaacctccccgaattccgcgatcattatataaaaaaaacgcaaccgaa

SEQ ID NO: 5223 - DNA, 989 bp, Artificial Sequence
  chemically treated genomic DNA (Homo sapiens) CpG-island No: 5223
gtttaaatatgagtaatttattataaattgtgtggcgtgtaaattaatatatttatttgattggtttttatacgtgagggggacgtagtcgggttttttcgagtttcgcgttttttttgtgagggggacgtagttaggtttttcgggttttttcgagtttcgcgttttttttgtgaggcggacgtagtcgggttttttcgagtttcgcgtttttttcgtgagggggacgtagttaggtttttcgggttttttcgagtttcgcgttttttttgtgaggcggacgtagtcgggttttttagacgttcgcgttttttacgtgagggggacgtagtcgggtttttcgggttttttcgagtttcgcgttttttacgtgaggcggacgtagtcgggttttttagacgttcgcgttttttacgtgagggggacgtagtcgggtttttcgggttttcggttttttcgagtttcgcgttttttttgtgagggggacgtagtcgggttttttagacgttcgcgtttttacgtgagggggacgtagtcgggtttttcggtttttttaagtttcgcgttttttttgtgaggcggacgtagtcgggttttttagacgttcgcgttttttttttgagggggacgtagttaggtttttcgggttttttcgagtttcgcgtttttttcgtgaggcggacgtagtcgggttttttagacgttcgcgtttttttcgtgagggggacgtagttaggtttttcgggtttttcggagtttcgcgtttttttcgtgagggggacgtagtcgggttttttagacgttcgcgttttttacgtgagggggacgtagttaggtttttcgggttttttcgagtttcgcgttttttacgtgagggggacgtagtttagtttttcgggttttttcgagtttcgcgtttttttcgtgagggggacgtagtcgggttttttcgagtttcgcggttattatgtgagggggacgtagtcggg

SEQ ID NO: 5224 - DNA, 989 bp, Artificial Sequence
  chemically treated genomic DNA (Homo sapiens) CpG-island No: 5224
cccgactacgtccccctcacataataaccgcgaaactcgaaaaaacccgactacgtccccctcacgaaaaaaacgcgaaactcgaaaaaacccgaaaaactaaactacgtccccctcacgtaaaaaacgcgaaactcgaaaaaacccgaaaaacctaactacgtccccctcacgtaaaaaacgcgaacgtctaaaaaacccgactacgtccccctcacgaaaaaaacgcgaaactccgaaaaacccgaaaaacctaactacgtccccctcacgaaaaaaacgcgaacgtctaaaaaacccgactacgtccgcctcacgaaaaaaacgcgaaactcgaaaaaacccgaaaaacctaactacgtccccctcaaaaaaaaaacgcgaacgtctaaaaaacccgactacgtccgcctcacaaaaaaaacgcgaaacttaaaaaaaccgaaaaacccgactacgtccccctcacgtaaaaacgcgaacgtctaaaaaacccgactacgtccccctcacaaaaaaaacgcgaaactcgaaaaaaccgaaaacccgaaaaacccgactacgtccccctcacgtaaaaaacgcgaacgtctaaaaaacccgactacgtccgcctcacgtaaaaaacgcgaaactcgaaaaaacccgaaaaacccgactacgtccccctcacgtaaaaaacgcgaacgtctaaaaaacccgactacgtccgcctcacaaaaaaaacgcgaaactcgaaaaaacccgaaaaacctaactacgtccccctcacgaaaaaaacgcgaaactcgaaaaaacccgactacgtccgcctcacaaaaaaaacgcgaaactcgaaaaaacccgaaaaacctaactacgtccccctcacaaaaaaaacgcgaaactcgaaaaaacccgactacgtccccctcacgtataaaaaccaatcaaataaatatattaatttacacgccacacaatttataataaattactcatatttaaac

SEQ ID NO: 5225 - DNA, 604 bp, Artificial Sequence
  chemically treated genomic DNA (Homo sapiens) CpG-island No: 5225
tttgattttaggagttagaagttggggaggaattcgtagttcgggcggaagagcgcgtatgcgtcgttttaggggtcggtttcgggggcggggtttgtttttttcgttttgggtttttataggttttcgcggggcggggtttatttttttcgttttgggttatagcgggcgttcggggggcggggtttgtttttttcgttttgggttttcgcgggcgttcgggggcggggtttgttttttttgttttgggttttcgtcggcgttcgtttcgttagttttatttgcgcggtacgtgattcgtatcgttcgtgggtattttgaaggcggatttcgcgcgttttcgtttttgtaggtgagagcggtcgcgtttacgggtcggtttagcggcggtggcggtaggtggggaagcgcggttgggtttgttcgcgcggggcgtttgagttttttatttttcggttttaatcgcgtagtagggtttaatcgggattttgagtgcggcgaggcgtggttcgtgtatttttggttcggggttagggcgggcgtgtcggcgtcgggtggaaggaagttttttgcgggtgagttttttgttttttaggtttttttt

SEQ ID NO: 5226 - DNA, 604 bp, Artificial Sequence
  chemically treated genomic DNA (Homo sapiens) CpG-island No: 5226
aaaaaaaacctaaaaaacaaaaaactcacccgcaaaaaacttccttccacccgacgccgacacgcccgccctaaccccgaaccaaaaatacacgaaccacgcctcgccgcactcaaaatcccgattaaaccctactacgcgattaaaaccgaaaaataaaaaactcaaacgccccgcgcgaacaaacccaaccgcgcttccccacctaccgccaccgccgctaaaccgacccgtaaacgcgaccgctctcacctacaaaaacgaaaacgcgcgaaatccgccttcaaaatacccacgaacgatacgaatcacgtaccgcgcaaataaaactaacgaaacgaacgccgacgaaaacccaaaacaaaaaaaacaaaccccgcccccgaacgcccgcgaaaacccaaaacgaaaaaaacaaaccccgccccccgaacgcccgctataacccaaaacgaaaaaaataaaccccgccccgcgaaaacctataaaaacccaaaacgaaaaaaacaaaccccgcccccgaaaccgacccctaaaacgacgcatacgcgctcttccgcccgaactacgaattcctccccaacttctaactcctaaaatcaaa

SEQ ID NO: 5227 - DNA, 604 bp, Artificial Sequence
  chemically treated genomic DNA (Homo sapiens) CpG-island No: 5227
gagggaggtttgggaggtagggagtttattcgtaaggggtttttttttattcgacgtcgatacgttcgttttagtttcgggttaagggtgtacgaattacgtttcgtcgtatttaaggtttcggttgggttttgttgcgcggttagaatcgggaaatggagggtttagacgtttcgcgcgagtaggtttagtcgcgtttttttatttgtcgttatcgtcgttgagtcggttcgtgggcgcggtcgtttttatttgtaggagcgggggcgcgcgggattcgtttttaaggtgtttacgggcggtgcgggttacgtgtcgcgtaggtgaggttggcggggcgggcgtcggcggagatttagagtagagggaataggtttcgttttcgaacgttcgcggggatttagagcggagggaataggtttcgtttttcgaacgttcgttgtgatttagagcggagggagtaggtttcgtttcgcgaaagtttgtggagatttagggcggagggaataggtttcgttttcgggatcggtttttgaggcggcgtatgcgcgttttttcgttcggattgcgagtttttttttagtttttggtttttagggttaag

SEQ ID NO: 5228 - DNA, 604 bp, Artificial Sequence
  chemically treated genomic DNA (Homo sapiens) CpG-island No: 5228
cttaaccctaaaaaccaaaaactaaaaaaaaactcgcaatccgaacgaaaaaacgcgcatacgccgcctcaaaaaccgatcccgaaaacgaaacctattccctccgccctaaatctccacaaactttcgcgaaacgaaacctactccctccgctctaaatcacaacgaacgttcgaaaaacgaaacctattccctccgctctaaatccccgcgaacgttcgaaaacgaaacctattccctctactctaaatctccgccgacgcccgccccgccaacctcacctacgcgacacgtaacccgcaccgcccgtaaacaccttaaaaacgaatcccgcgcgcccccgctcctacaaataaaaacgaccgcgcccacgaaccgactcaacgacgataacgacaaataaaaaaacgcgactaaacctactcgcgcgaaacgtctaaaccctccatttcccgattctaaccgcgcaacaaaacccaaccgaaaccttaaatacgacgaaacgtaattcgtacacccttaacccgaaactaaaacgaacgtatcgacgtcgaataaaaaaaaaccccttacgaataaactccctacctcccaaacctccctc

SEQ ID NO: 5229 - DNA, 521 bp, Artificial Sequence
  chemically treated genomic DNA (Homo sapiens) CpG-island No: 5229
gaaggcggcgtttagaagttttaggttttagaggttcgtttagcggtaggcgtataaggcggggtcggcgcgggtttttttttttatcggaatcgttttttcggggttgagtttttgttcggatttcgaacgtcgaagattaggggtcggaagcgcgcgtcgttattgttacgtcgtgttagtcgggagggagggagcgagtaggcgaagtcgcggaggacggggtgaagatggcggtttttttcggtgcgtttgtggaaattttgggggtggtggggcggtttgttgtacgttttagttttggggtcgttcgcggagagttaaaggggcgggagcggataggggttagggagatagaagggcgttgttcgttgtagtttttgatggattcgcgttgcgggattaggggcggtcgcggttcgggttcggaggacgattttttttaggagcgggtcggaacgtttttttttttgtttttttttttttattagtttttatttggtttttttgttagtgtattt

SEQ ID NO: 5230 - DNA, 521 bp, Artificial Sequence
  chemically treated genomic DNA (Homo sapiens) CpG-island No: 5230
aaatacactaacaaaaaaaccaaataaaaactaataaaaaaaaaaaaacaaaaaaaaaaacgttccgacccgctcctaaaaaaaatcgtcctccgaacccgaaccgcgaccgcccctaatcccgcaacgcgaatccatcaaaaactacaacgaacaacgcccttctatctccctaacccctatccgctcccgcccctttaactctccgcgaacgaccccaaaactaaaacgtacaacaaaccgccccaccacccccaaaatttccacaaacgcaccgaaaaaaaccgccatcttcaccccgtcctccgcgacttcgcctactcgctccctccctcccgactaacacgacgtaacaataacgacgcgcgcttccgacccctaatcttcgacgttcgaaatccgaacaaaaactcaaccccgaaaaaacgattccgataaaaaaaaaaacccgcgccgaccccgccttatacgcctaccgctaaacgaacctctaaaacctaaaacttctaaacgccgccttc

SEQ ID NO: 5231 - DNA, 521 bp, Artificial Sequence
  chemically treated genomic DNA (Homo sapiens) CpG-island No: 5231
aggtgtattggtaggaaagttaagtggagattggtagaagggaaagggtagggggagggacgtttcggttcgtttttgggaagaatcgtttttcgaattcgagtcgcggtcgtttttgatttcgtaacgcgggtttattagggattgtagcggatagcgtttttttgtttttttgatttttgttcgttttcgtttttttagtttttcgcgggcggttttagggttgaggcgtgtaataagtcgttttattatttttagagtttttataaacgtatcggagaaggtcgttatttttatttcgtttttcgcggtttcgtttgttcgttttttttttttcgattgatacggcgtggtagtggcggcgcgcgttttcggtttttggttttcggcgttcggagttcgggtagggatttagtttcgggagaacggtttcgatggaaggaaaggttcgcgtcggtttcgttttatgcgtttgtcgttgagcggatttttgggatttagggtttttggacgtcgttttt

SEQ ID NO: 5232 - DNA, 521 bp, Artificial Sequence
  chemically treated genomic DNA (Homo sapiens) CpG-island No: 5232
aaaaacgacgtccaaaaaccctaaatcccaaaaatccgctcaacgacaaacgcataaaacgaaaccgacgcgaacctttccttccatcgaaaccgttctcccgaaactaaatccctacccgaactccgaacgccgaaaaccaaaaaccgaaaacgcgcgccgccactaccacgccgtatcaatcgaaaaaaaaaaaacgaacaaacgaaaccgcgaaaaacgaaataaaaataacgaccttctccgatacgtttataaaaactctaaaaataataaaacgacttattacacgcctcaaccctaaaaccgcccgcgaaaaactaaaaaaacgaaaacgaacaaaaatcaaaaaaacaaaaaaacgctatccgctacaatccctaataaacccgcgttacgaaatcaaaaacgaccgcgactcgaattcgaaaaacgattcttcccaaaaacgaaccgaaacgtccctccccctaccctttcccttctaccaatctccacttaactttcctaccaatacacct

SEQ ID NO: 5233 - DNA, 575 bp, Artificial Sequence
  chemically treated genomic DNA (Homo sapiens) CpG-island No: 5233
  misc_feature (445)..(445): n is either a, c, g or t
ttgttagtagcgtcgcgttacgggcgatattaaaattttgttttagcgtttgttgtatataattttagtaaatatcgtcgagggtcgtcgtttttagcgtcgggttacgcgttagtaggttacgtattaaatgagcggagagattttttgtacgtacgttacgaaaagtatcgtttttcgaacggtttatcggggtgcgaattgtatcgataatgataatttgttttattgtgattttttaagtcgtttttaggtcgttaatcggacgggttggtttaatcggaggatagtacggttcgttatgacgcgttttattacgtagatttttcggtattttatatagcgggtcgaggtgttgatattgttgtgttatatcgaggtattttgcgttatcgagggtgtttagttagcggaacgcgtcgtcgtggaacggagggaagtttangtcgtaaattagcgttatattcgttttcggcggagtggcgataatgtttttttttaaatagcgtattatttcgttgattaatcggattattatgcgttattttgtaggttttagtttttcgttgagtata

SEQ ID NO: 5234 - DNA, 575 bp, Artificial Sequence
  chemically treated genomic DNA (Homo sapiens) CpG-island No: 5234
  misc_feature (131)..(131): n is either a, c, g or t
tatactcaacgaaaaactaaaacctacaaaataacgcataataatccgattaatcaacgaaataatacgctatttaaaaaaaaacattatcgccactccgccgaaaacgaatataacgctaatttacgacntaaacttccctccgttccacgacgacgcgttccgctaactaaacaccctcgataacgcaaaatacctcgatataacacaacaatatcaacacctcgacccgctatataaaataccgaaaaatctacgtaataaaacgcgtcataacgaaccgtactatcctccgattaaaccaacccgtccgattaacgacctaaaaacgacttaaaaaatcacaataaaacaaattatcattatcgatacaattcgcaccccgataaaccgttcgaaaaacgatacttttcgtaacgtacgtacaaaaaatctctccgctcatttaatacgtaacctactaacgcgtaacccgacgctaaaaacgacgaccctcgacgatatttactaaaattatatacaacaaacgctaaaacaaaattttaatatcgcccgtaacgcgacgctactaacaa

SEQ ID NO: 5235 - DNA, 575 bp, Artificial Sequence
  chemically treated genomic DNA (Homo sapiens) CpG-island No: 5235
  misc_feature (131)..(131): n is either a, c, g or t
tatgtttaacgaagaattgagatttgtaggatagcgtatgatgattcgattggttaacgaagtggtgcgttgtttggagaaaggtattatcgttatttcgtcggaagcggatatggcgttggtttacggtntgggttttttttcgttttacggcggcgcgtttcgttggttggatattttcggtagcgtaaaatatttcgatatggtatagtaatattagtatttcggttcgttgtatgaagtgtcggaaggtttgcgtaataaagcgcgttataacgaatcgtattatttttcggttgagttagttcgttcggttggcgatttgaaaacggtttaaggagttataatggaataggttgttattgtcgatgtaattcgtatttcgatgggtcgttcgaagggcggtgtttttcgtaacgtgcgtgtagaagattttttcgtttatttaatgcgtagtttgttggcgcgtaattcggcgttggaagcggcggttttcgacgatatttattggggttgtgtgtagtagacgttggagtagggttttaatatcgttcgtaacgcggcgttgttggtag

SEQ ID NO: 5236 - DNA, 575 bp, Artificial Sequence
  chemically treated genomic DNA (Homo sapiens) CpG-island No: 5236
  misc_feature (445)..(445): n is either a, c, g or t
ctaccaacaacgccgcgttacgaacgatattaaaaccctactccaacgtctactacacacaaccccaataaatatcgtcgaaaaccgccgcttccaacgccgaattacgcgccaacaaactacgcattaaataaacgaaaaaatcttctacacgcacgttacgaaaaacaccgcccttcgaacgacccatcgaaatacgaattacatcgacaataacaacctattccattataactccttaaaccgttttcaaatcgccaaccgaacgaactaactcaaccgaaaaataatacgattcgttataacgcgctttattacgcaaaccttccgacacttcatacaacgaaccgaaatactaatattactataccatatcgaaatattttacgctaccgaaaatatccaaccaacgaaacgcgccgccgtaaaacgaaaaaaaacccanaccgtaaaccaacgccatatccgcttccgacgaaataacgataatacctttctccaaacaacgcaccacttcgttaaccaatcgaatcatcatacgctatcctacaaatctcaattcttcgttaaacata

SEQ ID NO: 5237 - DNA, 513 bp, Artificial Sequence
  chemically treated genomic DNA (Homo sapiens) CpG-island No: 5237
tcgcgattatttttgaggttaatttcggaacgattgttaatggcgttttgcgttgggtcgttagttggcgtagcgtttgatttacgtcgtcgttatacgtttttattaatttatcggtgttaagtaatatgtcgtcgtagtatcgtattattatagcggtaattttttcgacgtcgttgtttattagttgggcgagtatcggtttatttgtcgttttcgtcggtttttcgtcgttagagaaatttagttgttgagaattattcggcgtattcgcgatttacgttacgtaatggtgtcgggtatcggggtgttttgttcgtatcgatttaataaacgttttcgtcgttttaacgttatcggtatgcgttaatatcgttatgaagcggttttttttgatttttttaacgatcgtgatcggtgtcgtaggaattaattagttttttattacgttagttttagatttcgggttatgttttttacgttgttttcgtggattattacgttgttttcgat

SEQ ID NO: 5238 - DNA, 513 bp, Artificial Sequence
  chemically treated genomic DNA (Homo sapiens) CpG-island No: 5238
atcgaaaacaacgtaataatccacgaaaacaacgtaaaaaacataacccgaaatctaaaactaacgtaataaaaaactaattaattcctacgacaccgatcacgatcgttaaaaaaatcaaaaaaaaccgcttcataacgatattaacgcataccgataacgttaaaacgacgaaaacgtttattaaatcgatacgaacaaaacaccccgatacccgacaccattacgtaacgtaaatcgcgaatacgccgaataattctcaacaactaaatttctctaacgacgaaaaaccgacgaaaacgacaaataaaccgatactcgcccaactaataaacaacgacgtcgaaaaaattaccgctataataatacgatactacgacgacatattacttaacaccgataaattaataaaaacgtataacgacgacgtaaatcaaacgctacgccaactaacgacccaacgcaaaacgccattaacaatcgttccgaaattaacctcaaaaataatcgcga

SEQ ID NO: 5239 - DNA, 513 bp, Artificial Sequence
  chemically treated genomic DNA (Homo sapiens) CpG-island No: 5239
atcgaagataacgtggtgatttacgaaaataacgtggaaaatatgattcgggatttgaaattggcgtgatggaaagttggttaatttttgcggtatcggttacggtcgttgaagagattaaaaagagtcgttttataacgatgttggcgtatatcgatggcgttgaggcggcgaaagcgtttgttgaatcggtgcgggtagaatatttcgatgttcggtattattgcgtggcgtgggtcgcgggtgcgtcggatgatttttaatagttgggtttttttgacgacggggagtcggcgggaacggtaggtaaatcgatgttcgtttagttaatgggtagcggcgtcggggaaattatcgttgtggtagtgcgatattacggcggtatattgtttggtatcggtgggttagtgaaagcgtatggcggcggcgtgaattaggcgttgcgttagttaacgatttaacgtaagacgttattaatagtcgtttcgagattagttttaaagatagtcgcga

SEQ ID NO: 5240 - DNA, 513 bp, Artificial Sequence
  chemically treated genomic DNA (Homo sapiens) CpG-island No: 5240
tcgcgactatctttaaaactaatctcgaaacgactattaataacgtcttacgttaaatcgttaactaacgcaacgcctaattcacgccgccgccatacgctttcactaacccaccgataccaaacaatataccgccgtaatatcgcactaccacaacgataatttccccgacgccgctacccattaactaaacgaacatcgatttacctaccgttcccgccgactccccgtcgtcaaaaaaacccaactattaaaaatcatccgacgcacccgcgacccacgccacgcaataataccgaacatcgaaatattctacccgcaccgattcaacaaacgctttcgccgcctcaacgccatcgatatacgccaacatcgttataaaacgactctttttaatctcttcaacgaccgtaaccgataccgcaaaaattaaccaactttccatcacgccaatttcaaatcccgaatcatattttccacgttattttcgtaaatcaccacgttatcttcgat

SEQ ID NO: 5241 - DNA, 554 bp, Artificial Sequence
  chemically treated genomic DNA (Homo sapiens) CpG-island No: 5241
atcggttcgttcgttagcgttttcggcgatacgtggtcgaagtaggcgttcgtcgatacgttcgagaagcgcgtatcggtgatgagcgatatcgttttgttttacgagatatgttttagcgcggaggtgagttggtaggttttttttatgtcggtgtcggacggttcgtcgtcgattattattatgatatcgttttgtataattttttttcgtttgatcgttttgatcgtttgcgtttcgagataaatattcgtattcggtcggtgtggtggtatacgttattttcgtttattatcgacgggtcgatcgtcgtggttttgattatcgaatttttcggcgcgatgttgttcgtcgggaagtagattcgttaggttaggtttttcgtttttgtttttttcggcgggaggattacgtaattcgggtttacgtcgttttggtcgcgtaagtatttgcgggagcgcgtttcgcgtttggatattttgtttattttaaggtttttgttttcgtttgggtcggtatagggttttggagagttatttggttttttttttggg

SEQ ID NO: 5242 - DNA, 554 bp, Artificial Sequence
  chemically treated genomic DNA (Homo sapiens) CpG-island No: 5242
cccaaaaaaaaaaccaaataactctccaaaaccctataccgacccaaacgaaaacaaaaaccttaaaataaacaaaatatccaaacgcgaaacgcgctcccgcaaatacttacgcgaccaaaacgacgtaaacccgaattacgtaatcctcccgccgaaaaaaacaaaaacgaaaaacctaacctaacgaatctacttcccgacgaacaacatcgcgccgaaaaattcgataatcaaaaccacgacgatcgacccgtcgataataaacgaaaataacgtataccaccacaccgaccgaatacgaatatttatctcgaaacgcaaacgatcaaaacgatcaaacgaaaaaaaattatacaaaacgatatcataataataatcgacgacgaaccgtccgacaccgacataaaaaaaacctaccaactcacctccgcgctaaaacatatctcgtaaaacaaaacgatatcgctcatcaccgatacgcgcttctcgaacgtatcgacgaacgcctacttcgaccacgtatcgccgaaaacgctaacgaacgaaccgat

SEQ ID NO: 5243 - DNA, 554 bp, Artificial Sequence
  chemically treated genomic DNA (Homo sapiens) CpG-island No: 5243
tttaaaaaagaaattaagtaattttttaaagttttgtgtcggtttagacgggggtaaagattttgaaatgggtaaggtgtttaagcgcggggcgcgttttcgtaagtgtttgcgcgattaggacggcgtagattcggattacgtgattttttcgtcggagaaggtaaaagcgaaaggtttgatttgacgggtttgtttttcgacgggtaatatcgcgtcggaaggttcggtgattaaggttacggcgatcgattcgtcggtggtgggcgaagatggcgtatattattatatcggtcgggtgcgggtgtttgtttcgaagcgtaggcgattaaggcgattaagcgggaagagattgtgtagggcgatattatggtggtgatcggcggcgggtcgttcggtatcggtatggaagagatttattagtttattttcgcgttaaagtatatttcgtggggtaagacggtgtcgtttattatcgatgcgcgtttttcgggcgtgtcgacgggcgtttgtttcggttacgtgtcgtcggaggcgttggcgggcgggtcgat

SEQ ID NO: 5244 - DNA, 554 bp, Artificial Sequence
  chemically treated genomic DNA (Homo sapiens) CpG-island No: 5244
atcgacccgcccgccaacgcctccgacgacacgtaaccgaaacaaacgcccgtcgacacgcccgaaaaacgcgcatcgataataaacgacaccgtcttaccccacgaaatatactttaacgcgaaaataaactaataaatctcttccataccgataccgaacgacccgccgccgatcaccaccataatatcgccctacacaatctcttcccgcttaatcgccttaatcgcctacgcttcgaaacaaacacccgcacccgaccgatataataatatacgccatcttcgcccaccaccgacgaatcgatcgccgtaaccttaatcaccgaaccttccgacgcgatattacccgtcgaaaaacaaacccgtcaaatcaaacctttcgcttttaccttctccgacgaaaaaatcacgtaatccgaatctacgccgtcctaatcgcgcaaacacttacgaaaacgcgccccgcgcttaaacaccttacccatttcaaaatctttacccccgtctaaaccgacacaaaactttaaaaaattacttaatttcttttttaaa

SEQ ID NO: 5245 - DNA, 656 bp, Artificial Sequence
  chemically treated genomic DNA (Homo sapiens) CpG-island No: 5245
cggcggaattcgggtgttttaattaaatatgggtattaaggtaagtcggcgcgattacgtgatatgtatcgcgcgttcgcgttcgcgtttttttttacgtttcggttttcgaggtttttatggcgttcgcgttttttttttagtcgagttttagtatttatttcggggggtagagtcgtagtttttcgattttttttaggaaggaaaaaagcgttcgtatttgttcgttggttatcgtcgacgatagattcgttatttgaattatcgacgtgggggtgaggtcgaagtttaagtttaaatcgaagtcgtcgtcgttgtttatttcgatttcgttgtcgttgttttttcgttttttaacgtttacgacgcgttagcgacggagtcgggaaagcggagaacgcgcggtcgcgagcgcgttttcgttggcgaatttatagcgtcgggtagatttagtcgtttattttataatttttttgttttcggggttgcgcgcgttagtcggaagcgtcgtttcggtaattcggcggttttcgcgcggttgcggtttttagttttcgggtttttggggttgttgttgttcgttttatcgtttggatttttatcggtgtttttgttttttttaaaagtcgatgagagttttgtgtttatgtttattt

SEQ ID NO: 5246 - DNA, 656 bp, Artificial Sequence
  chemically treated genomic DNA (Homo sapiens) CpG-island No: 5246
aaataaacataaacacaaaactctcatcgacttttaaaaaaaacaaaaacaccgataaaaatccaaacgataaaacgaacaacaacaaccccaaaaacccgaaaactaaaaaccgcaaccgcgcgaaaaccgccgaattaccgaaacgacgcttccgactaacgcgcgcaaccccgaaaacaaaaaaattataaaataaacgactaaatctacccgacgctataaattcgccaacgaaaacgcgctcgcgaccgcgcgttctccgctttcccgactccgtcgctaacgcgtcgtaaacgttaaaaaacgaaaaaacaacgacaacgaaatcgaaataaacaacgacgacgacttcgatttaaacttaaacttcgacctcacccccacgtcgataattcaaataacgaatctatcgtcgacgataaccaacgaacaaatacgaacgcttttttccttcctaaaaaaaatcgaaaaactacgactctaccccccgaaataaatactaaaactcgactaaaaaaaaaacgcgaacgccataaaaacctcgaaaaccgaaacgtaaaaaaaaacgcgaacgcgaacgcgcgatacatatcacgtaatcgcgccgacttaccttaatacccatatttaattaaaacacccgaattccgccg

SEQ ID NO: 5247 - DNA, 656 bp, Artificial Sequence
  chemically treated genomic DNA (Homo sapiens) CpG-island No: 5247
gggtagatatgagtataagatttttatcgatttttggggaaaataaaaatatcgataaaaatttaggcggtgaaacgagtagtaatagttttagggattcgggagttggaggtcgtagtcgcgcgagaatcgtcgggttgtcggggcgacgttttcggttggcgcgcgtagtttcgggagtaggggagttgtgaaatgggcggttagatttgttcggcgttgtgaattcgttagcgggagcgcgttcgcggtcgcgcgtttttcgttttttcggtttcgtcgttgacgcgtcgtagacgttggggagcgggaaggtaacggtagcgggatcgggatgaatagcggcggcggtttcggtttgggtttaagtttcggttttatttttacgtcggtgatttaggtgacgaatttgtcgtcggcggtgattagcgagtagatgcggacgttttttttttttttaggagaaatcgaggagttgcggttttatttttcggagtaagtgttggagttcggttgggggaggggcgcgggcgttatagagatttcgggagtcgaggcgtggaggagagcgcggacgcgggcgcgcggtgtatgttacgtgatcgcgtcggtttattttggtgtttatatttgattagggtattcgggtttcgtcg

SEQ ID NO: 5248 - DNA, 656 bp, Artificial Sequence
  chemically treated genomic DNA (Homo sapiens) CpG-island No: 5248
cgacgaaacccgaataccctaatcaaatataaacaccaaaataaaccgacgcgatcacgtaacatacaccgcgcgcccgcgtccgcgctctcctccacgcctcgactcccgaaatctctataacgcccgcgcccctcccccaaccgaactccaacacttactccgaaaaataaaaccgcaactcctcgatttctcctaaaaaaaaaaaaaacgtccgcatctactcgctaatcaccgccgacgacaaattcgtcacctaaatcaccgacgtaaaaataaaaccgaaacttaaacccaaaccgaaaccgccgccgctattcatcccgatcccgctaccgttaccttcccgctccccaacgtctacgacgcgtcaacgacgaaaccgaaaaaacgaaaaacgcgcgaccgcgaacgcgctcccgctaacgaattcacaacgccgaacaaatctaaccgcccatttcacaactcccctactcccgaaactacgcgcgccaaccgaaaacgtcgccccgacaacccgacgattctcgcgcgactacgacctccaactcccgaatccctaaaactattactactcgtttcaccgcctaaatttttatcgatatttttattttccccaaaaatcgataaaaatcttatactcatatctaccc

SEQ ID NO: 5249 - DNA, 863 bp, Artificial Sequence
  chemically treated genomic DNA (Homo sapiens) CpG-island No: 5249
gtgttcggcgtaagaggcgatacgtttttggagtagtcgggatttttcgttcgagttcggtacgtttcgttttacgcggagtttcggaggtcggacgggaagatttcggggtagtttttcgggtttttttttgttttttttcgttcgtttagggtataggatttttcggacggttgagcgtcgcggggttagttcgagcgatttattcgggttttacgttcggtcgcggagttgggagcgtatttaggtaggttttttacgtttggatttttggttcggtttttcgatttgataattttcgcgttgcgttcggtttcgtttatttggttcgtatagtattgagttgatatcgcggcggttaatgtcgaaggcgcgttcgttggtttttcgcgtcgtacgggtttttttggttgtttcgcgtttcgagcgttgggtttagtcgtagtttatatttgaacgaagattagtttcggcgaagcgtttaggcgtcgaggtttgggtaaaaataattgcggttaagtttcgtttcgtcgtcggtttcgtttcgttcgtttttagtttcgtttcgtgttcgttttttttcgggcgttcggcggcggagtaggttcgattcgggttcgtattttcgttggcgttaggcgggtgggttgttgcgattatttttcggttggggcgtcgagtttcggagtcggtcgttagtttttgggttttacgtttcgggtttggtgcgcggtttggtcgcgttcgggttttcgttaaatgagagcgtagcgttttttcgttttcggatttagagaaagagtttgttgttgtttttaaaaggttggagttttagtaagcggtttttgttttttttgtataga

SEQ ID NO: 5250 - DNA, 863 bp, Artificial Sequence
  chemically treated genomic DNA (Homo sapiens) CpG-island No: 5250
tctatacaaaaaaaacaaaaaccgcttactaaaactccaaccttttaaaaacaacaacaaactctttctctaaatccgaaaacgaaaaaacgctacgctctcatttaacgaaaacccgaacgcgaccaaaccgcgcaccaaacccgaaacgtaaaacccaaaaactaacgaccgactccgaaactcgacgccccaaccgaaaaataatcgcaacaacccacccgcctaacgccaacgaaaatacgaacccgaatcgaacctactccgccgccgaacgcccgaaaaaaaacgaacacgaaacgaaactaaaaacgaacgaaacgaaaccgacgacgaaacgaaacttaaccgcaattatttttacccaaacctcgacgcctaaacgcttcgccgaaactaatcttcgttcaaatataaactacgactaaacccaacgctcgaaacgcgaaacaaccaaaaaaacccgtacgacgcgaaaaaccaacgaacgcgccttcgacattaaccgccgcgatatcaactcaatactatacgaaccaaataaacgaaaccgaacgcaacgcgaaaattatcaaatcgaaaaaccgaaccaaaaatccaaacgtaaaaaacctacctaaatacgctcccaactccgcgaccgaacgtaaaacccgaataaatcgctcgaactaaccccgcgacgctcaaccgtccgaaaaatcctataccctaaacgaacgaaaaaaaacaaaaaaaaacccgaaaaactaccccgaaatcttcccgtccgacctccgaaactccgcgtaaaacgaaacgtaccgaactcgaacgaaaaatcccgactactccaaaaacgtatcgcctcttacgccgaacac

SEQ ID NO: 5251 - DNA, 863 bp, Artificial Sequence
  chemically treated genomic DNA (Homo sapiens) CpG-island No: 5251
tttgtgtaggaaaggtaggaatcgtttattaaggttttaattttttagaggtagtaataagttttttttttggattcgaaggcggagaggcgttgcgtttttatttggcgagggttcgagcgcggttagatcgcgtattagattcggagcgtggggtttaaaggttggcggtcgatttcggagttcggcgttttaatcgggaagtgatcgtagtagtttattcgtttgacgttagcggaagtgcgagttcgggtcgagtttgtttcgtcgtcgggcgttcgggaaggggcgggtacggggcggggttgggggcgggcgaggcggggtcggcggcggggcggggtttggtcgtagttgtttttatttaggtttcggcgtttaggcgtttcgtcgaggttgattttcgtttaagtgtgagttgcggttgagtttagcgttcgaggcgcgaggtagttaggagggttcgtgcggcgcggggagttagcgagcgcgttttcggtattggtcgtcgcgatgttagtttagtgttgtgcgggttaggtgagcgaggtcgggcgtagcgcgggggttgttagatcggagaatcgggttaggagtttaggcgtggaggatttgtttgggtgcgtttttagtttcgcggtcgaacgtagggttcgggtgggtcgttcgggttggtttcgcggcgtttagtcgttcgggaaattttgtgttttgggcgggcgggaaggggtagggggaagttcgagaggttatttcggggttttttcgttcggttttcgggatttcgcgtggagcggggcgtgtcgggttcgggcggaggatttcgattgttttaggggcgtgtcgttttttgcgtcgagtat

SEQ ID NO: 5252 - DNA, 863 bp, Artificial Sequence
  chemically treated genomic DNA (Homo sapiens) CpG-island No: 5252
atactcgacgcaaaaaacgacacgcccctaaaacaatcgaaatcctccgcccgaacccgacacgccccgctccacgcgaaatcccgaaaaccgaacgaaaaaaccccgaaataacctctcgaacttccccctaccccttcccgcccgcccaaaacacaaaatttcccgaacgactaaacgccgcgaaaccaacccgaacgacccacccgaaccctacgttcgaccgcgaaactaaaaacgcacccaaacaaatcctccacgcctaaactcctaacccgattctccgatctaacaacccccgcgctacgcccgacctcgctcacctaacccgcacaacactaaactaacatcgcgacgaccaataccgaaaacgcgctcgctaactccccgcgccgcacgaaccctcctaactacctcgcgcctcgaacgctaaactcaaccgcaactcacacttaaacgaaaatcaacctcgacgaaacgcctaaacgccgaaacctaaataaaaacaactacgaccaaaccccgccccgccgccgaccccgcctcgcccgcccccaaccccgccccgtacccgccccttcccgaacgcccgacgacgaaacaaactcgacccgaactcgcacttccgctaacgtcaaacgaataaactactacgatcacttcccgattaaaacgccgaactccgaaatcgaccgccaacctttaaaccccacgctccgaatctaatacgcgatctaaccgcgctcgaaccctcgccaaataaaaacgcaacgcctctccgccttcgaatccaaaaaaaaaacttattactacctctaaaaaattaaaaccttaataaacgattcctacctttcctacacaaa

SEQ ID NO: 5253 - DNA, 662 bp, Artificial Sequence
  chemically treated genomic DNA (Homo sapiens) CpG-island No: 5253
ggaagcgggggaggcgggggggtagcgtgttgtaaaattagtttgaagtaaataaaaagttatgtttttcgaggggttagtagcgcggagagtaggtttagttcgttgtcgggaaggcgggtttgtttagtagagatcggaacgtcgcgtaggtttagtaaagggttaaggttggggtcggggaagttgtttttaggttagcgaagggtaaaggaagttagatattgacgcgagtggtttttcgatttcgtagtcgagtggagaatcgagtttcgatttaaggtcgaattattaggcgttttcgttatttaataatttatttaggtattttcggtaagaaatttagtgtttttggttcggaatttgcgtcgtagtgcgtaagcgtttcgggtttggagacggtcgcggatgtcgagggagggggcgtgtgagtcgaagaggaaagcgttttttgcgtttgcgttttttgcgttgttcggtggggcggggaaagaagttttgagtcgggatttggtatttttaggattttcggtcggggtagttttttattttttagcgcgacgtcgtgtcgagtttttaaaaagtttcgtaggggttgtagggaggtaagagtttttcgtgatcggtcgtttcggtttttttttagttttgttgtttttata

SEQ ID NO: 5254 - DNA, 662 bp, Artificial Sequence
  chemically treated genomic DNA (Homo sapiens) CpG-island No: 5254
tataaaaacaacaaaactaaaaaaaaaccgaaacgaccgatcacgaaaaactcttacctccctacaacccctacgaaactttttaaaaactcgacacgacgtcgcgctaaaaaataaaaaactaccccgaccgaaaatcctaaaaataccaaatcccgactcaaaacttctttccccgccccaccgaacaacgcaaaaaacgcaaacgcaaaaaacgctttcctcttcgactcacacgccccctccctcgacatccgcgaccgtctccaaacccgaaacgcttacgcactacgacgcaaattccgaaccaaaaacactaaatttcttaccgaaaatacctaaataaattattaaataacgaaaacgcctaataattcgaccttaaatcgaaactcgattctccactcgactacgaaatcgaaaaaccactcgcgtcaatatctaacttcctttacccttcgctaacctaaaaacaacttccccgaccccaaccttaaccctttactaaacctacgcgacgttccgatctctactaaacaaacccgccttcccgacaacgaactaaacctactctccgcgctactaacccctcgaaaaacataactttttatttacttcaaactaattttacaacacgctacccccccgcctcccccgcttcc

SEQ ID NO: 5255 - DNA, 662 bp, Artificial Sequence
  chemically treated genomic DNA (Homo sapiens) CpG-island No: 5255
tgtgggaatagtagggttgaggggaggtcgagacgatcggttacggggggtttttatttttttatagtttttgcggagttttttgggaattcgatacgacgtcgcgttgaggagtgaagagttatttcggtcgggagttttgggagtgttagatttcggtttagggttttttttttcgttttatcgggtagcgtagagagcgtaggcgtagaggacgttttttttttcggtttatacgttttttttttcggtattcgcggtcgtttttaggttcggggcgtttgcgtattacgacgtaggtttcgagttaagggtattagattttttatcggaagtgtttgagtgggttgttgggtgacggggacgtttgatgattcgattttaggtcgggattcggttttttattcgattgcgggatcgggaggttattcgcgttagtgtttgattttttttatttttcgttaatttagaggtagttttttcggttttagttttagttttttgttgagtttgcgcggcgtttcggtttttattggatagattcgttttttcggtagcgggttaggtttgtttttcgcgttgttggtttttcggaaaatataattttttgtttattttaaattgattttataatacgttgttttttcgtttttttcgttttt

SEQ ID NO: 5256 - DNA, 662 bp, Artificial Sequence
  chemically treated genomic DNA (Homo sapiens) CpG-island No: 5256
aaaaacgaaaaaaacgaaaaaacaacgtattataaaatcaatttaaaataaacaaaaaattatattttccgaaaaaccaacaacgcgaaaaacaaacctaacccgctaccgaaaaaacgaatctatccaataaaaaccgaaacgccgcgcaaactcaacaaaaaactaaaactaaaaccgaaaaaactacctctaaattaacgaaaaataaaaaaaatcaaacactaacgcgaataacctcccgatcccgcaatcgaataaaaaaccgaatcccgacctaaaatcgaatcatcaaacgtccccgtcacccaacaacccactcaaacacttccgataaaaaatctaatacccttaactcgaaacctacgtcgtaatacgcaaacgccccgaacctaaaaacgaccgcgaataccgaaaaaaaaaacgtataaaccgaaaaaaaaaacgtcctctacgcctacgctctctacgctacccgataaaacgaaaaaaaaaaccctaaaccgaaatctaacactcccaaaactcccgaccgaaataactcttcactcctcaacgcgacgtcgtatcgaattcccaaaaaactccgcaaaaactataaaaaaataaaaaccccccgtaaccgatcgtctcgacctcccctcaaccctactattcccaca

SEQ ID NO: 5257 - DNA, 943 bp, Artificial Sequence
  chemically treated genomic DNA (Homo sapiens) CpG-island No: 5257
  misc_feature (239)..(239): n is either a, c, g or t
  misc_feature (335)..(335): n is either a, c, g or t
tgttgcgtcgtaggtatgttatttagacgttggtttacgtaggttagttgtcggattagtgtcggatcgttcggaagttttttatgcgtcggttcgagtatttttcgcgattgtgcgatattatcgttattttataaggcgtaattaagcgttgtttgggtgttgttattattcggttttagttttagcgcggcgcgtaaattatttatcgcggtcgggatattatgacgttggcgatnaattgtcgttcgcgtaacgtaagcgttggtagaaggcgtaatattgattgagcgcgtgagatcgtttagtgcgagtttcggttgattaggaatgtnacgttgcgtatgtagttattagtagagggtattgttttttagtttacgtttttttgtttgttgtagttagcgatcgcgagtcgtattattttttgtcgtttgggcggttattggtagtagtaagtagatttttatggtttatgtcgtgaagattgattttttgttaggtcgttagtgcggtggcgtagtttttaatttgatacgtttgataggttatcgtacgatgttgttaggcgttcggttgtcgttgttcggtttgaagttatgtatataacgttatatcgggtagcgtgtttcgataatattttgttagacggttttaggcggcggtatcgtaggaaggcgatatatcgtttagtaagcgaattattgtcgggtaattatttgtaatattcggtaattgattttgttattgacgttgtttcgttagcggtaagggtttcgataaaatcgttattttcgtcggcgttgttaggtaaggatgattttttagtagagacgttagtcgcgttattaaagtttggttgatacgcgtatcgtttggaaaggatagcgttgtagtaataaatcggtagtttcgcgtgattgttcgttttgtattagttgtt

SEQ ID NO: 5258 - DNA, 943 bp, Artificial Sequence
  chemically treated genomic DNA (Homo sapiens) CpG-island No: 5258
  misc_feature (609)..(609): n is either a, c, g or t
  misc_feature (705)..(705): n is either a, c, g or t
aacaactaatacaaaacgaacaatcacgcgaaactaccgatttattactacaacgctatcctttccaaacgatacgcgtatcaaccaaactttaataacgcgactaacgtctctactaaaaaatcatccttacctaacaacgccgacgaaaataacgattttatcgaaacccttaccgctaacgaaacaacgtcaataacaaaatcaattaccgaatattacaaataattacccgacaataattcgcttactaaacgatatatcgccttcctacgataccgccgcctaaaaccgtctaacaaaatattatcgaaacacgctacccgatataacgttatatacataacttcaaaccgaacaacgacaaccgaacgcctaacaacatcgtacgataacctatcaaacgtatcaaattaaaaactacgccaccgcactaacgacctaacaaaaaatcaatcttcacgacataaaccataaaaatctacttactactaccaataaccgcccaaacgacaaaaaataatacgactcgcgatcgctaactacaacaaacaaaaaaacgtaaactaaaaaacaataccctctactaataactacatacgcaacgtnacattcctaatcaaccgaaactcgcactaaacgatctcacgcgctcaatcaatattacgccttctaccaacgcttacgttacgcgaacgacaattnatcgccaacgtcataatatcccgaccgcgataaataatttacgcgccgcgctaaaactaaaaccgaataataacaacacccaaacaacgcttaattacgccttataaaataacgataatatcgcacaatcgcgaaaaatactcgaaccgacgcataaaaaacttccgaacgatccgacactaatccgacaactaacctacgtaaaccaacgtctaaataacatacctacgacgcaaca

SEQ ID NO: 5259 - DNA, 943 bp, Artificial Sequence
  chemically treated genomic DNA (Homo sapiens) CpG-island No: 5259
  misc_feature (609)..(609): n is either a, c, g or t
  misc_feature (705)..(705): n is either a, c, g or t
ggtaattgatgtagaacgagtagttacgcgaagttgtcgatttattgttgtaacgttattttttttaggcgatgcgcgtgttagttagattttaatggcgcgattggcgtttttgttggaaagttatttttatttggtaacgtcggcgaaggtggcgattttatcgaaatttttatcgttggcggagtaacgttagtggtaaagttagttgtcgggtattgtagataattgttcggtaatagttcgtttgttgggcgatatgtcgtttttttacgatgtcgtcgtttggaatcgtttggtaaagtgttatcgggatacgttattcggtgtggcgttgtatgtatggttttaggtcgaataacgataatcgagcgtttggtaatatcgtgcggtagtttattaggcgtattaggttgaggattacgttatcgtattggcggtttggtagaaaattagtttttacgatatgagttatgaggatttgtttgttgttgttaataatcgtttaggcggtaggaaatggtgcggttcgcgatcgttggttataataggtagaaaaacgtggattgggaagtaatgttttttattggtggttgtatgcgtaacgtnatatttttggttagtcggaattcgtattgaacgattttacgcgtttaattaatattgcgttttttgttaacgtttacgttgcgcgggcgataattnatcgttaacgttataatgtttcggtcgcggtgagtgatttgcgcgtcgcgttggaattggaatcgaataatagtaatatttaggtagcgtttggttacgttttgtgggatagcggtgatatcgtatagtcgcgggaaatgttcgaatcggcgtataaagggttttcggacgattcggtattgattcgataattggtttacgtgaattagcgtttggatgatatgtttgcgacgtagta

SEQ ID NO: 5260 - DNA, 943 bp, Artificial Sequence
  chemically treated genomic DNA (Homo sapiens) CpG-island No: 5260
  misc_feature (239)..(239): n is either a, c, g or t
  misc_feature (335)..(335): n is either a, c, g or t
tactacgtcgcaaacatatcatccaaacgctaattcacgtaaaccaattatcgaatcaataccgaatcgtccgaaaaccctttatacgccgattcgaacatttcccgcgactatacgatatcaccgctatcccacaaaacgtaaccaaacgctacctaaatattactattattcgattccaattccaacgcgacgcgcaaatcactcaccgcgaccgaaacattataacgttaacgatnaattatcgcccgcgcaacgtaaacgttaacaaaaaacgcaatattaattaaacgcgtaaaatcgttcaatacgaattccgactaaccaaaaatatnacgttacgcatacaaccaccaataaaaaacattacttcccaatccacgtttttctacctattataaccaacgatcgcgaaccgcaccatttcctaccgcctaaacgattattaacaacaacaaacaaatcctcataactcatatcgtaaaaactaattttctaccaaaccgccaatacgataacgtaatcctcaacctaatacgcctaataaactaccgcacgatattaccaaacgctcgattatcgttattcgacctaaaaccatacatacaacgccacaccgaataacgtatcccgataacactttaccaaacgattccaaacgacgacatcgtaaaaaaacgacatatcgcccaacaaacgaactattaccgaacaattatctacaatacccgacaactaactttaccactaacgttactccgccaacgataaaaatttcgataaaatcgccaccttcgccgacgttaccaaataaaaataactttccaacaaaaacgccaatcgcgccattaaaatctaactaacacgcgcatcgcctaaaaaaaataacgttacaacaataaatcgacaacttcgcgtaactactcgttctacatcaattacc

SEQ ID NO: 5261 - DNA, 975 bp, Artificial Sequence
  chemically treated genomic DNA (Homo sapiens) CpG-island No: 5261
tcggtttagttatgttttattgttggaagttgttagtttaagttcgtcgtagtttcgtcgttttgtttataacgatgttatttatttggcgcgattgtttgtttttttttgttcggggtagtaaatggtggtgatagaaggcgtgtttagtatggacggcgatagtgcgttattggcggaaatttagtaggtaacgtaatagtataatggttggttgatggtcgatgatgtttacggtacgggcgttatcggggagtaggggcgcggtagttgttggttgtaaaaggtaaaattagaattgttggtagtgatttttggtaaaggatttggcgttagcggggtagcggtgttttgttttagtacggtggcggattatttgttgtaattcgttcgttattttatttatagtattagtatgtcgttcgtttaggcgtaggtattacgtgcgtcgttggcggttattcgtagtgatgagggtgatgtacggcgcgaaaaattggcggtatttattacgcgttttcgtgtcggagtataggatttgtcgtttacgtttgttgatttatgtagcgttatttagttattgattgtcggtgataatagtcgtgcgttatagttggtagaaaaattgcgttagtaaggttgttgggttacggcgattcgttcgttattcgtattcgttggtattgcgcgattgcgtttaacgttaatcgttgcgtatgaaatgtaggatatcgttcgtttgttggaggtgttgtatggtaacggttaataaataagttattgtagcggtatttggtcgggtagtcgtatattatgagtaatatgtagatttatagcgttagagtgttgacgttttattggtaatgtttttatagcgtaaatatatttacgtattggacgcgggttgtggatttggttggatgagtcgttattggcgggaacgttacgcgtaggtgacggttttagatttttcgt

SEQ ID NO: 5262 - DNA, 975 bp, Artificial Sequence
  chemically treated genomic DNA (Homo sapiens) CpG-island No: 5262
acgaaaaatctaaaaccgtcacctacgcgtaacgttcccgccaataacgactcatccaaccaaatccacaacccgcgtccaatacgtaaatatatttacgctataaaaacattaccaataaaacgtcaacactctaacgctataaatctacatattactcataatatacgactacccgaccaaataccgctacaataacttatttattaaccgttaccatacaacacctccaacaaacgaacgatatcctacatttcatacgcaacgattaacgttaaacgcaatcgcgcaataccaacgaatacgaataacgaacgaatcgccgtaacccaacaaccttactaacgcaatttttctaccaactataacgcacgactattatcaccgacaatcaataactaaataacgctacataaatcaacaaacgtaaacgacaaatcctatactccgacacgaaaacgcgtaataaataccgccaatttttcgcgccgtacatcaccctcatcactacgaataaccgccaacgacgcacgtaatacctacgcctaaacgaacgacatactaatactataaataaaataacgaacgaattacaacaaataatccgccaccgtactaaaacaaaacaccgctaccccgctaacgccaaatcctttaccaaaaatcactaccaacaattctaattttaccttttacaaccaacaactaccgcgcccctactccccgataacgcccgtaccgtaaacatcatcgaccatcaaccaaccattatactattacgttacctactaaatttccgccaataacgcactatcgccgtccatactaaacacgccttctatcaccaccatttactaccccgaacaaaaaaaaacaaacaatcgcgccaaataaataacatcgttataaacaaaacgacgaaactacgacgaacttaaactaacaacttccaacaataaaacataactaaaccga

SEQ ID NO: 5263 - DNA, 975 bp, Artificial Sequence
  chemically treated genomic DNA (Homo sapiens) CpG-island No: 5263
gcgagagatttaaggtcgttatttgcgcgtgacgttttcgttagtggcggtttatttagttaggtttataattcgcgtttagtacgtgggtgtatttacgttgtggaagtattgttagtaaggcgttagtattttggcgttgtagatttgtatgttgtttatagtgtgcggttgttcgattaaatgtcgttgtaatggtttgtttattaatcgttgttatgtagtatttttagtagacggacgatattttgtattttatgcgtagcggttagcgttaagcgtagtcgcgtagtattagcgggtacggatggcgggcgaatcgtcgtgatttagtagttttgttgacgtagtttttttgttagttgtaacgtacggttgttattatcgataattaatggttggatggcgttgtatgaattagtaggcgtggacggtaaattttgtatttcggtacgaaaacgcgtaatgagtgtcgttagtttttcgcgtcgtgtattatttttattattgcgaatgatcgttagcgacgtacgtaatgtttgcgtttgagcgggcggtatattggtgttgtagataaggtggcgggcgaattgtagtagataattcgttatcgtattggagtaaagtatcgttgtttcgttgacgttaaattttttgttaaaagttattattagtaattttggttttattttttgtagttagtagttgtcgcgtttttgtttttcgataacgttcgtgtcgtgggtattatcgattattaattagttattgtgttgttgcgttatttgttggattttcgttagtggcgtattatcgtcgtttatgttgaatacgttttttgttattattatttgttgtttcggatagggggaagtaagtaatcgcgttaaatgagtgatatcgttatgagtaaaacggcgaagttgcgacgggtttaaattggtagtttttagtaatgaggtatggttaagtcgg

SEQ ID NO: 5264 - DNA, 975 bp, Artificial Sequence
  chemically treated genomic DNA (Homo sapiens) CpG-island No: 5264
ccgacttaaccatacctcattactaaaaactaccaatttaaacccgtcgcaacttcgccgttttactcataacgatatcactcatttaacgcgattacttacttccccctatccgaaacaacaaataataataacaaaaaacgtattcaacataaacgacgataatacgccactaacgaaaatccaacaaataacgcaacaacacaataactaattaataatcgataatacccacgacacgaacgttatcgaaaaacaaaaacgcgacaactactaactacaaaaaataaaaccaaaattactaataataacttttaacaaaaaatttaacgtcaacgaaacaacgatactttactccaatacgataacgaattatctactacaattcgcccgccaccttatctacaacaccaatataccgcccgctcaaacgcaaacattacgtacgtcgctaacgatcattcgcaataataaaaataatacacgacgcgaaaaactaacgacactcattacgcgttttcgtaccgaaatacaaaatttaccgtccacgcctactaattcatacaacgccatccaaccattaattatcgataataacaaccgtacgttacaactaacaaaaaaactacgtcaacaaaactactaaatcacgacgattcgcccgccatccgtacccgctaatactacgcgactacgcttaacgctaaccgctacgcataaaatacaaaatatcgtccgtctactaaaaatactacataacaacgattaataaacaaaccattacaacgacatttaatcgaacaaccgcacactataaacaacatacaaatctacaacgccaaaatactaacgccttactaacaatacttccacaacgtaaatacacccacgtactaaacgcgaattataaacctaactaaataaaccgccactaacgaaaacgtcacgcgcaaataacgaccttaaatctctcgc

SEQ ID NO: 5265 - DNA, 579 bp, Artificial Sequence
  chemically treated genomic DNA (Homo sapiens) CpG-island No: 5265
gatcgaggtttgcggtaaaggtcgcggttttggcgatacgcgttagtttttgcgtttgttcggcgttagttttggtattagtatagtaatcggtgtggatttcgaataacggtgcgttaatttttgtcgtagttttgatttgttttttatcggcgttaataaatagagaaatttgaatttcggtatttgttagacgtttgtaggtatcgcgtattttgttacgttgttttgcgatatttaggtcgttttcggttgttattttttgacgttttttcggtattaggtagtaaaaatgtggtttcgttttaacggcgatcgttagtattttttcggttatcgttatttttagatttatgcgggtatttagcgtttgacgtaggatgcgtacgtcgcggttagtaatgtgacggcgatttttacgtaaatgtacggtaatgtcgttcgttttcgtttgttcggtaataaacgcggtttgtatcggattcgggtaagcggtatcgcgcgcgttgcgtagcgtagcgatatggttaatgttgacgtttaatagtaatttagttatgataatttttattatttata

SEQ ID NO: 5266 - DNA, 579 bp, Artificial Sequence
  chemically treated genomic DNA (Homo sapiens) CpG-island No: 5266
tataaataataaaaattatcataactaaattactattaaacgtcaacattaaccatatcgctacgctacgcaacgcgcgcgataccgcttacccgaatccgatacaaaccgcgtttattaccgaacaaacgaaaacgaacgacattaccgtacatttacgtaaaaatcgccgtcacattactaaccgcgacgtacgcatcctacgtcaaacgctaaatacccgcataaatctaaaaataacgataaccgaaaaaatactaacgatcgccgttaaaacgaaaccacatttttactacctaataccgaaaaaacgtcaaaaaataacaaccgaaaacgacctaaatatcgcaaaacaacgtaacaaaatacgcgatacctacaaacgtctaacaaataccgaaattcaaatttctctatttattaacgccgataaaaaacaaatcaaaactacgacaaaaattaacgcaccgttattcgaaatccacaccgattactatactaataccaaaactaacgccgaacaaacgcaaaaactaacgcgtatcgccaaaaccgcgacctttaccgcaaacctcgatc

SEQ ID NO: 5267 - DNA, 579 bp, Artificial Sequence
  chemically treated genomic DNA (Homo sapiens) CpG-island No: 5267
tatgaatgatgaggattgttatggttgaattattgttaggcgttaatattgattatatcgttacgttgcgtaacgcgcgcggtatcgtttattcggattcggtgtaggtcgcgtttattgtcgagtaggcgggagcggacggtattatcgtgtatttacgtgaagatcgtcgttatattattgatcgcgacgtgcgtattttgcgttagacgttggatattcgtatgaatttggagatggcggtgatcgaagagatgttggcgatcgtcgttgagacgaagttatatttttgttgtttggtatcggaaaagcgttaggaagtaataatcgaaggcggtttggatgtcgtagggtagcgtgataaaatgcgcgatgtttgtaaacgtttggtagatgtcgggatttaggtttttttgtttattgacgtcgatgaagagtagattaaagttgcggtagaggttggcgtatcgttattcgagatttatatcggttgttatgttgatgttaaaattgacgtcgaataggcgtaagagttggcgcgtatcgttaaagtcgcgatttttgtcgtaagtttcggtt

SEQ ID NO: 5268 - DNA, 579 bp, Artificial Sequence
  chemically treated genomic DNA (Homo sapiens) CpG-island No: 5268
aaccgaaacttacgacaaaaatcgcgactttaacgatacgcgccaactcttacgcctattcgacgtcaattttaacatcaacataacaaccgatataaatctcgaataacgatacgccaacctctaccgcaactttaatctactcttcatcgacgtcaataaacaaaaaaacctaaatcccgacatctaccaaacgtttacaaacatcgcgcattttatcacgctaccctacgacatccaaaccgccttcgattattacttcctaacgcttttccgataccaaacaacaaaaatataacttcgtctcaacgacgatcgccaacatctcttcgatcaccgccatctccaaattcatacgaatatccaacgtctaacgcaaaatacgcacgtcgcgatcaataatataacgacgatcttcacgtaaatacacgataataccgtccgctcccgcctactcgacaataaacgcgacctacaccgaatccgaataaacgataccgcgcgcgttacgcaacgtaacgatataatcaatattaacgcctaacaataattcaaccataacaatcctcatcattcata

SEQ ID NO: 5269 - DNA, 681 bp, Artificial Sequence
  chemically treated genomic DNA (Homo sapiens) CpG-island No: 5269
ggaatatcgttacgggggaatggaatttgagtacggcggattgatggtataaaaggtggagcggatggatggttgcggcggaagtaagttaaggggagtttataaacggggagtatgcgcgttgttggcggggggggttcgagggggaggacggttgtgttagtgtcgatagcggggagttttatgggggttaggataggtaagaattttaaggggcgtcggtagcgcgggcgcgagttttacgggatatgaatggggtcgaggagcgcggtaattagggttagcgcgggtagatggagattggtagtggcggtaaagagcggtgttgtttgcgaaaggtagggtggcgtagttaaggtttgaaaggaggatgggtatatgggcgatggagagggtcgattaggggttgttggcgcgcgggggtgggtgggggtgttgtcgttattggagatatatttgttggcgtaaattgtatcgggttaagagtttgtcgcgcgtatttgacgtgagaacgggtattacggtcggggtgtaaagtttagtggagtagagatattacggggagagtaatgggtgacggtcgcggagggcgtaaatttgcgtgggtgggggaacggtcgaaaagatggtgttggttatattagtatatatttcggtaattatttaataattatatgtacg

SEQ ID NO: 5270 - DNA, 681 bp, Artificial Sequence
  chemically treated genomic DNA (Homo sapiens) CpG-island No: 5270
cgtacatataattattaaataattaccgaaatatatactaatataaccaacaccatcttttcgaccgttcccccacccacgcaaatttacgccctccgcgaccgtcacccattactctccccgtaatatctctactccactaaactttacaccccgaccgtaatacccgttctcacgtcaaatacgcgcgacaaactcttaacccgatacaatttacgccaacaaatatatctccaataacgacaacacccccacccacccccgcgcgccaacaacccctaatcgaccctctccatcgcccatatacccatcctcctttcaaaccttaactacgccaccctacctttcgcaaacaacaccgctctttaccgccactaccaatctccatctacccgcgctaaccctaattaccgcgctcctcgaccccattcatatcccgtaaaactcgcgcccgcgctaccgacgccccttaaaattcttacctatcctaacccccataaaactccccgctatcgacactaacacaaccgtcctccccctcgaaccccccccgccaacaacgcgcatactccccgtttataaactccccttaacttacttccgccgcaaccatccatccgctccaccttttataccatcaatccgccgtactcaaattccattcccccgtaacgatattcc

SEQ ID NO: 5271 - DNA, 681 bp, Artificial Sequence
  chemically treated genomic DNA (Homo sapiens) CpG-island No: 5271
cgtatatatggttattgggtggttgtcggaatgtgtattaatgtaattaatattattttttcggtcgtttttttatttacgtaaatttacgtttttcgcgatcgttatttattatttttttcgtggtatttttgttttattaaattttatatttcggtcgtagtgttcgtttttacgttaggtgcgcgcggtaagtttttaattcggtgtagtttacgttagtaggtatgtttttaatagcggtaatatttttatttattttcgcgcgttagtagtttttaatcggttttttttatcgtttatatatttattttttttttaggttttaattacgttattttatttttcgtagataatatcgttttttgtcgttattgttaatttttatttgttcgcgttaattttaattatcgcgtttttcggttttatttatgtttcgtggggttcgcgttcgcgttgtcggcgttttttaaggtttttgtttattttggtttttatagagtttttcgttatcggtattaatatagtcgttttttttttcgggtttttttcgttaataacgcgtatgtttttcgtttgtaggttttttttagtttgttttcgtcgtaattatttattcgttttattttttatgttattagttcgtcgtatttaagttttattttttcgtagcggtatttt

SEQ ID NO: 5272 - DNA, 681 bp, Artificial Sequence
  chemically treated genomic DNA (Homo sapiens) CpG-island No: 5272
aaaataccgctacgaaaaaataaaacttaaatacgacgaactaataacataaaaaataaaacgaataaataattacgacgaaaacaaactaaaaaaaacctacaaacgaaaaacatacgcgttattaacgaaaaaaacccgaaaaaaaaaacgactatattaataccgataacgaaaaactctataaaaaccaaaataaacaaaaaccttaaaaaacgccgacaacgcgaacgcgaaccccacgaaacataaataaaaccgaaaaacgcgataattaaaattaacgcgaacaaataaaaattaacaataacgacaaaaaacgatattatctacgaaaaataaaataacgtaattaaaacctaaaaaaaaaataaatatataaacgataaaaaaaaccgattaaaaactactaacgcgcgaaaataaataaaaatattaccgctattaaaaacatacctactaacgtaaactacaccgaattaaaaacttaccgcgcgcacctaacgtaaaaacgaacactacgaccgaaatataaaatttaataaaacaaaaataccacgaaaaaaataataaataacgatcgcgaaaaacgtaaatttacgtaaataaaaaaacgaccgaaaaaataatattaattacattaatacacattccgacaaccacccaataaccatatatacg

SEQ ID NO: 5273 - DNA, 694 bp, Artificial Sequence
  chemically treated genomic DNA (Homo sapiens) CpG-island No: 5273
tttaatgttttaagtattcgggcgaacgtggcgtgttttattagttcggtagtatgaattattattcgttaggtattttattggagacgacggaaatcgtagtcgaagcggcgttttagcgtttttagtatgacgttttgtattttttattggtgaagtcgtcggtagtgatcgtttagtgtagtgttttattattatagtagtttagcgcgaacgtgatacgtaagttttttttcgattatatagtagaattcgaattcgttagagtattatcgttgattgtttttttttcggttattttgtttgtatgtgttcggtgtcgatggcggtatagtaggtttcgtttaagtaatagcgtattttggcgtatgattcggtaaatacgtttgtattgatcgtaggtatattattaagttttgtttgtttgcgaagtagcgttatattcgacgataattatacgttggtagtttttcgataatatggtgtaacggagaagtatattcgtattattagtgtgacgattgcggcggttattttttagttatcggttcgtttgagaatgacgtgtaattgcgtacgcgatatcggagataacggttgattaagtttattttttattttcgggtaataaggggcgtgcgttatttatttttttgttcgtttatatttaacggtttttttgagagtttatttt

SEQ ID NO: 5274 - DNA, 694 bp, Artificial Sequence
  chemically treated genomic DNA (Homo sapiens) CpG-island No: 5274
aaaataaactctcaaaaaaaccgttaaatataaacgaacaaaaaaataaataacgcacgccccttattacccgaaaataaaaaataaacttaatcaaccgttatctccgatatcgcgtacgcaattacacgtcattctcaaacgaaccgataactaaaaaataaccgccgcaatcgtcacactaataatacgaatatacttctccgttacaccatattatcgaaaaactaccaacgtataattatcgtcgaatataacgctacttcgcaaacaaacaaaacttaataatatacctacgatcaatacaaacgtatttaccgaatcatacgccaaaatacgctattacttaaacgaaacctactataccgccatcgacaccgaacacatacaaacaaaataaccgaaaaaaaaacaatcaacgataatactctaacgaattcgaattctactatataatcgaaaaaaaacttacgtatcacgttcgcgctaaactactataataataaaacactacactaaacgatcactaccgacgacttcaccaataaaaaatacaaaacgtcatactaaaaacgctaaaacgccgcttcgactacgatttccgtcgtctccaataaaatacctaacgaataataattcatactaccgaactaataaaacacgccacgttcgcccgaatacttaaaacattaaa

SEQ ID NO: 5275 - DNA, 694 bp, Artificial Sequence
  chemically treated genomic DNA (Homo sapiens) CpG-island No: 5275
aaaatgaatttttaaagaagtcgttgaatatggacgggtaaaaaagtggatagcgtacgttttttattgttcggggatggggagtaagtttagttagtcgttgttttcggtgtcgcgtgcgtagttgtacgttatttttagacgaatcgatgattggaggatggtcgtcgtagtcgttatattgatgatacggatgtgttttttcgttatattatgttatcggagagttgttaacgtatggttatcgtcgggtatggcgttgtttcgtagataggtagaatttgatggtatgtttgcgattaatgtaaacgtgtttatcggattatgcgttagaatgcgttgttgtttgagcgaaatttgttgtatcgttatcgatatcgggtatatataggtagagtggtcggaaagaaaataattagcgatggtgttttgacgggttcgagttttgttgtataatcggagagagatttgcgtgttacgttcgcgttggattgttgtgatagtgaggtattgtattgggcggttattatcgacggttttattagtgaaaagtataggacgttatgttgggaacgttggaacgtcgtttcggttacgattttcgtcgtttttagtggagtgtttgacggataatggtttatgttatcgggttaatgaaatacgttacgttcgttcggatgtttgggatattgaa

SEQ ID NO: 5276 - DNA, 694 bp, Artificial Sequence
  chemically treated genomic DNA (Homo sapiens) CpG-island No: 5276
ttcaatatcccaaacatccgaacgaacgtaacgtatttcattaacccgataacataaaccattatccgtcaaacactccactaaaaacgacgaaaatcgtaaccgaaacgacgttccaacgttcccaacataacgtcctatacttttcactaataaaaccgtcgataataaccgcccaatacaatacctcactatcacaacaatccaacgcgaacgtaacacgcaaatctctctccgattatacaacaaaactcgaacccgtcaaaacaccatcgctaattattttctttccgaccactctacctatatatacccgatatcgataacgatacaacaaatttcgctcaaacaacaacgcattctaacgcataatccgataaacacgtttacattaatcgcaaacataccatcaaattctacctatctacgaaacaacgccatacccgacgataaccatacgttaacaactctccgataacataatataacgaaaaaacacatccgtatcatcaatataacgactacgacgaccatcctccaatcatcgattcgtctaaaaataacgtacaactacgcacgcgacaccgaaaacaacgactaactaaacttactccccatccccgaacaataaaaaacgtacgctatccacttttttacccgtccatattcaacgacttctttaaaaattcatttt

SEQ ID NO: 5277 - DNA, 683 bp, Artificial Sequence
  chemically treated genomic DNA (Homo sapiens) CpG-island No: 5277
tcgcgtaggtatttcggtaggtgattcgaatcgattattcggtttttttttttagtatttataggcgtaaattttgacgggcgtcggtttttagtagtcggtagttagtaggtttttaaaattcgtttggttaagttgtggttgtacgtgcgattaaacgtcgaatcgcgatgacgcgttaatttttttagattatatcgttcggttgtagttgtattaatagcgtgttatcgttgtcggtatatcgttaattagtattatcggttttgtgttagtttaatagtcgtttgaacgcggtttggcgtagtgttttataatcgttttttattagcggataattattttcgttgtatgtaattagttttgtataatatgtgagcgttgatcgttcgggcgtagtagagaatattttgcggattttgtaggtacgttgttcgtcggcgtttatgcgttgttgacgaattttattcgttattagtttatgtttcgcgttagcgttgcgtttgagttttgttgtttatagtaggtgttaacggcgcgcgtttatcgttatttattaacggtagattgatagcggcgggtattggtcgtgtttaaattcgataggggcgcgaatattaataatgggcgtattataattagtagggtacgatagttttgtttcgtgtgttttttttgtatag

SEQ ID NO: 5278 - DNA, 683 bp, Artificial Sequence
  chemically treated genomic DNA (Homo sapiens) CpG-island No: 5278
ctatacaaaaaaaacacacgaaacaaaactatcgtaccctactaattataatacgcccattattaatattcgcgcccctatcgaatttaaacacgaccaatacccgccgctatcaatctaccgttaataaataacgataaacgcgcgccgttaacacctactataaacaacaaaactcaaacgcaacgctaacgcgaaacataaactaataacgaataaaattcgtcaacaacgcataaacgccgacgaacaacgtacctacaaaatccgcaaaatattctctactacgcccgaacgatcaacgctcacatattatacaaaactaattacatacaacgaaaataattatccgctaataaaaaacgattataaaacactacgccaaaccgcgttcaaacgactattaaactaacacaaaaccgataatactaattaacgatataccgacaacgataacacgctattaatacaactacaaccgaacgatataatctaaaaaaattaacgcgtcatcgcgattcgacgtttaatcgcacgtacaaccacaacttaaccaaacgaattttaaaaacctactaactaccgactactaaaaaccgacgcccgtcaaaatttacgcctataaatactaaaaaaaaaaaccgaataatcgattcgaatcacctaccgaaatacctacgcga

SEQ ID NO: 5279 - DNA, 683 bp, Artificial Sequence
  chemically treated genomic DNA (Homo sapiens) CpG-island No: 5279
ttatgtaagagagatatacggaataggattatcgtgttttgttgattgtgatacgtttattattgatgttcgcgtttttatcgagtttgagtacggttaatgttcgtcgttattaatttgtcgttaatgaataacgatgaacgcgcgtcgttggtatttgttataaatagtaaggtttagacgtagcgttggcgcgggatataaattggtggcgggtgaaattcgttagtagcgtatggacgtcggcgggtagcgtgtttgtaaaattcgtaaggtattttttgttgcgttcgggcggttagcgtttatatattgtgtaaagttggttgtatgtagcggggatgattattcgttggtggaaggcggttataaggtattgcgttagatcgcgtttaggcgattattgaattggtataaaatcgatagtgttgattggcggtgtatcggtagcggtaatacgttgttagtgtagttatagtcgaacggtgtgatttggaagggttggcgcgttatcgcggttcggcgtttggtcgtacgtataattataatttagttaggcgagttttgaaaatttgttggttgtcgattgttaaaaatcgacgttcgttagaatttgcgtttgtgggtgttggaagagaaagtcggatgatcggttcgaattatttgtcggaatgtttgcgcga

SEQ ID NO: 5280 - DNA, 683 bp, Artificial Sequence
  chemically treated genomic DNA (Homo sapiens) CpG-island No: 5280
tcgcgcaaacattccgacaaataattcgaaccgatcatccgactttctcttccaacacccacaaacgcaaattctaacgaacgtcgatttttaacaatcgacaaccaacaaattttcaaaactcgcctaactaaattataattatacgtacgaccaaacgccgaaccgcgataacgcgccaacccttccaaatcacaccgttcgactataactacactaacaacgtattaccgctaccgatacaccgccaatcaacactatcgattttataccaattcaataatcgcctaaacgcgatctaacgcaataccttataaccgccttccaccaacgaataatcatccccgctacatacaaccaactttacacaatatataaacgctaaccgcccgaacgcaacaaaaaataccttacgaattttacaaacacgctacccgccgacgtccatacgctactaacgaatttcacccgccaccaatttatatcccgcgccaacgctacgtctaaaccttactatttataacaaataccaacgacgcgcgttcatcgttattcattaacgacaaattaataacgacgaacattaaccgtactcaaactcgataaaaacgcgaacatcaataataaacgtatcacaatcaacaaaacacgataatcctattccgtatatctctcttacataa

SEQ ID NO: 5281 - DNA, 512 bp, Artificial Sequence
  chemically treated genomic DNA (Homo sapiens) CpG-island No: 5281
agcggcgattcgttgtttttattttcggcggttgatacgtgcgtagtcgattattgttataggttttattaataacgttaaatttgtcgaagttgtcgttttgttcgacgcgttatacgcgcgtatcgaataggaaagttggaataagggcgatcgttgttggcgatgggttgtggcgtagtgttatgaaaggtggttatttggatgatgagtaaagttcggattggttgtttatcgcgagggtgaataacggtttatcgtatcgcgtattatgattaaaaatattacggtattggttgtatattttttgcggcgttggttgtattacgttcggttatataaattgggttgatatcgtataggaggtaaaaagttggttttttcggcgttagtttaggtcgatacgttggaagttggttacggtattggtcggtttattatttttacgtttggtggtgagtatcgtattatagttgttttgttattgttagtttttggtattgatatttagg

SEQ ID NO: 5282 - DNA, 512 bp, Artificial Sequence
  chemically treated genomic DNA (Homo sapiens) CpG-island No: 5282
cctaaatatcaataccaaaaactaacaataacaaaacaactataatacgatactcaccaccaaacgtaaaaataataaaccgaccaataccgtaaccaacttccaacgtatcgacctaaactaacgccgaaaaaaccaactttttacctcctatacgatatcaacccaatttatataaccgaacgtaatacaaccaacgccgcaaaaaatatacaaccaataccgtaatatttttaatcataatacgcgatacgataaaccgttattcaccctcgcgataaacaaccaatccgaactttactcatcatccaaataaccacctttcataacactacgccacaacccatcgccaacaacgatcgcccttattccaactttcctattcgatacgcgcgtataacgcgtcgaacaaaacgacaacttcgacaaatttaacgttattaataaaacctataacaataatcgactacgcacgtatcaaccgccgaaaataaaaacaacgaatcgccgct

SEQ ID NO: 5283 - DNA, 512 bp, Artificial Sequence
  chemically treated genomic DNA (Homo sapiens) CpG-island No: 5283
tttgaatgttagtgttaaaggttgataataataaagtagttatagtacggtgtttattattaggcgtggaagtggtgaatcgattaatatcgtgattaatttttagcgtgtcggtttgggttaacgtcgagaaagttagttttttgttttttgtacggtgttagtttagtttgtatggtcgggcgtagtgtagttaacgtcgtagagagtgtataattagtgtcgtggtgtttttggttataatgcgcggtgcggtaaatcgttgtttattttcgcggtaaatagttagttcgggttttgtttattatttagatgattattttttatagtattgcgttatagtttatcgttaatagcgatcgtttttgttttagtttttttgttcggtgcgcgcgtgtggcgcgtcgagtaaggcggtagtttcggtaagtttggcgttattaatgaaatttgtggtaataatcgattgcgtacgtattaatcgtcgaaggtgaaagtagcgggtcgtcgtt

SEQ ID NO: 5284 - DNA, 512 bp, Artificial Sequence
  chemically treated genomic DNA (Homo sapiens) CpG-island No: 5284
aacgacgacccgctactttcaccttcgacgattaatacgtacgcaatcgattattaccacaaatttcattaataacgccaaacttaccgaaactaccgccttactcgacgcgccacacgcgcgcaccgaacaaaaaaactaaaacaaaaacgatcgctattaacgataaactataacgcaatactataaaaaataatcatctaaataataaacaaaacccgaactaactatttaccgcgaaaataaacaacgatttaccgcaccgcgcattataaccaaaaacaccacgacactaattatacactctctacgacgttaactacactacgcccgaccatacaaactaaactaacaccgtacaaaaaacaaaaaactaactttctcgacgttaacccaaaccgacacgctaaaaattaatcacgatattaatcgattcaccacttccacgcctaataataaacaccgtactataactactttattattatcaacctttaacactaacattcaaa

SEQ ID NO: 5285 - DNA, 507 bp, Artificial Sequence
  chemically treated genomic DNA (Homo sapiens) CpG-island No: 5285
tttatgattcgcgatatcgtcgaatgtttggcggaggtggagtttgagtgaaaggtgaagcgtatcgtgtattttggagttagaatcgggcgcgtattaattcgacggtaatttgtaggtgttacgcgtagagttggcgcgttggtcgacggtaaaattttcgtcgataaagtgaaagataagttggaattgaagcgacgttaatcgggttggattacgggcgttttattcgttcgatgttgtttcgtaggggtaatttgttgtttttttgaatgttaaatttaaagaacggcggaattgttcgaggagttaatcggtattgaaatttacgggtaaatttggcgatggtttttgagtagtataaatcggttcgtatagagttggagaagtgtaagcgtaggttagcggcgttacgttgtttacgtcggaataagtgtatcgttgatagcgagtttgtaggtatttattgacgaagaaaaatagttaatatcgcgtagtagtaagaat

SEQ ID NO: 5286 - DNA, 507 bp, Artificial Sequence
  chemically treated genomic DNA (Homo sapiens) CpG-island No: 5286
attcttactactacgcgatattaactatttttcttcgtcaataaatacctacaaactcgctatcaacgatacacttattccgacgtaaacaacgtaacgccgctaacctacgcttacacttctccaactctatacgaaccgatttatactactcaaaaaccatcgccaaatttacccgtaaatttcaataccgattaactcctcgaacaattccgccgttctttaaatttaacattcaaaaaaacaacaaattacccctacgaaacaacatcgaacgaataaaacgcccgtaatccaacccgattaacgtcgcttcaattccaacttatctttcactttatcgacgaaaattttaccgtcgaccaacgcgccaactctacgcgtaacacctacaaattaccgtcgaattaatacgcgcccgattctaactccaaaatacacgatacgcttcacctttcactcaaactccacctccgccaaacattcgacgatatcgcgaatcataaa

SEQ ID NO: 5287 - DNA, 507 bp, Artificial Sequence
  chemically treated genomic DNA (Homo sapiens) CpG-island No: 5287
gtttttgttgttgcgcggtattaattgttttttttcgttagtaagtatttgtaaattcgttgttagcgatgtatttgtttcggcgtgagtaacgtgacgtcgttggtttgcgtttgtatttttttagttttgtgcgggtcgatttgtgttgtttaaaaattatcgttagatttgttcgtagattttagtgtcggttaatttttcgagtaatttcgtcgttttttgggtttggtatttaggaaggtagtaaattgtttttgcgaaatagtatcgaacgggtgaagcgttcgtaatttagttcggttaacgtcgttttagttttagtttattttttattttgtcggcgagaattttgtcgtcggttagcgcgttagttttacgcgtggtatttgtaaattatcgtcgggttggtacgcgttcgattttggttttagaatgtacggtacgttttattttttatttaaattttattttcgttagatattcggcggtatcgcgggttatgag

SEQ ID NO: 5288 - DNA, 507 bp, Artificial Sequence
  chemically treated genomic DNA (Homo sapiens) CpG-island No: 5288
ctcataacccgcgataccgccgaatatctaacgaaaataaaatttaaataaaaaataaaacgtaccgtacattctaaaaccaaaatcgaacgcgtaccaacccgacgataatttacaaataccacgcgtaaaactaacgcgctaaccgacgacaaaattctcgccgacaaaataaaaaataaactaaaactaaaacgacgttaaccgaactaaattacgaacgcttcacccgttcgatactatttcgcaaaaacaatttactaccttcctaaataccaaacccaaaaaacgacgaaattactcgaaaaattaaccgacactaaaatctacgaacaaatctaacgataatttttaaacaacacaaatcgacccgcacaaaactaaaaaaatacaaacgcaaaccaacgacgtcacgttactcacgccgaaacaaatacatcgctaacaacgaatttacaaatacttactaacgaaaaaaaacaattaataccgcgcaacaacaaaaac

SEQ ID NO: 5289 - DNA, 771 bp, Artificial Sequence
  chemically treated genomic DNA (Homo sapiens) CpG-island No: 5289
gcgtttcgtatggtatggtcgcggttattcgtttatttttgaggacgtttattaattttttgcgtagcgagtatattaacggtacggcgttgtatttcgacgttttttcggcggtggtcggtagttcggtcgtgtttcgcgggggtttcgtgttcgtggtttatagtgatttcgagatttttaagagtaagaagaaggggttgtttcggcgttcgttgttgagtgggttgaagttgcgtaagtcggagtttaagagtagtttggttagttaacgtagtaagtagagtttttttcgtagcgaggcgggtatgagtatcgttagttttacggttagcgatatttattttattattagtttgggcgaggttgaggtcgagttggcggttatcgaggacgatatcgacgttattattatcgagatttacgtgggcgagtggaagaacgataaacgtttcggtttcggcgtgagttagcgttcggacgggtttaagtacgagggcgagtgggttagtaatcggcgttatggttacggttgtatgattttttcggacggtattaaggaggagggtaagtataagtagaatattttcgtcggcggtaagcgtaagaattttatttttttgcgggttagtaagattcgcgagaaggtggatcgcgtcgttgaggtcgttgagcgggtcgttattatcgttaagtagaaggttgagatcgcggtttttaggtaggagggcgagggggcggggggttttttttggtgtttagaaggtgttt

SEQ ID NO: 5290 - DNA, 771 bp, Artificial Sequence
  chemically treated genomic DNA (Homo sapiens) CpG-island No: 5290
aaacaccttctaaacaccaaaaaaaaccccccgccccctcgccctcctacctaaaaaccgcgatctcaaccttctacttaacgataataacgacccgctcaacgacctcaacgacgcgatccaccttctcgcgaatcttactaacccgcaaaaaaataaaattcttacgcttaccgccgacgaaaatattctacttatacttaccctcctccttaataccgtccgaaaaaatcatacaaccgtaaccataacgccgattactaacccactcgccctcgtacttaaacccgtccgaacgctaactcacgccgaaaccgaaacgtttatcgttcttccactcgcccacgtaaatctcgataataataacgtcgatatcgtcctcgataaccgccaactcgacctcaacctcgcccaaactaataataaaataaatatcgctaaccgtaaaactaacgatactcatacccgcctcgctacgaaaaaaactctacttactacgttaactaaccaaactactcttaaactccgacttacgcaacttcaacccactcaacaacgaacgccgaaacaaccccttcttcttactcttaaaaatctcgaaatcactataaaccacgaacacgaaacccccgcgaaacacgaccgaactaccgaccaccgccgaaaaaacgtcgaaatacaacgccgtaccgttaatatactcgctacgcaaaaaattaataaacgtcctcaaaaataaacgaataaccgcgaccataccatacgaaacgc

SEQ ID NO: 5291 - DNA, 771 bp, Artificial Sequence
  chemically treated genomic DNA (Homo sapiens) CpG-island No: 5291
aaatattttttgggtattaagaagggtttttcgttttttcgtttttttatttggaagtcgcgattttagttttttgtttggcgatggtggcggttcgtttagcggttttaacggcgcggtttattttttcgcggattttgttggttcgtagggggatgaggtttttgcgtttgtcgtcgacgaggatgttttgtttgtatttgtttttttttttggtgtcgttcgggaaggttatgtagtcgtagttatggcgtcggttgttggtttattcgttttcgtatttgagttcgttcgagcgttggtttacgtcgaagtcggagcgtttgtcgtttttttattcgtttacgtaggtttcggtggtggtggcgtcgatgtcgttttcgatgatcgttagttcggttttagtttcgtttaggttgatggtggagtggatgtcgttggtcgtggagttgacggtgtttatgttcgtttcgttgcgaaaggagttttgtttgttgcgttggttggttaggttgtttttggatttcgatttgcgtagttttagtttatttagtagcgagcgtcgaaatagttttttttttttgtttttgaggatttcggagttattgtgggttacgagtacgaagttttcgcgggatacggtcgggttgtcggttatcgtcggagaggcgtcgggatgtagcgtcgtgtcgttggtgtgttcgttgcgtagggagttgatggacgtttttaggggtgagcggatgatcgcggttatgttatacgggacgt

SEQ ID NO: 5292 - DNA, 771 bp, Artificial Sequence
  chemically treated genomic DNA (Homo sapiens) CpG-island No: 5292
acgtcccgtataacataaccgcgatcatccgctcacccctaaaaacgtccatcaactccctacgcaacgaacacaccaacgacacgacgctacatcccgacgcctctccgacgataaccgacaacccgaccgtatcccgcgaaaacttcgtactcgtaacccacaataactccgaaatcctcaaaaacaaaaaaaaaaaactatttcgacgctcgctactaaataaactaaaactacgcaaatcgaaatccaaaaacaacctaaccaaccaacgcaacaaacaaaactcctttcgcaacgaaacgaacataaacaccgtcaactccacgaccaacgacatccactccaccatcaacctaaacgaaactaaaaccgaactaacgatcatcgaaaacgacatcgacgccaccaccaccgaaacctacgtaaacgaataaaaaaacgacaaacgctccgacttcgacgtaaaccaacgctcgaacgaactcaaatacgaaaacgaataaaccaacaaccgacgccataactacgactacataaccttcccgaacgacaccaaaaaaaaaaacaaatacaaacaaaacatcctcgtcgacgacaaacgcaaaaacctcatccccctacgaaccaacaaaatccgcgaaaaaataaaccgcgccgttaaaaccgctaaacgaaccgccaccatcgccaaacaaaaaactaaaatcgcgacttccaaataaaaaaacgaaaaaacgaaaaacccttcttaatacccaaaaaatattt

SEQ ID NO: 5293 - DNA, 587 bp, Artificial Sequence
  chemically treated genomic DNA (Homo sapiens) CpG-island No: 5293
cgcgttgcgtgtgttgtttgggtttgtgtttggtgtgcggtttcgggggtgtggcgtatttgttttttcgtttgttcgtttcgtgtttgttcgtgtcgttgttcgttggcggtttttcgcgggtcggtattggttcgtgtcggtgttttttgttgtcgttatgtgtgttgggcggttttttttggtattcggtgcggttcgtcgggtggtcggtggtttgcgcgcgcgtgttcgttttgttttgtttttcgttcgtcgtttgggttttttttgtgtggtttttttttggtgttgtcgttttttttttcgtttgcgtgcgtttgttgttttcgtgtgttgcgtttgacgtatttgtcgttgttgttttgttttgcgtggtgtttggtgggttttgtttcgttcgttcgttgcgttcgtttttttggggttttgttgcgttttcgcgttttttgtttgtgtttgtttgggggttgtttcgttcgttcgttgttttttttttcgtgtggcggttcgtcgtcggttttcgtgtgtgtgtgttttttttgtttgtggtttttgtggttgtggtgttttgtgtttattttgtg

SEQ ID NO: 5294 - DNA, 587 bp, Artificial Sequence
  chemically treated genomic DNA (Homo sapiens) CpG-island No: 5294
cacaaaataaacacaaaacaccacaaccacaaaaaccacaaacaaaaaaaacacacacacacgaaaaccgacgacgaaccgccacacgaaaaaaaaaacaacgaacgaacgaaacaacccccaaacaaacacaaacaaaaaacgcgaaaacgcaacaaaaccccaaaaaaacgaacgcaacgaacgaacgaaacaaaacccaccaaacaccacgcaaaacaaaacaacaacgacaaatacgtcaaacgcaacacacgaaaacaacaaacgcacgcaaacgaaaaaaaaaacgacaacaccaaaaaaaaaccacacaaaaaaaacccaaacgacgaacgaaaaacaaaacaaaacgaacacgcgcgcgcaaaccaccgaccacccgacgaaccgcaccgaataccaaaaaaaaccgcccaacacacataacgacaacaaaaaacaccgacacgaaccaataccgacccgcgaaaaaccgccaacgaacaacgacacgaacaaacacgaaacgaacaaacgaaaaaacaaatacgccacacccccgaaaccgcacaccaaacacaaacccaaacaacacacgcaacgcg

SEQ ID NO: 5295 - DNA, 587 bp, Artificial Sequence
  chemically treated genomic DNA (Homo sapiens) CpG-island No: 5295
tataaaatagatataaaatattataattataaaaattatagataaaagaagtatatatatacgaaagtcggcgacggatcgttatacgagaggggaaatagcggacgaacgaggtagtttttagataagtataaatagaagacgcgaaaacgtaatagagttttaagaaaacgaacgtagcgaacgagcggaatagggtttattaaatattacgtagagtagaatagtaacgatagatgcgttaaacgtagtatacggagataataagcgtacgtagacgagaaagaaaacgataatattagggaaaagttatataaaggaaatttaagcgacgagcggaaggtaggataagacggatacgcgcgcgtaaattatcgattattcgacgaatcgtatcggatgttaaggaaaatcgtttagtatatatgacggtaatagaaagtatcgatacggattaatgtcgattcgcgaagagtcgttagcggatagcggtacgaataaatacgggacggataggcggagaggtagatacgttatattttcggagtcgtatattagatatagatttagatagtatacgtagcgcg

SEQ ID NO: 5296 - DNA, 587 bp, Artificial Sequence
  chemically treated genomic DNA (Homo sapiens) CpG-island No: 5296
cgcgctacgtatactatctaaatctatatctaatatacgactccgaaaatataacgtatctacctctccgcctatccgtcccgtatttattcgtaccgctatccgctaacgactcttcgcgaatcgacattaatccgtatcgatactttctattaccgtcatatatactaaacgattttccttaacatccgatacgattcgtcgaataatcgataatttacgcgcgcgtatccgtcttatcctaccttccgctcgtcgcttaaatttcctttatataacttttccctaatattatcgttttctttctcgtctacgtacgcttattatctccgtatactacgtttaacgcatctatcgttactattctactctacgtaatatttaataaaccctattccgctcgttcgctacgttcgttttcttaaaactctattacgttttcgcgtcttctatttatacttatctaaaaactacctcgttcgtccgctatttcccctctcgtataacgatccgtcgccgactttcgtatatatatacttcttttatctataatttttataattataatattttatatctattttata

SEQ ID NO: 5297 - DNA, 724 bp, Artificial Sequence
  chemically treated genomic DNA (Homo sapiens) CpG-island No: 5297
ttattatcgcgcgtatttgatttttcggtattgttacgatcgcgcgtatttgatttttcggtattgttattatcgcgcgtatttgatttttcggaattgttattattaggcgtatttgatttttcggtattgttacgatcgcgcgtatttgatttttcggtattgttattatcgcgcgtatttgatttttcggtattgttattatcgcgcgtatttgatttttcggtattgttattatcgcgcgtatttgatttttcggtattgttacgatcgcgcgtatttgatttttcggaattgttattatcgcgcgtatttgatttttcggaattgttacgatcgcgcgtatttgatttttcggaattgttattatcgtgcgtatttgattttttggaattgttacgatcgcgcgtacgtgattttttggaattgttattatcgcgcgtatttgatttttcggaattgttattatcgcgtgtatttgatttttcggaattgttattatcgcgtgtatttgatttttcggaattgttattatcgcgcgtatttgatttttcggaattattattattgtgtgtatttgatttttgcgatgggtaatatttcgttaatgttttttttattttcgtaagttttcggagaggacggggttttttattttttcggttgtttagatttcgattataatgttttttattatatatagtacgagggattaaatgggaaa

SEQ ID NO: 5298 - DNA, 724 bp, Artificial Sequence
  chemically treated genomic DNA (Homo sapiens) CpG-island No: 5298
tttcccatttaatccctcgtactatatataataaaaaacattataatcgaaatctaaacaaccgaaaaaataaaaaaccccgtcctctccgaaaacttacgaaaataaaaaaaacattaacgaaatattacccatcgcaaaaatcaaatacacacaataataataattccgaaaaatcaaatacgcgcgataataacaattccgaaaaatcaaatacacgcgataataacaattccgaaaaatcaaatacacgcgataataacaattccgaaaaatcaaatacgcgcgataataacaattccaaaaaatcacgtacgcgcgatcgtaacaattccaaaaaatcaaatacgcacgataataacaattccgaaaaatcaaatacgcgcgatcgtaacaattccgaaaaatcaaatacgcgcgataataacaattccgaaaaatcaaatacgcgcgatcgtaacaataccgaaaaatcaaatacgcgcgataataacaataccgaaaaatcaaatacgcgcgataataacaataccgaaaaatcaaatacgcgcgataataacaataccgaaaaatcaaatacgcgcgatcgtaacaataccgaaaaatcaaatacgcctaataataacaattccgaaaaatcaaatacgcgcgataataacaataccgaaaaatcaaatacgcgcgatcgtaacaataccgaaaaatcaaatacgcgcgataataa

SEQ ID NO: 5299 - DNA, 724 bp, Artificial Sequence
  chemically treated genomic DNA (Homo sapiens) CpG-island No: 5299
ttttttatttggtttttcgtgttgtgtgtggtggggggtattgtggtcgaggtttgaatagtcggggaagtgaaagatttcgtttttttcgggagtttacgggagtgggagagatattgacgaaatattatttatcgtaggagttaggtgtatatagtgatgatagtttcgggaggttaggtgcgcgcggtgatgatagtttcggaaggttaggtgtacgcggtgatgatagtttcgggaggttaggtgtacgcggtgatgatagtttcgggaggttaggtgcgcgcggtgatgatagttttagaaggttacgtgcgcgcggtcgtgatagttttagaaggttaggtgcgtacggtgatgatagtttcgggaggttaggtgcgcgcggtcgtgatagtttcgggaggttaggtgcgcgcggtggtgatagtttcgggaggttaggtgcgcgcggtcgtgatagtgtcgggaggttaggtgcgcgcggtggtgatagtgtcgggaggttaggtgcgcgcggtggtgatagtgtcgggaggttaggtgcgcgcggtggtgatagtgtcgggaggttaggtgcgcgcggtcgtgatagtgtcgggaggttaggtgcgtttggtgatgatagtttcgggaggttaggtgcgcgcggtgatgatagtgtcgggaggttaggtgcgcgcggtcgtgatagtgtcgggaggttaggtgcgcgcggtggtga

SEQ ID NO: 5300 - DNA, 724 bp, Artificial Sequence
  chemically treated genomic DNA (Homo sapiens) CpG-island No: 5300
tcaccaccgcgcgcacctaacctcccgacactatcacgaccgcgcgcacctaacctcccgacactatcatcaccgcgcgcacctaacctcccgaaactatcatcaccaaacgcacctaacctcccgacactatcacgaccgcgcgcacctaacctcccgacactatcaccaccgcgcgcacctaacctcccgacactatcaccaccgcgcgcacctaacctcccgacactatcaccaccgcgcgcacctaacctcccgacactatcacgaccgcgcgcacctaacctcccgaaactatcaccaccgcgcgcacctaacctcccgaaactatcacgaccgcgcgcacctaacctcccgaaactatcatcaccgtacgcacctaaccttctaaaactatcacgaccgcgcgcacgtaaccttctaaaactatcatcaccgcgcgcacctaacctcccgaaactatcatcaccgcgtacacctaacctcccgaaactatcatcaccgcgtacacctaaccttccgaaactatcatcaccgcgcgcacctaacctcccgaaactatcatcactatatacacctaactcctacgataaataatatttcgtcaatatctctcccactcccgtaaactcccgaaaaaaacgaaatctttcacttccccgactattcaaacctcgaccacaataccccccaccacacacaacacgaaaaaccaaataaaaaa

SEQ ID NO: 5301 - DNA, 704 bp, Artificial Sequence
  chemically treated genomic DNA (Homo sapiens) CpG-island No: 5301
tagcggagagcgtggagagattttcgtcgtagttattttttgttttttgtgtgatagtcgttgcggcgaaggggcgggcgttgggtgggggcggagtcgcggcgggcggagtagcggggtcggggcggggtcgagcgcggcgtagcggagcggggtagagtattttgcgtttcggcgcggggtttttgcggtagttttaggttttttttttggattcgtcgtagagttaggtaagcggttttcgtaggtttcgggtcgggtacggggattaggatgtcgtcggggacggggatgaggtcgtgaggatgcgcgaagggtcgttttttttttcggttcgcggggggcgttcggcgttgtgttcgggttagttcgaggttcggttttaggttttacgcggtttttttttttttcggatttatcgtgcgtttcgcggtacggattttttgttcgggaggcgcgggtatatcgcggagtttcggcgcggcggcgggggagtcgtagtagtaggtgcgcggtttgggtcggagtcgttagttcgggaggaggcggtgttaattttagggatcggagatatttgtagcggtcgggagttcggtagcggcgatattttcgagtttaggtattgtagagcgttggtttttgtttttgtcgtcgtgattatcgttattttttttagggttagcgagagtcgtttgggttcgttt

SEQ ID NO: 5302 - DNA, 704 bp, Artificial Sequence
  chemically treated genomic DNA (Homo sapiens) CpG-island No: 5302
aaacgaacccaaacgactctcgctaaccctaaaaaaaataacgataatcacgacgacaaaaacaaaaaccaacgctctacaatacctaaactcgaaaatatcgccgctaccgaactcccgaccgctacaaatatctccgatccctaaaattaacaccgcctcctcccgaactaacgactccgacccaaaccgcgcacctactactacgactcccccgccgccgcgccgaaactccgcgatatacccgcgcctcccgaacaaaaaatccgtaccgcgaaacgcacgataaatccgaaaaaaaaaaaaaccgcgtaaaacctaaaaccgaacctcgaactaacccgaacacaacgccgaacgccccccgcgaaccgaaaaaaaaaacgacccttcgcgcatcctcacgacctcatccccgtccccgacgacatcctaatccccgtacccgacccgaaacctacgaaaaccgcttacctaactctacgacgaatccaaaaaaaaaacctaaaactaccgcaaaaaccccgcgccgaaacgcaaaatactctaccccgctccgctacgccgcgctcgaccccgccccgaccccgctactccgcccgccgcgactccgcccccacccaacgcccgccccttcgccgcaacgactatcacacaaaaaacaaaaaataactacgacgaaaatctctccacgctctccgcta

SEQ ID NO: 5303 - DNA, 704 bp, Artificial Sequence
  chemically treated genomic DNA (Homo sapiens) CpG-island No: 5303
aggcgggtttaggcggttttcgttggttttgggggaggtgacggtggttacggcggtagaggtaggggttagcgttttgtagtatttggattcgaggatgtcgtcgttgtcgggttttcggtcgttgtaggtgttttcggtttttgagattagtatcgttttttttcgggttggcggtttcggtttaggtcgcgtatttgttgttgcggttttttcgtcgtcgcgtcggagtttcgcgatgtgttcgcgtttttcgggtagagggttcgtgtcgcgggacgtacggtgggttcgagggggaaaggggtcgcgtggggtttgaggtcgggtttcgggttagttcgggtatagcgtcgagcgtttttcgcgggtcgggagagggggcggtttttcgcgtatttttacggttttattttcgttttcggcggtattttagttttcgtgttcggttcgaggtttgcgagggtcgtttatttggttttgcggcgggtttaggggaggggtttgaggttatcgtaggggtttcgcgtcggggcgtaggatgttttgtttcgtttcgttgcgtcgcgttcggtttcgtttcggtttcgttgtttcgttcgtcgcggtttcgtttttatttagcgttcgttttttcgtcgtagcggttgttatataaagggtaggaaatggttgcggcgagggtttttttacgtttttcgttg

SEQ ID NO: 5304 - DNA, 704 bp, Artificial Sequence
  chemically treated genomic DNA (Homo sapiens) CpG-island No: 5304
caacgaaaaacgtaaaaaaaccctcgccgcaaccatttcctaccctttatataacaaccgctacgacgaaaaaacgaacgctaaataaaaacgaaaccgcgacgaacgaaacaacgaaaccgaaacgaaaccgaacgcgacgcaacgaaacgaaacaaaacatcctacgccccgacgcgaaacccctacgataacctcaaacccctcccctaaacccgccgcaaaaccaaataaacgaccctcgcaaacctcgaaccgaacacgaaaactaaaataccgccgaaaacgaaaataaaaccgtaaaaatacgcgaaaaaccgccccctctcccgacccgcgaaaaacgctcgacgctatacccgaactaacccgaaacccgacctcaaaccccacgcgacccctttccccctcgaacccaccgtacgtcccgcgacacgaaccctctacccgaaaaacgcgaacacatcgcgaaactccgacgcgacgacgaaaaaaccgcaacaacaaatacgcgacctaaaccgaaaccgccaacccgaaaaaaaacgatactaatctcaaaaaccgaaaacacctacaacgaccgaaaacccgacaacgacgacatcctcgaatccaaatactacaaaacgctaacccctacctctaccgccgtaaccaccgtcacctcccccaaaaccaacgaaaaccgcctaaacccgcct

SEQ ID NO: 5305 - DNA, 609 bp, Artificial Sequence
  chemically treated genomic DNA (Homo sapiens) CpG-island No: 5305
  misc_feature (76)..(76): n is either a, c, g or t
tagttaaatttttcgcgacgtggcggatcgttgttaggcgattttgattttattgggcgattttagcgattcgtgntgttggttacgtatcgtggaaacggatcgtttatttcggtagcggtggtttatagggcgtagtacgcgagtcggcgttgaaagtgttggaattgacggcgggtaaattggcggttttttatgattttttaatcggatttcgttatggattaaaatcgttggtcgatgacgaaacgttggtggtggtatttgtttttagttatttttatattcgttagtatgattttgatttgttggttgaatttcgtcgtgataattaggtaatgcgtgtaatcgttatcgtcgcggaaagtagcgatatcgtcgttgtcggtttatatattattttgttatcgttacgttattttatcgacgttgagtaggtattttgttttttgatgtacgtttagacgtttgtattgatgtagtcgttgtatatgggtaatacgtcggatattttattagttagtggtatcgttaatcgcgtggtgtaaggcgtaattatttattcgtggtaggtataagaggatcgtattatgagtattatttttatta

SEQ ID NO: 5306 - DNA, 609 bp, Artificial Sequence
  chemically treated genomic DNA (Homo sapiens) CpG-island No: 5306
  misc_feature (534)..(534): n is either a, c, g or t
taataaaaataatactcataatacgatcctcttatacctaccacgaataaataattacgccttacaccacgcgattaacgataccactaactaataaaatatccgacgtattacccatatacaacgactacatcaatacaaacgtctaaacgtacatcaaaaaacaaaatacctactcaacgtcgataaaataacgtaacgataacaaaataatatataaaccgacaacgacgatatcgctactttccgcgacgataacgattacacgcattacctaattatcacgacgaaattcaaccaacaaatcaaaatcatactaacgaatataaaaataactaaaaacaaataccaccaccaacgtttcgtcatcgaccaacgattttaatccataacgaaatccgattaaaaaatcataaaaaaccgccaatttacccgccgtcaattccaacactttcaacgccgactcgcgtactacgccctataaaccaccgctaccgaaataaacgatccgtttccacgatacgtaaccaacancacgaatcgctaaaatcgcccaataaaatcaaaatcgcctaacaacgatccgccacgtcgcgaaaaatttaacta

SEQ ID NO: 5307 - DNA, 609 bp, Artificial Sequence
  chemically treated genomic DNA (Homo sapiens) CpG-island No: 5307
  misc_feature (534)..(534): n is either a, c, g or t
tagtggagataatgtttataatgcgatttttttatgtttgttacggatgaatgattacgttttgtattacgcggttaacggtgttattggttgatggggtattcggcgtattgtttatgtgtagcgattgtattagtgtaaacgtttgggcgtatattaggaagtaaaatgtttgtttaacgtcgataaagtgacgtgacggtggtaggatgatatgtggatcggtagcgacgatgtcgttgtttttcgcggcgatggcgattatacgtattgtttggttgttacggcgaagtttagttagtagattaagattatattgacgggtgtaagggtggttggagataaatattattattagcgtttcgttatcgattagcgattttggtttatgacggaattcggttggagaattataaaaggtcgttagtttattcgtcgttagttttagtatttttagcgtcgattcgcgtgttgcgttttgtaagttatcgttatcgagataaacgattcgtttttacggtgcgtaattaatantacgggtcgttgaaatcgtttagtgaggttaggatcgtttggtaacgattcgttacgtcgcggaaggtttggttg

SEQ ID NO: 5308 - DNA, 609 bp, Artificial Sequence
  chemically treated genomic DNA (Homo sapiens) CpG-island No: 5308
  misc_feature (76)..(76): n is either a, c, g or t
caaccaaaccttccgcgacgtaacgaatcgttaccaaacgatcctaacctcactaaacgatttcaacgacccgtantattaattacgcaccgtaaaaacgaatcgtttatctcgataacgataacttacaaaacgcaacacgcgaatcgacgctaaaaatactaaaactaacgacgaataaactaacgaccttttataattctccaaccgaattccgtcataaaccaaaatcgctaatcgataacgaaacgctaataataatatttatctccaaccacccttacacccgtcaatataatcttaatctactaactaaacttcgccgtaacaaccaaacaatacgtataatcgccatcgccgcgaaaaacaacgacatcgtcgctaccgatccacatatcatcctaccaccgtcacgtcactttatcgacgttaaacaaacattttacttcctaatatacgcccaaacgtttacactaatacaatcgctacacataaacaatacgccgaataccccatcaaccaataacaccgttaaccgcgtaatacaaaacgtaatcattcatccgtaacaaacataaaaaaatcgcattataaacattatctccacta

SEQ ID NO: 5309 - DNA, 1084 bp, Artificial Sequence
  chemically treated genomic DNA (Homo sapiens) CpG-island No: 5309
  misc_feature (238)..(238): n is either a, c, g or t
gtgtggataatatgttcggcgttattttaagtttgtatggttggcgtttgcggggcgattttattttttattttggcggttgtaagtttcgtcgataaggcgatttcgacgttagtgtcgttattcgttggtaagaattttgtcgtttggtagtattaggagtggtgtaatgattacgcgtttgattcgttggttaattacgttggatattttgaagttaaaatggcgtagttgtttngcggtacgtcgttacgggcgattaattcgcgttatcgggttggtgttggaagttatcggattataattgtcgttcggcgtaatttgtgttattgagcgttagaacggtagcgaaacgtacgaagtagaaagcgaagtcgttggttttaacggttaacggttgtttttaatgtcgttggaggaagtcgaaggtgttttgttcggcgcgcgtgtttatgttaaaaatatttcggtagaagggttgtaaagcggtaagtagttgtcgttcggttcggcgttattaggtcgcgttttggacggtagcggtaaatcgttcgatggtttgttttttttcgatacgacggaaatcggtgcgttgattatttcgttatttaattcgttgtaacgtatatcgattgaatatgtgttggatatcggcgtgcgtttaattaatgttttgtttatcgttgggcgtgggtagcgtatggggttgtttgtcgggttcggcgttggtaaaagtgtgttgttggggatgatggtacgttatattcgcgtcgatgttattgtcgtgggtttgattggtgaacgtgggcgcgaagtaaaagattttattgagaatattttcggcgtcgaagggcgtgtacgtttagtggtgattgtcgtttcggcggatgttttttcgtttttgcgaatgtagggtgtcgtttatgttacgcgtattgtcgaagattttcgcgatcgtggttagtatgtgttgttgattatggatttttttattcgttacgcgatggtttagcgtgaaattgcgttggcgattggcgaattttcgttattaaaggttatttatcgttggcgtttgatcgatgat

SEQ ID NO: 5310 - DNA, 1084 bp, Artificial Sequence
  chemically treated genomic DNA (Homo sapiens) CpG-island No: 5310
  misc_feature (847)..(847): n is either a, c, g or t
atcatcgatcaaacgccaacgataaataacctttaataacgaaaattcgccaatcgccaacgcaatttcacgctaaaccatcgcgtaacgaataaaaaaatccataatcaacaacacatactaaccacgatcgcgaaaatcttcgacaatacgcgtaacataaacgacaccctacattcgcaaaaacgaaaaaacatccgccgaaacgacaatcaccactaaacgtacacgcccttcgacgccgaaaatattctcaataaaatcttttacttcgcgcccacgttcaccaatcaaacccacgacaataacatcgacgcgaatataacgtaccatcatccccaacaacacacttttaccaacgccgaacccgacaaacaaccccatacgctacccacgcccaacgataaacaaaacattaattaaacgcacgccgatatccaacacatattcaatcgatatacgttacaacgaattaaataacgaaataatcaacgcaccgatttccgtcgtatcgaaaaaaaacaaaccatcgaacgatttaccgctaccgtccaaaacgcgacctaataacgccgaaccgaacgacaactacttaccgctttacaacccttctaccgaaatatttttaacataaacacgcgcgccgaacaaaacaccttcgacttcctccaacgacattaaaaacaaccgttaaccgttaaaaccaacgacttcgctttctacttcgtacgtttcgctaccgttctaacgctcaataacacaaattacgccgaacgacaattataatccgataacttccaacaccaacccgataacgcgaattaatcgcccgtaacgacgtaccgcnaaacaactacgccattttaacttcaaaatatccaacgtaattaaccaacgaatcaaacgcgtaatcattacaccactcctaatactaccaaacgacaaaattcttaccaacgaataacgacactaacgtcgaaatcgccttatcgacgaaacttacaaccgccaaaataaaaaataaaatcgccccgcaaacgccaaccatacaaacttaaaataacgccgaacatattatccacac

SEQ ID NO: 5311 - DNA, 1084 bp, Artificial Sequence
  chemically treated genomic DNA (Homo sapiens) CpG-island No: 5311
  misc_feature (847)..(847): n is either a, c, g or t
gttatcggttagacgttaacggtggataatttttggtggcgggggttcgttaatcgttagcgtaattttacgttgggttatcgcgtagcgggtgagggagtttataattagtaatatatgttgattacgatcgcgaaaattttcggtaatgcgcgtggtataggcggtattttgtattcgtaggagcggagaaatattcgtcggagcggtaattattattgagcgtgtacgtttttcggcgtcgaggatgtttttaataaaattttttatttcgcgtttacgtttattaattaaatttacgataatgatatcggcgcgggtgtaacgtgttattatttttagtagtatatttttattaacgtcggattcggtaaatagttttatacgttgtttacgtttaacggtaagtagggtattgattgggcgtacgtcggtgtttagtatatgtttaatcggtgtacgttgtaacgggttaaatggcggggtaattagcgtatcggttttcgtcgtatcgggggagggtaggttatcgagcggtttatcgttgtcgtttagaacgcgatttaataacgtcggatcgagcggtaattgtttgtcgttttgtagtttttttgtcgaaatgtttttggtataaatacgcgcgtcgggtaggatattttcgattttttttagcggtattaaaaatagtcgttgatcgttaaagttaacgatttcgttttttatttcgtgcgtttcgttgtcgttttggcgtttaatgatataggttgcgtcgagcggtaattgtaattcggtggtttttagtattagttcggtagcgcgggttaatcgttcgtagcgacgtatcgtnaggtaattgcgttattttggttttaaagtatttagcgtggttagttagcgagttaggcgcgtggttattatattatttttggtgttgttagacggtagagtttttgttagcgagtggcgatattggcgtcgagatcgttttatcggcgggatttatagtcgttaggatggagggtgggatcgtttcgtaagcgttagttatgtaaatttaaggtagcgtcgagtatattatttatat

SEQ ID NO: 5312 - DNA, 1084 bp, Artificial Sequence
  chemically treated genomic DNA (Homo sapiens) CpG-island No: 5312
  misc_feature (238)..(238): n is either a, c, g or t
atataaataatatactcgacgctaccttaaatttacataactaacgcttacgaaacgatcccaccctccatcctaacgactataaatcccgccgataaaacgatctcgacgccaatatcgccactcgctaacaaaaactctaccgtctaacaacaccaaaaataatataataaccacgcgcctaactcgctaactaaccacgctaaatactttaaaaccaaaataacgcaattacctnacgatacgtcgctacgaacgattaacccgcgctaccgaactaatactaaaaaccaccgaattacaattaccgctcgacgcaacctatatcattaaacgccaaaacgacaacgaaacgcacgaaataaaaaacgaaatcgttaactttaacgatcaacgactatttttaataccgctaaaaaaaatcgaaaatatcctacccgacgcgcgtatttataccaaaaacatttcgacaaaaaaactacaaaacgacaaacaattaccgctcgatccgacgttattaaatcgcgttctaaacgacaacgataaaccgctcgataacctaccctcccccgatacgacgaaaaccgatacgctaattaccccgccatttaacccgttacaacgtacaccgattaaacatatactaaacaccgacgtacgcccaatcaataccctacttaccgttaaacgtaaacaacgtataaaactatttaccgaatccgacgttaataaaaatatactactaaaaataataacacgttacacccgcgccgatatcattatcgtaaatttaattaataaacgtaaacgcgaaataaaaaattttattaaaaacatcctcgacgccgaaaaacgtacacgctcaataataattaccgctccgacgaatatttctccgctcctacgaatacaaaataccgcctataccacgcgcattaccgaaaattttcgcgatcgtaatcaacatatattactaattataaactccctcacccgctacgcgataacccaacgtaaaattacgctaacgattaacgaacccccgccaccaaaaattatccaccgttaacgtctaaccgataac

SEQ ID NO: 5313 - DNA, 664 bp, Artificial Sequence
  chemically treated genomic DNA (Homo sapiens) CpG-island No: 5313
gtgaggttaaaacgttaacgggcgtagagtatttaatcgatttggtaggttaatcgcggttggtaaatagttggtggttcggtgcggtgattagcgaagagttggtaacggcggtagtattgcgttagtagtaggcgttgttgatacggttggtagaatagggcgtagattttagcgtcgacgattgtcgttgcgattaacggttttacgttagtaaatttaggcgttgaaagtgacgggtaggtaaaaaattaattttgatttcgatatcgttcgcgttgtcgaacgcggtaattcgtcgttgtagggtaattatacgttgtgggtcggattatcgtcgtttacggttacgttgttcgggtttattagtcgttttggataagatagttatttattttaggtcgcgacgtggcgagttatttttttgattagagtttgtttagcggtgcggatcgtagttacgcgtgggtggtttattcggacggacgtacgtaaaaagcgtcggtggtttattggaataagcgttacgtagagtcgatgttcggtagtattatttatgttggtttcgcggatttcgtttggagtgagacgtttgatgtttttaacgtcgatattttttagattttgacgtagcggatattttaataatgaaaaaaagatattt

SEQ ID NO: 5314 - DNA, 664 bp, Artificial Sequence
  chemically treated genomic DNA (Homo sapiens) CpG-island No: 5314
aaatatctttttttcattattaaaatatccgctacgtcaaaatctaaaaaatatcgacgttaaaaacatcaaacgtctcactccaaacgaaatccgcgaaaccaacataaataatactaccgaacatcgactctacgtaacgcttattccaataaaccaccgacgctttttacgtacgtccgtccgaataaaccacccacgcgtaactacgatccgcaccgctaaacaaactctaatcaaaaaaataactcgccacgtcgcgacctaaaataaataactatcttatccaaaacgactaataaacccgaacaacgtaaccgtaaacgacgataatccgacccacaacgtataattaccctacaacgacgaattaccgcgttcgacaacgcgaacgatatcgaaatcaaaattaattttttacctacccgtcactttcaacgcctaaatttactaacgtaaaaccgttaatcgcaacgacaatcgtcgacgctaaaatctacgccctattctaccaaccgtatcaacaacgcctactactaacgcaatactaccgccgttaccaactcttcgctaatcaccgcaccgaaccaccaactatttaccaaccgcgattaacctaccaaatcgattaaatactctacgcccgttaacgttttaacctcac

SEQ ID NO: 5315 - DNA, 664 bp, Artificial Sequence
  chemically treated genomic DNA (Homo sapiens) CpG-island No: 5315
agatgttttttttttattattgaggtattcgttgcgttagagtttgaagaatgtcggcgttaagggtattaggcgttttattttagacggagttcgcgaggttaatataaataatgttgtcgggtatcggttttacgtgacgtttgttttagtaagttatcggcgttttttgcgtgcgttcgttcgggtaaattatttacgcgtagttgcgattcgtatcgttgagtaggttttggttagagagatagttcgttacgtcgcgatttggagtgaatggttgttttgtttaggacggttgataagttcgaataacgtgatcgtggacggcggtggttcgatttatagcgtgtagttgttttgtaacggcgggttatcgcgttcggtaacgcggacgatatcgggattaagattgattttttgtttgttcgttatttttaacgtttgaatttgttggcgtaaggtcgttaatcgtagcggtagtcgtcggcgttggaatttgcgttttgttttgttagtcgtgttagtaacgtttgttgttgacgtaatgttgtcgtcgttgttagtttttcgttaattatcgtatcgggttattagttgtttgttagtcgcggttggtttattagatcgattaaatgttttgcgttcgttagcgttttggttttat

SEQ ID NO: 5316 - DNA, 664 bp, Artificial Sequence
  chemically treated genomic DNA (Homo sapiens) CpG-island No: 5316
ataaaaccaaaacgctaacgaacgcaaaacatttaatcgatctaataaaccaaccgcgactaacaaacaactaataacccgatacgataattaacgaaaaactaacaacgacgacaacattacgtcaacaacaaacgttactaacacgactaacaaaacaaaacgcaaattccaacgccgacgactaccgctacgattaacgaccttacgccaacaaattcaaacgttaaaaataacgaacaaacaaaaaatcaatcttaatcccgatatcgtccgcgttaccgaacgcgataacccgccgttacaaaacaactacacgctataaatcgaaccaccgccgtccacgatcacgttattcgaacttatcaaccgtcctaaacaaaacaaccattcactccaaatcgcgacgtaacgaactatctctctaaccaaaacctactcaacgatacgaatcgcaactacgcgtaaataatttacccgaacgaacgcacgcaaaaaacgccgataacttactaaaacaaacgtcacgtaaaaccgatacccgacaacattatttatattaacctcgcgaactccgtctaaaataaaacgcctaatacccttaacgccgacattcttcaaactctaacgcaacgaatacctcaataataaaaaaaaaacatct

SEQ ID NO: 5317 - DNA, 744 bp, Artificial Sequence
  chemically treated genomic DNA (Homo sapiens) CpG-island No: 5317
gtcgtcgtcgcggagggggcgtgttttatagagcgagtgggtgtaattagagggggcgtggttagaaatcggggggcggtatggagtgttcgaggttttatttattttcgttttttagcgcgcggacgtggtaggcggttaagcgtttttggttgtttttcgggaagtcgttggtcgcgtttgcgtagtgaatcgttgaggttgtgttgagcgtttttttttcgcgtaattttcggtttcgatatcgtttttttttttatgaatttttaatttaacgtggttatagttagtttaagatcggtatttttcgggtttcgttttgtaggatttcggtttggtttcgagggtttttatataggttatcgtaggtttttttaattttcgtcgtttttaggttcgcggtattagtgagattttagtttcgatttttttaggattatttcgatttttcgtaggtttttaaggtttgagcgtttttcgattagttcgttttttatcgtttttttatcgggtttttcgtaaggttttttaaacgcgattttcgaagttcgttttttacggggaagttttttcgttcgttgtttgcgaagtttcgttttgtattggtgttcgtgttttttttttcgtcggtttcgaagtttcgtttttcgaagttttttttatttattttttttataggttttagtttcgtttattatagttttttacggtacgttttttttaggttttatagtcgtgtatttt

SEQ ID NO: 5318 - DNA, 744 bp, Artificial Sequence
  chemically treated genomic DNA (Homo sapiens) CpG-island No: 5318
aaaatacacgactataaaacctaaaaaaaacgtaccgtaaaaaactataataaacgaaactaaaacctataaaaaaaataaataaaaaaaacttcgaaaaacgaaacttcgaaaccgacgaaaaaaaaaacacgaacaccaatacaaaacgaaacttcgcaaacaacgaacgaaaaaacttccccgtaaaaaacgaacttcgaaaatcgcgtttaaaaaaccttacgaaaaacccgataaaaaaacgataaaaaacgaactaatcgaaaaacgctcaaaccttaaaaacctacgaaaaatcgaaataatcctaaaaaaatcgaaactaaaatctcactaataccgcgaacctaaaaacgacgaaaattaaaaaaacctacgataacctatataaaaaccctcgaaaccaaaccgaaatcctacaaaacgaaacccgaaaaataccgatcttaaactaactataaccacgttaaattaaaaattcataaaaaaaaaaacgatatcgaaaccgaaaattacgcgaaaaaaaaacgctcaacacaacctcaacgattcactacgcaaacgcgaccaacgacttcccgaaaaacaaccaaaaacgcttaaccgcctaccacgtccgcgcgctaaaaaacgaaaataaataaaacctcgaacactccataccgccccccgatttctaaccacgccccctctaattacacccactcgctctataaaacacgccccctccgcgacgacgac

SEQ ID NO: 5319 - DNA, 744 bp, Artificial Sequence
  chemically treated genomic DNA (Homo sapiens) CpG-island No: 5319
gaggtgtacggttgtgaggtttgagaggggcgtgtcgtagggagttgtgatgggcggggttgagatttgtgaggagagtgagtgggaagaatttcgaggggcggggtttcggggtcggcgaggggaggggtacggatattagtataggacggggtttcgtagatagcgagcggaggggttttttcgtaaggggcgggtttcgagggtcgcgtttggaaggttttacgaggggttcggtggaagggcggtgaagggcgggttaatcgggaggcgtttaggttttgaaggtttgcgggaggtcgaaatggttttggggaggtcgaggttgaggttttattagtatcgcgggtttggaagcggcgggagttgaaagagtttgcggtgatttgtatggaagttttcgaagttaggtcgaggttttataagacggagttcgagaggtgtcggttttaagttgattgtgattacgttaaattaaggatttataggaaggaaggcggtgtcgaagtcgggagttgcgcggagaaggagcgtttaatatagttttagcggtttattacgtaagcgcgattaacggtttttcgggaagtagttaaaaacgtttggtcgtttattacgttcgcgcgttggagggcggaagtgggtgagatttcgggtattttatatcgtttttcggtttttggttacgttttttttggttatatttattcgttttgtaaggtacgtttttttcgcggcggcggt

SEQ ID NO: 5320 - DNA, 744 bp, Artificial Sequence
  chemically treated genomic DNA (Homo sapiens) CpG-island No: 5320
accgccgccgcgaaaaaaacgtaccttacaaaacgaataaatataaccaaaaaaaacgtaaccaaaaaccgaaaaacgatataaaatacccgaaatctcacccacttccgccctccaacgcgcgaacgtaataaacgaccaaacgtttttaactacttcccgaaaaaccgttaatcgcgcttacgtaataaaccgctaaaactatattaaacgctccttctccgcgcaactcccgacttcgacaccgccttccttcctataaatccttaatttaacgtaatcacaatcaacttaaaaccgacacctctcgaactccgtcttataaaacctcgacctaacttcgaaaacttccatacaaatcaccgcaaactctttcaactcccgccgcttccaaacccgcgatactaataaaacctcaacctcgacctccccaaaaccatttcgacctcccgcaaaccttcaaaacctaaacgcctcccgattaacccgcccttcaccgcccttccaccgaacccctcgtaaaaccttccaaacgcgaccctcgaaacccgccccttacgaaaaaacccctccgctcgctatctacgaaaccccgtcctatactaatatccgtacccctcccctcgccgaccccgaaaccccgcccctcgaaattcttcccactcactctcctcacaaatctcaaccccgcccatcacaactccctacgacacgcccctctcaaacctcacaaccgtacacctc

SEQ ID NO: 5321 - DNA, 593 bp, Artificial Sequence
  chemically treated genomic DNA (Homo sapiens) CpG-island No: 5321
gataacgcggtagttcgttaaattgtcgtgaagtgcggtatttcgtaggttagataaggcggttacgtcgtattcgatatttaacgttcgagtcggttgtttgatgcgacgttggcgcgttttattaggtttataaaaggtgttagaatcgtaggtcggataaggcgtttacgtcgtattcggtaataagtgtttcgatgtttgatgcgacgtttgtcgcgttttattaggtttgtaaaatgtgttagaatcgcgtagggcggataaggcgtttacgtcgtattcggtaataagtaatgagtatcgagattataatttattttagtggtttcgttagtatcggagtattcgtcgtttgttggcgtattatagcgattatatagtagtaacgacgatatcgtagttaaacgaaagtagggcggtaggtagcgttacgtaattatatgttagttttagcgttagtattatattttcgtaatatgcgtcgacggcgttatcgaggttaaacgttatttgtttatttgcggtatttaataatttttcgttttaggcgtaatgtaggtaataagtattcgtagtaggtgttgatacgg

SEQ ID NO: 5322 - DNA, 593 bp, Artificial Sequence
  chemically treated genomic DNA (Homo sapiens) CpG-island No: 5322
ccgtatcaacacctactacgaatacttattacctacattacgcctaaaacgaaaaattattaaataccgcaaataaacaaataacgtttaacctcgataacgccgtcgacgcatattacgaaaatataatactaacgctaaaactaacatataattacgtaacgctacctaccgccctactttcgtttaactacgatatcgtcgttactactatataatcgctataatacgccaacaaacgacgaatactccgatactaacgaaaccactaaaataaattataatctcgatactcattacttattaccgaatacgacgtaaacgccttatccgccctacgcgattctaacacattttacaaacctaataaaacgcgacaaacgtcgcatcaaacatcgaaacacttattaccgaatacgacgtaaacgccttatccgacctacgattctaacaccttttataaacctaataaaacgcgccaacgtcgcatcaaacaaccgactcgaacgttaaatatcgaatacgacgtaaccgccttatctaacctacgaaataccgcacttcacgacaatttaacgaactaccgcgttatc

SEQ ID NO: 5323 - DNA, 593 bp, Artificial Sequence
  chemically treated genomic DNA (Homo sapiens) CpG-island No: 5323
tcgtgttagtatttgttacgaatatttgttatttatattacgtttaaggcggagagttattaggtgtcgtaggtgggtaaatagcgtttaatttcggtagcgtcgtcggcgtatattgcggaggtatgatgttgacgttggggttggtatataattacgtggcgttgtttgtcgttttgttttcgtttggttgcgatgtcgtcgttgttgttgtatggtcgttataatgcgttagtaagcggcggatatttcggtgttggcgaaattattggggtaggttatagtttcggtgtttattatttattgtcggatgcggcgtgaacgttttattcgttttacgcggttttggtatattttgtaggtttgataagacgcggtaagcgtcgtattaggtatcggagtatttattgtcggatgcggcgtgaacgttttattcggtttacggttttggtattttttgtaggtttgataagacgcgttagcgtcgtattaggtaatcggttcgggcgttggatgtcggatgcggcgtgatcgttttgtttgatttacggggtgtcgtattttacggtagtttagcgaattatcgcgttgtt

SEQ ID NO: 5324 - DNA, 593 bp, Artificial Sequence
  chemically treated genomic DNA (Homo sapiens) CpG-island No: 5324
aacaacgcgataattcgctaaactaccgtaaaatacgacaccccgtaaatcaaacaaaacgatcacgccgcatccgacatccaacgcccgaaccgattacctaatacgacgctaacgcgtcttatcaaacctacaaaaaataccaaaaccgtaaaccgaataaaacgttcacgccgcatccgacaataaatactccgatacctaatacgacgcttaccgcgtcttatcaaacctacaaaatataccaaaaccgcgtaaaacgaataaaacgttcacgccgcatccgacaataaataataaacaccgaaactataacctaccccaataatttcgccaacaccgaaatatccgccgcttactaacgcattataacgaccatacaacaacaacgacgacatcgcaaccaaacgaaaacaaaacgacaaacaacgccacgtaattatataccaaccccaacgtcaacatcatacctccgcaatatacgccgacgacgctaccgaaattaaacgctatttacccacctacgacacctaataactctccgccttaaacgtaatataaataacaaatattcgtaacaaatactaacacga

SEQ ID NO: 5325 - DNA, 563 bp, Artificial Sequence
  chemically treated genomic DNA (Homo sapiens) CpG-island No: 5325
gtggtttggatgattttatttgatggtaaatatcgtatcgttgtttggttaggaatgggaatacggtgaagatatggcgttggcgatttgttgcgcggtaattgattttcgtgggttggtcgaattgtcgattatgttaattattatgatggaattacggggtcgtgatttgcgtcgttgaataaattggcgtgggattacgtatgggtgatttttattcggaaaaattattaagagcgattggggttttcgggaagttgcggttatggttgaggcgttaattaattgttcggtcgaataaatggtagtttggtcgttagatttttttgtatcgtattaatcgatgcgaaaaggattgtaaggtggtcgaatagacggcgcgcgtgtatgatacgtaaatttcgtcgttacgttttttttgtgttcgtgcgtacggttcggaagtggggttttcgtagagtttgggggaggtttacgatatgttgtacgataaattttttgagagggataattgtggtttcggtttgatcgtttatatagaaggcgaatttagttataaggta

SEQ ID NO: 5326 - DNA, 563 bp, Artificial Sequence
  chemically treated genomic DNA (Homo sapiens) CpG-island No: 5326
taccttataactaaattcgccttctatataaacgatcaaaccgaaaccacaattatccctctcaaaaaatttatcgtacaacatatcgtaaacctcccccaaactctacgaaaaccccacttccgaaccgtacgcacgaacacaaaaaaaacgtaacgacgaaatttacgtatcatacacgcgcgccgtctattcgaccaccttacaatccttttcgcatcgattaatacgatacaaaaaaatctaacgaccaaactaccatttattcgaccgaacaattaattaacgcctcaaccataaccgcaacttcccgaaaaccccaatcgctcttaataatttttccgaataaaaatcacccatacgtaatcccacgccaatttattcaacgacgcaaatcacgaccccgtaattccatcataataattaacataatcgacaattcgaccaacccacgaaaatcaattaccgcgcaacaaatcgccaacgccatatcttcaccgtattcccattcctaaccaaacaacgatacgatatttaccatcaaataaaatcatccaaaccac

SEQ ID NO: 5327 - DNA, 563 bp, Artificial Sequence
  chemically treated genomic DNA (Homo sapiens) CpG-island No: 5327
tattttgtggttaggttcgttttttatgtgggcgattaggtcgaaattatagttattttttttaagggatttatcgtataatatatcgtgaattttttttaggttttgcgggaattttattttcgaatcgtgcgtacgggtatagaaagagcgtggcgacggggtttgcgtgttatatacgcgcgtcgtttgttcgattattttgtagtttttttcgtatcggttaatacggtgtagagggatttgacggttaggttattatttattcggtcgaatagttgattggcgttttaattatggtcgtaatttttcggggattttagtcgtttttagtggttttttcgagtaggggttatttatacgtagttttacgttagtttgtttagcggcgtaggttacgatttcgtagttttattatgatggttaatataatcggtagttcgattagtttacgggaattaattgtcgcgtaataaatcgttagcgttatgtttttatcgtatttttatttttggttaaataacgatgcgatatttgttattaggtgaggttatttaggttat

SEQ ID NO: 5328 - DNA, 563 bp, Artificial Sequence
  chemically treated genomic DNA (Homo sapiens) CpG-island No: 5328
ataacctaaataacctcacctaataacaaatatcgcatcgttatttaaccaaaaataaaaatacgataaaaacataacgctaacgatttattacgcgacaattaattcccgtaaactaatcgaactaccgattatattaaccatcataataaaactacgaaatcgtaacctacgccgctaaacaaactaacgtaaaactacgtataaataacccctactcgaaaaaaccactaaaaacgactaaaatccccgaaaaattacgaccataattaaaacgccaatcaactattcgaccgaataaataataacctaaccgtcaaatccctctacaccgtattaaccgatacgaaaaaaactacaaaataatcgaacaaacgacgcgcgtatataacacgcaaaccccgtcgccacgctctttctatacccgtacgcacgattcgaaaataaaattcccgcaaaacctaaaaaaaattcacgatatattatacgataaatcccttaaaaaaaataactataatttcgacctaatcgcccacataaaaaacgaacctaaccacaaaata

SEQ ID NO: 5329 - DNA, 630 bp, Artificial Sequence
  chemically treated genomic DNA (Homo sapiens) CpG-island No: 5329
  misc_feature (581)..(581): n is either a, c, g or t
tgatattagtagttgtgtatacggatgatgcgggtcgtcgagtacgcggtcggttaaggtattttttattatttgtttttgttttattattagtaaacggttcgttagtagggacgatacgttaatattatgggtgataattattatcgcgagttttagttttattattaggtcgcgtagtaggtcgagtaggcgggtttgtatcgatatatttagttcgtcggtcggtttatttataaatattagtttcggatgcgttattaggttgcgggtaatttgtaaacgttgttgtatatcgtcggaaaaggtggtcggtaggtcgtcgattcggttggcgggaatttttattttttttagttatttttgcgcggtggtacgaatattttcgtaatgacgtgtttcggtcgttattaatcgttcgcgatatttgcggtttgtcgatagtttggcgggtaagcgttcgagtggatgttgatgtattacgttttattttggtagtagtagggacgggcgtcggtttcgtaattgtataaagcgaacggtttttttaatgaattttttttgtttgggtttttaggggncggaaatttattttcgggcgagtatgtaggtttgtaggtttagtttttt

SEQ ID NO: 5330 - DNA, 630 bp, Artificial Sequence
  chemically treated genomic DNA (Homo sapiens) CpG-island No: 5330
  misc_feature (50)..(50): n is either a, c, g or t
aaaaaactaaacctacaaacctacatactcgcccgaaaataaatttccgncccctaaaaacccaaacaaaaaaaattcattaaaaaaaccgttcgctttatacaattacgaaaccgacgcccgtccctactactaccaaaataaaacgtaatacatcaacatccactcgaacgcttacccgccaaactatcgacaaaccgcaaatatcgcgaacgattaataacgaccgaaacacgtcattacgaaaatattcgtaccaccgcgcaaaaataactaaaaaaaataaaaattcccgccaaccgaatcgacgacctaccgaccaccttttccgacgatatacaacaacgtttacaaattacccgcaacctaataacgcatccgaaactaatatttataaataaaccgaccgacgaactaaatatatcgatacaaacccgcctactcgacctactacgcgacctaataataaaactaaaactcgcgataataattatcacccataatattaacgtatcgtccctactaacgaaccgtttactaataataaaacaaaaacaaataataaaaaataccttaaccgaccgcgtactcgacgacccgcatcatccgtatacacaactactaatatca

SEQ ID NO: 5331 - DNA, 630 bp, Artificial Sequence
  chemically treated genomic DNA (Homo sapiens) CpG-island No: 5331
  misc_feature (50)..(50): n is either a, c, g or t
ggaaggttggatttgtaggtttgtatgttcgttcgggagtaaattttcgntttttgaaagtttaagtaggggaaatttattaagagaatcgttcgttttatgtaattacgaagtcgacgttcgtttttgttgttattagaatggggcgtggtgtattagtatttattcgaacgtttgttcgttaagttgtcggtaggtcgtaaatatcgcgagcggttgatggcgatcggggtacgttattacgggaatattcgtgttatcgcgtagaagtggttggaagaggtggagattttcgttaatcggatcgacgatttgtcgattatttttttcggcggtatgtagtagcgtttgtagattgttcgtaatttggtgacgtattcgaagttggtgtttatggatgaatcgatcggcgggttggatgtgtcggtgtaggttcgtttgttcgatttgttgcgcggtttggtggtggagttgaaattcgcggtggtgattgttatttatgatgttagcgtatcgtttttgttggcggatcgtttgttggtgatgaagtaggggtaagtggtggagagtgttttaatcgatcgcgtgttcgacgattcgtattattcgtatatatagttgttggtgtta

SEQ ID NO: 5332 - DNA, 630 bp, Artificial Sequence
  chemically treated genomic DNA (Homo sapiens) CpG-island No: 5332
  misc_feature (581)..(581): n is either a, c, g or t
taacaccaacaactatatatacgaataatacgaatcgtcgaacacgcgatcgattaaaacactctccaccacttacccctacttcatcaccaacaaacgatccgccaacaaaaacgatacgctaacatcataaataacaatcaccaccgcgaatttcaactccaccaccaaaccgcgcaacaaatcgaacaaacgaacctacaccgacacatccaacccgccgatcgattcatccataaacaccaacttcgaatacgtcaccaaattacgaacaatctacaaacgctactacataccgccgaaaaaaataatcgacaaatcgtcgatccgattaacgaaaatctccacctcttccaaccacttctacgcgataacacgaatattcccgtaataacgtaccccgatcgccatcaaccgctcgcgatatttacgacctaccgacaacttaacgaacaaacgttcgaataaatactaatacaccacgccccattctaataacaacaaaaacgaacgtcgacttcgtaattacataaaacgaacgattctcttaataaatttcccctacttaaactttcaaaaancgaaaatttactcccgaacgaacatacaaacctacaaatccaaccttcc

SEQ ID NO: 5333 - DNA, 602 bp, Artificial Sequence
  chemically treated genomic DNA (Homo sapiens) CpG-island No: 5333
gtgcggtagagtgcgtcgtgtgtcgggttagcgtggcgtgagagtgaggcggagaggaggggtcggcggcgatcgggagtggggttcgtgtggcgtagacgaggtgtagtagcgacgcgtggagagtggggcggagagtgggcggcgtgggaatgacggggtgagtgttgtcgtggcggtgtgacggcgatggtggtggggggtgagttgtgtagtacggggcgatgatggggtggtagcgtgtgcgagtgagtaggtttggttggtgggtggtcggcgataggttggagtcgagtcgtcgacgggcgcggtagatatcgcgcgttttgtaggtttattatggttgacggagtagttttgtgcgttttaggcggtttttgtttagcgaggtgggattacgattttgacggtcgaaatcgtattcggtagtaaaatcgtgattttgattcggtgtttaggtaaattcgatattgtcgtcgcggttggagaattttttaatacgcggcgttttttcggtatcggtggtcgttgagttttgcgggttattttttttacgttttgttaggttgtcgtaagtttttatttttagtatattattaatt

SEQ ID NO: 5334 - DNA, 602 bp, Artificial Sequence
  chemically treated genomic DNA (Homo sapiens) CpG-island No: 5334
aattaataatatactaaaaataaaaacttacgacaacctaacaaaacgtaaaaaaaataacccgcaaaactcaacgaccaccgataccgaaaaaacgccgcgtattaaaaaattctccaaccgcgacgacaatatcgaatttacctaaacaccgaatcaaaatcacgattttactaccgaatacgatttcgaccgtcaaaatcgtaatcccacctcgctaaacaaaaaccgcctaaaacgcacaaaactactccgtcaaccataataaacctacaaaacgcgcgatatctaccgcgcccgtcgacgactcgactccaacctatcgccgaccacccaccaaccaaacctactcactcgcacacgctaccaccccatcatcgccccgtactacacaactcaccccccaccaccatcgccgtcacaccgccacgacaacactcaccccgtcattcccacgccgcccactctccgccccactctccacgcgtcgctactacacctcgtctacgccacacgaaccccactcccgatcgccgccgacccctcctctccgcctcactctcacgccacgctaacccgacacacgacgcactctaccgcac

SEQ ID NO: 5335 - DNA, 602 bp, Artificial Sequence
  chemically treated genomic DNA (Homo sapiens) CpG-island No: 5335
aattgatggtgtgttgggaatgaaagtttacggtagtttggtaaaacgtgaaaaggatgattcgtaaaatttaacgattatcgatatcggagaaacgtcgcgtattgaaggattttttagtcgcgacggtaatgtcgaatttgtttggatatcgaattaaaattacgattttattgtcggatacggtttcgatcgttaggatcgtgattttatttcgttggataaaaatcgtttggaacgtatagaattatttcgttagttataatggatttgtaggacgcgcggtgtttgtcgcgttcgtcggcggttcggttttaatttatcgtcggttatttattagttagatttgtttattcgtatacgttgttattttattatcgtttcgtgttgtataatttattttttattattatcgtcgttatatcgttacgataatatttatttcgttatttttacgtcgtttatttttcgttttattttttacgcgtcgttgttatatttcgtttgcgttatacgggttttattttcggtcgtcgtcggtttttttttttcgttttatttttacgttacgttggttcgatatacggcgtattttgtcgtat

SEQ ID NO: 5336 - DNA, 602 bp, Artificial Sequence
  chemically treated genomic DNA (Homo sapiens) CpG-island No: 5336
atacgacaaaatacgccgtatatcgaaccaacgtaacgtaaaaataaaacgaaaaaaaaaaaccgacgacgaccgaaaataaaacccgtataacgcaaacgaaatataacaacgacgcgtaaaaaataaaacgaaaaataaacgacgtaaaaataacgaaataaatattatcgtaacgatataacgacgataataataaaaaataaattatacaacacgaaacgataataaaataacaacgtatacgaataaacaaatctaactaataaataaccgacgataaattaaaaccgaaccgccgacgaacgcgacaaacaccgcgcgtcctacaaatccattataactaacgaaataattctatacgttccaaacgatttttatccaacgaaataaaatcacgatcctaacgatcgaaaccgtatccgacaataaaatcgtaattttaattcgatatccaaacaaattcgacattaccgtcgcgactaaaaaatccttcaatacgcgacgtttctccgatatcgataatcgttaaattttacgaatcatccttttcacgttttaccaaactaccgtaaactttcattcccaacacaccatcaatt

SEQ ID NO: 5337 - DNA, 618 bp, Artificial Sequence
  chemically treated genomic DNA (Homo sapiens) CpG-island No: 5337
gcgatcgttttttagtgttattacggttttagggattcgtagttcgtacgttcggttgcggttacgcgtacggtatcgtaggattatcggagtagcgttgatattcgtcggcggtttagttttcgtagatagtcgtcgcggttttatttcgggatcgtgcgcgattaggaattacgtcgagcgaaacgttcgcgtttttatcgagttcgcgtagacgtacgcggatacggtaagggcgcgtagcggtttcggtagtttagtttgtatattggattttttagacgagagttcgtcgtagcgcggggttagaacggcggattacgagatttaaacgttgtcggggagaatatcggacggtttagatattagttatagattaaaagttagagtacgcgtcgtgtttatattaaagcgtcggcgaacggcgtttatttaattcgatgtcgcgtcgtggttatttagtcggacgaattttaaaattttaggttagattattcgagttttttattattatcgttattacgatttacgttagggtataacgttaaattcggaggcgttatcgtatatttatttttgggaatttggttaggtttaggaggtattgggttttatttt

SEQ ID NO: 5338 - DNA, 618 bp, Artificial Sequence
  chemically treated genomic DNA (Homo sapiens) CpG-island No: 5338
aaaataaaacccaatacctcctaaacctaaccaaattcccaaaaataaatatacgataacgcctccgaatttaacgttataccctaacgtaaatcgtaataacgataataataaaaaactcgaataatctaacctaaaattttaaaattcgtccgactaaataaccacgacgcgacatcgaattaaataaacgccgttcgccgacgctttaatataaacacgacgcgtactctaacttttaatctataactaatatctaaaccgtccgatattctccccgacaacgtttaaatctcgtaatccgccgttctaaccccgcgctacgacgaactctcgtctaaaaaatccaatatacaaactaaactaccgaaaccgctacgcgcccttaccgtatccgcgtacgtctacgcgaactcgataaaaacgcgaacgtttcgctcgacgtaattcctaatcgcgcacgatcccgaaataaaaccgcgacgactatctacgaaaactaaaccgccgacgaatatcaacgctactccgataatcctacgataccgtacgcgtaaccgcaaccgaacgtacgaactacgaatccctaaaaccgtaataacactaaaaaacgatcgc

SEQ ID NO: 5339 - DNA, 618 bp, Artificial Sequence
  chemically treated genomic DNA (Homo sapiens) CpG-island No: 5339
gggatggagtttagtgttttttggatttggttaagtttttagggataagtatgcggtggcgttttcggatttggcgttgtattttgacgtaagtcgtgatggcggtagtggtggagggttcgagtgatttggtttgaagttttgggattcgttcgattggatggttacggcgcgatatcgagttaagtggacgtcgttcgtcggcgttttagtgtgggtacggcgcgtgttttggtttttggtttgtggttggtgtttgggtcgttcggtgtttttttcggtagcgtttgggtttcgtggttcgtcgttttgatttcgcgttgcggcgggttttcgtttgggaagtttaatgtgtagattgggttgtcgaggtcgttgcgcgtttttgtcgtgttcgcgtgcgtttacgcgagttcggtgaaggcgcgggcgtttcgttcggcgtggtttttggtcgcgtacgatttcgaaataggatcgcggcggttgtttgcgggggttgagtcgtcggcgggtattagcgttgtttcggtggttttgcggtgtcgtgcgcgtggtcgtagtcgagcgtacgggttgcggatttttgggatcgtagtagtattagaaggcgatcgt

SEQ ID NO: 5340 - DNA, 618 bp, Artificial Sequence
  chemically treated genomic DNA (Homo sapiens) CpG-island No: 5340
acgatcgccttctaatactactacgatcccaaaaatccgcaacccgtacgctcgactacgaccacgcgcacgacaccgcaaaaccaccgaaacaacgctaatacccgccgacgactcaacccccgcaaacaaccgccgcgatcctatttcgaaatcgtacgcgaccaaaaaccacgccgaacgaaacgcccgcgccttcaccgaactcgcgtaaacgcacgcgaacacgacaaaaacgcgcaacgacctcgacaacccaatctacacattaaacttcccaaacgaaaacccgccgcaacgcgaaatcaaaacgacgaaccacgaaacccaaacgctaccgaaaaaaacaccgaacgacccaaacaccaaccacaaaccaaaaaccaaaacacgcgccgtacccacactaaaacgccgacgaacgacgtccacttaactcgatatcgcgccgtaaccatccaatcgaacgaatcccaaaacttcaaaccaaatcactcgaaccctccaccactaccgccatcacgacttacgtcaaaatacaacgccaaatccgaaaacgccaccgcatacttatccctaaaaacttaaccaaatccaaaaaacactaaactccatccc

SEQ ID NO: 5341 - DNA, 590 bp, Artificial Sequence
  chemically treated genomic DNA (Homo sapiens) CpG-island No: 5341
  misc_feature (53)..(53): n is either a, c, g or t
  misc_feature (65)..(65): n is either a, c, g or t
  misc_feature (327)..(327): n is either a, c, g or t
aggtggttcgaagggttatcggtcggttttaagtcggggaaaagtcgtaattnggggattatcgnttatcggaatttcgttatttcggggcgggatttaggggaagtataaatttaaacgcggtcggggcggagcggttcggatcgcgggagtcgttcgatagaggtatatagcgggtagagttttggcgattcgtaaaacgtaaaaggcggcggggtcgatttaggattcgacggataggtaggcggggtatagaaggtcgtaggagagtagtagcgtcgttagagaggcggaagaggtacgttaagtcggagtttaagaattagnggtacgggagagaaaattaagagtaggcgggagtcgaggttttagtaaggaatcggtaggggcggagtcgaggttttggcggacgggtaggtagtagagacgagtttagaatcgagttttaggtcgggtacgacgtagaggcgggagatcgtttcggggagttacgatcgggggcgtaaggtacgaacgtagggtataggaatttcgattttttaggataagtaagttttcgggacgttttttaaggcggttttaggataagt

SEQ ID NO: 5342 - DNA, 590 bp, Artificial Sequence
  chemically treated genomic DNA (Homo sapiens) CpG-island No: 5342
  misc_feature (264)..(264): n is either a, c, g or t
  misc_feature (526)..(526): n is either a, c, g or t
  misc_feature (538)..(538): n is either a, c, g or t
acttatcctaaaaccgccttaaaaaacgtcccgaaaacttacttatcctaaaaaatcgaaattcctataccctacgttcgtaccttacgcccccgatcgtaactccccgaaacgatctcccgcctctacgtcgtacccgacctaaaactcgattctaaactcgtctctactacctacccgtccgccaaaacctcgactccgcccctaccgattccttactaaaacctcgactcccgcctactcttaattttctctcccgtaccnctaattcttaaactccgacttaacgtacctcttccgcctctctaacgacgctactactctcctacgaccttctataccccgcctacctatccgtcgaatcctaaatcgaccccgccgccttttacgttttacgaatcgccaaaactctacccgctatatacctctatcgaacgactcccgcgatccgaaccgctccgccccgaccgcgtttaaatttatacttcccctaaatcccgccccgaaataacgaaattccgataancgataatccccnaattacgacttttccccgacttaaaaccgaccgataacccttcgaaccacct

SEQ ID NO: 5343 - DNA, 590 bp, Artificial Sequence
  chemically treated genomic DNA (Homo sapiens) CpG-island No: 5343
  misc_feature (264)..(264): n is either a, c, g or t
  misc_feature (526)..(526): n is either a, c, g or t
  misc_feature (538)..(538): n is either a, c, g or t
gtttgttttggggtcgttttggggggcgtttcgggggtttgtttgttttggggggtcggggtttttgtgttttgcgttcgtgttttgcgttttcggtcgtggtttttcggggcggtttttcgtttttgcgtcgtgttcggtttggggttcggttttgggttcgtttttgttgtttgttcgttcgttagggtttcggtttcgtttttgtcggttttttgttggggtttcggttttcgtttgtttttggttttttttttcgtgttnttggtttttgggtttcggtttggcgtgtttttttcgtttttttggcggcgttgttgtttttttgcggttttttgtgtttcgtttgtttgttcgtcgggttttgggtcggtttcgtcgttttttgcgttttgcgggtcgttagggttttgttcgttgtgtgtttttgtcgggcggttttcgcggttcgggtcgtttcgtttcggtcgcgtttgggtttgtgttttttttgggtttcgtttcggggtggcggggtttcggtggncggtggtttttnggttgcggttttttttcggtttggggtcggtcggtggtttttcgggttattt

SEQ ID NO: 5344 - DNA, 590 bp, Artificial Sequence
  chemically treated genomic DNA (Homo sapiens) CpG-island No: 5344
  misc_feature (53)..(53): n is either a, c, g or t
  misc_feature (65)..(65): n is either a, c, g or t
  misc_feature (327)..(327): n is either a, c, g or t
aaataacccgaaaaaccaccgaccgaccccaaaccgaaaaaaaaccgcaaccnaaaaaccaccgnccaccgaaaccccgccaccccgaaacgaaacccaaaaaaaacacaaacccaaacgcgaccgaaacgaaacgacccgaaccgcgaaaaccgcccgacaaaaacacacaacgaacaaaaccctaacgacccgcaaaacgcaaaaaacgacgaaaccgacccaaaacccgacgaacaaacaaacgaaacacaaaaaaccgcaaaaaaacaacaacgccgccaaaaaaacgaaaaaaacacgccaaaccgaaacccaaaaaccaanaacacgaaaaaaaaaaccaaaaacaaacgaaaaccgaaaccccaacaaaaaaccgacaaaaacgaaaccgaaaccctaacgaacgaacaaacaacaaaaacgaacccaaaaccgaaccccaaaccgaacacgacgcaaaaacgaaaaaccgccccgaaaaaccacgaccgaaaacgcaaaacacgaacgcaaaacacaaaaaccccgaccccccaaaacaaacaaacccccgaaacgccccccaaaacgaccccaaaacaaac

SEQ ID NO: 5345 - DNA, 521 bp, Artificial Sequence
  chemically treated genomic DNA (Homo sapiens) CpG-island No: 5345
tatgtttcgcgttatagcgcgtattttatcggaattattttagtagtatttgacggggtatatcggtttgtcgggcgtacgtgggtgcgggtgaatgaagaattttcgtggtttgacgatttcgtggtgaggttgtcgtaatgacgtatttggaattggttttcgtttcgtttgtcgcgtaattggcgggcgtgatagtatttatggaaaaatcgttgcgttgaataatattattttcgatatttcggttcgttgtatggtcgggttgattggtcggacggcgtcgggaagtcgagtttgttgtcgttgattttcggtgttcgcgttattgaatagggtaatgtgatggtgttgggcggcgatatgcgcgattcgaagtatcgtcgcgacgtttgttcgcgtatcgtttggatgtcgtagggttgggtaaaaatttttattatattttgtcggtgtatgaaaacgtcgattttttcgttcgtttgttcggttacgataaagcggagtggatagtgcgaatt

SEQ ID NO: 5346 - DNA, 521 bp, Artificial Sequence
  chemically treated genomic DNA (Homo sapiens) CpG-island No: 5346
aattcgcactatccactccgctttatcgtaaccgaacaaacgaacgaaaaaatcgacgttttcatacaccgacaaaatataataaaaatttttacccaaccctacgacatccaaacgatacgcgaacaaacgtcgcgacgatacttcgaatcgcgcatatcgccgcccaacaccatcacattaccctattcaataacgcgaacaccgaaaatcaacgacaacaaactcgacttcccgacgccgtccgaccaatcaacccgaccatacaacgaaccgaaatatcgaaaataatattattcaacgcaacgatttttccataaatactatcacgcccgccaattacgcgacaaacgaaacgaaaaccaattccaaatacgtcattacgacaacctcaccacgaaatcgtcaaaccacgaaaattcttcattcacccgcacccacgtacgcccgacaaaccgatataccccgtcaaatactactaaaataattccgataaaatacgcgctataacgcgaaacata

SEQ ID NO: 5347 - DNA, 521 bp, Artificial Sequence
  chemically treated genomic DNA (Homo sapiens) CpG-island No: 5347
gattcgtattgtttatttcgttttgtcgtgatcgaataggcgagcgaaaaaatcgacgtttttatatatcgataaggtgtggtagaggtttttgtttagttttgcggtatttaggcgatgcgcgggtagacgtcgcggcgatgtttcgggtcgcgtatatcgtcgtttagtattattatattgttttgtttaatgacgcgggtatcggaaattaacgataataagttcgatttttcgacgtcgttcggttaattagttcgattatatagcgggtcggaatatcgagagtgatattgtttagcgtaacggtttttttataagtgttgttacgttcgttagttgcgcgataggcgggacgggaattagttttagatgcgttattgcggtaattttattacgaggtcgttaggttacggaagttttttatttattcgtatttacgtacgttcggtaaatcggtatatttcgttagatgttgttggagtaatttcggtgagatacgcgttatgacgcggaatatg

SEQ ID NO: 5348 - DNA, 521 bp, Artificial Sequence
  chemically treated genomic DNA (Homo sapiens) CpG-island No: 5348
catattccgcgtcataacgcgtatctcaccgaaattactccaacaacatctaacgaaatataccgatttaccgaacgtacgtaaatacgaataaataaaaaacttccgtaacctaacgacctcgtaataaaattaccgcaataacgcatctaaaactaattcccgtcccgcctatcgcgcaactaacgaacgtaacaacacttataaaaaaaccgttacgctaaacaatatcactctcgatattccgacccgctatataatcgaactaattaaccgaacgacgtcgaaaaatcgaacttattatcgttaatttccgatacccgcgtcattaaacaaaacaatataataatactaaacgacgatatacgcgacccgaaacatcgccgcgacgtctacccgcgcatcgcctaaataccgcaaaactaaacaaaaacctctaccacaccttatcgatatataaaaacgtcgattttttcgctcgcctattcgatcacgacaaaacgaaataaacaatacgaatc

SEQ ID NO: 5349 - DNA, 688 bp, Artificial Sequence
  chemically treated genomic DNA (Homo sapiens) CpG-island No: 5349
  misc_feature (640)..(640): n is either a, c, g or t
  misc_feature (642)..(642): n is either a, c, g or t
  misc_feature (650)..(650): n is either a, c, g or t
cgattacgcggtgggcgatagcgtatgcggttacggttcgtttttcgagacggttattattaacgtagtgaataattataagttgcgtaaaatgtcgtaaggtagtttttggaaaaacgtcgtttgttacgattcggcgtagtttgttatgagcggcgtgcgcgatgttaacgtgcgcgtaggggattttgtggtggtggtagggtttggcgtaatcggttaaattgttatttaattggttaagacgcgttggcgtttttgtggtgattggcgtcgattttatcgtttatcgttgtgatattgttcgtcgttacggcgcggatttttgttttaattttatcggtattgatgtaggtaaagagattaaaacgttgatcggtaagtagggtgtcgatgtgattatcgaaattagcggttacgtcgacgcgttgtaagtcggcgtttcgcggtttggtttatggcggtattattttttatgtcgcgtttgttaagtcgtttgtcgaaggttttaatttcgggatcggaagcgtatttgattcgagagatttttgcggtatcgaggtcggatttatttaggttgagaggttgtaacgtatggagtgttttttagtcgtagtagatgcgtagtggttttgggcgngngagttttnattttaacgtttgggatttttggatttaggagtgttcg

SEQ ID NO: 5350 - DNA, 688 bp, Artificial Sequence
  chemically treated genomic DNA (Homo sapiens) CpG-island No: 5350
  misc_feature (39)..(39): n is either a, c, g or t
  misc_feature (47)..(47): n is either a, c, g or t
  misc_feature (49)..(49): n is either a, c, g or t
cgaacactcctaaatccaaaaatcccaaacgttaaaatnaaaactcncncgcccaaaaccactacgcatctactacgactaaaaaacactccatacgttacaacctctcaacctaaataaatccgacctcgataccgcaaaaatctctcgaatcaaatacgcttccgatcccgaaattaaaaccttcgacaaacgacttaacaaacgcgacataaaaaataataccgccataaaccaaaccgcgaaacgccgacttacaacgcgtcgacgtaaccgctaatttcgataatcacatcgacaccctacttaccgatcaacgttttaatctctttacctacatcaataccgataaaattaaaacaaaaatccgcgccgtaacgacgaacaatatcacaacgataaacgataaaatcgacgccaatcaccacaaaaacgccaacgcgtcttaaccaattaaataacaatttaaccgattacgccaaaccctaccaccaccacaaaatcccctacgcgcacgttaacatcgcgcacgccgctcataacaaactacgccgaatcgtaacaaacgacgtttttccaaaaactaccttacgacattttacgcaacttataattattcactacgttaataataaccgtctcgaaaaacgaaccgtaaccgcatacgctatcgcccaccgcgtaatcg

SEQ ID NO: 5351 - DNA, 688 bp, Artificial Sequence
  chemically treated genomic DNA (Homo sapiens) CpG-island No: 5351
  misc_feature (39)..(39): n is either a, c, g or t
  misc_feature (47)..(47): n is either a, c, g or t
  misc_feature (49)..(49): n is either a, c, g or t
cgggtatttttgggtttaggagttttagacgttggggtngagatttntncgtttaaaattattgcgtatttattgcggttgaagaatattttatacgttgtaattttttagtttggatgaattcgatttcggtatcgtaggagtttttcgagttaaatgcgttttcggtttcgaggttaaaattttcggtaaacggtttggtaaacgcgatataggagatggtgtcgttataagttagatcgcggagcgtcgatttgtagcgcgtcggcgtagtcgttggtttcgataattatatcggtattttgtttgtcggttagcgttttgatttttttatttatattagtgtcgatggggttaaggtagaaattcgcgtcgtggcgacgggtaatattatagcgatgggcgataggatcgacgttaattattatagaagcgttagcgcgttttagttagttggatggtaatttgatcgattgcgttaagttttattattattataaaattttttacgcgtacgttggtatcgcgtacgtcgtttatggtaaattgcgtcgggtcgtagtagacggcgtttttttaggagttgttttgcggtattttgcgtagtttgtagttatttattgcgttaatgatgatcgtttcggagagcgggtcgtagtcgtatacgttgtcgtttatcgcgtagtcg

SEQ ID NO: 5352 - DNA, 688 bp, Artificial Sequence
  chemically treated genomic DNA (Homo sapiens) CpG-island No: 5352
  misc_feature (640)..(640): n is either a, c, g or t
  misc_feature (642)..(642): n is either a, c, g or t
  misc_feature (650)..(650): n is either a, c, g or t
cgactacgcgataaacgacaacgtatacgactacgacccgctctccgaaacgatcatcattaacgcaataaataactacaaactacgcaaaataccgcaaaacaactcctaaaaaaacgccgtctactacgacccgacgcaatttaccataaacgacgtacgcgataccaacgtacgcgtaaaaaattttataataataataaaacttaacgcaatcgatcaaattaccatccaactaactaaaacgcgctaacgcttctataataattaacgtcgatcctatcgcccatcgctataatattacccgtcgccacgacgcgaatttctaccttaaccccatcgacactaatataaataaaaaaatcaaaacgctaaccgacaaacaaaataccgatataattatcgaaaccaacgactacgccgacgcgctacaaatcgacgctccgcgatctaacttataacgacaccatctcctatatcgcgtttaccaaaccgtttaccgaaaattttaacctcgaaaccgaaaacgcatttaactcgaaaaactcctacgataccgaaatcgaattcatccaaactaaaaaattacaacgtataaaatattcttcaaccgcaataaatacgcaataattttaaacgnanaaatctcnaccccaacgtctaaaactcctaaacccaaaaatacccg

SEQ ID NO: 5353 - DNA, 520 bp, Artificial Sequence
  chemically treated genomic DNA (Homo sapiens) CpG-island No: 5353
gtaggtcggttttttaatggcgcgtgatagtatagttatacggtttcgtattggtagtatttatagattcgttagtttcggtagtcgtacggtgttatttagttttttaatgattttgtttatcgttatgtttggtcgttattgtttttgcggtttaagttggatggtcgtttttattatttttagcggagtagaatcggtggcggttttcgttttttcggttttgttaaatattcgcgttattttaggtacgtttataattagtttgtcggttttttgtagtatattcgtcgtttttgttgcggaaattttcggtagcgtcgatggtatatataataagtcgtttttattgatttgcggtaaaaatttttcgttaattttattgagcggttagagaatcgttagtatcgaaagcgtcgttattagtagcgtggttttcggttagtgtagtatttttagtaatagcggatgataaatacgaattaaaaagcgattgagcgggttattgtttttcggcgga

SEQ ID NO: 5354 - DNA, 520 bp, Artificial Sequence
  chemically treated genomic DNA (Homo sapiens) CpG-island No: 5354
tccgccgaaaaacaataacccgctcaatcgctttttaattcgtatttatcatccgctattactaaaaatactacactaaccgaaaaccacgctactaataacgacgctttcgatactaacgattctctaaccgctcaataaaattaacgaaaaatttttaccgcaaatcaataaaaacgacttattatatataccatcgacgctaccgaaaatttccgcaacaaaaacgacgaatatactacaaaaaaccgacaaactaattataaacgtacctaaaataacgcgaatatttaacaaaaccgaaaaaacgaaaaccgccaccgattctactccgctaaaaataataaaaacgaccatccaacttaaaccgcaaaaacaataacgaccaaacataacgataaacaaaatcattaaaaaactaaataacaccgtacgactaccgaaactaacgaatctataaatactaccaatacgaaaccgtataactatactatcacgcgccattaaaaaaccgacctac

SEQ ID NO: 5355 - DNA, 520 bp, Artificial Sequence
  chemically treated genomic DNA (Homo sapiens) CpG-island No: 5355
ttcgtcggaaagtagtaattcgtttaatcgttttttgattcgtgtttattattcgttgttgttgaaagtattgtattggtcgaaaattacgttgttggtggcggcgttttcggtgttgacggttttttggtcgtttaataaagttggcggggaatttttatcgtagattaatgaaggcgatttgttgtatatgttatcgacgttgtcggggattttcgtagtagaggcggcgagtatgttgtaaaaaatcgataagttaattatgagcgtatttgaagtggcgcgggtatttggtaaaatcgggaaagcggaaatcgttatcgattttgtttcgttggagatggtagaaacgattatttagtttaagtcgtaggagtagtggcggttaggtatgacgatggataaaattattgaggaattggataatatcgtgcggttgtcggggttggcgaatttgtgggtgttgttaatacggagtcgtgtagttatgttgttacgcgttattaaaaggtcgatttgt

SEQ ID NO: 5356 - DNA, 520 bp, Artificial Sequence
  chemically treated genomic DNA (Homo sapiens) CpG-island No: 5356
acaaatcgaccttttaataacgcgtaacaacataactacacgactccgtattaacaacacccacaaattcgccaaccccgacaaccgcacgatattatccaattcctcaataattttatccatcgtcatacctaaccgccactactcctacgacttaaactaaataatcgtttctaccatctccaacgaaacaaaatcgataacgatttccgctttcccgattttaccaaatacccgcgccacttcaaatacgctcataattaacttatcgattttttacaacatactcgccgcctctactacgaaaatccccgacaacgtcgataacatatacaacaaatcgccttcattaatctacgataaaaattccccgccaactttattaaacgaccaaaaaaccgtcaacaccgaaaacgccgccaccaacaacgtaattttcgaccaatacaatactttcaacaacaacgaataataaacacgaatcaaaaaacgattaaacgaattactactttccgacgaa

SEQ ID NO: 5357 - DNA, 522 bp, Artificial Sequence
  chemically treated genomic DNA (Homo sapiens) CpG-island No: 5357
  misc_feature (417)..(417): n is either a, c, g or t
  misc_feature (424)..(424): n is either a, c, g or t
ttacgtttacgttattttcggggtcgggttcgcggcggttttcgtgggagggcgcggacgtcggggcggttggcggggaggtcggcggggcgggagcgtcggggtcggcggaggaggacggggaggacgaggacgaggacgaggaggaggacgaggaggcggcggcgtcgggcgcggcggcggggtcgcggggtttcgggagggcgcgagtagtttcggtgttcgtcgtggtgagtagcgtcgacgcggacgcggttcgttcgttgcggggttgtttaagttttcgcgcggggtcgacgagttagatgatagcgagttggagaggaagcgtaagatggtttttttttacggggacgtgatcgtttattttttcgattaggtgcggaattcgagagggcgcggtttcgggttatagtntatattnaagtttcgaaaataacgtttatttcgttattatatatatatttaaatatttatcgagtttttgttataggagtatagggttgggggtttggattttcg

SEQ ID NO: 5358 - DNA, 522 bp, Artificial Sequence
  chemically treated genomic DNA (Homo sapiens) CpG-island No: 5358
  misc_feature (99)..(99): n is either a, c, g or t
  misc_feature (106)..(106): n is either a, c, g or t
cgaaaatccaaacccccaaccctatactcctataacaaaaactcgataaatatttaaatatatatataataacgaaataaacgttattttcgaaacttnaatatanactataacccgaaaccgcgccctctcgaattccgcacctaatcgaaaaaataaacgatcacgtccccgtaaaaaaaaaccatcttacgcttcctctccaactcgctatcatctaactcgtcgaccccgcgcgaaaacttaaacaaccccgcaacgaacgaaccgcgtccgcgtcgacgctactcaccacgacgaacaccgaaactactcgcgccctcccgaaaccccgcgaccccgccgccgcgcccgacgccgccgcctcctcgtcctcctcctcgtcctcgtcctcgtcctccccgtcctcctccgccgaccccgacgctcccgccccgccgacctccccgccaaccgccccgacgtccgcgccctcccacgaaaaccgccgcgaacccgaccccgaaaataacgtaaacgtaa

SEQ ID NO: 5359 - DNA, 522 bp, Artificial Sequence
  chemically treated genomic DNA (Homo sapiens) CpG-island No: 5359
  misc_feature (99)..(99): n is either a, c, g or t
  misc_feature (106)..(106): n is either a, c, g or t
cgggagtttagatttttagttttgtgtttttgtagtaaaaattcggtgaatgtttggatgtgtgtgtggtgacgagatgggcgttgttttcggggtttnggtatanattgtggttcgaaatcgcgttttttcgggtttcgtatttggtcgaagaggtagacggttacgttttcgtggaaggagattattttgcgttttttttttagttcgttgttatttggttcgtcggtttcgcgcggagatttgagtagtttcgtagcgggcgggtcgcgttcgcgtcggcgttgtttattacgacgggtatcggggttgttcgcgttttttcggggtttcgcggtttcgtcgtcgcgttcggcgtcgtcgttttttcgttttttttttcgttttcgttttcgtttttttcgttttttttcgtcggtttcggcgttttcgtttcgtcggttttttcgttagtcgtttcggcgttcgcgtttttttacgggggtcgtcgcgggttcggtttcgggaatggcgtgagcgtga

SEQ ID NO: 5360 - DNA, 522 bp, Artificial Sequence
  chemically treated genomic DNA (Homo sapiens) CpG-island No: 5360
  misc_feature (417)..(417): n is either a, c, g or t
  misc_feature (424)..(424): n is either a, c, g or t
tcacgctcacgccattcccgaaaccgaacccgcgacgacccccgtaaaaaaacgcgaacgccgaaacgactaacgaaaaaaccgacgaaacgaaaacgccgaaaccgacgaaaaaaaacgaaaaaaacgaaaacgaaaacgaaaaaaaaaacgaaaaaacgacgacgccgaacgcgacgacgaaaccgcgaaaccccgaaaaaacgcgaacaaccccgatacccgtcgtaataaacaacgccgacgcgaacgcgacccgcccgctacgaaactactcaaatctccgcgcgaaaccgacgaaccaaataacaacgaactaaaaaaaaaacgcaaaataatctccttccacgaaaacgtaaccgtctacctcttcgaccaaatacgaaacccgaaaaaacgcgatttcgaaccacaatntataccnaaaccccgaaaacaacgcccatctcgtcaccacacacacatccaaacattcaccgaatttttactacaaaaacacaaaactaaaaatctaaactcccg

SEQ ID NO: 5361 - DNA, 1502 bp, Artificial Sequence
  chemically treated genomic DNA (Homo sapiens) CpG-island No: 5361
  misc_feature (703)..(703): n is either a, c, g or t
gtagcgttgaggtcgttttatcgttcgttaagttttcgtcgtcgttatagtttttgtttagtttcgcgtatttcgcgtcgcggtcggttttcgggttcgtatttttcgtgtttcgcgagcgcgttttagtggatcgttggcgtcggattaagggcgcgggcgtcgtcggggggcgcgggtttggtcgattgtttttatcgttattacggttttatcgagtcgtagggtttaggtttcggttgggcgaagtgtcgcgcggtattttcgggcgtattcgggcgtcgtttggttttcgtcggtcgtttagttttcgtagaagtcgtcgtttttttatttcgttatcgtacgcgataaggagttagtcgagtttttcgtcggcgtttttttcggtttttcgtcgtcgttcgcgtttttcgtcgtcgcggttatcgtcgtcgggtcgttattttgtcgtttggttttcgaggacgagagttcgtcggcgttcgcgcggtggtcgcgttcggatttcgagagttaatttttgttggggttaggcgcgggcggcgcggggggtacggggggcgtaggcggaggagtttcggtcgtttcgttttcgtgtcgcgtcgcgtcgttttcgtgtttttatttcgatttcgagtcgtcgtcgtcggattcggatgattcggagagtttgggcggcgcgtcgttgggcggtttgganttttggtggttcgtcgattttttttattcgtatgtcgagcgtttcgggtcgtcgttcggtcgttattggtcggtcgataagttcgggggttggcgcgtcgggagttgggattatttgttttcgcgtagcggttcggtcgtttggtattgtcggtattgcgttagtttggagttgttgtcgtcgtcgcgttattttagttgttcgtacgatggtttggacggcggttggtgggcgttatcgtttttattttgggtcgtcgggtttttgtttcgacgtcgggttcgttgcgggtgttcgcggtcgtattcgtatcgttcgcgggtttcgtatcgtacgttcgtcgtcgtcgcgttttattattataggtatcggcgcgtcgttgggggttgggatttttcgtcgttcgcgtttatttcgcgttcgttcgaggattttagttcgtgttttcgcgtcgtttttgcgcgtaggtttatcgggttttttcgttacgttcgtaggtgttcgtacgtcgcgtattgggggtcgtcgttgtttatagttttttatcggagatatcggggcggggatttgggtattcgtaggggttcggcgtatttttttagtttcgagttcgaggtatgacgcggtttcgggggttttatcgtttttttggttagcgtaggttacggttcgagggggcgttcgtagtggataggattcgcgtgggttgggaaggaaagtagtggaattggtcggatttcgtttggagtagcgttttgcgttttttggttttggaggaatcgtaagtcggagaggattt

SEQ ID NO: 5362 - DNA, 1502 bp, Artificial Sequence
  chemically treated genomic DNA (Homo sapiens) CpG-island No: 5362
  misc_feature (800)..(800): n is either a, c, g or t
aaatcctctccgacttacgattcctccaaaaccaaaaaacgcaaaacgctactccaaacgaaatccgaccaattccactactttccttcccaacccacgcgaatcctatccactacgaacgccccctcgaaccgtaacctacgctaaccaaaaaaacgataaaacccccgaaaccgcgtcatacctcgaactcgaaactaaaaaaatacgccgaacccctacgaatacccaaatccccgccccgatatctccgataaaaaactataaacaacgacgacccccaatacgcgacgtacgaacacctacgaacgtaacgaaaaaacccgataaacctacgcgcaaaaacgacgcgaaaacacgaactaaaatcctcgaacgaacgcgaaataaacgcgaacgacgaaaaatcccaacccccaacgacgcgccgatacctataataataaaacgcgacgacgacgaacgtacgatacgaaacccgcgaacgatacgaatacgaccgcgaacacccgcaacgaacccgacgtcgaaacaaaaacccgacgacccaaaataaaaacgataacgcccaccaaccgccgtccaaaccatcgtacgaacaactaaaataacgcgacgacgacaacaactccaaactaacgcaataccgacaataccaaacgaccgaaccgctacgcgaaaacaaataatcccaactcccgacgcgccaacccccgaacttatcgaccgaccaataacgaccgaacgacgacccgaaacgctcgacatacgaataaaaaaaatcgacgaaccaccaaaantccaaaccgcccaacgacgcgccgcccaaactctccgaatcatccgaatccgacgacgacgactcgaaatcgaaataaaaacacgaaaacgacgcgacgcgacacgaaaacgaaacgaccgaaactcctccgcctacgccccccgtaccccccgcgccgcccgcgcctaaccccaacaaaaattaactctcgaaatccgaacgcgaccaccgcgcgaacgccgacgaactctcgtcctcgaaaaccaaacgacaaaataacgacccgacgacgataaccgcgacgacgaaaaacgcgaacgacgacgaaaaaccgaaaaaaacgccgacgaaaaactcgactaactccttatcgcgtacgataacgaaataaaaaaacgacgacttctacgaaaactaaacgaccgacgaaaaccaaacgacgcccgaatacgcccgaaaataccgcgcgacacttcgcccaaccgaaacctaaaccctacgactcgataaaaccgtaataacgataaaaacaatcgaccaaacccgcgccccccgacgacgcccgcgcccttaatccgacgccaacgatccactaaaacgcgctcgcgaaacacgaaaaatacgaacccgaaaaccgaccgcgacgcgaaatacgcgaaactaaacaaaaactataacgacgacgaaaacttaacgaacgataaaacgacctcaacgctac

SEQ ID NO: 5363 - DNA, 1502 bp, Artificial Sequence
  chemically treated genomic DNA (Homo sapiens) CpG-island No: 5363
  misc_feature (800)..(800): n is either a, c, g or t
aaatttttttcggtttgcggtttttttagaattagggggcgtaggacgttgttttaggcggggttcggttagttttattgtttttttttttaatttacgcgggttttgtttattgcgggcgttttttcgggtcgtggtttgcgttgattaagggggcggtggggttttcggggtcgcgttatatttcggattcgaggttagagaagtgcgtcgagtttttgcgggtgtttaggttttcgtttcggtgttttcggtgggaagttgtgggtagcggcggtttttagtgcgcggcgtgcggatatttgcgagcgtggcgggagggttcggtaagtttgcgcgtaggggcggcgcgagggtacgagttgaggttttcgagcgagcgcgaggtgggcgcgggcggcgggaggttttagtttttagcggcgcgtcggtgtttgtggtggtggggcgcggcggcggcgggcgtgcggtgcgaggttcgcgggcggtgcgggtgcgatcgcgggtattcgtagcgggttcggcgtcggggtaggggttcggcggtttagggtggaggcggtggcgtttattagtcgtcgtttaggttatcgtgcgagtagttgagatggcgcggcggcggtagtagttttaggttggcgtagtgtcgatagtgttaggcggtcggatcgttgcgcgggggtaggtagttttagttttcggcgcgttagttttcgagtttgtcgatcgattagtagcggtcgggcggcggttcgaggcgttcggtatacgggtaagggaagtcggcgaattattagggntttaggtcgtttagcgacgcgtcgtttaggtttttcgagttattcgagttcgacggcgacggttcgagatcgaggtaagggtacgggggcggcgcggcgcggtacgggggcggagcggtcggggttttttcgtttgcgtttttcgtgtttttcgcgtcgttcgcgtttggttttagtaggggttggttttcggggttcgagcgcggttatcgcgcgggcgtcggcgggttttcgttttcgaaggttaagcggtagagtggcggttcgacggcggtggtcgcggcggcggggggcgcgggcggcgacgggaagtcggggaaggcgtcggcggggggttcggttggttttttgtcgcgtacgatggcgaaataggagggcggcggtttttgcgggggttgagcggtcggcggggattaagcggcgttcggatgcgttcgggggtgtcgcgcggtatttcgtttagtcgaggtttaggttttgcggttcgatggggtcgtagtagcggtggaagtagtcggttaggttcgcgtttttcggcggcgttcgcgtttttggttcggcgttagcggtttattgaggcgcgttcgcggggtacgaaaggtgcgggttcgggagtcggtcgcggcgcggggtacgcggggttgggtaggggttgtggcggcggcgggggtttggcgggcggtggggcggttttagcgttgt

SEQ ID NO: 5364 - DNA, 1502 bp, Artificial Sequence
  chemically treated genomic DNA (Homo sapiens) CpG-island No: 5364
  misc_feature (703)..(703): n is either a, c, g or t
acaacgctaaaaccgccccaccgcccgccaaacccccgccgccgccacaacccctacccaaccccgcgtaccccgcgccgcgaccgactcccgaacccgcacctttcgtaccccgcgaacgcgcctcaataaaccgctaacgccgaaccaaaaacgcgaacgccgccgaaaaacgcgaacctaaccgactacttccaccgctactacgaccccatcgaaccgcaaaacctaaacctcgactaaacgaaataccgcgcgacacccccgaacgcatccgaacgccgcttaatccccgccgaccgctcaacccccgcaaaaaccgccgccctcctatttcgccatcgtacgcgacaaaaaaccaaccgaaccccccgccgacgccttccccgacttcccgtcgccgcccgcgccccccgccgccgcgaccaccgccgtcgaaccgccactctaccgcttaaccttcgaaaacgaaaacccgccgacgcccgcgcgataaccgcgctcgaaccccgaaaaccaacccctactaaaaccaaacgcgaacgacgcgaaaaacacgaaaaacgcaaacgaaaaaaccccgaccgctccgcccccgtaccgcgccgcgccgcccccgtacccttacctcgatctcgaaccgtcgccgtcgaactcgaataactcgaaaaacctaaacgacgcgtcgctaaacgacctaaanccctaataattcgccgacttcccttacccgtataccgaacgcctcgaaccgccgcccgaccgctactaatcgatcgacaaactcgaaaactaacgcgccgaaaactaaaactacctacccccgcgcaacgatccgaccgcctaacactatcgacactacgccaacctaaaactactaccgccgccgcgccatctcaactactcgcacgataacctaaacgacgactaataaacgccaccgcctccaccctaaaccgccgaacccctaccccgacgccgaacccgctacgaatacccgcgatcgcacccgcaccgcccgcgaacctcgcaccgcacgcccgccgccgccgcgccccaccaccacaaacaccgacgcgccgctaaaaactaaaacctcccgccgcccgcgcccacctcgcgctcgctcgaaaacctcaactcgtaccctcgcgccgcccctacgcgcaaacttaccgaaccctcccgccacgctcgcaaatatccgcacgccgcgcactaaaaaccgccgctacccacaacttcccaccgaaaacaccgaaacgaaaacctaaacacccgcaaaaactcgacgcacttctctaacctcgaatccgaaatataacgcgaccccgaaaaccccaccgcccccttaatcaacgcaaaccacgacccgaaaaaacgcccgcaataaacaaaacccgcgtaaattaaaaaaaaaaacaataaaactaaccgaaccccgcctaaaacaacgtcctacgccccctaattctaaaaaaaccgcaaaccgaaaaaaattt

SEQ ID NO: 5365 - DNA, 927 bp, Artificial Sequence
  chemically treated genomic DNA (Homo sapiens) CpG-island No: 5365
cgttgggttcgttcgtttttttagcgggaatggtttcgtttcggtttcgtttttattattttatttcgtttttttcgtcgttatcggaaataggtttagtttaaataatggtttggaacgttcggttttcgggtttcgtcggaagttcgtttagcgtttaataaaagcggcgcgataagtttacgattgagtcgaacgtttttgggcgtcgcgcgttagggggaaacgttcgcggcggaacgtttaggagaaaacgttttagtaatttttagtcgatttcgttttttttcgatttattatagacgtcgttttttatggcggttaggaaggttcgcggggaattcggggcggtttcgttagtcgggtttggattcgcgttgtgttcggcgtcgggtgagttcgtttaaacgtttcgggagttatcgtcgtttttttagcgttagtttttagcgttgaaaagattttttttttcgtcgtttaatcgtttttttagtagggatcgtttttttttttgatattgtttaatttatagtgggcgttttcgtttttttcgttttcgttattaaaggatcgttttttagggttaatagtcgtataaaaagtcggtgtaggtatgttcggttagaggtagtacggttcgcggttaatcggagtgtaggtagggtagtaggtttcgttttcgaaataatagaaagtatttgataggtttgttttttaatgagaagtttcggaaaagtgtcgcgcggagcggagttacgcggtatagttatttttgcgtttgtttaaaggttttggatatttggagtttaggtaaatcgagtttcgttttcgataatacgttgttagggggcggtattttgttagttttgttgttaggaggcggggttagaattggtttgttttcgtaagttatattttttagtaggt

SEQ ID NO: 5366 - DNA, 927 bp, Artificial Sequence
  chemically treated genomic DNA (Homo sapiens) CpG-island No: 5366
acctactaaaaaatataacttacgaaaacaaaccaattctaaccccgcctcctaacaacaaaactaacaaaataccgccccctaacaacgtattatcgaaaacgaaactcgatttacctaaactccaaatatccaaaacctttaaacaaacgcaaaaataactataccgcgtaactccgctccgcgcgacacttttccgaaacttctcattaaaaaacaaacctatcaaatactttctattatttcgaaaacgaaacctactaccctacctacactccgattaaccgcgaaccgtactacctctaaccgaacatacctacaccgactttttatacgactattaaccctaaaaaacgatcctttaataacgaaaacgaaaaaaacgaaaacgcccactataaattaaacaatatcaaaaaaaaaaacgatccctactaaaaaaacgattaaacgacgaaaaaaaaaatcttttcaacgctaaaaactaacgctaaaaaaacgacgataactcccgaaacgtttaaacgaactcacccgacgccgaacacaacgcgaatccaaacccgactaacgaaaccgccccgaattccccgcgaaccttcctaaccgccataaaaaacgacgtctataataaatcgaaaaaaaacgaaatcgactaaaaattactaaaacgttttctcctaaacgttccgccgcgaacgtttccccctaacgcgcgacgcccaaaaacgttcgactcaatcgtaaacttatcgcgccgcttttattaaacgctaaacgaacttccgacgaaacccgaaaaccgaacgttccaaaccattatttaaactaaacctatttccgataacgacgaaaaaaacgaaataaaataataaaaacgaaaccgaaacgaaaccattcccgctaaaaaaacgaacgaacccaacg

SEQ ID NO: 5367 - DNA, 927 bp, Artificial Sequence
  chemically treated genomic DNA (Homo sapiens) CpG-island No: 5367
gtttgttaggaggtgtggtttacggaaataagttagttttagtttcgttttttagtaataagattaataaagtatcgttttttagtaacgtattatcggaggcggggttcggtttatttagattttaagtgtttagggtttttgagtaggcgtagaggtggttgtatcgcgtggtttcgtttcgcgcgatattttttcggggttttttattggagagtaagtttgttaagtgttttttgttgtttcggaggcggggtttgttgttttgtttgtatttcgattggtcgcgggtcgtgttatttttggtcggatatatttatatcggttttttgtacgattgttggttttggagaacgattttttggtggcgagggcggggaggacgaaagcgtttattgtggattggatagtgttaaaaagaggggcggtttttattgaaggggcggttgggcgacgaagggaagagtttttttagcgttgaggattggcgttgaggaggcggcggtggttttcggggcgtttgagcgggtttattcgacgtcgaatataacgcgagtttaggttcgattggcgggatcgtttcggatttttcgcgggtttttttagtcgttatggaggacggcgtttatggtaggtcggggaggggcggggtcggttgggagttgttggagcgtttttttttgaacgtttcgtcgcgaacgtttttttttggcgcgcggcgtttagaagcgttcggtttagtcgtagatttgtcgcgtcgtttttgttgggcgttggacgggttttcggcggggttcgaaagtcgggcgttttaggttattgtttgggttgagtttgttttcggtggcggcgggaggggcgggatggagtggtggaggcgaggtcggggcggaattattttcgttggaggggcgggcgagtttagcg

SEQ ID NO: 5368 - DNA, 927 bp, Artificial Sequence
  chemically treated genomic DNA (Homo sapiens) CpG-island No: 5368
cgctaaactcgcccgcccctccaacgaaaataattccgccccgacctcgcctccaccactccatcccgcccctcccgccgccaccgaaaacaaactcaacccaaacaataacctaaaacgcccgactttcgaaccccgccgaaaacccgtccaacgcccaacaaaaacgacgcgacaaatctacgactaaaccgaacgcttctaaacgccgcgcgccaaaaaaaaacgttcgcgacgaaacgttcaaaaaaaaacgctccaacaactcccaaccgaccccgcccctccccgacctaccataaacgccgtcctccataacgactaaaaaaacccgcgaaaaatccgaaacgatcccgccaatcgaacctaaactcgcgttatattcgacgtcgaataaacccgctcaaacgccccgaaaaccaccgccgcctcctcaacgccaatcctcaacgctaaaaaaactcttcccttcgtcgcccaaccgccccttcaataaaaaccgcccctctttttaacactatccaatccacaataaacgctttcgtcctccccgccctcgccaccaaaaaatcgttctccaaaaccaacaatcgtacaaaaaaccgatataaatatatccgaccaaaaataacacgacccgcgaccaatcgaaatacaaacaaaacaacaaaccccgcctccgaaacaacaaaaaacacttaacaaacttactctccaataaaaaaccccgaaaaaatatcgcgcgaaacgaaaccacgcgatacaaccacctctacgcctactcaaaaaccctaaacacttaaaatctaaataaaccgaaccccgcctccgataatacgttactaaaaaacgatactttattaatcttattactaaaaaacgaaactaaaactaacttatttccgtaaaccacacctcctaacaaac

SEQ ID NO: 5369 - DNA, 603 bp, Artificial Sequence
  chemically treated genomic DNA (Homo sapiens) CpG-island No: 5369
tcgtttggcggcgttgtttaacgaagaattgggtgcggtgatttaggttcgtgtcgttgatcgtgaagcggtcgagttcgtattggtatagtatgggtttgttgattgtgtttattatgtagggtaggcggttttcggtgatcgttttgtgattatcgttaacgggtagattgtatttagcgaaagtcgtattacgttgcgtgtttggtgggtagaaattatttggtagatgtagcgtttgcgtgataattcggagtgtgtcgattaggagtattaggcgaaatttaacgacgtcgattcgggtttgaatgtaaaattgtcgttcgatattaacgaagatgtggtagtatcgtatattgttattggcgtacgttcgaaagttgtcgtattgcgtgagtagggcgtgaatttttatgttgaaatggcggtagttttttatcgtgtaggttttgatgttatcgacgtgtatatgagtgatttgttgatcggacgtacgggtttggaagatttttacgttttggtcgcgtgcggtggttttttttacggtgatgtgtttggtgttcggtgaacgttgggcgaaattttaaaaaaaaaaagaaaaaa

SEQ ID NO: 5370 - DNA, 603 bp, Artificial Sequence
  chemically treated genomic DNA (Homo sapiens) CpG-island No: 5370
ttttttctttttttttttaaaatttcgcccaacgttcaccgaacaccaaacacatcaccgtaaaaaaaaccaccgcacgcgaccaaaacgtaaaaatcttccaaacccgtacgtccgatcaacaaatcactcatatacacgtcgataacatcaaaacctacacgataaaaaactaccgccatttcaacataaaaattcacgccctactcacgcaatacgacaactttcgaacgtacgccaataacaatatacgatactaccacatcttcgttaatatcgaacgacaattttacattcaaacccgaatcgacgtcgttaaatttcgcctaatactcctaatcgacacactccgaattatcacgcaaacgctacatctaccaaataatttctacccaccaaacacgcaacgtaatacgactttcgctaaatacaatctacccgttaacgataatcacaaaacgatcaccgaaaaccgcctaccctacataataaacacaatcaacaaacccatactataccaatacgaactcgaccgcttcacgatcaacgacacgaacctaaatcaccgcacccaattcttcgttaaacaacgccgccaaacga

SEQ ID NO: 5371 - DNA, 603 bp, Artificial Sequence
  chemically treated genomic DNA (Homo sapiens) CpG-island No: 5371
ttttttttttttttttttgggatttcgtttaacgtttatcgggtattaggtatattatcgtaggagaaattatcgtacgcgattagggcgtggaaattttttaggttcgtgcgttcggttagtaggttatttatatgtacgtcgatagtattaaagtttgtacggtggaaagttgtcgttattttaatatgagagtttacgttttgtttacgtagtacggtaattttcggacgtgcgttagtggtaatatacggtgttgttatattttcgttgatatcgaacgatagttttatatttaggttcggatcggcgtcgttagatttcgtttgatgtttttgatcggtatatttcgggttgttacgtaggcgttgtatttgttaggtagtttttgtttattagatacgtaacgtggtgcggttttcgttgaatatagtttgttcgttggcggtaattataaaacggttatcggaaatcgtttgttttatataatggatataattagtaagtttatgttgtgttagtacggattcgatcgttttacggttagcggtacgaatttgaattatcgtatttagtttttcgttaaataacgtcgttaggcga

SEQ ID NO: 5372 - DNA, 603 bp, Artificial Sequence
  chemically treated genomic DNA (Homo sapiens) CpG-island No: 5372
tcgcctaacgacgttatttaacgaaaaactaaatacgataattcaaattcgtaccgctaaccgtaaaacgatcgaatccgtactaacacaacataaacttactaattatatccattatataaaacaaacgatttccgataaccgttttataattaccgccaacgaacaaactatattcaacgaaaaccgcaccacgttacgtatctaataaacaaaaactacctaacaaatacaacgcctacgtaacaacccgaaatataccgatcaaaaacatcaaacgaaatctaacgacgccgatccgaacctaaatataaaactatcgttcgatatcaacgaaaatataacaacaccgtatattaccactaacgcacgtccgaaaattaccgtactacgtaaacaaaacgtaaactctcatattaaaataacgacaactttccaccgtacaaactttaatactatcgacgtacatataaataacctactaaccgaacgcacgaacctaaaaaatttccacgccctaatcgcgtacgataatttctcctacgataatatacctaatacccgataaacgttaaacgaaatcccaaaaaaaaaaaaaaaaaa

SEQ ID NO: 5373 - DNA, 570 bp, Artificial Sequence
  chemically treated genomic DNA (Homo sapiens) CpG-island No: 5373
  misc_feature (103)..(103): n is either a, c, g or t
  misc_feature (434)..(434): n is either a, c, g or t
  misc_feature (445)..(445): n is either a, c, g or t
  misc_feature (470)..(470): n is either a, c, g or t
attgtcgcgtaattatttatgaaagcgtttatgtttcgtcgtgcgatagtattttcggaataaatttgtttttttgcgcgattcggaatttcgaggtcgtttntacgcgtcgtcgttcgtttttttatatcggattgggttttacgtaaggatgaggcggggtttcgtcgtggcgcgtatgcgtgtagtaaagaatggaggagtcggaattcgaacggaaggtaggagagaggcgagatttcgcgcgtgtgggagcgggcgtgaagaggggagtaggtcgtgtttgattggcgtgtgtttgtagcgggttcgtatcgacgaggtgtttgtcggaggaagtcgtttcgaggcggaagatgaggacgacgaggattacgtgttttatgtgtcgttacggtagcgtcggtagttattggtgaggggtacgcgttcgnggagggtaagnggttagttagtggtcgattaatttnttacgcgcgttcgttacgtattttatatttatagggtttggttttttttcgagtttggagatttatcggggatggtaggaggatttttaagagagttgtt

SEQ ID NO: 5374 - DNA, 570 bp, Artificial Sequence
  chemically treated genomic DNA (Homo sapiens) CpG-island No: 5374
  misc_feature (101)..(101): n is either a, c, g or t
  misc_feature (126)..(126): n is either a, c, g or t
  misc_feature (137)..(137): n is either a, c, g or t
  misc_feature (468)..(468): n is either a, c, g or t
aacaactctcttaaaaatcctcctaccatccccgataaatctccaaactcgaaaaaaaaccaaaccctataaatataaaatacgtaacgaacgcgcgtaanaaattaatcgaccactaactaaccncttaccctccncgaacgcgtacccctcaccaataactaccgacgctaccgtaacgacacataaaacacgtaatcctcgtcgtcctcatcttccgcctcgaaacgacttcctccgacaaacacctcgtcgatacgaacccgctacaaacacacgccaatcaaacacgacctactcccctcttcacgcccgctcccacacgcgcgaaatctcgcctctctcctaccttccgttcgaattccgactcctccattctttactacacgcatacgcgccacgacgaaaccccgcctcatccttacgtaaaacccaatccgatataaaaaaacgaacgacgacgcgtanaaacgacctcgaaattccgaatcgcgcaaaaaaacaaatttattccgaaaatactatcgcacgacgaaacataaacgctttcataaataattacgcgacaat

SEQ ID NO: 5375 - DNA, 570 bp, Artificial Sequence
  chemically treated genomic DNA (Homo sapiens) CpG-island No: 5375
  misc_feature (101)..(101): n is either a, c, g or t
  misc_feature (126)..(126): n is either a, c, g or t
  misc_feature (137)..(137): n is either a, c, g or t
  misc_feature (468)..(468): n is either a, c, g or t
ggtagtttttttgggagtttttttattattttcggtgagtttttaggttcgggagagagttaggttttataaatgtggggtacgtagcgagcgcgcgtaanaaattgatcgattattgattggttntttgttttttncggacgcgtgttttttattagtagttgtcggcgttgtcgtaacggtatatagggtacgtagttttcgtcgtttttatttttcgtttcggagcggtttttttcggtaggtatttcgtcggtgcgagttcgttgtaagtatacgttagttaggtacggtttgtttttttttttacgttcgtttttatacgcgcggggtttcgttttttttttatttttcgttcgggtttcgatttttttattttttgttgtacgtatgcgcgttacggcgaaatttcgttttatttttgcgtgagatttaattcgatgtgaagaggcgaacgacggcgcgtangaacgatttcggagtttcggatcgcgtagagggataaatttgtttcggagatattatcgtacggcgaggtatggacgtttttatgggtggttacgcgatagt

SEQ ID NO: 5376 - DNA, 570 bp, Artificial Sequence
  chemically treated genomic DNA (Homo sapiens) CpG-island No: 5376
  misc_feature (103)..(103): n is either a, c, g or t
  misc_feature (434)..(434): n is either a, c, g or t
  misc_feature (445)..(445): n is either a, c, g or t
  misc_feature (470)..(470): n is either a, c, g or t
actatcgcgtaaccacccataaaaacgtccatacctcgccgtacgataatatctccgaaacaaatttatccctctacgcgatccgaaactccgaaatcgttcntacgcgccgtcgttcgcctcttcacatcgaattaaatctcacgcaaaaataaaacgaaatttcgccgtaacgcgcatacgtacaacaaaaaataaaaaaatcgaaacccgaacgaaaaataaaaaaaaaacgaaaccccgcgcgtataaaaacgaacgtaaaaaaaaaaacaaaccgtacctaactaacgtatacttacaacgaactcgcaccgacgaaatacctaccgaaaaaaaccgctccgaaacgaaaaataaaaacgacgaaaactacgtaccctatataccgttacgacaacgccgacaactactaataaaaaacacgcgtccgnaaaaaacaaanaaccaatcaataatcgatcaatttnttacgcgcgctcgctacgtaccccacatttataaaacctaactctctcccgaacctaaaaactcaccgaaaataataaaaaaactcccaaaaaaactacc

SEQ ID NO: 5377 - DNA, 760 bp, Artificial Sequence
  chemically treated genomic DNA (Homo sapiens) CpG-island No: 5377
atcgcgagtcggagtcggagtcggagtcggggtcggtcgggttgttgaggttcgagcggtaggagcgtagcgcggagcgttgagttaggcgtttagtcgcgagaagttgtcgtcgtttttgttcgttcggcgtcgtagtttcgggcggtttatggggcgggtacggcgtcgttgtaggcgtcggtagttttggagggtagtcgtttaggcgttgcgtttttgttttcgtaggtcgtagttagggcggcggggcgcgtttagtttcggtttttggagcgttcgtcgcggtttttatttttatggacgtttttaaggggggtatgagtttggagcggttgtcggaggggtttcggtcgtcgtcgtcgttattttatgatatggggttcgttttttatttggttcggttcgtcgattttcgcgagtcgttcgagaatttcgttagcgagtcgtttgatacggagttgttaggtaagcgtcgtttttcgcgcggcgcgtatagagtttattcgggcgcggagtacggggagttgggagtagggtttgacgttcgcgtcgcgtaattaagtttttttttcgttttagaagcgttaggagttttttttttttcgttttcgatttgacggtgaacgcggaaatttacgtatacgcgaaggtatttttacgcggtttttacgcgttaagagattggtagatgtacgagtttatagttggagggttggattgatagttttttttgattaggagtaaatagaacgggaaa

SEQ ID NO: 5378 - DNA, 760 bp, Artificial Sequence
  chemically treated genomic DNA (Homo sapiens) CpG-island No: 5378
tttcccgttctatttactcctaatcaaaaaaaactatcaatccaaccctccaactataaactcgtacatctaccaatctcttaacgcgtaaaaaccgcgtaaaaataccttcgcgtatacgtaaatttccgcgttcaccgtcaaatcgaaaacgaaaaaaaaaaaactcctaacgcttctaaaacgaaaaaaaaacttaattacgcgacgcgaacgtcaaaccctactcccaactccccgtactccgcgcccgaataaactctatacgcgccgcgcgaaaaacgacgcttacctaacaactccgtatcaaacgactcgctaacgaaattctcgaacgactcgcgaaaatcgacgaaccgaaccaaataaaaaacgaaccccatatcataaaataacgacgacgacgaccgaaacccctccgacaaccgctccaaactcataccccccttaaaaacgtccataaaaataaaaaccgcgacgaacgctccaaaaaccgaaactaaacgcgccccgccgccctaactacgacctacgaaaacaaaaacgcaacgcctaaacgactaccctccaaaactaccgacgcctacaacgacgccgtacccgccccataaaccgcccgaaactacgacgccgaacgaacaaaaacgacgacaacttctcgcgactaaacgcctaactcaacgctccgcgctacgctcctaccgctcgaacctcaacaacccgaccgaccccgactccgactccgactccgactcgcgat

SEQ ID NO: 5379 - DNA, 760 bp, Artificial Sequence
  chemically treated genomic DNA (Homo sapiens) CpG-island No: 5379
tttttcgttttatttatttttgattaagaggggttgttagtttaattttttagttgtaggttcgtgtatttgttagttttttggcgcgtggggatcgcgtggaagtgttttcgcgtgtgcgtaagttttcgcgtttatcgttaggtcgagaacgggaaaaagaaagtttttgacgtttttggggcggagagggagtttggttgcgcggcgcgggcgttaggttttgtttttagtttttcgtgtttcgcgttcgggtaggttttgtgcgcgtcgcgcggggaacggcgtttatttggtagtttcgtgttagacgattcgttggcggagttttcgagcggttcgcgggggtcggcgggtcgggttaggtggaaggcgggttttatgttatggggtggcggcggcggcggtcggagttttttcggtagtcgttttaggtttatgttttttttgaaggcgtttatggaggtggggatcgcggcgggcgttttaggggtcggggttgggcgcgtttcgtcgttttggttgcgatttgcggggataagagcgtagcgtttaagcggttgttttttagggttgtcggcgtttgtagcgacgtcgtgttcgttttatggatcgttcggggttgcggcgtcgggcgggtagaggcggcggtagtttttcgcgattgggcgtttggtttagcgtttcgcgttgcgtttttgtcgttcgggttttagtagttcggtcggtttcggtttcggtttcggtttcggttcgcgat

SEQ ID NO: 5380 - DNA, 760 bp, Artificial Sequence
  chemically treated genomic DNA (Homo sapiens) CpG-island No: 5380
atcgcgaaccgaaaccgaaaccgaaaccgaaaccgaccgaactactaaaacccgaacgacaaaaacgcaacgcgaaacgctaaaccaaacgcccaatcgcgaaaaactaccgccgcctctacccgcccgacgccgcaaccccgaacgatccataaaacgaacacgacgtcgctacaaacgccgacaaccctaaaaaacaaccgcttaaacgctacgctcttatccccgcaaatcgcaaccaaaacgacgaaacgcgcccaaccccgacccctaaaacgcccgccgcgatccccacctccataaacgccttcaaaaaaaacataaacctaaaacgactaccgaaaaaactccgaccgccgccgccgccaccccataacataaaacccgccttccacctaacccgacccgccgacccccgcgaaccgctcgaaaactccgccaacgaatcgtctaacacgaaactaccaaataaacgccgttccccgcgcgacgcgcacaaaacctacccgaacgcgaaacacgaaaaactaaaaacaaaacctaacgcccgcgccgcgcaaccaaactccctctccgccccaaaaacgtcaaaaactttctttttcccgttctcgacctaacgataaacgcgaaaacttacgcacacgcgaaaacacttccacgcgatccccacgcgccaaaaaactaacaaatacacgaacctacaactaaaaaattaaactaacaacccctcttaatcaaaaataaataaaacgaaaaa

SEQ ID NO: 5381 - DNA, 565 bp, Artificial Sequence
  chemically treated genomic DNA (Homo sapiens) CpG-island No: 5381
cgttaaggagcggttcggacgaagggagaggaggagatcgagaaaggaagaggggtgacgggcgagagaacgtatttagagagatagagagggaggttaatatcgtgatagtaggcgatagaatgaaagagattaaagagaaggggcgggcgggaagggtaaacggggggagaggggttattaagtagaagggagatatagaggacggtgagggcgagcgggttaataggcgcggtcggatttttagtaaggttagtcggaacgtcgattaagggattcggtttacgtgcgcggtcgaagttcggagtagttcggttttggttttcgtttcggtttttgcgcgttttttttcgcgttgtttttttttgttcgagttggagtttttttttagtagcgaattgggttcgcgggtggtcggcgcgggtagtggggtagcgaattcgttgtttagcgtagtcggtcgggtttcggaggggtttcgagtttttcggtgtgggcgttttttttgcgtttattttttaatatatagttgaatgtttttttttatttttttagtatttgtttt

SEQ ID NO: 5382 - DNA, 565 bp, Artificial Sequence
  chemically treated genomic DNA (Homo sapiens) CpG-island No: 5382
aaaacaaatactaaaaaaataaaaaaaaacattcaactatatattaaaaaataaacgcaaaaaaaacgcccacaccgaaaaactcgaaacccctccgaaacccgaccgactacgctaaacaacgaattcgctaccccactacccgcgccgaccacccgcgaacccaattcgctactaaaaaaaaactccaactcgaacaaaaaaaaacaacgcgaaaaaaaacgcgcaaaaaccgaaacgaaaaccaaaaccgaactactccgaacttcgaccgcgcacgtaaaccgaatcccttaatcgacgttccgactaaccttactaaaaatccgaccgcgcctattaacccgctcgccctcaccgtcctctatatctcccttctacttaataacccctctccccccgtttacccttcccgcccgccccttctctttaatctctttcattctatcgcctactatcacgatattaacctccctctctatctctctaaatacgttctctcgcccgtcacccctcttcctttctcgatctcctcctctcccttcgtccgaaccgctccttaacg

SEQ ID NO: 5383 - DNA, 565 bp, Artificial Sequence
  chemically treated genomic DNA (Homo sapiens) CpG-island No: 5383
gaaatagatattaagaaagtggagagaaatatttagttgtgtattaagaaatgaacgtagaagaggcgtttatatcggggagttcggagttttttcggaattcggtcggttgcgttgggtagcggattcgttgttttattgttcgcgtcggttattcgcgggtttagttcgttgttggaaaaaagttttagttcggataaaaaaaggtagcgcggagggagacgcgtaggagtcggggcgggggttagagtcgggttgtttcgggtttcggtcgcgtacgtgggtcggattttttgatcggcgtttcggttggttttgttgggagttcggtcgcgtttgttggttcgttcgtttttatcgttttttgtgttttttttttatttgatgattttttttttttcgtttatttttttcgttcgttttttttttttggttttttttattttgtcgtttattgttacggtgttaatttttttttttgtttttttgagtgcgttttttcgttcgttatttttttttttttttcggttttttttttttttttcgttcgagtcgttttttagcg

SEQ ID NO: 5384 - DNA, 565 bp, Artificial Sequence
  chemically treated genomic DNA (Homo sapiens) CpG-island No: 5384
cgctaaaaaacgactcgaacgaaaaaaaaaaaaaaaaccgaaaaaaaaaaaaaaataacgaacgaaaaaacgcactcaaaaaaacaaaaaaaaaaattaacaccgtaacaataaacgacaaaataaaaaaaaccaaaaaaaaaaaacgaacgaaaaaaataaacgaaaaaaaaaaaatcatcaaataaaaaaaaaacacaaaaaacgataaaaacgaacgaaccaacaaacgcgaccgaactcccaacaaaaccaaccgaaacgccgatcaaaaaatccgacccacgtacgcgaccgaaacccgaaacaacccgactctaacccccgccccgactcctacgcgtctccctccgcgctacctttttttatccgaactaaaacttttttccaacaacgaactaaacccgcgaataaccgacgcgaacaataaaacaacgaatccgctacccaacgcaaccgaccgaattccgaaaaaactccgaactccccgatataaacgcctcttctacgttcatttcttaatacacaactaaatatttctctccactttcttaatatctatttc

SEQ ID NO: 5385 - DNA, 782 bp, Artificial Sequence
  chemically treated genomic DNA (Homo sapiens) CpG-island No: 5385
ttcggatattatgtagcgtggatattttcgagttgttttgcggaatttcggggttttgaatcgtatttaagttttcgacgtcgaagtttacgaagttgttgttggcggcggtagtggtcggttgcgttggggaaggttcggcggggtaagcggtagtgtagttgtagttagggttgtaggtcgcgtcgtcgtaattcggataggcggggtaggcgttataatcgtagggattgaggtttacgtcgtaggtaggcgcgtagggcgtcgagttttttaggtatggtttgttatcgcgtattagtattggtatcgcgattttgcgggtaggcggcggcggcggcgggggtagttttattagttttagagtttggttttgtcgttgtcgtttgtatttgtagcgtcggttttggaattagattttgatttgcgtggacgtgagttttagtacgttggttagttggtcgcgttcgggggtcgataggtatcgttgttgtttgaagcgtcgttttagtttatagatttgcgtttgcgagaagagtacgcgcggtttttttcgtcgtcgcgttcggggtcgtttcgcgttgttcgtttttgttttttttagttttatcgttttttgtagcgcgtatagttttgagggggaatagagaggtagagagacgtttggtaagagcggtttgatttacggagcgcggtcgtatagtaatggtaagggattttcgtggaggttattgtgttttgtttggagcgtttagttggttgcggtttattttgttaagtgt

SEQ ID NO: 5386 - DNA, 782 bp, Artificial Sequence
  chemically treated genomic DNA (Homo sapiens) CpG-island No: 5386
acacttaacaaaataaaccgcaaccaactaaacgctccaaacaaaacacaataacctccacgaaaatcccttaccattactatacgaccgcgctccgtaaatcaaaccgctcttaccaaacgtctctctacctctctattccccctcaaaactatacgcgctacaaaaaacgataaaactaaaaaaaacaaaaacgaacaacgcgaaacgaccccgaacgcgacgacgaaaaaaaccgcgcgtactcttctcgcaaacgcaaatctataaactaaaacgacgcttcaaacaacaacgatacctatcgacccccgaacgcgaccaactaaccaacgtactaaaactcacgtccacgcaaatcaaaatctaattccaaaaccgacgctacaaatacaaacgacaacgacaaaaccaaactctaaaactaataaaactacccccgccgccgccgccgcctacccgcaaaatcgcgataccaatactaatacgcgataacaaaccatacctaaaaaactcgacgccctacgcgcctacctacgacgtaaacctcaatccctacgattataacgcctaccccgcctatccgaattacgacgacgcgacctacaaccctaactacaactacactaccgcttaccccgccgaaccttccccaacgcaaccgaccactaccgccgccaacaacaacttcgtaaacttcgacgtcgaaaacttaaatacgattcaaaaccccgaaattccgcaaaacaactcgaaaatatccacgctacataatatccgaa

SEQ ID NO: 5387 - DNA, 782 bp, Artificial Sequence
  chemically treated genomic DNA (Homo sapiens) CpG-island No: 5387
gtatttggtagagtgagtcgtagttagttgggcgttttaggtaggatatagtggtttttacgaggattttttattattattgtgcggtcgcgtttcgtaggttaagtcgtttttattaagcgtttttttgtttttttgtttttttttagagttgtgcgcgttgtagaaggcggtggagttggagaagatagaggcggataacgcggagcggtttcgggcgcgacggcggaggaagtcgcgcgtgtttttttcgtaggcgtaggtttatgagttggagcggcgttttaagtagtagcggtatttgtcggttttcgaacgcgattagttggttagcgtgttgaaatttacgtttacgtaggttaagatttggttttagaatcggcgttataagtgtaagcggtagcggtaggattagattttggagttggtggggttgttttcgtcgtcgtcgtcgtttgttcgtaggatcgcggtgttagtgttggtgcgcgatggtaagttatgtttaggggattcggcgttttacgcgtttgtttacggcgtgggttttaatttttacggttataacgtttatttcgtttattcgggttacggcggcgcggtttgtagttttggttatagttgtattgtcgtttatttcgtcgggttttttttagcgtagtcggttattgtcgtcgttaataataatttcgtgaatttcggcgtcggggatttgaatgcggtttagagtttcgggatttcgtagagtaattcgggagtgtttacgttgtatggtattcgag

SEQ ID NO: 5388 - DNA, 782 bp, Artificial Sequence
  chemically treated genomic DNA (Homo sapiens) CpG-island No: 5388
ctcgaataccatacaacgtaaacactcccgaattactctacgaaatcccgaaactctaaaccgcattcaaatccccgacgccgaaattcacgaaattattattaacgacgacaataaccgactacgctaaaaaaaacccgacgaaataaacgacaatacaactataaccaaaactacaaaccgcgccgccgtaacccgaataaacgaaataaacgttataaccgtaaaaattaaaacccacgccgtaaacaaacgcgtaaaacgccgaatcccctaaacataacttaccatcgcgcaccaacactaacaccgcgatcctacgaacaaacgacgacgacgacgaaaacaaccccaccaactccaaaatctaatcctaccgctaccgcttacacttataacgccgattctaaaaccaaatcttaacctacgtaaacgtaaatttcaacacgctaaccaactaatcgcgttcgaaaaccgacaaataccgctactacttaaaacgccgctccaactcataaacctacgcctacgaaaaaaacacgcgcgacttcctccgccgtcgcgcccgaaaccgctccgcgttatccgcctctatcttctccaactccaccgccttctacaacgcgcacaactctaaaaaaaaacaaaaaaacaaaaaaacgcttaataaaaacgacttaacctacgaaacgcgaccgcacaataataataaaaaatcctcgtaaaaaccactatatcctacctaaaacgcccaactaactacgactcactctaccaaatac

SEQ ID NO: 5389 - DNA, 509 bp, Artificial Sequence
  chemically treated genomic DNA (Homo sapiens) CpG-island No: 5389
ttagatacgtataaggaaaagattaagcgataataacgacggttaaaataaataaagcggagatacgagaagataggaaggacggatacgaaagaagagattatcgattataacgatacgggaagacggggggtagggcgaaatagatgcgagaagagagattcgacggtataaaagagtaaggagaggagtaagagagcggggtacgagatagtcgggcgagcgaggagaaaaagacgtaagagggacggaggtagaaagagagaaaacgaggtaaaaggagaagtgggggtttagattaggaagaagagagaaagagagaaaaagaggggagagcgcgagagaagagtagagaacgaagggagaggggaggagtcgcggagagaaaaataggaagaaggagagaggaggggcgggagagagcgaaacggaattggataggcggaaggtagaagtacgagggggaggggtaagggtagcgaggagggggaagagggggataagcgaga

SEQ ID NO: 5390 - DNA, 509 bp, Artificial Sequence
  chemically treated genomic DNA (Homo sapiens) CpG-island No: 5390
tctcgcttatccccctcttccccctcctcgctacccttacccctccccctcgtacttctaccttccgcctatccaattccgtttcgctctctcccgcccctcctctctccttcttcctatttttctctccgcgactcctcccctctcccttcgttctctactcttctctcgcgctctcccctctttttctctctttctctcttcttcctaatctaaacccccacttctccttttacctcgttttctctctttctacctccgtccctcttacgtctttttctcctcgctcgcccgactatctcgtaccccgctctcttactcctctccttactcttttataccgtcgaatctctcttctcgcatctatttcgccctaccccccgtcttcccgtatcgttataatcgataatctcttctttcgtatccgtccttcctatcttctcgtatctccgctttatttattttaaccgtcgttattatcgcttaatcttttccttatacgtatctaa

SEQ ID NO: 5391 - DNA, 509 bp, Artificial Sequence
  chemically treated genomic DNA (Homo sapiens) CpG-island No: 5391
tttcgtttgtttttttttttttttttttcgttgtttttgtttttttttttcgtgtttttgtttttcgtttgtttagtttcgtttcgttttttttcgttttttttttttttttttttttgttttttttttcgcggtttttttttttttttttcgttttttgtttttttttcgcgttttttttttttttttttttttttttttttttttttggtttgggtttttatttttttttttgtttcgttttttttttttttgttttcgttttttttgcgttttttttttttcgttcgttcggttgtttcgtgtttcgtttttttgtttttttttttgtttttttgtgtcgtcgggttttttttttcgtatttgtttcgttttgtttttcgttttttcgtgtcgttgtggtcggtggttttttttttcgtgttcgttttttttgttttttcgtgttttcgttttgtttgttttggtcgtcgttgttgtcgtttggttttttttttgtgcgtgtttgg

SEQ ID NO: 5392 - DNA, 509 bp, Artificial Sequence
  chemically treated genomic DNA (Homo sapiens) CpG-island No: 5392
ccaaacacgcacaaaaaaaaaaccaaacgacaacaacgacgaccaaaacaaacaaaacgaaaacacgaaaaaacaaaaaaaacgaacacgaaaaaaaaaaccaccgaccacaacgacacgaaaaaacgaaaaacaaaacgaaacaaatacgaaaaaaaaaacccgacgacacaaaaaaacaaaaaaaaaaacaaaaaaacgaaacacgaaacaaccgaacgaacgaaaaaaaaaaaacgcaaaaaaaacgaaaacaaaaaaaaaaaaaacgaaacaaaaaaaaaaataaaaacccaaaccaaaaaaaaaaaaaaaaaaaaaaaaaaaaaaaaaaaacgcgaaaaaaaaacaaaaaacgaaaaaaaaaaaaaaaaaccgcgaaaaaaaaaacaaaaaaaaaaaaaaaaaaaaaacgaaaaaaaacgaaacgaaactaaacaaacgaaaaacaaaaacacgaaaaaaaaaaacaaaaacaacgaaaaaaaaaaaaaaaaaaacaaacgaaa

SEQ ID NO: 5393 - DNA, 578 bp, Artificial Sequence
  chemically treated genomic DNA (Homo sapiens) CpG-island No: 5393
  misc_feature (99)..(99): n is either a, c, g or t
  misc_feature (307)..(307): n is either a, c, g or t
  misc_feature (317)..(317): n is either a, c, g or t
  misc_feature (327)..(327): n is either a, c, g or t
  misc_feature (344)..(344): n is either a, c, g or t
  misc_feature (403)..(403): n is either a, c, g or t
  misc_feature (447)..(447): n is either a, c, g or t
  misc_feature (452)..(452): n is either a, c, g or t
  misc_feature (469)..(469): n is either a, c, g or t
  misc_feature (480)..(480): n is either a, c, g or t
  misc_feature (506)..(506): n is either a, c, g or t
aagacgacgacgacgatgaagacgaaaacgacgaggaagaagaggacgacgagacgacgacgggaagaagacgataagacgacgagacgacgagtatgngacggagaggaggacgttatgacgaagaagaatacgagacgatgacgatgacgatatgacgacggataagacgaagacgacgacgacgacgacgacgacgacgacgacgaggacgaagagtacgacgacgacgaggcgacgacgaggcgacgacgacgaggacgacgacgaggacgaagatgatagagatgacgaacgacgaggtganggaggacgangaatgacgangaggacgcgacgagtangagatgacgacgacgacgaggagacgaggaagagcgacgtgacgagacgatgcgatggngacgacgggagaaggagttacgacgaggagaggagagatgagangagancgagacgaagacgcgangatgacgaggngagtacgacgaggacgtgacgacgantacgagaggacgacgagacgacgaggagatgaggcgatgacgaacgggagtaggagaacgcgaggcgatgat

SEQ ID NO: 5394 - DNA, 578 bp, Artificial Sequence
  chemically treated genomic DNA (Homo sapiens) CpG-island No: 5394
  misc_feature (73)..(73): n is either a, c, g or t
  misc_feature (99)..(99): n is either a, c, g or t
  misc_feature (110)..(110): n is either a, c, g or t
  misc_feature (127)..(127): n is either a, c, g or t
  misc_feature (132)..(132): n is either a, c, g or t
  misc_feature (176)..(176): n is either a, c, g or t
  misc_feature (235)..(235): n is either a, c, g or t
  misc_feature (252)..(252): n is either a, c, g or t
  misc_feature (262)..(262): n is either a, c, g or t
  misc_feature (272)..(272): n is either a, c, g or t
  misc_feature (480)..(480): n is either a, c, g or t
atcatcgcctcgcgttctcctactcccgttcgtcatcgcctcatctcctcgtcgtctcgtcgtcctctcgtantcgtcgtcacgtcctcgtcgtactcncctcgtcatcntcgcgtcttcgtctcgntctcntctcatctctcctctcctcgtcgtaactccttctcccgtcgtcnccatcgcatcgtctcgtcacgtcgctcttcctcgtctcctcgtcgtcgtcgtcatctcntactcgtcgcgtcctcntcgtcattcntcgtcctccntcacctcgtcgttcgtcatctctatcatcttcgtcctcgtcgtcgtcctcgtcgtcgtcgcctcgtcgtcgcctcgtcgtcgtcgtactcttcgtcctcgtcgtcgtcgtcgtcgtcgtcgtcgtcgtcgtcttcgtcttatccgtcgtcatatcgtcatcgtcatcgtctcgtattcttcttcgtcataacgtcctcctctccgtcncatactcgtcgtctcgtcgtcttatcgtcttcttcccgtcgtcgtctcgtcgtcctcttcttcctcgtcgttttcgtcttcatcgtcgtcgtcgtctt

SEQ ID NO: 5395 - DNA, 578 bp, Artificial Sequence
  chemically treated genomic DNA (Homo sapiens) CpG-island No: 5395
  misc_feature (73)..(73): n is either a, c, g or t
  misc_feature (99)..(99): n is either a, c, g or t
  misc_feature (110)..(110): n is either a, c, g or t
  misc_feature (127)..(127): n is either a, c, g or t
  misc_feature (132)..(132): n is either a, c, g or t
  misc_feature (176)..(176): n is either a, c, g or t
  misc_feature (235)..(235): n is either a, c, g or t
  misc_feature (252)..(252): n is either a, c, g or t
  misc_feature (262)..(262): n is either a, c, g or t
  misc_feature (272)..(272): n is either a, c, g or t
  misc_feature (480)..(480): n is either a, c, g or t
gttatcgtttcgcgtttttttattttcgttcgttatcgttttattttttcgtcgtttcgtcgttttttcgtgntcgtcgttacgttttcgtcgtgtttntttcgttattntcgcgttttcgtttcgnttttnttttatttttttttttttcgtcgtggttttttttttcgtcgttnttatcgtatcgtttcgttacgtcgttttttttcgttttttcgtcgtcgtcgttattttntgttcgtcgcgtttttntcgttatttntcgttttttnttatttcgtcgttcgttatttttgttattttcgttttcgtcgtcgttttcgtcgtcgtcgtttcgtcgtcgtttcgtcgtcgtcgtgtttttcgttttcgtcgtcgtcgtcgtcgtcgtcgtcgtcgtcgttttcgttttgttcgtcgttatgtcgttatcgttatcgtttcgtattttttttcgttatgacgttttttttttcgttntatgttcgtcgtttcgtcgttttgtcgtttttttttcgtcgtcgtttcgtcgtttttttttttttcgtcgttttcgtttttatcgtcgtcgtcgtttt

SEQ ID NO: 5396 - DNA, 578 bp, Artificial Sequence
  chemically treated genomic DNA (Homo sapiens) CpG-island No: 5396
  misc_feature (99)..(99): n is either a, c, g or t
  misc_feature (307)..(307): n is either a, c, g or t
  misc_feature (317)..(317): n is either a, c, g or t
  misc_feature (327)..(327): n is either a, c, g or t
  misc_feature (344)..(344): n is either a, c, g or t
  misc_feature (403)..(403): n is either a, c, g or t
  misc_feature (447)..(447): n is either a, c, g or t
  misc_feature (452)..(452): n is either a, c, g or t
  misc_feature (469)..(469): n is either a, c, g or t
  misc_feature (480)..(480): n is either a, c, g or t
  misc_feature (506)..(506): n is either a, c, g or t
aaaacgacgacgacgataaaaacgaaaacgacgaaaaaaaaaaaaacgacgaaacgacgacgaaaaaaaaacgacaaaacgacgaaacgacgaacatanaacgaaaaaaaaaacgtcataacgaaaaaaaatacgaaacgataacgataacgacataacgacgaacaaaacgaaaacgacgacgacgacgacgacgacgacgacgacgaaaacgaaaaacacgacgacgacgaaacgacgacgaaacgacgacgacgaaaacgacgacgaaaacgaaaataacaaaaataacgaacgacgaaataanaaaaaacganaaataacganaaaaacgcgacgaacanaaaataacgacgacgacgaaaaaacgaaaaaaaacgacgtaacgaaacgatacgataanaacgacgaaaaaaaaaaccacgacgaaaaaaaaaaaaataaaanaaaancgaaacgaaaacgcganaataacgaaanaaacacgacgaaaacgtaacgacgancacgaaaaaacgacgaaacgacgaaaaaataaaacgataacgaacgaaaataaaaaaacgcgaaacgataac

SEQ ID NO: 5397 - DNA, 659 bp, Artificial Sequence
  chemically treated genomic DNA (Homo sapiens) CpG-island No: 5397
tttattacggtcgttttagtgatggttatcgttgcggggaattaataattcggttttttagtatttagttcggattaaggtaggagtaagttatcgtttttcgcgcgttaagatttttaagggattttcgttgtcggaggtagtacgtgggattattagtattgaaagtagttttaggtagtagttattttcgttgtagtagcggcggtgagacgtcgagtttgagggcgcgacggggtttttcggtgttttagcggtcgagggggagttcgaggaggaggacgggggcgcggttgggtagcggagagacggtcggtcggggagtagttataacggtagcggggacgggggcgttgtcgtttcgagcgttcgatttcgggattttttgtacgtgggggtgatgatcgcgtagaagtatttgggtagtcgcgcgttggtcgcgtagcggatttgggcgcgttttatttcgggtcgcgtggagtttttttttagttagtagttttttaacgtcggttagttttcgttatttttgtttgttatcgcgttatcgggtgtggacgatttttattttttttagaaaaagttttttatgatgattaagtatatgtacgattattatttggataagtatgagtggtttatgcgcgtcgacgacgatg

SEQ ID NO: 5398 - DNA, 659 bp, Artificial Sequence
  chemically treated genomic DNA (Homo sapiens) CpG-island No: 5398
catcgtcgtcgacgcgcataaaccactcatacttatccaaataataatcgtacatatacttaatcatcataaaaaactttttctaaaaaaaataaaaatcgtccacacccgataacgcgataacaaacaaaaataacgaaaactaaccgacgttaaaaaactactaactaaaaaaaaactccacgcgacccgaaataaaacgcgcccaaatccgctacgcgaccaacgcgcgactacccaaatacttctacgcgatcatcacccccacgtacaaaaaatcccgaaatcgaacgctcgaaacgacaacgcccccgtccccgctaccgttataactactccccgaccgaccgtctctccgctacccaaccgcgcccccgtcctcctcctcgaactccccctcgaccgctaaaacaccgaaaaaccccgtcgcgccctcaaactcgacgtctcaccgccgctactacaacgaaaataactactacctaaaactactttcaatactaataatcccacgtactacctccgacaacgaaaatcccttaaaaatcttaacgcgcgaaaaacgataacttactcctaccttaatccgaactaaatactaaaaaaccgaattattaattccccgcaacgataaccatcactaaaacgaccgtaataaa

SEQ ID NO: 5399 - DNA, 659 bp, Artificial Sequence
  chemically treated genomic DNA (Homo sapiens) CpG-island No: 5399
tatcgtcgtcggcgcgtatgaattatttatatttgtttaggtagtggtcgtgtatgtatttgattattatgaaggattttttttggggaggataggagtcgtttatattcggtagcgcgatgataggtaggggtggcgggggttggtcggcgttggggggttgttggttggaaaagaattttacgcggttcgggatgaaacgcgtttaggttcgttgcgcggttagcgcgcggttgtttaggtatttttgcgcggttattatttttacgtataggaagtttcggggtcgggcgttcggggcggtagcgttttcgttttcgttgtcgttgtggttatttttcggtcggtcgttttttcgttgtttagtcgcgttttcgttttttttttcgggttttttttcggtcgttggagtatcgggaagtttcgtcgcgtttttaagttcggcgttttatcgtcgttgttgtagcggaagtggttgttgtttggggttgtttttaatattggtgattttacgtgttgttttcggtagcggaggttttttgaaaattttggcgcgcggggggcggtaatttgtttttgttttggttcggattaggtgttggaggatcgggttgttgatttttcgtagcggtggttattattaaaacgatcgtaatagg

SEQ ID NO: 5400 - DNA, 659 bp, Artificial Sequence
  chemically treated genomic DNA (Homo sapiens) CpG-island No: 5400
cctattacgatcgttttaataataaccaccgctacgaaaaatcaacaacccgatcctccaacacctaatccgaaccaaaacaaaaacaaattaccgccccccgcgcgccaaaattttcaaaaaacctccgctaccgaaaacaacacgtaaaatcaccaatattaaaaacaaccccaaacaacaaccacttccgctacaacaacgacgataaaacgccgaacttaaaaacgcgacgaaacttcccgatactccaacgaccgaaaaaaaacccgaaaaaaaaaacgaaaacgcgactaaacaacgaaaaaacgaccgaccgaaaaataaccacaacgacaacgaaaacgaaaacgctaccgccccgaacgcccgaccccgaaacttcctatacgtaaaaataataaccgcgcaaaaatacctaaacaaccgcgcgctaaccgcgcaacgaacctaaacgcgtttcatcccgaaccgcgtaaaattcttttccaaccaacaaccccccaacgccgaccaacccccgccacccctacctatcatcgcgctaccgaatataaacgactcctatcctccccaaaaaaaatccttcataataatcaaatacatacacgaccactacctaaacaaatataaataattcatacgcgccgacgacgata

SEQ ID NO: 5401 - DNA, 893 bp, Artificial Sequence
  chemically treated genomic DNA (Homo sapiens) CpG-island No: 5401
  misc_feature (319)..(319): n is either a, c, g or t
  misc_feature (610)..(610): n is either a, c, g or t
  misc_feature (620)..(620): n is either a, c, g or t
  misc_feature (640)..(640): n is either a, c, g or t
  misc_feature (846)..(848): n is either a, c, g or t
  misc_feature (850)..(850): n is either a, c, g or t
  misc_feature (852)..(852): n is either a, c, g or t
  misc_feature (854)..(855): n is either a, c, g or t
gaaggcgcggagtggtagcggtaataataacgtggaaaggacggaaaacgcgaagagtggcgttttggcggatttggggcggggtagagtggtaagggttacgttaggacgtattcgtttgtgggtcggggagaagagcgcggtgggatagtaacgaattggttgggggttttaggattcgagtttcgtcgatgaggttagcggagttagggcgtcgggaggaggttagtagagtttttagatacgagtgtcgggaggttagcggaggggcgggacgggacgggaaatggggcgaagagtaagagttgggggagggggnaagagggggcgtcggcgttgtaagtcggaggcggttcgatagggatcgttttttttcggagaggaggtcggatttggattgaggcgcggacggggggcgtttaagggcgggtgacggggaaatatcgcggttcgcgtttttttttcgtatgtacgggtcgtcgttgtaggttttattatcgggttagttcggagttcgtcggcgggggacgcggacggcggtagttagggcgggggttcgggaaggaggatggagggagggtttaggcgcgtttttgatagggtggtagtntaggagcggncgcgttgtcgtcgtcgtgtnttttttttttttttttgtagtttttttagttgtcgttgttgtcgtcgttgtcgttatcgtcgtcgtcgggagaagttttattttcgatttttgttcggagtttcggtttagagttgagcgggagttcggtaggtagttgtagttcgcggtagtcgaggcgttcgcggcgtttcgatttttatttagagtatagtgggatgagtttnnngnantnnggcggtcggcggataaaaaaagtgatattaatgattat

SEQ ID NO: 5402 - DNA, 893 bp, Artificial Sequence
  chemically treated genomic DNA (Homo sapiens) CpG-island No: 5402
  misc_feature (39)..(40): n is either a, c, g or t
  misc_feature (42)..(42): n is either a, c, g or t
  misc_feature (44)..(44): n is either a, c, g or t
  misc_feature (46)..(48): n is either a, c, g or t
  misc_feature (254)..(254): n is either a, c, g or t
  misc_feature (274)..(274): n is either a, c, g or t
  misc_feature (284)..(284): n is either a, c, g or t
  misc_feature (575)..(575): n is either a, c, g or t
ataatcattaatatcactttttttatccgccgaccgccnnantncnnnaaactcatcccactatactctaaataaaaatcgaaacgccgcgaacgcctcgactaccgcgaactacaactacctaccgaactcccgctcaactctaaaccgaaactccgaacaaaaatcgaaaataaaacttctcccgacgacgacgataacgacaacgacgacaacaacgacaactaaaaaaactacaaaaaaaaaaaaaaaanacacgacgacgacaacgcgnccgctcctanactaccaccctatcaaaaacgcgcctaaaccctccctccatcctccttcccgaacccccgccctaactaccgccgtccgcgtcccccgccgacgaactccgaactaacccgataataaaacctacaacgacgacccgtacatacgaaaaaaaaacgcgaaccgcgatatttccccgtcacccgcccttaaacgccccccgtccgcgcctcaatccaaatccgacctcctctccgaaaaaaaacgatccctatcgaaccgcctccgacttacaacgccgacgccccctcttnccccctcccccaactcttactcttcgccccatttcccgtcccgtcccgcccctccgctaacctcccgacactcgtatctaaaaactctactaacctcctcccgacgccctaactccgctaacctcatcgacgaaactcgaatcctaaaacccccaaccaattcgttactatcccaccgcgctcttctccccgacccacaaacgaatacgtcctaacgtaacccttaccactctaccccgccccaaatccgccaaaacgccactcttcgcgttttccgtcctttccacgttattattaccgctaccactccgcgccttc

SEQ ID NO: 5403 - DNA, 893 bp, Artificial Sequence
  chemically treated genomic DNA (Homo sapiens) CpG-island No: 5403
  misc_feature (39)..(40): n is either a, c, g or t
  misc_feature (42)..(42): n is either a, c, g or t
  misc_feature (44)..(44): n is either a, c, g or t
  misc_feature (46)..(48): n is either a, c, g or t
  misc_feature (254)..(254): n is either a, c, g or t
  misc_feature (274)..(274): n is either a, c, g or t
  misc_feature (284)..(284): n is either a, c, g or t
  misc_feature (575)..(575): n is either a, c, g or t
atgattattgatattattttttttattcgtcggtcgttnngntntnnnggatttattttattgtgttttaagtggaggtcgaagcgtcgcggacgtttcgattgtcgcgggttgtagttgtttgtcgggttttcgtttagttttgggtcggggtttcgagtaagggtcgggagtgaaatttttttcggcggcggcggtggcggtagcggcggtagtagcggtagttagaggagttgtaggaggaggaggaggangtacggcggcggtaacgcgntcgtttttangttgttattttgttaggggcgcgtttgggttttttttttattttttttttcgagttttcgttttaattgtcgtcgttcgcgtttttcgtcgacgggtttcgagttggttcggtagtagagtttgtagcggcgattcgtgtatgcgggagagaagcgcgggtcgcggtattttttcgttattcgtttttggacgtttttcgttcgcgttttagtttagattcggtttttttttcggaaggaaacgatttttgtcgggtcgttttcggtttgtagcgtcgacgtttttttttntttttttttttagtttttgtttttcgttttatttttcgtttcgtttcgttttttcgttggtttttcgatattcgtgtttgggggttttattggttttttttcggcgttttagtttcgttgattttatcggcggagttcgggttttggagtttttagttagttcgttgttgttttatcgcgttttttttttcggtttatagacgggtacgttttgacgtgatttttattattttgtttcgttttaggttcgttagggcgttatttttcgcgtttttcgttttttttacgttgttgttatcgttgttatttcgcgttttt

SEQ ID NO: 5404 - DNA, 893 bp, Artificial Sequence
  chemically treated genomic DNA (Homo sapiens) CpG-island No: 5404
  misc_feature (319)..(319): n is either a, c, g or t
  misc_feature (610)..(610): n is either a, c, g or t
  misc_feature (620)..(620): n is either a, c, g or t
  misc_feature (640)..(640): n is either a, c, g or t
  misc_feature (846)..(848): n is either a, c, g or t
  misc_feature (850)..(850): n is either a, c, g or t
  misc_feature (852)..(852): n is either a, c, g or t
  misc_feature (854)..(855): n is either a, c, g or t
aaaaacgcgaaataacaacgataacaacaacgtaaaaaaaacgaaaaacgcgaaaaataacgccctaacgaacctaaaacgaaacaaaataataaaaatcacgtcaaaacgtacccgtctataaaccgaaaaaaaaaacgcgataaaacaacaacgaactaactaaaaactccaaaacccgaactccgccgataaaatcaacgaaactaaaacgccgaaaaaaaaccaataaaacccccaaacacgaatatcgaaaaaccaacgaaaaaacgaaacgaaacgaaaaataaaacgaaaaacaaaaactaaaaaaaaaaanaaaaaaaaacgtcgacgctacaaaccgaaaacgacccgacaaaaatcgtttccttccgaaaaaaaaaccgaatctaaactaaaacgcgaacgaaaaacgtccaaaaacgaataacgaaaaaataccgcgacccgcgcttctctcccgcatacacgaatcgccgctacaaactctactaccgaaccaactcgaaacccgtcgacgaaaaacgcgaacgacgacaattaaaacgaaaactcgaaaaaaaaaataaaaaaaaaacccaaacgcgcccctaacaaaataacaacntaaaaacgancgcgttaccgccgccgtacntcctcctcctcctcctacaactcctctaactaccgctactaccgccgctaccgccaccgccgccgccgaaaaaaatttcactcccgacccttactcgaaaccccgacccaaaactaaacgaaaacccgacaaacaactacaacccgcgacaatcgaaacgtccgcgacgcttcgacctccacttaaaacacaataaaataaatccnnnanancnnaacgaccgacgaataaaaaaaataatatcaataatcat

SEQ ID NO: 5405 - DNA, 567 bp, Artificial Sequence
  chemically treated genomic DNA (Homo sapiens) CpG-island No: 5405
cgatagtcggtggttaaaaaagtcggatacgttgatttatttgttaggcggaaaaaatggtcgttaaaagcgattcgcgtttgggttttcgcgcggttttcgatagtattattgcgttggtagtgtggttgtaaattgaattggcggaatcgtggtagtcgtggttggcggatattcgttcgcgttttggtaatattatgcgcgtcgatgcgttgggggaatcgttgggttgttaggcgattgtcgggttttttgacgaagatttgtatcggtttttttattagtcgttgcgttatttcgattacgattatttggtgtcggaagttagttacgggcgcgatgttgcgttgtttaatttgttacgtattaaagtgcgggaaatcgaaatcgtagcggcgtaggtttttattattcgtagttttgaagtattacgttcggatattttgtaggcgttgaatcgtttttcgagtacggtttacgtgatgatgattttgagcgtaacgaagtagtcgttaacggtgaagtagatttaataacgattgggggaaacgtaatgattattgaacg

SEQ ID NO: 5406 - DNA, 567 bp, Artificial Sequence
  chemically treated genomic DNA (Homo sapiens) CpG-island No: 5406
cgttcaataatcattacgtttcccccaatcgttattaaatctacttcaccgttaacgactacttcgttacgctcaaaatcatcatcacgtaaaccgtactcgaaaaacgattcaacgcctacaaaatatccgaacgtaatacttcaaaactacgaataataaaaacctacgccgctacgatttcgatttcccgcactttaatacgtaacaaattaaacaacgcaacatcgcgcccgtaactaacttccgacaccaaataatcgtaatcgaaataacgcaacgactaataaaaaaaccgatacaaatcttcgtcaaaaaacccgacaatcgcctaacaacccaacgattcccccaacgcatcgacgcgcataatattaccaaaacgcgaacgaatatccgccaaccacgactaccacgattccgccaattcaatttacaaccacactaccaacgcaataatactatcgaaaaccgcgcgaaaacccaaacgcgaatcgcttttaacgaccattttttccgcctaacaaataaatcaacgtatccgacttttttaaccaccgactatcg

SEQ ID NO: 5407 - DNA, 567 bp, Artificial Sequence
  chemically treated genomic DNA (Homo sapiens) CpG-island No: 5407
cgtttaataattattgcgttttttttagtcgttgttggatttgttttatcgttagcggttgtttcgttacgtttaggattattattacgtagatcgtgttcgaaaggcggtttagcgtttgtaaaatgttcgggcgtaatattttaaagttgcgggtgataaagatttgcgtcgttacggtttcggtttttcgtattttggtgcgtagtagattgagtaacgtagtatcgcgttcgtggttggttttcggtattagatgatcgtggtcgagatagcgtagcggttgatgagaaagtcgatgtagattttcgttagaaagttcgataatcgtttggtagtttagcggtttttttagcgtatcggcgcgtataatgttgttaagacgcgaacggatattcgttagttacggttgttacggtttcgttagtttaatttgtagttatattgttagcgtaatggtgttgtcgagaatcgcgcgaaaatttagacgcggatcgtttttggcgattatttttttcgtttgataggtgagttagcgtattcggtttttttagttatcggttgtcg

SEQ ID NO: 5408 - DNA, 567 bp, Artificial Sequence
  chemically treated genomic DNA (Homo sapiens) CpG-island No: 5408
cgacaaccgataactaaaaaaaccgaatacgctaactcacctatcaaacgaaaaaaataatcgccaaaaacgatccgcgtctaaattttcgcgcgattctcgacaacaccattacgctaacaatataactacaaattaaactaacgaaaccgtaacaaccgtaactaacgaatatccgttcgcgtcttaacaacattatacgcgccgatacgctaaaaaaaccgctaaactaccaaacgattatcgaactttctaacgaaaatctacatcgactttctcatcaaccgctacgctatctcgaccacgatcatctaataccgaaaaccaaccacgaacgcgatactacgttactcaatctactacgcaccaaaatacgaaaaaccgaaaccgtaacgacgcaaatctttatcacccgcaactttaaaatattacgcccgaacattttacaaacgctaaaccgcctttcgaacacgatctacgtaataataatcctaaacgtaacgaaacaaccgctaacgataaaacaaatccaacaacgactaaaaaaaacgcaataattattaaacg

SEQ ID NO: 5409 - DNA, 888 bp, Artificial Sequence
  chemically treated genomic DNA (Homo sapiens) CpG-island No: 5409
  misc_feature (706)..(706): n is either a, c, g or t
tcgttacgtagcgcgttttgtttttttggcgtaatgtcgatacggtagtaattggtcgcgcgtagaattcgtggaaagagtgtaatattcggcggatggaagaagataacgttcgtttggcgcggcgtagtagcggtggcggcgcggtgttttacgatttcggtaatatttgttttatttttatggttggtaagtcggagtacgataaaattatttttacgtcgattgtgtttaatgcgttgaacgcgttcggcgttagcgtcgaagcgttcggacgtaacgatttggtggtgaaaatcgtcgaaggcgatcgtaaagttttaggttcggtttatcgcgaaattaaagatcgcggtttttattacggtattttgttatttaatgtcgattttagtcgtttggtaaattattttaattcggataaaaagaaattggcggcgaaaggtattacgtcggtacgttttcgcgtgattaattttatcgagttgttgtcggggattatttatgagtaggtttgcgaggttataatcgaggtttttttcgtttattatggcgagcgcgtggaagcggaaattattttttcgaataaaacgttagatttgttaaatttcgtcgaaatttttgttcgttagagtagttgggaatggaatttcggttaggtttcggtattttcgtatttgttggatgaacgttttatttggggttncgtggaattgtatttcgacgttgaaaaaggttatattattcgcgtttaggtgtttatcgatagttttaatttcgcgtcgttggaagttttcgtcggacgattgtaaggttgtttgtatcgcgtagatatgttgtaataggagtgcgaagcgttgttggttgatttttcggaataggaaaaag

SEQ ID NO: 5410 - DNA, 888 bp, Artificial Sequence
  chemically treated genomic DNA (Homo sapiens) CpG-island No: 5410
  misc_feature (183)..(183): n is either a, c, g or t
ctttttcctattccgaaaaatcaaccaacaacgcttcgcactcctattacaacatatctacgcgatacaaacaaccttacaatcgtccgacgaaaacttccaacgacgcgaaattaaaactatcgataaacacctaaacgcgaataatataacctttttcaacgtcgaaatacaattccacgnaaccccaaataaaacgttcatccaacaaatacgaaaataccgaaacctaaccgaaattccattcccaactactctaacgaacaaaaatttcgacgaaatttaacaaatctaacgttttattcgaaaaaataatttccgcttccacgcgctcgccataataaacgaaaaaaacctcgattataacctcgcaaacctactcataaataatccccgacaacaactcgataaaattaatcacgcgaaaacgtaccgacgtaatacctttcgccgccaatttctttttatccgaattaaaataatttaccaaacgactaaaatcgacattaaataacaaaataccgtaataaaaaccgcgatctttaatttcgcgataaaccgaacctaaaactttacgatcgccttcgacgattttcaccaccaaatcgttacgtccgaacgcttcgacgctaacgccgaacgcgttcaacgcattaaacacaatcgacgtaaaaataattttatcgtactccgacttaccaaccataaaaataaaacaaatattaccgaaatcgtaaaacaccgcgccgccaccgctactacgccgcgccaaacgaacgttatcttcttccatccgccgaatattacactctttccacgaattctacgcgcgaccaattactaccgtatcgacattacgccaaaaaaacaaaacgcgctacgtaacga

SEQ ID NO: 5411 - DNA, 888 bp, Artificial Sequence
  chemically treated genomic DNA (Homo sapiens) CpG-island No: 5411
  misc_feature (183)..(183): n is either a, c, g or t
tttttttttgtttcgggaagttaattaatagcgtttcgtatttttgttgtagtatatttgcgcggtataggtagttttgtagtcgttcggcgagggtttttagcggcgcggggttgaggttgtcggtaaatatttgggcgcgggtgatatggttttttttaacgtcgaaatgtagttttacgngattttaggtaaagcgtttatttagtagatgcgagaatgtcggagtttgatcgaagttttatttttagttattttggcgggtaaaggtttcggcgaagtttggtaagtttggcgttttgttcggggagatgattttcgtttttacgcgttcgttataatgggcgaaaaaggtttcggttatggtttcgtaaatttgtttatgggtgattttcggtaatagttcggtgaggttggttacgcgggaacgtatcgacgtaatgtttttcgtcgttagtttttttttattcggattgagatagtttgttaggcggttgaggtcggtattgagtagtaaggtgtcgtggtggaagtcgcgatttttggtttcgcgataggtcgagtttgagattttgcggtcgttttcgacggtttttattattagatcgttacgttcggacgtttcggcgttgacgtcgagcgcgtttagcgtattgagtataatcgacgtggagatagttttatcgtatttcggtttgttagttataaaggtaaagtaggtattgtcgagatcgtggaatatcgcgtcgttatcgttattgcgtcgcgttaggcggacgttatttttttttattcgtcgggtattatattttttttacgggttttgcgcgcgattaattattatcgtgtcggtattgcgttagagaaatagaacgcgttgcgtggcgg

SEQ ID NO: 5412 - DNA, 888 bp, Artificial Sequence
  chemically treated genomic DNA (Homo sapiens) CpG-island No: 5412
  misc_feature (706)..(706): n is either a, c, g or t
ccgccacgcaacgcgttctatttctctaacgcaataccgacacgataataattaatcgcgcgcaaaacccgtaaaaaaaatataatacccgacgaataaaaaaaaataacgtccgcctaacgcgacgcaataacgataacgacgcgatattccacgatctcgacaatacctactttacctttataactaacaaaccgaaatacgataaaactatctccacgtcgattatactcaatacgctaaacgcgctcgacgtcaacgccgaaacgtccgaacgtaacgatctaataataaaaaccgtcgaaaacgaccgcaaaatctcaaactcgacctatcgcgaaaccaaaaatcgcgacttccaccacgacaccttactactcaataccgacctcaaccgcctaacaaactatctcaatccgaataaaaaaaaactaacgacgaaaaacattacgtcgatacgttcccgcgtaaccaacctcaccgaactattaccgaaaatcacccataaacaaatttacgaaaccataaccgaaacctttttcgcccattataacgaacgcgtaaaaacgaaaatcatctccccgaacaaaacgccaaacttaccaaacttcgccgaaacctttacccgccaaaataactaaaaataaaacttcgatcaaactccgacattctcgcatctactaaataaacgctttacctaaaatcncgtaaaactacatttcgacgttaaaaaaaaccatatcacccgcgcccaaatatttaccgacaacctcaaccccgcgccgctaaaaaccctcgccgaacgactacaaaactacctataccgcgcaaatatactacaacaaaaatacgaaacgctattaattaacttcccgaaacaaaaaaaaa

SEQ ID NO: 5413 - DNA, 532 bp, Artificial Sequence
  chemically treated genomic DNA (Homo sapiens) CpG-island No: 5413
cgttagttagaaatttttgttttgtatcgtttatcggaaaaaaaacgtcgggtaatttttagcgttttacgtttggcgtaggaattgggcgcggagacggtaatattttttgatttagcggaagagaaagcggtagtgcgttatgttcgtgaatataatttcggtaagattattttcggtcgttcggtttcgcgtcgttggtggcgtcgggaaacgtttgttgatcgattggcgcgtatcgttttcgatttcgattaggtgttggtcgcgtttgatgaattattcgttcgtacgattaataacgcgtcggataatcgtttttttaaagataagtggcgtgtataaatttagggatgcgtggttgtcgtcgcgttatgcgtcgttattattttaattgttatgtagtggttgatggcgtttgatgtcgttaatttggtgaatgttgtatttgtttggcgtggtggtggtggcgttattttatggacgttggtttttagtggttgttatcgttattaatgtagtgagtttcgat

SEQ ID NO: 5414 - DNA, 532 bp, Artificial Sequence
  chemically treated genomic DNA (Homo sapiens) CpG-island No: 5414
atcgaaactcactacattaataacgataacaaccactaaaaaccaacgtccataaaataacgccaccaccaccacgccaaacaaatacaacattcaccaaattaacgacatcaaacgccatcaaccactacataacaattaaaataataacgacgcataacgcgacgacaaccacgcatccctaaatttatacacgccacttatctttaaaaaaacgattatccgacgcgttattaatcgtacgaacgaataattcatcaaacgcgaccaacacctaatcgaaatcgaaaacgatacgcgccaatcgatcaacaaacgtttcccgacgccaccaacgacgcgaaaccgaacgaccgaaaataatcttaccgaaattatattcacgaacataacgcactaccgctttctcttccgctaaatcaaaaaatattaccgtctccgcgcccaattcctacgccaaacgtaaaacgctaaaaattacccgacgttttttttccgataaacgatacaaaacaaaaatttctaactaacg

SEQ ID NO: 5415 - DNA, 532 bp, Artificial Sequence
  chemically treated genomic DNA (Homo sapiens) CpG-island No: 5415
atcgaaatttattatattaatgacggtggtaattattgaaggttagcgtttataaaatagcgttattattattacgttaagtagatatagtatttattaggttggcggtattaaacgttattagttattgtatggtaattaaggtgataacggcgtataacgcggcggtaattacgtatttttgaatttgtatacgttatttgtttttaaaagagcggttattcggcgcgttgttaatcgtgcgggcgggtggtttattaagcgcgattagtatttgatcgagatcgggggcgatgcgcgttagtcggttagtaaacgtttttcgacgttattagcggcgcgaggtcgggcgatcgagaataattttgtcgagattatgtttacgggtataacgtattatcgttttttttttcgttggattagaaagtgttgtcgttttcgcgtttagtttttgcgttagacgtaaggcgttgagaattgttcgacgtttttttttcggtaagcggtgtagggtaggggtttttaattggcg

SEQ ID NO: 5416 - DNA, 532 bp, Artificial Sequence
  chemically treated genomic DNA (Homo sapiens) CpG-island No: 5416
cgccaattaaaaacccctaccctacaccgcttaccgaaaaaaaaacgtcgaacaattctcaacgccttacgtctaacgcaaaaactaaacgcgaaaacgacaacactttctaatccaacgaaaaaaaaaacgataatacgttatacccgtaaacataatctcgacaaaattattctcgatcgcccgacctcgcgccgctaataacgtcgaaaaacgtttactaaccgactaacgcgcatcgcccccgatctcgatcaaatactaatcgcgcttaataaaccacccgcccgcacgattaacaacgcgccgaataaccgctcttttaaaaacaaataacgtatacaaattcaaaaatacgtaattaccgccgcgttatacgccgttatcaccttaattaccatacaataactaataacgtttaataccgccaacctaataaatactatatctacttaacgtaataataataacgctattttataaacgctaaccttcaataattaccaccgtcattaatataataaatttcgat

SEQ ID NO: 5417 - DNA, 695 bp, Artificial Sequence
  chemically treated genomic DNA (Homo sapiens) CpG-island No: 5417
cgcgagcgtgggatcgcgtgtcgatgttaaagaagttttgtgggcgcgtttatttacgtttgcggaaaatttgtgatttgtaaaagaggtatgtcgtttgtggtcgaagcgatgaggtgttgggcggtattggttattgcgaggagagtgagttgtcgcggtttatcgggagatgtcggtaaatagtatttgggacggtttcggtatttatggtttggttgtgttgcgcgtttttagttagtagcgggggtttcgatttattcggagttttgtggtcgttacgggtcggttcgtattggtcggcgggtcggttaagtcgcgcgggttgtcgttggaattggcgcggattttttcgatttttggtgggtttttgtgatttttttcgtatggcggtttgttcgcgttattcggggtgtgttgggtttagatttgggcgggggttttgatataggcgtttgaaaatttgagtttttattttgtagtttattttagagattttcgtcgcgatgtgatttcgttgatgttggggtcgatggtcgtagtttgcggcggtatatttcgatgatttttggtcgcggtttcggttatattggcggtacgtcgataaattggaatttatttttggtttcgatattttttcggatgataacgttttcgcgaaattattaaagacgtcggcgtggcgattatcggtt

SEQ ID NO: 5418 - DNA, 695 bp, Artificial Sequence
  chemically treated genomic DNA (Homo sapiens) CpG-island No: 5418
aaccgataatcgccacgccgacgtctttaataatttcgcgaaaacgttatcatccgaaaaaatatcgaaaccaaaaataaattccaatttatcgacgtaccgccaatataaccgaaaccgcgaccaaaaatcatcgaaatataccgccgcaaactacgaccatcgaccccaacatcaacgaaatcacatcgcgacgaaaatctctaaaataaactacaaaataaaaactcaaattttcaaacgcctatatcaaaacccccgcccaaatctaaacccaacacaccccgaataacgcgaacaaaccgccatacgaaaaaaatcacaaaaacccaccaaaaatcgaaaaaatccgcgccaattccaacgacaacccgcgcgacttaaccgacccgccgaccaatacgaaccgacccgtaacgaccacaaaactccgaataaatcgaaacccccgctactaactaaaaacgcgcaacacaaccaaaccataaataccgaaaccgtcccaaatactatttaccgacatctcccgataaaccgcgacaactcactctcctcgcaataaccaataccgcccaacacctcatcgcttcgaccacaaacgacatacctcttttacaaatcacaaattttccgcaaacgtaaataaacgcgcccacaaaacttctttaacatcgacacgcgatcccacgctcgcg

SEQ ID NO: 5419 - DNA, 695 bp, Artificial Sequence
  chemically treated genomic DNA (Homo sapiens) CpG-island No: 5419
gatcgataatcgttacgtcgacgtttttaataatttcgcggaaacgttgttattcgggaaaatgtcgaagttagggatggattttagtttgtcggcgtatcgttagtatgatcgaggtcgcgattagagattatcggaatatatcgtcgtaggttgcgattatcggttttaatattagcgaagttatatcgcgacggggatttttagagtggattgtaggatggaaatttaggtttttaaacgtttgtgttaaaattttcgtttaaatttggatttagtatatttcggataacgcggataagtcgttatgcggaaaaagttataggggtttattaagaatcgagggaattcgcgttagttttaacggtaattcgcgcggtttaatcgattcgtcgattaatgcggatcggttcgtaacggttataaggtttcgaataagtcgaaattttcgttgttaattgagaacgcgtaatatagttaggttataaatgtcggaatcgttttaaatattgtttatcggtatttttcggtaagtcgcggtagtttatttttttcgtaataattaatgtcgtttagtattttatcgtttcggttataaacggtatattttttttgtagattataaatttttcgtaggcgtaaataaacgcgtttatagggtttttttggtatcggtacgcggttttacgttcgcg

SEQ ID NO: 5420 - DNA, 695 bp, Artificial Sequence
  chemically treated genomic DNA (Homo sapiens) CpG-island No: 5420
cgcgaacgtaaaaccgcgtaccgataccaaaaaaaccctataaacgcgtttatttacgcctacgaaaaatttataatctacaaaaaaaatataccgtttataaccgaaacgataaaatactaaacgacattaattattacgaaaaaaataaactaccgcgacttaccgaaaaataccgataaacaatatttaaaacgattccgacatttataacctaactatattacgcgttctcaattaacaacgaaaatttcgacttattcgaaaccttataaccgttacgaaccgatccgcattaatcgacgaatcgattaaaccgcgcgaattaccgttaaaactaacgcgaattccctcgattcttaataaacccctataactttttccgcataacgacttatccgcgttatccgaaatatactaaatccaaatttaaacgaaaattttaacacaaacgtttaaaaacctaaatttccatcctacaatccactctaaaaatccccgtcgcgatataacttcgctaatattaaaaccgataatcgcaacctacgacgatatattccgataatctctaatcgcgacctcgatcatactaacgatacgccgacaaactaaaatccatccctaacttcgacattttcccgaataacaacgtttccgcgaaattattaaaaacgtcgacgtaacgattatcgatc

SEQ ID NO: 5421 - DNA, 797 bp, Artificial Sequence
  chemically treated genomic DNA (Homo sapiens) CpG-island No: 5421
acgtaatcgtggattttatttcgttgattatcgtttttattttggcgaagaatttgcggaaggtttggacgcgttggtgatggacgtgaaagtgggtagggcgcgtttatgtcgatttacgaattttttgaagtttttgtcgaagcgatgttggcgtggttaacggcgttggcgtgcgtattatcgcgttgtttattatatgaattaggtattggtttttagtgtaggtaacgcggttgaagttcggaagcggtgtagtttttgacgggtgaatatcgtaattcgcgttttgttgtgttacgatggcgttgtgcgtggagatgttgattttcggtaaattggcgaagatgacgtcgaagcgcgcgcgaaattgtaggcggtgttggataacggaaagcggtagaagtttttggtcgtatggtagcggtataaaaaggttcgacgatttcgttgagaattacgcgaagtatttgtcgatagcgatgttgacgaagtagtttatgttgatatcgaaggttttgttagtgaaatggatattcggcgttggggatggtagtggttgtaatgggcggcggacgtcgttaggtattgatattatcgattatagcgtcggttttattgatatggcgcgtttgggtattaggtagacggttagcgttcgttggcggttatttacgcgaaagacgaaataattggtaggaagcggcgaaagcggtgaaagcggtaattaaatttgcgataaagtatcggaaagtatattaattgttatcgtcgattagcgaatacggatattgatt

SEQ ID NO: 5422 - DNA, 797 bp, Artificial Sequence
  chemically treated genomic DNA (Homo sapiens) CpG-island No: 5422
aatcaatatccgtattcgctaatcgacgataacaattaatatactttccgatactttatcgcaaatttaattaccgctttcaccgctttcgccgcttcctaccaattatttcgtctttcgcgtaaataaccgccaacgaacgctaaccgtctacctaatacccaaacgcgccatatcaataaaaccgacgctataatcgataatatcaatacctaacgacgtccgccgcccattacaaccactaccatccccaacgccgaatatccatttcactaacaaaaccttcgatatcaacataaactacttcgtcaacatcgctatcgacaaatacttcgcgtaattctcaacgaaatcgtcgaacctttttataccgctaccatacgaccaaaaacttctaccgctttccgttatccaacaccgcctacaatttcgcgcgcgcttcgacgtcatcttcgccaatttaccgaaaatcaacatctccacgcacaacgccatcgtaacacaacaaaacgcgaattacgatattcacccgtcaaaaactacaccgcttccgaacttcaaccgcgttacctacactaaaaaccaatacctaattcatataataaacaacgcgataatacgcacgccaacgccgttaaccacgccaacatcgcttcgacaaaaacttcaaaaaattcgtaaatcgacataaacgcgccctacccactttcacgtccatcaccaacgcgtccaaaccttccgcaaattcttcgccaaaataaaaacgataatcaacgaaataaaatccacgattacgt

SEQ ID NO: 5423 - DNA, 797 bp, Artificial Sequence
  chemically treated genomic DNA (Homo sapiens) CpG-island No: 5423
gattagtattcgtattcgttgatcggcgatgatagttggtgtgtttttcggtgttttatcgtaagtttaattgtcgtttttatcgttttcgtcgttttttgttagttgtttcgtttttcgcgtggataatcgttagcggacgttgatcgtttatttggtgtttagacgcgttatattagtaaagtcgacgttgtaatcgatggtgttaatgtttgacggcgttcgtcgtttattgtaattattgttatttttagcgtcgggtatttattttattgataaaattttcggtattagtatagattgtttcgttagtatcgttgtcggtagatatttcgcgtagtttttaacgaagtcgtcgggtttttttgtgtcgttattatacgattaaagatttttgtcgtttttcgttgtttagtatcgtttgtaatttcgcgcgcgtttcggcgttattttcgttagtttgtcggagattagtatttttacgtatagcgttatcgtgatataataagacgcgggttacgatatttattcgttagaaattgtatcgttttcgaattttaatcgcgttatttgtattggaggttagtatttgatttatgtggtgagtagcgcggtggtgcgtacgttagcgtcgttagttacgttaatatcgtttcggtaagggttttagagagttcgtaggtcggtataaacgcgttttatttatttttacgtttattattagcgcgtttagatttttcgtaagtttttcgttagaatagaggcggtgattagcgggatggagtttacggttgcgt

SEQ ID NO: 5424 - DNA, 797 bp, Artificial Sequence
  chemically treated genomic DNA (Homo sapiens) CpG-island No: 5424
acgcaaccgtaaactccatcccgctaatcaccgcctctattctaacgaaaaacttacgaaaaatctaaacgcgctaataataaacgtaaaaataaataaaacgcgtttataccgacctacgaactctctaaaacccttaccgaaacgatattaacgtaactaacgacgctaacgtacgcaccaccgcgctactcaccacataaatcaaatactaacctccaatacaaataacgcgattaaaattcgaaaacgatacaatttctaacgaataaatatcgtaacccgcgtcttattatatcacgataacgctatacgtaaaaatactaatctccgacaaactaacgaaaataacgccgaaacgcgcgcgaaattacaaacgatactaaacaacgaaaaacgacaaaaatctttaatcgtataataacgacacaaaaaaacccgacgacttcgttaaaaactacgcgaaatatctaccgacaacgatactaacgaaacaatctatactaataccgaaaattttatcaataaaataaatacccgacgctaaaaataacaataattacaataaacgacgaacgccgtcaaacattaacaccatcgattacaacgtcgactttactaatataacgcgtctaaacaccaaataaacgatcaacgtccgctaacgattatccacgcgaaaaacgaaacaactaacaaaaaacgacgaaaacgataaaaacgacaattaaacttacgataaaacaccgaaaaacacaccaactatcatcgccgatcaacgaatacgaatactaatc

SEQ ID NO: 5425 - DNA, 936 bp, Artificial Sequence
  chemically treated genomic DNA (Homo sapiens) CpG-island No: 5425
acgtcggggttgatattttgggttaatcgtagaagtttgtgttaaaggcgaagcgtgataacggtcgtaaagtcgtatatttgtcggtattttatttgttgatcgtttaggaagttagtaaagagtaaatgtagatttcgatattttggcgcgttcggcgttttattttatcgtttcgtagtaacgcgggaagaatatttgaagaaagggttaattaattcggatgcgacgtcggatagacgcgcgtcgcggtgaaagcgatcgaaacgtttaacggtaattggttttatcgggcggtgcggtgaaatttaatatcgttatatcgtcggtgatcggcgttggtttttcggtaattagatttggtcgtgggatatttggaagtagcgtttgcgatggcgtattttaattcggatatcgttaaagagaatatttcgcggtttttttttggtagatttagtttggcgatagcgtgcgttcgtagatgtgggttttgttttcgatttgatagcgtggaattttagtttcgagcgggtggcgatggcggtaattggaacgaacgtaatattaaatttagttttgcgtttggtcggtgatggaagtgtataacgttatttaagataaaatttggtggtagagatgtattcgaaattggtggtttattacgattggtggttacgaatcgcgattataacggtaacggcgtgtcggaatatggcgcgattcgcgtaaagtttataatattgagagcggcgagatgttgtttacggtgaaaaaagcgataaagaagagacgtagtttgggttgaataattacgttcgcgtggtgagaaaggttagtacgatagtttggaaatttcggtataggttgttgtatgtgggaatcggggcgtgatgatgtcgtcgtttttgggtttatcgataaaaatagttggataat

SEQ ID NO: 5426 - DNA, 936 bp, Artificial Sequence
  chemically treated genomic DNA (Homo sapiens) CpG-island No: 5426
attatccaactatttttatcgataaacccaaaaacgacgacatcatcacgccccgattcccacatacaacaacctataccgaaatttccaaactatcgtactaacctttctcaccacgcgaacgtaattattcaacccaaactacgtctcttctttatcgcttttttcaccgtaaacaacatctcgccgctctcaatattataaactttacgcgaatcgcgccatattccgacacgccgttaccgttataatcgcgattcgtaaccaccaatcgtaataaaccaccaatttcgaatacatctctaccaccaaattttatcttaaataacgttatacacttccatcaccgaccaaacgcaaaactaaatttaatattacgttcgttccaattaccgccatcgccacccgctcgaaactaaaattccacgctatcaaatcgaaaacaaaacccacatctacgaacgcacgctatcgccaaactaaatctaccaaaaaaaaaccgcgaaatattctctttaacgatatccgaattaaaatacgccatcgcaaacgctacttccaaatatcccacgaccaaatctaattaccgaaaaaccaacgccgatcaccgacgatataacgatattaaatttcaccgcaccgcccgataaaaccaattaccgttaaacgtttcgatcgctttcaccgcgacgcgcgtctatccgacgtcgcatccgaattaattaaccctttcttcaaatattcttcccgcgttactacgaaacgataaaataaaacgccgaacgcgccaaaatatcgaaatctacatttactctttactaacttcctaaacgatcaacaaataaaataccgacaaatatacgactttacgaccgttatcacgcttcgcctttaacacaaacttctacgattaacccaaaatatcaaccccgacgt

SEQ ID NO: 5427 - DNA, 936 bp, Artificial Sequence
  chemically treated genomic DNA (Homo sapiens) CpG-island No: 5427
attatttaattgtttttgtcgataaatttaaagacggcggtattattacgtttcgatttttatatgtagtaatttgtgtcggaatttttagattgtcgtattggttttttttattacgcgggcgtagttgtttagtttagattgcgttttttttttatcgttttttttatcgtaaatagtatttcgtcgtttttagtgttgtgggttttgcgcgggtcgcgttatatttcggtacgtcgttgtcgttgtgatcgcggttcgtaattattagtcgtgataggttattagtttcgggtatatttttgttattaggttttattttgggtgacgttatatatttttattatcgattaggcgtaaggttgggtttggtattacgttcgttttagttgtcgttatcgttattcgttcggggttaaggttttacgttattaggtcggggataaagtttatatttgcggacgtacgttatcgttaggttggatttgttaggagaagatcgcgggatattttttttggcgatgttcggattgaaatgcgttatcgtaaacgttgtttttaggtattttacggttaggtttgattgtcggagaattagcgtcggttatcgacggtgtaacggtgttaaattttatcgtatcgttcggtgaggttagttatcgttgagcgtttcgatcgtttttatcgcgacgcgcgtttgttcggcgtcgtattcggattggttaattttttttttaggtatttttttcgcgttgttgcgaggcggtgagataaaacgtcggacgcgttagaatatcgggatttgtatttgttttttgttaattttttgagcggttagtagatgggatatcggtagatgtgcggttttacgatcgttattacgtttcgtttttggtataagtttttgcgattgatttagggtgttagtttcgacgt

SEQ ID NO: 5428 - DNA, 936 bp, Artificial Sequence
  chemically treated genomic DNA (Homo sapiens) CpG-island No: 5428
acgtcgaaactaacaccctaaatcaatcgcaaaaacttataccaaaaacgaaacgtaataacgatcgtaaaaccgcacatctaccgatatcccatctactaaccgctcaaaaaattaacaaaaaacaaatacaaatcccgatattctaacgcgtccgacgttttatctcaccgcctcgcaacaacgcgaaaaaaatacctaaaaaaaaaattaaccaatccgaatacgacgccgaacaaacgcgcgtcgcgataaaaacgatcgaaacgctcaacgataactaacctcaccgaacgatacgataaaatttaacaccgttacaccgtcgataaccgacgctaattctccgacaatcaaacctaaccgtaaaatacctaaaaacaacgtttacgataacgcatttcaatccgaacatcgccaaaaaaaatatcccgcgatcttctcctaacaaatccaacctaacgataacgtacgtccgcaaatataaactttatccccgacctaataacgtaaaaccttaaccccgaacgaataacgataacgacaactaaaacgaacgtaataccaaacccaaccttacgcctaatcgataataaaaatatataacgtcacccaaaataaaacctaataacaaaaatatacccgaaactaataacctatcacgactaataattacgaaccgcgatcacaacgacaacgacgtaccgaaatataacgcgacccgcgcaaaacccacaacactaaaaacgacgaaatactatttacgataaaaaaaacgataaaaaaaaaacgcaatctaaactaaacaactacgcccgcgtaataaaaaaaaccaatacgacaatctaaaaattccgacacaaattactacatataaaaatcgaaacgtaataataccgccgtctttaaatttatcgacaaaaacaattaaataat

SEQ ID NO: 5429 - DNA, 519 bp, Artificial Sequence
  chemically treated genomic DNA (Homo sapiens) CpG-island No: 5429
tcgtcgcgtttgatttcgggagaaggtttcggtattttgaataatttttttttgtcgttttttttttttttataatagttttagttttaaaatggcgtcgattcgattcgtaatgttttgggttagtttcgcgagatcgtgtatagtggcgaggcggggaaggaattagagggttgaggagggagggaaggcggggcgaggagaaggagggagaaagagtgtgaagaagcggtgcgaacgaatttattgggcgggatattaggaagagcgttttattagagaattttttggtttaagtaatcgtttacgtcgcggtttaaaagtttcggtttttacgtcgggcgtttggaggggaagggggagaaggcgtgtttaaggttgggggtcgggtttcgaggaaggttcgggaattagggcggcggggggcggtggttttacgcggtttttattgttaaatattttttttaggttcgttttataatttttaaagtttagggttatttttagtttttgaaatgt

SEQ ID NO: 5430 - DNA, 519 bp, Artificial Sequence
  chemically treated genomic DNA (Homo sapiens) CpG-island No: 5430
acatttcaaaaactaaaaataaccctaaactttaaaaattataaaacgaacctaaaaaaaatatttaacaataaaaaccgcgtaaaaccaccgccccccgccgccctaattcccgaaccttcctcgaaacccgacccccaaccttaaacacgccttctcccccttcccctccaaacgcccgacgtaaaaaccgaaacttttaaaccgcgacgtaaacgattacttaaaccaaaaaattctctaataaaacgctcttcctaatatcccgcccaataaattcgttcgcaccgcttcttcacactctttctccctccttctcctcgccccgccttccctccctcctcaaccctctaattccttccccgcctcgccactatacacgatctcgcgaaactaacccaaaacattacgaatcgaatcgacgccattttaaaactaaaactattataaaaaaaaaaaaaacgacaaaaaaaaattattcaaaataccgaaaccttctcccgaaatcaaacgcgacga

SEQ ID NO: 5431 - DNA, 519 bp, Artificial Sequence
  chemically treated genomic DNA (Homo sapiens) CpG-island No: 5431
atattttaagggttagagatgattttaggttttgaggattgtgaaacgagtttgggagaagtgtttgataatgaaaatcgcgtggagttatcgtttttcgtcgttttggttttcgggtttttttcgaagttcggtttttagttttaagtacgttttttttttttttttttttaggcgttcgacgtagaggtcggagtttttggatcgcggcgtgagcggttgtttgggttagaaggttttttggtggagcgttttttttggtgtttcgtttagtaggttcgttcgtatcgtttttttatatttttttttttttttttttttcgtttcgttttttttttttttttaattttttagtttttttttcgtttcgttattgtgtacgatttcgcgagattggtttagaatattgcggatcgggtcggcgttattttgggattgagattgttgtgggggagggaaaagcggtaaaaggggattatttaaagtatcgaaattttttttcgggattaggcgcggcgg

SEQ ID NO: 5432 - DNA, 519 bp, Artificial Sequence
  chemically treated genomic DNA (Homo sapiens) CpG-island No: 5432
ccgccgcgcctaatcccgaaaaaaaatttcgatactttaaataatccccttttaccgcttttccctcccccacaacaatctcaatcccaaaataacgccgacccgatccgcaatattctaaaccaatctcgcgaaatcgtacacaataacgaaacgaaaaaaaaactaaaaaattaaaaaaaaaaaaaaaacgaaacgaaaaaaaaaaaaaaaaaaaaatataaaaaaacgatacgaacgaacctactaaacgaaacaccaaaaaaaacgctccaccaaaaaaccttctaacccaaacaaccgctcacgccgcgatccaaaaactccgacctctacgtcgaacgcctaaaaaaaaaaaaaaaaaaaacgtacttaaaactaaaaaccgaacttcgaaaaaaacccgaaaaccaaaacgacgaaaaacgataactccacgcgattttcattatcaaacacttctcccaaactcgtttcacaatcctcaaaacctaaaatcatctctaacccttaaaatat

SEQ ID NO: 5433 - DNA, 507 bp, Artificial Sequence
  chemically treated genomic DNA (Homo sapiens) CpG-island No: 5433
ttgggacgggggaaaggagacgttttttttttttgttgtttttttcgttttcgagattagcggcggcggtgatcgcgagtgggtcggtatcgttttcggtttcgggtgcgaataatgttgattgatagcggaggcggcggtattttttttgaggaggatttggattttgtggtttcgcgattcgttttagttggggtttcggagtcgttttcgtcgggaggggtcggtttggggattcgtatcgtgaggttttttggggaggtcgggttagcgtcgggagtcggtagtagcggcggcggcggtagcggtagcggtacgggcggaggggacgcggcgttggattttaagttggcggttgtcgtgttgaggatcgggggtggaggtggtgtttttggtagtgacgaggacgaagtgttcgaggtaaggtttcgggattttcgttttttatatattgtgaggcgtgaattttttttgggtaggttttgggtcggggttattttttcgttt

SEQ ID NO: 5434 - DNA, 507 bp, Artificial Sequence
  chemically treated genomic DNA (Homo sapiens) CpG-island No: 5434
aaacgaaaaaataaccccgacccaaaacctacccaaaaaaaattcacgcctcacaatatataaaaaacgaaaatcccgaaaccttacctcgaacacttcgtcctcgtcactaccaaaaacaccacctccacccccgatcctcaacacgacaaccgccaacttaaaatccaacgccgcgtcccctccgcccgtaccgctaccgctaccgccgccgccgctactaccgactcccgacgctaacccgacctccccaaaaaacctcacgatacgaatccccaaaccgacccctcccgacgaaaacgactccgaaaccccaactaaaacgaatcgcgaaaccacaaaatccaaatcctcctcaaaaaaaataccgccgcctccgctatcaatcaacattattcgcacccgaaaccgaaaacgataccgacccactcgcgatcaccgccgccgctaatctcgaaaacgaaaaaaacaacaaaaaaaaaaaacgtctcctttcccccgtcccaa

SEQ ID NO: 5435 - DNA, 507 bp, Artificial Sequence
  chemically treated genomic DNA (Homo sapiens) CpG-island No: 5435
aagcgggaggatggtttcggtttagagtttatttaaagagaatttacgttttataatgtgtgggaggcgagggtttcggagttttatttcggatatttcgttttcgttattgttagaggtattatttttattttcggtttttagtacggtagtcgttaatttgaaatttagcgtcgcgtttttttcgttcgtatcgttgtcgttgtcgtcgtcgtcgttgttgtcgattttcgacgttggttcggtttttttaaagagttttacggtgcggatttttagatcgatttttttcggcggaggcggtttcgaggttttagttggggcggatcgcggagttatagagtttaggttttttttaaaggaggtgtcgtcgttttcgttattagttagtattgttcgtattcggagtcggagacggtgtcgatttattcgcggttatcgtcgtcgttgatttcgggaacgagaagagtagtaagaggaagaagcgttttttttttttcgttttag

SEQ ID NO: 5436 - DNA, 507 bp, Artificial Sequence
  chemically treated genomic DNA (Homo sapiens) CpG-island No: 5436
ctaaaacgaaaaaaaaaaaacgcttcttcctcttactactcttctcgttcccgaaatcaacgacgacgataaccgcgaataaatcgacaccgtctccgactccgaatacgaacaatactaactaataacgaaaacgacgacacctcctttaaaaaaaacctaaactctataactccgcgatccgccccaactaaaacctcgaaaccgcctccgccgaaaaaaatcgatctaaaaatccgcaccgtaaaactctttaaaaaaaccgaaccaacgtcgaaaatcgacaacaacgacgacgacgacaacgacaacgatacgaacgaaaaaaacgcgacgctaaatttcaaattaacgactaccgtactaaaaaccgaaaataaaaataatacctctaacaataacgaaaacgaaatatccgaaataaaactccgaaaccctcgcctcccacacattataaaacgtaaattctctttaaataaactctaaaccgaaaccatcctcccgctt

SEQ ID NO: 5437 - DNA, 535 bp, Artificial Sequence
  chemically treated genomic DNA (Homo sapiens) CpG-island No: 5437
ggttcgttattttgtatggtcgagcgggtattttcggtttcggcggggggttttttttttttttttttattgtaaggcggcggtaggagaggttgtggtgttagtttttttaagttatttagtgttattttcgtcgttgtagcgatatacgttttcgtcgtcgttatgattgagtagatgatttttcgtggtatttttaagggttataacggttgggtaatttagatcgttattatttcgtagttttcggatatgatttttttcgtttttcgaggtacggattaaggtagattttaggattcgagattgtagggttgggggatttcgcgtgtcgtgtagggaatttcgcgtgtggtgtggtaggtcggtggcgcgcgagttggcggggattgatagatttttttgttttattgtgaattggggcgtgcggattcgagtttaggttttaattcgggcgaattatattgtagatgagaatttacgtgtatattagttcgtagttgttaggagggttggagagttggaaatttttaaa

SEQ ID NO: 5438 - DNA, 535 bp, Artificial Sequence
  chemically treated genomic DNA (Homo sapiens) CpG-island No: 5438
tttaaaaatttccaactctccaaccctcctaacaactacgaactaatatacacgtaaattctcatctacaatataattcgcccgaattaaaacctaaactcgaatccgcacgccccaattcacaataaaacaaaaaaatctatcaatccccgccaactcgcgcgccaccgacctaccacaccacacgcgaaattccctacacgacacgcgaaatcccccaaccctacaatctcgaatcctaaaatctaccttaatccgtacctcgaaaaacgaaaaaaatcatatccgaaaactacgaaataataacgatctaaattacccaaccgttataacccttaaaaataccacgaaaaatcatctactcaatcataacgacgacgaaaacgtatatcgctacaacgacgaaaataacactaaataacttaaaaaaactaacaccacaacctctcctaccgccgccttacaataaaaaaaaaaaaaaaaaaccccccgccgaaaccgaaaatacccgctcgaccatacaaaataacgaacc

SEQ ID NO: 5439 - DNA, 535 bp, Artificial Sequence
  chemically treated genomic DNA (Homo sapiens) CpG-island No: 5439
tttaaaagtttttaattttttaatttttttagtagttgcgagttgatgtatacgtaggtttttatttgtaatgtggttcgttcgggttgaggtttaggttcgggttcgtacgttttaatttataatggggtagagaagtttgttagttttcgttaattcgcgcgttatcggtttgttatattatacgcggaattttttatacgatacgcggaattttttagttttgtaatttcgggttttgaaatttattttagttcgtatttcgagaggcggagaggattatgttcgggaattgcggggtagtagcgatttgggttatttagtcgttgtggtttttgagggtgttacgaagggttatttgtttagttatggcggcggcgagagcgtgtgtcgttgtagcgacgaggatggtattggatggtttagagaaattagtattataattttttttgtcgtcgttttgtagtgaaagagagagagaaaagtttttcgtcggaatcggaaatattcgttcgattatgtaaaatggcgagtt

SEQ ID NO: 5440 - DNA, 535 bp, Artificial Sequence
  chemically treated genomic DNA (Homo sapiens) CpG-island No: 5440
aactcgccattttacataatcgaacgaatatttccgattccgacgaaaaacttttctctctctctttcactacaaaacgacgacaaaaaaaattataatactaatttctctaaaccatccaataccatcctcgtcgctacaacgacacacgctctcgccgccgccataactaaacaaataacccttcgtaacaccctcaaaaaccacaacgactaaataacccaaatcgctactaccccgcaattcccgaacataatcctctccgcctctcgaaatacgaactaaaataaatttcaaaacccgaaattacaaaactaaaaaattccgcgtatcgtataaaaaattccgcgtataatataacaaaccgataacgcgcgaattaacgaaaactaacaaacttctctaccccattataaattaaaacgtacgaacccgaacctaaacctcaacccgaacgaaccacattacaaataaaaacctacgtatacatcaactcgcaactactaaaaaaattaaaaaattaaaaacttttaaa

SEQ ID NO: 5441 - DNA, 628 bp, Artificial Sequence
  chemically treated genomic DNA (Homo sapiens) CpG-island No: 5441
acgtcgattatagttggggaagggtggggcgtttgttgttttaattcgcgaagcgtttttttaggtttcgttttcggttcgattcggacgattttttgagttttttataacgaagtcgtttgtttagaagggtcggaagtattttagggcgcgtcgcggatttattttttcgttttcggtatcggttgtggggagtatcggttgtagtcggttgtgtcgggagggtaggatggcgtttggtcgatgcggtgatagtatcgaaagtagacggtcgttaggcgttttttttatttttcgaagtttttttttagcggcgggggatgggggtaggcggtttttttgttttttttgcgtttttcgcggttttttattatagagacgcgggtttttatcgttttagttttttcgttttgttttttagtgcggattagagcgttttttcgttattttttgtcgttttggggtttcgcggggaaaaagggggagtagtaggatagcggagggaagtcgcgagtttaggtggtgtgtagacgtcggaagtgttgggaaggaggtcggaagttaggggcggggttaggaagtgaggaggggcgggggtttatgaggagtttaagggagtatggggtag

SEQ ID NO: 5442 - DNA, 628 bp, Artificial Sequence
  chemically treated genomic DNA (Homo sapiens) CpG-island No: 5442
ctaccccatactcccttaaactcctcataaacccccgcccctcctcacttcctaaccccgcccctaacttccgacctccttcccaacacttccgacgtctacacaccacctaaactcgcgacttccctccgctatcctactactccccctttttccccgcgaaaccccaaaacgacaaaaaataacgaaaaaacgctctaatccgcactaaaaaacaaaacgaaaaaactaaaacgataaaaacccgcgtctctataataaaaaaccgcgaaaaacgcaaaaaaaacaaaaaaaccgcctacccccatcccccgccgctaaaaaaaaacttcgaaaaataaaaaaaacgcctaacgaccgtctactttcgatactatcaccgcatcgaccaaacgccatcctaccctcccgacacaaccgactacaaccgatactccccacaaccgataccgaaaacgaaaaaataaatccgcgacgcgccctaaaatacttccgacccttctaaacaaacgacttcgttataaaaaactcaaaaaatcgtccgaatcgaaccgaaaacgaaacctaaaaaaacgcttcgcgaattaaaacaacaaacgccccacccttccccaactataatcgacgt

SEQ ID NO: 5443 - DNA, 628 bp, Artificial Sequence
  chemically treated genomic DNA (Homo sapiens) CpG-island No: 5443
ttgttttatgtttttttggattttttataaattttcgtttttttttattttttggtttcgtttttagttttcggttttttttttaatattttcggcgtttatatattatttaagttcgcgattttttttcgttgttttgttatttttttttttttttcgcggggttttagggcgataggaaatggcgaggagacgttttagttcgtattagagaatagggcgggagggttaggacggtggaggttcgcgtttttgtggtaagaggtcgcggggaacgtagaaagaatagaggaatcgtttatttttatttttcgtcgttggggagaaatttcggggggtagggggagcgtttggcggtcgtttgttttcggtgttattatcgtatcggttagacgttattttattttttcggtatagtcgattgtagtcggtattttttatagtcgatgtcggaagcgagggggtgggttcgcggcgcgttttgaagtattttcggtttttttaggtagacgatttcgttgtggaggatttagagggtcgttcgggtcggatcgggggcggggtttgagaaagcgtttcgcgggttagggtagtagacgttttatttttttttaattgtagtcggcgt

SEQ ID NO: 5444 - DNA, 628 bp, Artificial Sequence
  chemically treated genomic DNA (Homo sapiens) CpG-island No: 5444
acgccgactacaattaaaaaaaaataaaacgtctactaccctaacccgcgaaacgctttctcaaaccccgcccccgatccgacccgaacgaccctctaaatcctccacaacgaaatcgtctacctaaaaaaaccgaaaatacttcaaaacgcgccgcgaacccaccccctcgcttccgacatcgactataaaaaataccgactacaatcgactataccgaaaaaataaaataacgtctaaccgatacgataataacaccgaaaacaaacgaccgccaaacgctccccctaccccccgaaatttctccccaacgacgaaaaataaaaataaacgattcctctattctttctacgttccccgcgacctcttaccacaaaaacgcgaacctccaccgtcctaaccctcccgccctattctctaatacgaactaaaacgtctcctcgccatttcctatcgccctaaaaccccgcgaaaaaaaaaaaaaaataacaaaacaacgaaaaaaaatcgcgaacttaaataatatataaacgccgaaaatattaaaaaaaaaaccgaaaactaaaaacgaaaccaaaaaataaaaaaaaacgaaaatttataaaaaatccaaaaaaacataaaacaa

SEQ ID NO: 5445 - DNA, 941 bp, Artificial Sequence
  chemically treated genomic DNA (Homo sapiens) CpG-island No: 5445
  misc_feature (40)..(40): n is either a, c, g or t
  misc_feature (61)..(61): n is either a, c, g or t
  misc_feature (64)..(64): n is either a, c, g or t
  misc_feature (84)..(84): n is either a, c, g or t
  misc_feature (152)..(152): n is either a, c, g or t
  misc_feature (199)..(199): n is either a, c, g or t
  misc_feature (202)..(204): n is either a, c, g or t
tttatatcgttttgtattatgacgtatttattcggtttanttatttttaaggcgtatttantanttcggcggtattcggaattntttacgaatttaacgtaacggtcggtgatatatgagtgacggtttcgatttggattatggaaacgggntatagtggcgtgtcgtaagggaagtttttattttttttttacggcgntgnnnttattggcgtttagcggttgggtatgaaaacgttgtgtttcggtacgtaaggttaatatgttgaggttgtgcgttagtagtttttttagaattagacgacgttgcgtcggatgttgttcggtttttagatcgttaagttgtagcgtcggtggcgggcggtgtaaagtgcgtaacgttttcggtagcgttattattttttgtgatagtttcggcggtaggagttttttaatggcgtaggtgtcgagtagatttagcgtttggtcggttaatttacgtagcgtggtttgttttacgtttttcgttgttggataaatcggcgtgagcgttttttgtaattttggcgtgttgagatcgttttgtacgcggtatttcgggtggattattttcgtattatatttatcgcgttttgtttcgttataagttagtatacggcggatcgtcgttaggttattttttattgtcgcgttgaaattgaaaaagcgtatggtgaggatgtcggaatcgtcgttgatttggtaggttattattcgacgatcgtcgaaggagattttgtagtttagtatttcgttttttatcgtggtataaacgttcggtagtagttttcgatggggtagagatgggtgcgattttcgtacgtagggaaggtgtagagtagattttgacggtatgcggtgattacgtagttgtattagtgtggttaagtcgataggaatggtggaaggttacgggatttttga

SEQ ID NO: 5446 - DNA, 941 bp, Artificial Sequence
  chemically treated genomic DNA (Homo sapiens) CpG-island No: 5446
  misc_feature (738)..(740): n is either a, c, g or t
  misc_feature (743)..(743): n is either a, c, g or t
  misc_feature (790)..(790): n is either a, c, g or t
  misc_feature (858)..(858): n is either a, c, g or t
  misc_feature (878)..(878): n is either a, c, g or t
  misc_feature (881)..(881): n is either a, c, g or t
  misc_feature (902)..(902): n is either a, c, g or t
tcaaaaatcccgtaaccttccaccattcctatcgacttaaccacactaatacaactacgtaatcaccgcataccgtcaaaatctactctacaccttccctacgtacgaaaatcgcacccatctctaccccatcgaaaactactaccgaacgtttataccacgataaaaaacgaaatactaaactacaaaatctccttcgacgatcgtcgaataataacctaccaaatcaacgacgattccgacatcctcaccatacgctttttcaatttcaacgcgacaataaaaaataacctaacgacgatccgccgtatactaacttataacgaaacaaaacgcgataaatataatacgaaaataatccacccgaaataccgcgtacaaaacgatctcaacacgccaaaattacaaaaaacgctcacgccgatttatccaacaacgaaaaacgtaaaacaaaccacgctacgtaaattaaccgaccaaacgctaaatctactcgacacctacgccattaaaaaactcctaccgccgaaactatcacaaaaaataataacgctaccgaaaacgttacgcactttacaccgcccgccaccgacgctacaacttaacgatctaaaaaccgaacaacatccgacgcaacgtcgtctaattctaaaaaaactactaacgcacaacctcaacatattaaccttacgtaccgaaacacaacgttttcatacccaaccgctaaacgccaataannncancgccgtaaaaaaaaaataaaaacttcccttacgacacgccactatancccgtttccataatccaaatcgaaaccgtcactcatatatcaccgaccgttacgttaaattcgtaaanaattccgaataccgccgaantantaaatacgccttaaaaataantaaaccgaataaatacgtcataatacaaaacgatataaa

SEQ ID NO: 5447 - DNA, 941 bp, Artificial Sequence
  chemically treated genomic DNA (Homo sapiens) CpG-island No: 5447
  misc_feature (738)..(740): n is either a, c, g or t
  misc_feature (743)..(743): n is either a, c, g or t
  misc_feature (790)..(790): n is either a, c, g or t
  misc_feature (858)..(858): n is either a, c, g or t
  misc_feature (878)..(878): n is either a, c, g or t
  misc_feature (881)..(881): n is either a, c, g or t
  misc_feature (902)..(902): n is either a, c, g or t
ttagaagtttcgtaattttttattatttttatcggtttggttatattagtataattgcgtaattatcgtatatcgttaggatttattttatattttttttgcgtacgaagatcgtatttatttttattttatcgagaattattgtcgggcgtttatgttacggtggaaggcgaagtgttgaattgtaagatttttttcggcggtcgtcggatgatgatttgttagattagcgacggtttcggtatttttattatgcgtttttttaattttagcgcggtaatgaaaaatagtttggcggcggttcgtcgtgtattggtttatggcgaagtaaagcgcggtaaatatggtgcggagatgatttattcggaatatcgcgtgtagggcgattttagtacgttagaattataggaaacgtttacgtcggtttatttaataacggaaggcgtaaagtaggttacgttgcgtaaattaatcgattaggcgttggatttgttcgatatttgcgttattgaagaatttttgtcgtcggaattgttataaggaatgatgacgttatcggaagcgttgcgtattttgtatcgttcgttatcgacgttatagtttagcgatttggaaatcgggtagtattcggcgtaacgtcgtttgattttggaagaattgttggcgtataattttagtatgttagttttacgtgtcggagtatagcgtttttatgtttagtcgttgagcgttaatgannntancgtcgtgagaagagagtagaagttttttttacgatacgttattgtanttcgtttttatagtttaaatcggggtcgttatttatgtgttatcggtcgttacgttgggttcgtgaangatttcggatgtcgtcgaantantaggtacgttttgggaatagntagatcggatgaatgcgttatggtgtagggcgatgtagg

SEQ ID NO: 5448 - DNA, 941 bp, Artificial Sequence
  chemically treated genomic DNA (Homo sapiens) CpG-island No: 5448
  misc_feature (40)..(40): n is either a, c, g or t
  misc_feature (61)..(61): n is either a, c, g or t
  misc_feature (64)..(64): n is either a, c, g or t
  misc_feature (84)..(84): n is either a, c, g or t
  misc_feature (152)..(152): n is either a, c, g or t
  misc_feature (199)..(199): n is either a, c, g or t
  misc_feature (202)..(204): n is either a, c, g or t
cctacatcgccctacaccataacgcattcatccgatctanctattcccaaaacgtacctantanttcgacgacatccgaaatcnttcacgaacccaacgtaacgaccgataacacataaataacgaccccgatttaaactataaaaacgaantacaataacgtatcgtaaaaaaaacttctactctcttctcacgacgntannntcattaacgctcaacgactaaacataaaaacgctatactccgacacgtaaaactaacatactaaaattatacgccaacaattcttccaaaatcaaacgacgttacgccgaatactacccgatttccaaatcgctaaactataacgtcgataacgaacgatacaaaatacgcaacgcttccgataacgtcatcattccttataacaattccgacgacaaaaattcttcaataacgcaaatatcgaacaaatccaacgcctaatcgattaatttacgcaacgtaacctactttacgccttccgttattaaataaaccgacgtaaacgtttcctataattctaacgtactaaaatcgccctacacgcgatattccgaataaatcatctccgcaccatatttaccgcgctttacttcgccataaaccaatacacgacgaaccgccgccaaactatttttcattaccgcgctaaaattaaaaaaacgcataataaaaataccgaaaccgtcgctaatctaacaaatcatcatccgacgaccgccgaaaaaaatcttacaattcaacacttcgccttccaccgtaacataaacgcccgacaataattctcgataaaataaaaataaatacgatcttcgtacgcaaaaaaaatataaaataaatcctaacgatatacgataattacgcaattatactaatataaccaaaccgataaaaataataaaaaattacgaaacttctaa

SEQ ID NO: 5449 - DNA, 634 bp, Artificial Sequence
  chemically treated genomic DNA (Homo sapiens) CpG-island No: 5449
ttacgcgcggttaggttagttagtacgtcgtgcgttgtcgtacgtaggttttcggtggtcgtagaatttagcggtagttcgagggtggtattttcgagtgaaattttttagatgcgaatttttattattatcgatcggcgtttttatggagattggttttttggcgatttttagtattttgcggattttgtttttcggtattagtatacgtttagtcgttttgaagtgttgcgtagttttttggacgattaatcggtaggtcggattaggcgttacgtcgtattcggtattaggttttttgtataaacgttattttttcggtggcgttattttatcgtttacgtattattagcgtttggtttagttcgcgatacgttttaattagtttttttagtgaaacgcgatttatatcgttgggattttggtagtatttaaatttgcgtcgaattaatggtgagcgtttgttttttttattgtgtatcgtagttggttgaatgcgttgtttatatgtttgtttgtttagaatcgttaacgtttggcggttgataatttttaatgtttttaattagtttacgttcgtttgcgtgtagtttttgcgtttgaaattttattggtttgttatcgttggacggtt

SEQ ID NO: 5450 - DNA, 634 bp, Artificial Sequence
  chemically treated genomic DNA (Homo sapiens) CpG-island No: 5450
aaccgtccaacgataacaaaccaataaaatttcaaacgcaaaaactacacgcaaacgaacgtaaactaattaaaaacattaaaaattatcaaccgccaaacgttaacgattctaaacaaacaaacatataaacaacgcattcaaccaactacgatacacaataaaaaaaacaaacgctcaccattaattcgacgcaaatttaaatactaccaaaatcccaacgatataaatcgcgtttcactaaaaaaactaattaaaacgtatcgcgaactaaaccaaacgctaataatacgtaaacgataaaataacgccaccgaaaaaataacgtttatacaaaaaacctaataccgaatacgacgtaacgcctaatccgacctaccgattaatcgtccaaaaaactacgcaacacttcaaaacgactaaacgtatactaataccgaaaaacaaaatccgcaaaatactaaaaatcgccaaaaaaccaatctccataaaaacgccgatcgataataataaaaattcgcatctaaaaaatttcactcgaaaataccaccctcgaactaccgctaaattctacgaccaccgaaaacctacgtacgacaacgcacgacgtactaactaacctaaccgcgcgtaa

SEQ ID NO: 5451 - DNA, 634 bp, Artificial Sequence
  chemically treated genomic DNA (Homo sapiens) CpG-island No: 5451
gatcgtttaacggtgataagttaatgaagttttaaacgtaggagttatacgtaggcgggcgtaagttgattgaaaatattgaagattattagtcgttaggcgttggcgattttgggtaaataagtatatgaatagcgtatttagttagttgcggtgtatagtgggggaaataaacgtttattattggttcgacgtagatttgggtgttgttaaaattttagcggtgtaagtcgcgttttattggagaaattggttgaagcgtatcgcgagttggattaggcgttggtagtgcgtgggcgataaaataacgttatcgaaaaggtggcgtttgtgtagagggtttagtgtcgggtgcggcgtaacgtttgattcggtttatcgattaatcgtttaggaagttacgtagtattttagaacggttgaacgtatgttgatgtcggaagataagattcgtaaagtgttgaagatcgttaaagagttaatttttatggaaacgtcgatcggtgatgatgaagattcgtatttgggggattttattcgaggatattattttcgagttgtcgttggattttgcgattatcgaaagtttgcgtgcggtaacgtacgacgtgttggttggtttgatcgcgcgtga

SEQ ID NO: 5452 - DNA, 634 bp, Artificial Sequence
  chemically treated genomic DNA (Homo sapiens) CpG-island No: 5452
tcacgcgcgatcaaaccaaccaacacgtcgtacgttaccgcacgcaaactttcgataatcgcaaaatccaacgacaactcgaaaataatatcctcgaataaaatcccccaaatacgaatcttcatcatcaccgatcgacgtttccataaaaattaactctttaacgatcttcaacactttacgaatcttatcttccgacatcaacatacgttcaaccgttctaaaatactacgtaacttcctaaacgattaatcgataaaccgaatcaaacgttacgccgcacccgacactaaaccctctacacaaacgccaccttttcgataacgttattttatcgcccacgcactaccaacgcctaatccaactcgcgatacgcttcaaccaatttctccaataaaacgcgacttacaccgctaaaattttaacaacacccaaatctacgtcgaaccaataataaacgtttatttcccccactatacaccgcaactaactaaatacgctattcatatacttatttacccaaaatcgccaacgcctaacgactaataatcttcaatattttcaatcaacttacgcccgcctacgtataactcctacgtttaaaacttcattaacttatcaccgttaaacgatc

SEQ ID NO: 5453 - DNA, 661 bp, Artificial Sequence
  chemically treated genomic DNA (Homo sapiens) CpG-island No: 5453
gaagtgttgggcgataatatgggtatcggtatggcggttgatatcgttttgcgtatttatgaaatttcgtatatttggtcgtaggttgttgagtaataggttgtcgggttgaaagaagaagtgtcggaagaagtaaaagcgggtcgtgttgatttgcgcgatttatcgttggttattattgatggcgaagacgttcgtgattttgacgatgtagtttattgcgagaaaaaacgcggcggcggttggcgtttatgggtcgcgattgtcgacgttagttattatgtgcgttcgttaacgtcgttggatagagaagcgcgtaatcgtggtacgtcggtgtattttttttcgtaggttatttcgatgttgtcggaagtgttttttaacggtttgtgttcgtttaattcgtaggtagatcgtttgtgtatggtgtgcgagatgacggtttcgtcgaaaggtcgtttgacgggttataaattttacgaagcggtgatgagtttttacgcgcgtttgatttatattaaagtttggtatattttgtagggcgattaggatttgcgcgagtagtacgtttcgttggttaagtatttcgaagagttgtataatttttataaagtgttggataaagttcgtgaagaacgcggtgggattttatttgagagcg

SEQ ID NO: 5454 - DNA, 661 bp, Artificial Sequence
  chemically treated genomic DNA (Homo sapiens) CpG-island No: 5454
cgctctcaaataaaatcccaccgcgttcttcacgaactttatccaacactttataaaaattatacaactcttcgaaatacttaaccaacgaaacgtactactcgcgcaaatcctaatcgccctacaaaatataccaaactttaatataaatcaaacgcgcgtaaaaactcatcaccgcttcgtaaaatttataacccgtcaaacgacctttcgacgaaaccgtcatctcgcacaccatacacaaacgatctacctacgaattaaacgaacacaaaccgttaaaaaacacttccgacaacatcgaaataacctacgaaaaaaaatacaccgacgtaccacgattacgcgcttctctatccaacgacgttaacgaacgcacataataactaacgtcgacaatcgcgacccataaacgccaaccgccgccgcgttttttctcgcaataaactacatcgtcaaaatcacgaacgtcttcgccatcaataataaccaacgataaatcgcgcaaatcaacacgacccgcttttacttcttccgacacttcttctttcaacccgacaacctattactcaacaacctacgaccaaatatacgaaatttcataaatacgcaaaacgatatcaaccgccataccgatacccatattatcgcccaacacttc

SEQ ID NO: 5455 - DNA, 661 bp, Artificial Sequence
  chemically treated genomic DNA (Homo sapiens) CpG-island No: 5455
cgtttttaaatgagattttatcgcgttttttacgggttttatttagtattttatagaggttatgtaatttttcgagatgtttaattagcggggcgtattgttcgcgtagattttgatcgttttgtagaatatgttagattttggtgtaggttagacgcgcgtgagagtttattatcgtttcgtagaatttgtagttcgttaggcggtttttcgacgaaatcgttatttcgtatattatatataggcggtttatttgcgggttgagcgaatataggtcgttagagagtattttcggtagtatcgggataatttgcgaagggaagtatatcgacgtgttacggttacgcgtttttttgtttagcggcgttgacggacgtatatagtagttgacgtcggtaatcgcgatttataaacgttagtcgtcgtcgcgttttttttcgtagtaaattgtatcgttaaagttacgggcgttttcgttattaatggtgattagcggtaaatcgcgtagattaatacggttcgtttttgtttttttcggtatttttttttttagttcggtaatttgttgtttaatagtttgcggttagatgtacggaattttatgggtacgtagagcgatattaatcgttatgtcggtgtttatattgtcgtttagtatttt

SEQ ID NO: 5456 - DNA, 661 bp, Artificial Sequence
  chemically treated genomic DNA (Homo sapiens) CpG-island No: 5456
aaaatactaaacgacaatataaacaccgacataacgattaatatcgctctacgtacccataaaattccgtacatctaaccgcaaactattaaacaacaaattaccgaactaaaaaaaaaaataccgaaaaaaacaaaaacgaaccgtattaatctacgcgatttaccgctaatcaccattaataacgaaaacgcccgtaactttaacgatacaatttactacgaaaaaaaacgcgacgacgactaacgtttataaatcgcgattaccgacgtcaactactatatacgtccgtcaacgccgctaaacaaaaaaacgcgtaaccgtaacacgtcgatatacttcccttcgcaaattatcccgatactaccgaaaatactctctaacgacctatattcgctcaacccgcaaataaaccgcctatatataatatacgaaataacgatttcgtcgaaaaaccgcctaacgaactacaaattctacgaaacgataataaactctcacgcgcgtctaacctacaccaaaatctaacatattctacaaaacgatcaaaatctacgcgaacaatacgccccgctaattaaacatctcgaaaaattacataacctctataaaatactaaataaaacccgtaaaaaacgcgataaaatctcatttaaaaacg

SEQ ID NO: 5457 - DNA, 585 bp, Artificial Sequence
  chemically treated genomic DNA (Homo sapiens) CpG-island No: 5457
gtttcggagttttcggagtcgagggatacgtcggagttcgtgggcgagcggcggtagaggaagggtttgggaggcgcgggtagcgggtttcggggattggtgtaggacgaaggatcggcgggtaacgggtttcgcgggatgggcgcgaaggttgttttcggtatagtagtcgagtcggggcgggcgggttgtggcgagcgtatgcgcgggggcgggggcgggggcgggggcgggggcggtggcgttttcggcggggagaagggtcgcgggttttcggcgttcgtcgatcgcggggaggcgtttttgcgtcgggtcgtattgatgatgtttcgcgttagaagcgtttgtagttggcggttggggggtcgcgtttcggttttaggtcgtagcggggatatcgagcgttcgttttacgagggagatatgggcggtggcggcggtagcggcggggggttgtttatgttgttttcgcgatttggtttttacgggttcgggtttatttagtcgtttaggttgttggggggtcgggacgcgttcggcgtttagggtggggaggtgggtaggttttttcggcggttttgggga

SEQ ID NO: 5458 - DNA, 585 bp, Artificial Sequence
  chemically treated genomic DNA (Homo sapiens) CpG-island No: 5458
tccccaaaaccgccgaaaaaacctacccacctccccaccctaaacgccgaacgcgtcccgaccccccaacaacctaaacgactaaataaacccgaacccgtaaaaaccaaatcgcgaaaacaacataaacaaccccccgccgctaccgccgccaccgcccatatctccctcgtaaaacgaacgctcgatatccccgctacgacctaaaaccgaaacgcgaccccccaaccgccaactacaaacgcttctaacgcgaaacatcatcaatacgacccgacgcaaaaacgcctccccgcgatcgacgaacgccgaaaacccgcgacccttctccccgccgaaaacgccaccgcccccgcccccgcccccgcccccgcccccgcgcatacgctcgccacaacccgcccgccccgactcgactactataccgaaaacaaccttcgcgcccatcccgcgaaacccgttacccgccgatccttcgtcctacaccaatccccgaaacccgctacccgcgcctcccaaacccttcctctaccgccgctcgcccacgaactccgacgtatccctcgactccgaaaactccgaaac

SEQ ID NO: 5459 - DNA, 585 bp, Artificial Sequence
  chemically treated genomic DNA (Homo sapiens) CpG-island No: 5459
tttttaggatcgtcgggagagtttgtttatttttttattttggacgtcgggcgcgtttcggttttttagtagtttagacggttgggtgagttcgggttcgtgggagttaggtcgcgggagtagtatgagtagtttttcgtcgttgtcgtcgttatcgtttatgtttttttcgtggagcgagcgttcggtgttttcgttgcgatttgagatcgaggcgcggttttttagtcgttagttgtaggcgtttttggcgcgaaatattattaatgcggttcggcgtaagagcgttttttcgcggtcggcgggcgtcgagaattcgcggttttttttttcgtcgagggcgttatcgttttcgttttcgttttcgttttcgttttcgcgtatgcgttcgttatagttcgttcgtttcggttcggttgttgtgtcgggggtagttttcgcgtttatttcgcggagttcgttgttcgtcggtttttcgttttgtattagttttcggagttcgttgttcgcgttttttaggttttttttttatcgtcgttcgtttacggatttcgacgtgtttttcgatttcgaggatttcggggt

SEQ ID NO: 5460 - DNA, 585 bp, Artificial Sequence
  chemically treated genomic DNA (Homo sapiens) CpG-island No: 5460
accccgaaatcctcgaaatcgaaaaacacgtcgaaatccgtaaacgaacgacgataaaaaaaaaacctaaaaaacgcgaacaacgaactccgaaaactaatacaaaacgaaaaaccgacgaacaacgaactccgcgaaataaacgcgaaaactacccccgacacaacaaccgaaccgaaacgaacgaactataacgaacgcatacgcgaaaacgaaaacgaaaacgaaaacgaaaacgataacgccctcgacgaaaaaaaaaaccgcgaattctcgacgcccgccgaccgcgaaaaaacgctcttacgccgaaccgcattaataatatttcgcgccaaaaacgcctacaactaacgactaaaaaaccgcgcctcgatctcaaatcgcaacgaaaacaccgaacgctcgctccacgaaaaaaacataaacgataacgacgacaacgacgaaaaactactcatactactcccgcgacctaactcccacgaacccgaactcacccaaccgtctaaactactaaaaaaccgaaacgcgcccgacgtccaaaataaaaaaataaacaaactctcccgacgatcctaaaaa

SEQ ID NO: 5461 - DNA, 673 bp, Artificial Sequence
  chemically treated genomic DNA (Homo sapiens) CpG-island No: 5461
gttcgtttgtgtacgttcggcgggtgttgcgttgcggtggttcgtggatggtcggttgcgcgtggcgtagttatatgattgaagtatgacgtttacgttagtcgcggatttaacggttgacgtttgggttattgtacgtttggcgaatatttgtattgtattgttattttggtgcggtggcgtattgaaatggggggggggggggatgatgggcggtgaaggggtgtaagacggggaagagtatagagggaatggtgaagttacgcgagatcggcgagagtggggagtttgggatgggtaatagcgcgagggaaagaggataaaggcgtcgggggagatataggcgaaggggttgcgacgttgatttgcgggggggcgacgtacggtaacggcgtgagcgggaagtttgagaagtgtgcggcggggggcgggggggagggggcgttgatggtggtatagtattggggaaaggaggtaaggaacgggaacgttggaagtaacggtcgtgggatagttggggtatgtgggggcgttggagcgtggatacgagttttataataaaggtggggaaaggttgcggaaggaggttaattggggtgcggggtgtgttattgttacgaaatgtattagggtatagttgtaaggtcggcgggatagtaggaatatagatgat

SEQ ID NO: 5462 - DNA, 673 bp, Artificial Sequence
  chemically treated genomic DNA (Homo sapiens) CpG-island No: 5462
atcatctatattcctactatcccgccgaccttacaactataccctaatacatttcgtaacaataacacaccccgcaccccaattaacctccttccgcaacctttccccacctttattataaaactcgtatccacgctccaacgcccccacataccccaactatcccacgaccgttacttccaacgttcccgttccttacctcctttccccaatactataccaccatcaacgccccctcccccccgccccccgccgcacacttctcaaacttcccgctcacgccgttaccgtacgtcgcccccccgcaaatcaacgtcgcaaccccttcgcctatatctcccccgacgcctttatcctctttccctcgcgctattacccatcccaaactccccactctcgccgatctcgcgtaacttcaccattccctctatactcttccccgtcttacaccccttcaccgcccatcatccccccccccccccatttcaatacgccaccgcaccaaaataacaatacaatacaaatattcgccaaacgtacaataacccaaacgtcaaccgttaaatccgcgactaacgtaaacgtcatacttcaatcatataactacgccacgcgcaaccgaccatccacgaaccaccgcaacgcaacacccgccgaacgtacacaaacgaac

SEQ ID NO: 5463 - DNA, 673 bp, Artificial Sequence
  chemically treated genomic DNA (Homo sapiens) CpG-island No: 5463
attatttatatttttattgtttcgtcggttttataattgtattttggtatatttcgtagtaatggtatatttcgtattttaattaattttttttcgtaatttttttttatttttattgtaaggttcgtatttacgttttagcgtttttatatattttaattattttacggtcgttatttttaacgttttcgttttttattttttttttttaatgttatattattattagcgttttttttttttcgtttttcgtcgtatattttttaaatttttcgtttacgtcgttatcgtgcgtcgttttttcgtagattagcgtcgtagttttttcgtttatgtttttttcggcgtttttgttttttttttttcgcgttattatttattttaaattttttattttcgtcggtttcgcgtggttttattattttttttatattttttttcgttttgtatttttttatcgtttattatttttttttttttttattttaatacgttatcgtattagggtagtaatatagtataagtgttcgttaagcgtgtagtggtttaggcgttaatcgttaggttcgcggttggcgtaggcgttatattttaattatgtaattgcgttacgcgtagtcgattatttacgagttatcgtaacgtagtattcgtcgaacgtgtatagacggat

SEQ ID NO: 5464 - DNA, 673 bp, Artificial Sequence
  chemically treated genomic DNA (Homo sapiens) CpG-island No: 5464
atccgtctatacacgttcgacgaatactacgttacgataactcgtaaataatcgactacgcgtaacgcaattacataattaaaatataacgcctacgccaaccgcgaacctaacgattaacgcctaaaccactacacgcttaacgaacacttatactatattactaccctaatacgataacgtattaaaataaaaaaaaaaaaaaataataaacgataaaaaaatacaaaacgaaaaaaaatataaaaaaaataataaaaccacgcgaaaccgacgaaaataaaaaatttaaaataaataataacgcgaaaaaaaaaaaacaaaaacgccgaaaaaaacataaacgaaaaaactacgacgctaatctacgaaaaaacgacgcacgataacgacgtaaacgaaaaatttaaaaaatatacgacgaaaaacgaaaaaaaaaaaacgctaataataatataacattaaaaaaaaaaaataaaaaacgaaaacgttaaaaataacgaccgtaaaataattaaaatatataaaaacgctaaaacgtaaatacgaaccttacaataaaaataaaaaaaaattacgaaaaaaaattaattaaaatacgaaatataccattactacgaaatataccaaaatacaattataaaaccgacgaaacaataaaaatataaataat

SEQ ID NO: 5465 - DNA, 590 bp, Artificial Sequence
  chemically treated genomic DNA (Homo sapiens) CpG-island No: 5465
gtcgcgcgtgcgcgtcgtgcgtgcgtgagcgacggacgtgcgcgtgggcgtgggacgggtgtacgcgcggtatgcgggagggaatgtttgaaagtgtatggtatgaaaaaggtggtttgttggcggtgtgttaaattcggtcgtggatataatgtagggtttgtcggggtgtggtgtttgtgttagtcgcggagggaaagcgataaagatagttgagagtgggggatagtatgggcgaacgtgatagcggttacgggtagcgggtagtagcgcggcggcgtgagtcgagggagtaatgatcggaattaatcgtggttcgaaaacgggtgcgtgatggggttgtggttggtggggtttgggagcgcgggattggaagtgaagggtaaggggttaatattgggttgcgcggttggatggagcggacggcgggtgggttgcgtggatcggtagaaattggtagagtgatgtttgggtttaaggagtgtggggtgagagggcggtacggtagtatggggttgggggagtgggaggatacgaaagggggatgcgggggtatagtatggggttaaatatttttgttgaagaaattt

SEQ ID NO: 5466 - DNA, 590 bp, Artificial Sequence
  chemically treated genomic DNA (Homo sapiens) CpG-island No: 5466
aaatttcttcaacaaaaatatttaaccccatactatacccccgcatccccctttcgtatcctcccactcccccaaccccatactaccgtaccgccctctcaccccacactccttaaacccaaacatcactctaccaatttctaccgatccacgcaacccacccgccgtccgctccatccaaccgcgcaacccaatattaaccccttacccttcacttccaatcccgcgctcccaaaccccaccaaccacaaccccatcacgcacccgttttcgaaccacgattaattccgatcattactccctcgactcacgccgccgcgctactacccgctacccgtaaccgctatcacgttcgcccatactatcccccactctcaactatctttatcgctttccctccgcgactaacacaaacaccacaccccgacaaaccctacattatatccacgaccgaatttaacacaccgccaacaaaccacctttttcataccatacactttcaaacattccctcccgcataccgcgcgtacacccgtcccacgcccacgcgcacgtccgtcgctcacgcacgcacgacgcgcacgcgcgac

SEQ ID NO: 5467 - DNA, 590 bp, Artificial Sequence
  chemically treated genomic DNA (Homo sapiens) CpG-island No: 5467
aaatttttttaataaaaatgtttaattttatattatgttttcgtatttttttttcgtatttttttatttttttagttttatattatcgtatcgtttttttattttatattttttaggtttaggtattattttattagtttttgtcggtttacgtaatttattcgtcgttcgttttatttagtcgcgtagtttagtattagttttttattttttatttttagtttcgcgtttttaagttttattagttatagttttattacgtattcgttttcgggttacggttggtttcggttattattttttcggtttacgtcgtcgcgttattattcgttattcgtaatcgttgttacgttcgtttatattattttttatttttaattatttttatcgtttttttttcgcgattgatataaatattatatttcggtagattttgtattatatttacggtcgggtttaatatatcgttaataggttattttttttatattatgtatttttagatattttttttcgtatatcgcgcgtgtattcgttttacgtttacgcgtacgttcgtcgtttacgtacgtacgacgcgtacgcgcggt

SEQ ID NO: 5468 - DNA, 590 bp, Artificial Sequence
  chemically treated genomic DNA (Homo sapiens) CpG-island No: 5468
accgcgcgtacgcgtcgtacgtacgtaaacgacgaacgtacgcgtaaacgtaaaacgaatacacgcgcgatatacgaaaaaaaatatctaaaaatacataatataaaaaaaataacctattaacgatatattaaacccgaccgtaaatataatacaaaatctaccgaaatataatatttatatcaatcgcgaaaaaaaaacgataaaaataattaaaaataaaaaataatataaacgaacgtaacaacgattacgaataacgaataataacgcgacgacgtaaaccgaaaaaataataaccgaaaccaaccgtaacccgaaaacgaatacgtaataaaactataactaataaaacttaaaaacgcgaaactaaaaataaaaaataaaaaactaatactaaactacgcgactaaataaaacgaacgacgaataaattacgtaaaccgacaaaaactaataaaataatacctaaacctaaaaaatataaaataaaaaaacgatacgataatataaaactaaaaaaataaaaaaatacgaaaaaaaaatacgaaaacataatataaaattaaacatttttattaaaaaaattt

SEQ ID NO: 5469 - DNA, 1123 bp, Artificial Sequence
  chemically treated genomic DNA (Homo sapiens) CpG-island No: 5469
tatacgttgtttttttgcgggtaaattatagtcgcgagatttttcgtttgggcggtatatttaatatgttttatcgtatagcgtcgatttaggtagaggatgcgggacgggtcgcgtgattattattaaaagtgcgggagggggtcgatgaggttagtaggatacgggttagagacgacgggggaagcgaggtagcgacgggacggaggggattaggggagtgtggatagttggcgtacggatatcgcgggtgcggggtatcggacgtagtggaaggaggtcgcgaacggatagagtttgggggttaaatggtgtggttgggggggggggtggggtttagcggtggcgattaaatgtagtaggaatagttgggtgaaagagcgggggaaggtgttggattattagggtataaggggcgtacggcgcgtcgtgttttttgtaagaatagaggcgttgttgaatttaggagaggggtttgggtgggagtgtagtggcggggcggggttgtgtcgttgtagatttattagggtgtacggtacggggattaaggtggggagtatttggtgcggaatggtggattaaaggggaagtagtgagttgtcgttggtttcgaaagaaatatcgtattggtcgacgaaaggtgagtggggggtggacgattttttgttattttatttatgatttataggatttggtttaaattcgtttggttatttttcgatgttacgttatgtcgtaaacgcgttgtttattttgtgattacgggtttatatatagtagggggtgtgggggaagtttttcgtagatttttttgttataggatttgttagtatcgcgtttacgtttgtcgcggtacggattgtcgcgatcgttaattgtacggaacgcgattttttgtattgattgtttacggatgtgcgtacgcgtatttgatatcggggtgtggggattaaatattgtgagggagcggaaagggtgtgggggtgtgacgatggatatgaacgaatgcgggtcggttaaacgtggggaatgggtgagaaaattatcgatgtggtaagttttgttggggtagcgggtaagtggcgtcggtaggttttgagaagtaagtggttttgagagaata

SEQ ID NO: 5470 - DNA, 1123 bp, Artificial Sequence
  chemically treated genomic DNA (Homo sapiens) CpG-island No: 5470
tattctctcaaaaccacttacttctcaaaacctaccgacgccacttacccgctaccccaacaaaacttaccacatcgataattttctcacccattccccacgtttaaccgacccgcattcgttcatatccatcgtcacacccccacaccctttccgctccctcacaatatttaatccccacaccccgatatcaaatacgcgtacgcacatccgtaaacaatcaatacaaaaaatcgcgttccgtacaattaacgatcgcgacaatccgtaccgcgacaaacgtaaacgcgatactaacaaatcctataacaaaaaaatctacgaaaaacttcccccacaccccctactatatataaacccgtaatcacaaaataaacaacgcgtttacgacataacgtaacatcgaaaaataaccaaacgaatttaaaccaaatcctataaatcataaataaaataacaaaaaatcgtccaccccccactcacctttcgtcgaccaatacgatatttctttcgaaaccaacgacaactcactacttcccctttaatccaccattccgcaccaaatactccccaccttaatccccgtaccgtacaccctaataaatctacaacgacacaaccccgccccgccactacactcccacccaaacccctctcctaaattcaacaacgcctctattcttacaaaaaacacgacgcgccgtacgccccttataccctaataatccaacaccttcccccgctctttcacccaactattcctactacatttaatcgccaccgctaaaccccacccccccccccaaccacaccatttaacccccaaactctatccgttcgcgacctccttccactacgtccgataccccgcacccgcgatatccgtacgccaactatccacactcccctaatcccctccgtcccgtcgctacctcgcttcccccgtcgtctctaacccgtatcctactaacctcatcgaccccctcccgcacttttaataataatcacgcgacccgtcccgcatcctctacctaaatcgacgctatacgataaaacatattaaatataccgcccaaacgaaaaatctcgcgactataatttacccgcaaaaaaacaacgtata

SEQ ID NO: 5471 - DNA, 1123 bp, Artificial Sequence
  chemically treated genomic DNA (Homo sapiens) CpG-island No: 5471
tgtttttttaaagttatttattttttaaaatttatcggcgttatttattcgttattttagtaaaatttgttatatcggtaatttttttatttattttttacgtttgatcggttcgtattcgtttatatttatcgttatatttttatatttttttcgtttttttataatatttggtttttatatttcgatattaaatacgcgtgcgtatattcgtaagtaattagtgtaagagatcgcgtttcgtgtagttggcggtcgcggtaattcgtatcgcggtaggcgtaggcgcgatattagtaaattttgtaatagggaggtttgcgggaagttttttttatattttttattatatgtaagttcgtggttataaggtaagtaacgcgtttgcggtatggcgtaatatcggagggtggttaagcgggtttagattaaattttgtaagttataggtggagtggtaaggagtcgtttattttttatttatttttcgtcggttagtgcggtatttttttcggggttaacgataatttattattttttttttagtttattatttcgtattaagtattttttattttaattttcgtgtcgtatattttggtaaatttgtaacgatataatttcgtttcgttattatatttttatttaagttttttttttaaatttagtaacgtttttatttttataaaaaatacggcgcgtcgtacgttttttgtattttaataatttagtattttttttcgtttttttatttaattatttttgttatatttggtcgttatcgttaaattttatttttttttttaattatattatttaatttttaagttttattcgttcgcggtttttttttattacgttcggtatttcgtattcgcggtattcgtgcgttaattatttatatttttttaatttttttcgtttcgtcgttatttcgtttttttcgtcgtttttaattcgtgttttgttagttttatcggttttttttcgtatttttagtagtagttacgcggttcgtttcgtattttttatttaaatcggcgttatacgatggaatatattaagtgtatcgtttaaacggggggtttcgcggttgtgatttgttcgtagaaaaatagcgtgtg

SEQ ID NO: 5472 - DNA, 1123 bp, Artificial Sequence
  chemically treated genomic DNA (Homo sapiens) CpG-island No: 5472
cacacgctatttttctacgaacaaatcacaaccgcgaaaccccccgtttaaacgatacacttaatatattccatcgtataacgccgatttaaataaaaaatacgaaacgaaccgcgtaactactactaaaaatacgaaaaaaaaccgataaaactaacaaaacacgaattaaaaacgacgaaaaaaacgaaataacgacgaaacgaaaaaaattaaaaaaatataaataattaacgcacgaataccgcgaatacgaaataccgaacgtaataaaaaaaaaccgcgaacgaataaaacttaaaaattaaataatataattaaaaaaaaaaataaaatttaacgataacgaccaaatataacaaaaataattaaataaaaaaacgaaaaaaaatactaaattattaaaatacaaaaaacgtacgacgcgccgtattttttataaaaataaaaacgttactaaatttaaaaaaaaaacttaaataaaaatataataacgaaacgaaattatatcgttacaaatttaccaaaatatacgacacgaaaattaaaataaaaaatacttaatacgaaataataaactaaaaaaaaaataataaattatcgttaaccccgaaaaaaataccgcactaaccgacgaaaaataaataaaaaataaacgactccttaccactccacctataacttacaaaatttaatctaaacccgcttaaccaccctccgatattacgccataccgcaaacgcgttacttaccttataaccacgaacttacatataataaaaaatataaaaaaaacttcccgcaaacctccctattacaaaatttactaatatcgcgcctacgcctaccgcgatacgaattaccgcgaccgccaactacacgaaacgcgatctcttacactaattacttacgaatatacgcacgcgtatttaatatcgaaatataaaaaccaaatattataaaaaaacgaaaaaaatataaaaatataacgataaatataaacgaatacgaaccgatcaaacgtaaaaaataaataaaaaaattaccgatataacaaattttactaaaataacgaataaataacgccgataaattttaaaaaataaataactttaaaaaaaca

SEQ ID NO: 5473 - DNA, 576 bp, Artificial Sequence
  chemically treated genomic DNA (Homo sapiens) CpG-island No: 5473
  misc_feature (539)..(539): n is either a, c, g or t
gtagtacgttatcgcgatgcgggaagttgacgtagcgggtcgaagttagtttgcggatcgaaaacgtcgttcgcgcgaatgcgtttaacgcgcgttagaattttttgtttaaatgcggttttgtatttcgtcggaacgaagacgcgggtgttattggtatatatttgatcggagttgaagaagtttgttattatggcgatatcggcggcgagatcgagattcgtattatcgaaaacgattagcggtgatttatcgtttagttttatggttattttttttagggaagaggtcgtcgagttagttattatttttttgtcgttggcgatatcgtcggtaaatgatattttggtaatgttcggatgttcggttagatattgttcggttttcgcgtttacgttcggtaatacgttaaatacgtcgttcggtaggttcgtttcgttgtaaattttagttagttttaacgcggtaagcggggtaatttcgttcggtttgaaaattattgcgttgtttgtcgttagcgtcggggcggattttgaatnatttttgttacgtatttatgaagttttattttttttt

SEQ ID NO: 5474 - DNA, 576 bp, Artificial Sequence
  chemically treated genomic DNA (Homo sapiens) CpG-island No: 5474
  misc_feature (38)..(38): n is either a, c, g or t
aaaaaaaaataaaacttcataaatacgtaacaaaaatnattcaaaatccgccccgacgctaacgacaaacaacgcaataattttcaaaccgaacgaaattaccccgcttaccgcgttaaaactaactaaaatttacaacgaaacgaacctaccgaacgacgtatttaacgtattaccgaacgtaaacgcgaaaaccgaacaatatctaaccgaacatccgaacattaccaaaatatcatttaccgacgatatcgccaacgacaaaaaaataataactaactcgacgacctcttccctaaaaaaaataaccataaaactaaacgataaatcaccgctaatcgttttcgataatacgaatctcgatctcgccgccgatatcgccataataacaaacttcttcaactccgatcaaatatataccaataacacccgcgtcttcgttccgacgaaatacaaaaccgcatttaaacaaaaaattctaacgcgcgttaaacgcattcgcgcgaacgacgttttcgatccgcaaactaacttcgacccgctacgtcaacttcccgcatcgcgataacgtactac

SEQ ID NO: 5475 - DNA, 576 bp, Artificial Sequence
  chemically treated genomic DNA (Homo sapiens) CpG-island No: 5475
  misc_feature (38)..(38): n is either a, c, g or t
aaaaaagaatgagattttatgggtacgtagtaagggtnatttaggattcgtttcggcgttggcggtaggtaacgtaatgatttttaaatcgagcgaagttatttcgtttatcgcgttaaagttggttgaaatttatagcgaagcgggtttgtcggacggcgtatttaacgtgttgtcgggcgtgggcgcggagatcgggtaatatttgatcgagtattcgggtattgttaaagtgttatttatcggcggtgtcgttagcggtaaaaaagtgatggttaattcggcggttttttttttgaaagaagtgattatggaattgggcggtaaattatcgttgatcgttttcgatgatgcggatttcgatttcgtcgtcgatatcgttatgatggtaaatttttttagtttcggttaggtgtgtattaatggtattcgcgttttcgtttcggcgaaatgtaaagtcgtatttgagtagaaaattttggcgcgcgttgagcgtattcgcgcgggcgacgttttcgattcgtaaattaatttcggttcgttgcgttagtttttcgtatcgcgataacgtgttgt

SEQ ID NO: 5476 - DNA, 576 bp, Artificial Sequence
  chemically treated genomic DNA (Homo sapiens) CpG-island No: 5476
  misc_feature (539)..(539): n is either a, c, g or t
acaacacgttatcgcgatacgaaaaactaacgcaacgaaccgaaattaatttacgaatcgaaaacgtcgcccgcgcgaatacgctcaacgcgcgccaaaattttctactcaaatacgactttacatttcgccgaaacgaaaacgcgaataccattaatacacacctaaccgaaactaaaaaaatttaccatcataacgatatcgacgacgaaatcgaaatccgcatcatcgaaaacgatcaacgataatttaccgcccaattccataatcacttctttcaaaaaaaaaaccgccgaattaaccatcacttttttaccgctaacgacaccgccgataaataacactttaacaatacccgaatactcgatcaaatattacccgatctccgcgcccacgcccgacaacacgttaaatacgccgtccgacaaacccgcttcgctataaatttcaaccaactttaacgcgataaacgaaataacttcgctcgatttaaaaatcattacgttacctaccgccaacgccgaaacgaatcctaaatnacccttactacgtacccataaaatctcattctttttt

SEQ ID NO: 5477 - DNA, 506 bp, Artificial Sequence
  chemically treated genomic DNA (Homo sapiens) CpG-island No: 5477
tcgcggtcgtcgttaggtaagtcgttaatagtagtagcgtaattcgcgtcggcgttagcgttatttttacggttcgggcggtattattatttagcggtaaaatggttagttagcggcggtatagcggggtaatcgttagtaaaattattattataatttcggtgcgttagagttgcgtatcggtcgcgtagtaggtcgaatcgggaaatttaggttagtatttgcgttattcgcgggttaatatttggttgtaaattattaaagtatggtggacgcggtggttaaagtaatttcggtcgttatatacgggtggggagaattacggggttgggggattatatgatatagggtacggcggttaaagtttgagtaaattttacggtatcgggtcgaaaagaatacggtaagcggcgaagaatataataataggggtatagatcgtaagaggaataagagtttaaggtagaggaattgggggggatataacgggatcgggtaggtattgt

SEQ ID NO: 5478 - DNA, 506 bp, Artificial Sequence
  chemically treated genomic DNA (Homo sapiens) CpG-island No: 5478
acaatacctacccgatcccgttatatcccccccaattcctctaccttaaactcttattcctcttacgatctatacccctattattatattcttcgccgcttaccgtattcttttcgacccgataccgtaaaatttactcaaactttaaccgccgtaccctatatcatataatcccccaaccccgtaattctccccacccgtatataacgaccgaaattactttaaccaccgcgtccaccatactttaataatttacaaccaaatattaacccgcgaataacgcaaatactaacctaaatttcccgattcgacctactacgcgaccgatacgcaactctaacgcaccgaaattataataataattttactaacgattaccccgctataccgccgctaactaaccattttaccgctaaataataataccgcccgaaccgtaaaaataacgctaacgccgacgcgaattacgctactactattaacgacttacctaacgacgaccgcga

SEQ ID NO: 5479 - DNA, 506 bp, Artificial Sequence
  chemically treated genomic DNA (Homo sapiens) CpG-island No: 5479
gtagtatttattcggtttcgttatattttttttagtttttttgttttgggtttttattttttttacgatttgtatttttgttgttgtatttttcgtcgtttgtcgtatttttttcgattcggtgtcgtggggtttatttagattttggtcgtcgtattttgtgttatatggttttttagtttcgtggttttttttattcgtatgtaacggtcgggattgttttaattatcgcgtttattatgttttgatgatttgtagttaagtgttgattcgcgaatggcgtaagtgttgatttggatttttcggttcgatttattacgcgatcgatgcgtagttttggcgtatcggaattgtgatggtgattttgttggcgattatttcgttgtgtcgtcgttggttgattattttatcgttgggtggtgatatcgttcgagtcgtaggaatggcgttgacgtcgacgcgaattgcgttgttgttgttagcggtttgtttgacggcgatcgcga

SEQ ID NO: 5480 - DNA, 506 bp, Artificial Sequence
  chemically treated genomic DNA (Homo sapiens) CpG-island No: 5480
tcgcgatcgccgtcaaacaaaccgctaacaacaacaacgcaattcgcgtcgacgtcaacgccattcctacgactcgaacgatatcaccacccaacgataaaataatcaaccaacgacgacacaacgaaataatcgccaacaaaatcaccatcacaattccgatacgccaaaactacgcatcgatcgcgtaataaatcgaaccgaaaaatccaaatcaacacttacgccattcgcgaatcaacacttaactacaaatcatcaaaacataataaacgcgataattaaaacaatcccgaccgttacatacgaataaaaaaaaccacgaaactaaaaaaccatataacacaaaatacgacgaccaaaatctaaataaaccccacgacaccgaatcgaaaaaaatacgacaaacgacgaaaaatacaacaacaaaaatacaaatcgtaaaaaaaataaaaacccaaaacaaaaaaactaaaaaaaatataacgaaaccgaataaatactac

SEQ ID NO: 5481 - DNA, 771 bp, Artificial Sequence
  chemically treated genomic DNA (Homo sapiens) CpG-island No: 5481
ggcgttgaaaagtttggcgttgagcgtcgggttggaattggcgggtagcggcgtgcgttgtaatgtggtttcgtttggttttatcgatatcgatatgtaacgtacgttgtgggtgagcgatgacgtcgaagaatagcgtattcgcggttttggcgagtagtttaaattcggtatttcgttggggaaaatcgttcgtttataagagatcgttaatacgattttgtttttcgtttttgatttcgttagttatattattttataggatattgtggtcgatggcggtttaacgttgggggtataagtatgatttggaaacgttatttaacgttcgacgaattgaacgttattagcgataatataatggtggcgtatttgggaattgtgtatattcgtttgggcgatgatgtgttggaagtcgaaatgtcggttgatattcgtatttattagtcgttcggtttattatatggcggcgcgtcggcggcgttggcggaaacgttgggatcgatggtcggatttatgatgattcgcgacggatagtgtgtggtaggtatagaattttatgtaatatagtatcggtcggtgtttgagggaaaggtattcggcgtttgttagtcgttgtattttggtcggtaaaattagagttgggaaatcgtcgttttcgatgaataggggcggcgttgttgtatttgtcggttgggtacggtagttttgggatgaattcgatagaattagatgagattgtaggaaaattcggttaacggagtgatcgag

SEQ ID NO: 5482 - DNA, 771 bp, Artificial Sequence
  chemically treated genomic DNA (Homo sapiens) CpG-island No: 5482
ctcgatcactccgttaaccgaattttcctacaatctcatctaattctatcgaattcatcccaaaactaccgtacccaaccgacaaatacaacaacgccgcccctattcatcgaaaacgacgatttcccaactctaattttaccgaccaaaatacaacgactaacaaacgccgaatacctttccctcaaacaccgaccgatactatattacataaaattctatacctaccacacactatccgtcgcgaatcatcataaatccgaccatcgatcccaacgtttccgccaacgccgccgacgcgccgccatataataaaccgaacgactaataaatacgaatatcaaccgacatttcgacttccaacacatcatcgcccaaacgaatatacacaattcccaaatacgccaccattatattatcgctaataacgttcaattcgtcgaacgttaaataacgtttccaaatcatacttatacccccaacgttaaaccgccatcgaccacaatatcctataaaataatataactaacgaaatcaaaaacgaaaaacaaaatcgtattaacgatctcttataaacgaacgattttccccaacgaaataccgaatttaaactactcgccaaaaccgcgaatacgctattcttcgacgtcatcgctcacccacaacgtacgttacatatcgatatcgataaaaccaaacgaaaccacattacaacgcacgccgctacccgccaattccaacccgacgctcaacgccaaacttttcaacgcc

SEQ ID NO: 5483 - DNA, 771 bp, Artificial Sequence
  chemically treated genomic DNA (Homo sapiens) CpG-island No: 5483
ttcgattatttcgttaatcgagtttttttgtaattttatttaattttgtcgggtttattttaaaattgtcgtatttagtcgataagtgtagtaacgtcgtttttgtttatcgaaaacgacgattttttagttttgattttgtcgattaagatgtagcggttggtagacgtcgggtattttttttttagatatcggtcgatgttgtgttgtataaagttttgtgtttattatatattgttcgtcgcgggttattataaattcggttatcgattttagcgttttcgttagcgtcgtcgacgcgtcgttatgtagtaaatcgaacggttgatgagtacgggtattaatcggtatttcggtttttagtatattatcgtttagacgggtatatataatttttagatgcgttattattgtgttatcgttggtggcgtttagttcgtcgagcgttaaatggcgtttttagattatgtttatgtttttagcgttgagtcgttatcgattataatattttgtagggtaatatggttggcgaggttagaggcgaggaataaaatcgtgttggcgattttttgtggacgggcgattttttttagcggaatgtcgagtttaaattgttcgttaaagtcgcgaatacgttgtttttcggcgttatcgtttatttatagcgtgcgttgtatatcggtgtcggtggagttaggcgaaattatattatagcgtacgtcgttattcgttagttttagttcgacgtttaacgttaggttttttagcgtt

SEQ ID NO: 5484 - DNA, 771 bp, Artificial Sequence
  chemically treated genomic DNA (Homo sapiens) CpG-island No: 5484
aacgctaaaaaacctaacgttaaacgtcgaactaaaactaacgaataacgacgtacgctataatataatttcgcctaactccaccgacaccgatatacaacgcacgctataaataaacgataacgccgaaaaacaacgtattcgcgactttaacgaacaatttaaactcgacattccgctaaaaaaaatcgcccgtccacaaaaaatcgccaacacgattttattcctcgcctctaacctcgccaaccatattaccctacaaaatattataatcgataacgactcaacgctaaaaacataaacataatctaaaaacgccatttaacgctcgacgaactaaacgccaccaacgataacacaataataacgcatctaaaaattatatatacccgtctaaacgataatatactaaaaaccgaaataccgattaatacccgtactcatcaaccgttcgatttactacataacgacgcgtcgacgacgctaacgaaaacgctaaaatcgataaccgaatttataataacccgcgacgaacaatatataataaacacaaaactttatacaacacaacatcgaccgatatctaaaaaaaaaatacccgacgtctaccaaccgctacatcttaatcgacaaaatcaaaactaaaaaatcgtcgttttcgataaacaaaaacgacgttactacacttatcgactaaatacgacaattttaaaataaacccgacaaaattaaataaaattacaaaaaaactcgattaacgaaataatcgaa

SEQ ID NO: 5485 - DNA, 1131 bp, Artificial Sequence
  chemically treated genomic DNA (Homo sapiens) CpG-island No: 5485
tttttcgtgttgataagcgttagcgataggtcgcgatggtcgtagtggtataggtggatttttcgcgtcggcgtgtatatcgggtttatttggttttgtatttgttttatcgttaggtcgtacgatgttagttagcggcggttttttttatttattcggttagttaggattttattttttagtcggtcgagtatttgtattagtatcggcgggaatattatattgttatcgttttcgtcgtcggattgttgaagcgtattcgttaggttgcggcgttgcgttttcgttagtttatcggtggcggttttaattttgatgagtggcgtgaagtttttcggttgataaatcgtttggatgcgggttttgtcgttttgtatcgtggttaggcggtcgtcgttttagtcgtattaggttatttgcggttttcgtgatagcgatatttagttcgttaggtttcgtttacgtcgttatattcgttttgttattttgcggtttagcgggtcgtaaagatagcggttttcgattagcggttttgtatattgtgttcgcgtgtagtgtattagtcggtgttgattgtcgtaatggtatcggtgggtgcgtttattattcgtgcggataatttttttcgggatgaggtcggttttttttgttagtttgtcgtgacggttatatcggtaaagatagtgcgcgttacgggcgatacggttattcggttatatgttgagggtgttgttcgggtgtagtttcgggtcgggtaggcggttatttgtcgggtttgtggtatacgggatgcggatatttagattcgttgcggtggtgtgaacgtcggttagtttggcggtggtgttgtagttgtgattttcggtttggcggcggttgttgatgtcgatgagttcgtcggtgtcgttttacgtgtgacgcggtcgatagtagcggttacgtgttggtcgtaattgtcgacggggtaaaaggggggattataaggagaaacgagtaagataatttgataagaggacgcggtgtattttaatcgagggttgtgtatatagttgtcgtaaaagaggcggggtataaaatatcgggagaggcgatatatataattatcgttatagttgtgttgttaagtacgtg

SEQ ID NO: 5486 - DNA, 1131 bp, Artificial Sequence
  chemically treated genomic DNA (Homo sapiens) CpG-island No: 5486
cacgtacttaacaacacaactataacgataattatatatatcgcctctcccgatattttataccccgcctcttttacgacaactatatacacaaccctcgattaaaatacaccgcgtcctcttatcaaattatcttactcgtttctccttataatccccccttttaccccgtcgacaattacgaccaacacgtaaccgctactatcgaccgcgtcacacgtaaaacgacaccgacgaactcatcgacatcaacaaccgccgccaaaccgaaaatcacaactacaacaccaccgccaaactaaccgacgttcacaccaccgcaacgaatctaaatatccgcatcccgtataccacaaacccgacaaataaccgcctacccgacccgaaactacacccgaacaacaccctcaacatataaccgaataaccgtatcgcccgtaacgcgcactatctttaccgatataaccgtcacgacaaactaacaaaaaaaaccgacctcatcccgaaaaaaattatccgcacgaataataaacgcacccaccgataccattacgacaatcaacaccgactaatacactacacgcgaacacaatatacaaaaccgctaatcgaaaaccgctatctttacgacccgctaaaccgcaaaataacaaaacgaatataacgacgtaaacgaaacctaacgaactaaatatcgctatcacgaaaaccgcaaataacctaatacgactaaaacgacgaccgcctaaccacgatacaaaacgacaaaacccgcatccaaacgatttatcaaccgaaaaacttcacgccactcatcaaaattaaaaccgccaccgataaactaacgaaaacgcaacgccgcaacctaacgaatacgcttcaacaatccgacgacgaaaacgataacaatataatattcccgccgatactaatacaaatactcgaccgactaaaaaataaaatcctaactaaccgaataaataaaaaaaaccgccgctaactaacatcgtacgacctaacgataaaacaaatacaaaaccaaataaacccgatatacacgccgacgcgaaaaatccacctataccactacgaccatcgcgacctatcgctaacgcttatcaacacgaaaaa

SEQ ID NO: 5487 - DNA, 1131 bp, Artificial Sequence
  chemically treated genomic DNA (Homo sapiens) CpG-island No: 5487
tacgtgtttgataatataattatagcggtggttatatatatcgtttttttcggtgttttgtatttcgttttttttgcggtagttatgtgtataattttcggttggaatatatcgcgtttttttgttaggttattttgttcgtttttttttatgatttttttttttatttcgtcggtagttacggttagtacgtaatcgttgttgtcgatcgcgttatacgtgggacgatatcggcgaatttatcggtattagtagtcgtcgttagatcgggagttatagttatagtattatcgttaggttgatcggcgtttatattatcgtagcgaatttgaatattcgtatttcgtatgttatagattcggtaggtaatcgtttgttcgattcggagttgtattcggatagtatttttagtatgtggtcggataatcgtatcgttcgtgacgcgtattatttttatcggtatgatcgttacggtaggttgatagagaaaatcgattttatttcggaaggggttattcgtacggatgatgagcgtatttatcggtattattacgatagttagtatcggttggtgtattatacgcggatataatatgtagagtcgttggtcgaaagtcgttatttttacgattcgttgggtcgtagggtggtaaaacgggtgtggcggcgtgaacgggatttgacgggttggatgtcgttgttacggaaatcgtaagtgatttggtacggttgggacggcgatcgtttgattacgatatagaacgatagaattcgtatttagacgatttattagtcggggagttttacgttatttattagagttgaaatcgttatcggtgagttggcgaaaacgtagcgtcgtagtttggcggatgcgttttagtagttcggcggcgaagacggtggtagtgtggtgttttcgtcggtgttggtgtagatgttcgatcggttggaaagtgaaattttggttgatcgggtgagtgaggaaagtcgtcgttggttggtatcgtgcggtttgacggtggagtagatgtaaaattagatggattcggtgtatacgtcggcgcgaaaaatttatttgtattattgcgattatcgcggtttgtcgttggcgtttgttagtacgggaag

SEQ ID NO: 5488 - DNA, 1131 bp, Artificial Sequence
  chemically treated genomic DNA (Homo sapiens) CpG-island No: 5488
cttcccgtactaacaaacgccaacgacaaaccgcgataatcgcaataatacaaataaatttttcgcgccgacgtatacaccgaatccatctaattttacatctactccaccgtcaaaccgcacgataccaaccaacgacgactttcctcactcacccgatcaaccaaaatttcactttccaaccgatcgaacatctacaccaacaccgacgaaaacaccacactaccaccgtcttcgccgccgaactactaaaacgcatccgccaaactacgacgctacgttttcgccaactcaccgataacgatttcaactctaataaataacgtaaaactccccgactaataaatcgtctaaatacgaattctatcgttctatatcgtaatcaaacgatcgccgtcccaaccgtaccaaatcacttacgatttccgtaacaacgacatccaacccgtcaaatcccgttcacgccgccacacccgttttaccaccctacgacccaacgaatcgtaaaaataacgactttcgaccaacgactctacatattatatccgcgtataatacaccaaccgatactaactatcgtaataataccgataaatacgctcatcatccgtacgaataaccccttccgaaataaaatcgattttctctatcaacctaccgtaacgatcataccgataaaaataatacgcgtcacgaacgatacgattatccgaccacatactaaaaatactatccgaatacaactccgaatcgaacaaacgattacctaccgaatctataacatacgaaatacgaatattcaaattcgctacgataatataaacgccgatcaacctaacgataatactataactataactcccgatctaacgacgactactaataccgataaattcgccgatatcgtcccacgtataacgcgatcgacaacaacgattacgtactaaccgtaactaccgacgaaataaaaaaaaaaatcataaaaaaaaacgaacaaaataacctaacaaaaaaacgcgatatattccaaccgaaaattatacacataactaccgcaaaaaaaacgaaatacaaaacaccgaaaaaaacgatatatataaccaccgctataattatattatcaaacacgta

SEQ ID NO: 5489 - DNA, 537 bp, Artificial Sequence
  chemically treated genomic DNA (Homo sapiens) CpG-island No: 5489
aagcgagtgttcggggtttttcgtggtgattatttttttttttcggatgatcggcgatttatatttttagaagggtgtttaagcgtattattgtgtcggttggtgcgggaaataaggtttaattcggtgcggcgtggggaatcgtatattatttaggttatagtgcggtgtacggaggtgacgaggtgcgggttattgtcgtttaggcgtgtatatcgcgggtgtggggtgggtaagtgagatttttttgggcgtagaggtgggagtcggatttgcgtttttcgcggtagttcgaatggtttttacgttgtggtcgtgtagagtatagattgcggacggtagaggcgttttgggtgtttatagtgggtgtaatttgcgcggtgtaaagtgttaattttgttttcgttttcgttggttataggtgtggttatagatgtgataagtcggttttttttacgaggttgcggcggagagtgtggtatagggttatttagattattttttataaatgtagttaaggtttgttaaataataaga

SEQ ID NO: 5490 - DNA, 537 bp, Artificial Sequence
  chemically treated genomic DNA (Homo sapiens) CpG-island No: 5490
tcttattatttaacaaaccttaactacatttataaaaaataatctaaataaccctataccacactctccgccgcaacctcgtaaaaaaaaccgacttatcacatctataaccacacctataaccaacgaaaacgaaaacaaaattaacactttacaccgcgcaaattacacccactataaacacccaaaacgcctctaccgtccgcaatctatactctacacgaccacaacgtaaaaaccattcgaactaccgcgaaaaacgcaaatccgactcccacctctacgcccaaaaaaatctcacttacccaccccacacccgcgatatacacgcctaaacgacaataacccgcacctcgtcacctccgtacaccgcactataacctaaataatatacgattccccacgccgcaccgaattaaaccttatttcccgcaccaaccgacacaataatacgcttaaacacccttctaaaaatataaatcgccgatcatccgaaaaaaaaaaataatcaccacgaaaaaccccgaacactcgctt

SEQ ID NO: 5491 - DNA, 537 bp, Artificial Sequence
  chemically treated genomic DNA (Homo sapiens) CpG-island No: 5491
ttttattgtttgatagattttagttgtatttgtaaaaggtggtttagatggttttatgttatatttttcgtcgtaatttcgtgaggagagtcggtttattatatttataattatatttgtaattagcgaaagcgggggtagggttgatattttgtatcgcgtaggttgtatttattataaatatttaaagcgtttttgtcgttcgtaatttatgttttatacggttatagcgtaagaattattcgaattgtcgcgaagggcgtagattcgatttttatttttgcgtttaggagggttttatttatttattttatattcgcggtgtatacgtttgagcgatagtggttcgtatttcgttattttcgtatatcgtattgtgatttgaataatatacggttttttacgtcgtatcgggttgagttttgtttttcgtattaatcggtataatgatgcgtttaagtatttttttaggaatataaatcgtcggttattcggggagagggggtagttattacgaagagtttcgggtattcgttt

SEQ ID NO: 5492 - DNA, 537 bp, Artificial Sequence
  chemically treated genomic DNA (Homo sapiens) CpG-island No: 5492
aaacgaatacccgaaactcttcgtaataactaccccctctccccgaataaccgacgatttatattcctaaaaaaatacttaaacgcatcattataccgattaatacgaaaaacaaaactcaacccgatacgacgtaaaaaaccgtatattattcaaatcacaatacgatatacgaaaataacgaaatacgaaccactatcgctcaaacgtatacaccgcgaatataaaataaataaataaaaccctcctaaacgcaaaaataaaaatcgaatctacgcccttcgcgacaattcgaataattcttacgctataaccgtataaaacataaattacgaacgacaaaaacgctttaaatatttataataaatacaacctacgcgatacaaaatatcaaccctacccccgctttcgctaattacaaatataattataaatataataaaccgactctcctcacgaaattacgacgaaaaatataacataaaaccatctaaaccaccttttacaaatacaactaaaatctatcaaacaataaaa

SEQ ID NO: 5493 - DNA, 572 bp, Artificial Sequence
  chemically treated genomic DNA (Homo sapiens) CpG-island No: 5493
atttacgagagatataaaatgtacgtttttacgttatattttttttatttcgtaatgggttaagattgttaataggtaggttatttcgtagcgttcgcggagttgtaggttcgttttcgttagggtgtggcgttgtttttttggcgttgggcgggggaggaggggcgcgcggcggtcgaggaggggcgcgcggcggtcgggcggggcgagcggaggcgagtggaggacgcgtagacgcgtcgcggttttcgtttgtcgttgtttcgtcgtagtcgtcgttttagtttattcggtattaggaatagtttcgagcggcgagacggttttcgttatgtttgcggttatgagggagaggttcgatcggtttttgtacgagaagaattgtatgattgattttttggttaagttcgaggttaaaatcggcgtgaataggagttttatcgtttttggtgggtggtcgggggtcgtcgtcgttggtagggttacgggagtcgtcgttgttttagttgttggggaaggaagtagggagaggattcgggaaaggtggagtcggagatagacgggataagtag

SEQ ID NO: 5494 - DNA, 572 bp, Artificial Sequence
  chemically treated genomic DNA (Homo sapiens) CpG-island No: 5494
ctacttatcccgtctatctccgactccacctttcccgaatcctctccctacttccttccccaacaactaaaacaacgacgactcccgtaaccctaccaacgacgacgacccccgaccacccaccaaaaacgataaaactcctattcacgccgattttaacctcgaacttaaccaaaaaatcaatcatacaattcttctcgtacaaaaaccgatcgaacctctccctcataaccgcaaacataacgaaaaccgtctcgccgctcgaaactattcctaataccgaataaactaaaacgacgactacgacgaaacaacgacaaacgaaaaccgcgacgcgtctacgcgtcctccactcgcctccgctcgccccgcccgaccgccgcgcgcccctcctcgaccgccgcgcgcccctcctcccccgcccaacgccaaaaaaacaacgccacaccctaacgaaaacgaacctacaactccgcgaacgctacgaaataacctacctattaacaatcttaacccattacgaaataaaaaaaatataacgtaaaaacgtacattttatatctctcgtaaat

SEQ ID NO: 5495 - DNA, 572 bp, Artificial Sequence
  chemically treated genomic DNA (Homo sapiens) CpG-island No: 5495
ttgtttgtttcgtttgttttcgattttatttttttcgagttttttttttgtttttttttttagtagttggggtagcggcggttttcgtggttttattagcggcggcgattttcggttatttattaagagcgatgaagtttttgtttacgtcggttttggtttcgagtttggttagaaggttagttatgtagtttttttcgtgtaggaatcggtcgaattttttttttatggtcgtagatatggcggggatcgtttcgtcgttcggggttgtttttagtgtcggatagattggagcggcgattgcggcggagtagcggtaggcggggatcgcggcgcgtttacgcgttttttattcgttttcgttcgtttcgttcggtcgtcgcgcgttttttttcggtcgtcgcgcgttttttttttttcgtttagcgttagggggatagcgttatattttggcgggggcgggtttgtaatttcgcggacgttgcgaggtggtttgtttgttgatagttttaatttattgcggggtaaaaaggatgtggcgtgggggcgtgtattttgtgtttttcgtgggt

SEQ ID NO: 5496 - DNA, 572 bp, Artificial Sequence
  chemically treated genomic DNA (Homo sapiens) CpG-island No: 5496
acccacgaaaaacacaaaatacacgcccccacgccacatcctttttaccccgcaataaattaaaactatcaacaaacaaaccacctcgcaacgtccgcgaaattacaaacccgcccccgccaaaatataacgctatccccctaacgctaaacgaaaaaaaaaaaacgcgcgacgaccgaaaaaaaacgcgcgacgaccgaacgaaacgaacgaaaacgaataaaaaacgcgtaaacgcgccgcgatccccgcctaccgctactccgccgcaatcgccgctccaatctatccgacactaaaaacaaccccgaacgacgaaacgatccccgccatatctacgaccataaaaaaaaaattcgaccgattcctacacgaaaaaaactacataactaaccttctaaccaaactcgaaaccaaaaccgacgtaaacaaaaacttcatcgctcttaataaataaccgaaaatcgccgccgctaataaaaccacgaaaaccgccgctaccccaactactaaaaaaaaaaacaaaaaaaaaactcgaaaaaaataaaatcgaaaacaaacgaaacaaacaa

SEQ ID NO: 5497 - DNA, 540 bp, Artificial Sequence
  chemically treated genomic DNA (Homo sapiens) CpG-island No: 5497
ggaggtcgcggagcggagaagcgcggtgtagtatttgtagtattatagtaagtttttttttttcggaggatttatcgttttagaatttatttgttttggtcggtcggggatcgcgcggtagcgtaagttatttttataagagttttaataatttaggagtcgtagggagaaattcggtagaaattcgggaggaattcggttttgagttttcgagatagttcgttttttcgtcggaagttttgtttaagaaatggtgtcgcgttcgcgattttttatcgtttgtttgtttcggtatttgtcgttcggcgttaggatttttagtttttgacgtggtatgaagattttttttttcgcgagagaattatgaaagttttttattttttttttaagtcgggaagattatgtggggcgtatgtatcgttattaaaaagggtttaatttcgattttttttcgtttttagttttttagcgagtatgggtggtattagttattttttgttaaggggcgaagattgtgttacgaggggaatttgtgtggtt

SEQ ID NO: 5498 - DNA, 540 bp, Artificial Sequence
  chemically treated genomic DNA (Homo sapiens) CpG-island No: 5498
aaccacacaaattcccctcgtaacacaatcttcgccccttaacaaaaaataactaataccacccatactcgctaaaaaactaaaaacgaaaaaaaatcgaaattaaaccctttttaataacgatacatacgccccacataatcttcccgacttaaaaaaaaaataaaaaactttcataattctctcgcgaaaaaaaaaatcttcataccacgtcaaaaactaaaaatcctaacgccgaacgacaaataccgaaacaaacaaacgataaaaaatcgcgaacgcgacaccatttcttaaacaaaacttccgacgaaaaaacgaactatctcgaaaactcaaaaccgaattcctcccgaatttctaccgaatttctccctacgactcctaaattattaaaactcttataaaaataacttacgctaccgcgcgatccccgaccgaccaaaacaaataaattctaaaacgataaatcctccgaaaaaaaaaaacttactataatactacaaatactacaccgcgcttctccgctccgcgacctcc

SEQ ID NO: 5499 - DNA, 540 bp, Artificial Sequence
  chemically treated genomic DNA (Homo sapiens) CpG-island No: 5499
aattatatagatttttttcgtggtatagttttcgttttttaatagagagtagttagtattatttatattcgttgagaaattggaaacgagggagggtcgaagttaaattttttttagtggcggtgtatgcgttttatatggttttttcggtttgggaaaggaatgagaagtttttatgattttttcgcgagaagggaagtttttatgttacgttagagattagagattttggcgtcgagcgataggtgtcggaataaataggcgatgagaaatcgcggacgcggtattattttttgggtaggattttcggcggaaaagcgggttgtttcggaaatttagagtcgggtttttttcgggtttttgtcgggtttttttttgcggtttttgggttgttgagatttttgtgaagatggtttgcgttgtcgcgcggttttcggtcgattaggataggtgggttttgaggcggtgggtttttcgaaaggaaggggtttgttgtggtgttgtaggtgttatatcgcgttttttcgtttcgcggttttt

SEQ ID NO: 5500 - DNA, 540 bp, Artificial Sequence
  chemically treated genomic DNA (Homo sapiens) CpG-island No: 5500
aaaaaccgcgaaacgaaaaaacgcgatataacacctacaacaccacaacaaaccccttcctttcgaaaaacccaccgcctcaaaacccacctatcctaatcgaccgaaaaccgcgcgacaacgcaaaccatcttcacaaaaatctcaacaacccaaaaaccgcaaaaaaaaacccgacaaaaacccgaaaaaaacccgactctaaatttccgaaacaacccgcttttccgccgaaaatcctacccaaaaaataataccgcgtccgcgatttctcatcgcctatttattccgacacctatcgctcgacgccaaaatctctaatctctaacgtaacataaaaacttcccttctcgcgaaaaaatcataaaaacttctcattcctttcccaaaccgaaaaaaccatataaaacgcatacaccgccactaaaaaaaatttaacttcgaccctccctcgtttccaatttctcaacgaatataaataatactaactactctctattaaaaaacgaaaactataccacgaaaaaaatctatataatt

SEQ ID NO: 5501 - DNA, 950 bp, Artificial Sequence
  chemically treated genomic DNA (Homo sapiens) CpG-island No: 5501
tcgtatcgtcgtgtttttcggtttaagttttaatattcgggcgaattggcgtgttttattagttcggtagtatgaattattattcgttagttattttattggagacgacggaagatcgttgtcgaagcggcgttttatcgtttttagtatgacgttttgtattgttttattgttgaagtcgtcggtagtgatcgtttagtgtagtgttttacgattatagtagtttagcgcgaacgtgatacgtagttttttttcgttattatagtagaattcgaattcgttagagtattatcgttgattgtttttttttacggttattttgtttgtatgtgttcgtttcgatggcggtatagtaggttttcgtttaagtaatagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcggttatttatttagttatcggttcgtttgagaatgacgtgtaattgcgtacgcgatattcggagataacggttgattaagtttatttcgtttatttttaggagggattttcgtagagattgatttgttaggcgatgcggagcgttggttattggatcggtcgtgatacgagagttagtgacgtgggtaaaatttatgtgcgttattttaagtttaattagtttttgttatgtatattttcgcgttgtcgttaagcgtaggtaggtaattagtagtaaggacggcgtcgtttattcgaattagtttcgttttacgaattagatatgcggcgaagatcgtgtatatggtagtatagtggtagtttttggattgttgtgtgattattttttcgtatgacgat

SEQ ID NO: 5502 - DNA, 950 bp, Artificial Sequence
  chemically treated genomic DNA (Homo sapiens) CpG-island No: 5502
atcgtcatacgaaaaaataatcacacaacaatccaaaaactaccactatactaccatatacacgatcttcgccgcatatctaattcgtaaaacgaaactaattcgaataaacgacgccgtccttactactaattacctacctacgcttaacgacaacgcgaaaatatacataacaaaaactaattaaacttaaaataacgcacataaattttacccacgtcactaactctcgtatcacgaccgatccaataaccaacgctccgcatcgcctaacaaatcaatctctacgaaaatccctcctaaaaataaacgaaataaacttaatcaaccgttatctccgaatatcgcgtacgcaattacacgtcattctcaaacgaaccgataactaaataaataaccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctattacttaaacgaaaacctactataccgccatcgaaacgaacacatacaaacaaaataaccgtaaaaaaaaacaatcaacgataatactctaacgaattcgaattctactataataacgaaaaaaaactacgtatcacgttcgcgctaaactactataatcgtaaaacactacactaaacgatcactaccgacgacttcaacaataaaacaatacaaaacgtcatactaaaaacgataaaacgccgcttcgacaacgatcttccgtcgtctccaataaaataactaacgaataataattcatactaccgaactaataaaacacgccaattcgcccgaatattaaaacttaaaccgaaaaacacgacgatacga

SEQ ID NO: 5503 - DNA, 950 bp, Artificial Sequence
  chemically treated genomic DNA (Homo sapiens) CpG-island No: 5503
gtcgttatacggaagaataattatatagtagtttaaggattgttattgtattgttatgtgtacgattttcgtcgtatatttagttcgtggaacggagttgattcgggtagacggcgtcgtttttgttgttagttatttgtttacgtttggcgataacgcggggatgtgtatagtaaggattgattaagtttagggtaacgtatatgggttttatttacgttattgattttcgtattacgatcggtttagtgattaacgtttcgtatcgtttagtaggttagtttttacgaggattttttttggggataggcggagtaagtttagttagtcgttgttttcgggtgtcgcgtgcgtagttgtacgttatttttagacgaatcgatgattggatggatggtcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttgttgtttgagcgaaaatttgttgtatcgttatcgaaacgggtatatataggtagagtggtcgtgaaagaaagtaattagcgatggtgttttgacgggttcgagttttgttgtgataacggagagagattgcgtgttacgttcgcgttggattgttgtgatcgtgaggtattgtattgggcggttattatcggcggttttaatagtgaaatagtataggacgttatgttgggagcggtggaacgtcgtttcggtaacgatttttcgtcgtttttagtggagtggttgacggataatggtttatgttatcgggttaatgaaatacgttagttcgttcggatgttgggatttgaatcgaagaatacggcggtgcgg

SEQ ID NO: 5504 - DNA, 950 bp, Artificial Sequence
  chemically treated genomic DNA (Homo sapiens) CpG-island No: 5504
ccgcaccgccgtattcttcgattcaaatcccaacatccgaacgaactaacgtatttcattaacccgataacataaaccattatccgtcaaccactccactaaaaacgacgaaaaatcgttaccgaaacgacgttccaccgctcccaacataacgtcctatactatttcactattaaaaccgccgataataaccgcccaatacaatacctcacgatcacaacaatccaacgcgaacgtaacacgcaatctctctccgttatcacaacaaaactcgaacccgtcaaaacaccatcgctaattactttctttcacgaccactctacctatatatacccgtttcgataacgatacaacaaattttcgctcaaacaacaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaccatccatccaatcatcgattcgtctaaaaataacgtacaactacgcacgcgacacccgaaaacaacgactaactaaacttactccgcctatccccaaaaaaaatcctcgtaaaaactaacctactaaacgatacgaaacgttaatcactaaaccgatcgtaatacgaaaatcaataacgtaaataaaacccatatacgttaccctaaacttaatcaatccttactatacacatccccgcgttatcgccaaacgtaaacaaataactaacaacaaaaacgacgccgtctacccgaatcaactccgttccacgaactaaatatacgacgaaaatcgtacacataacaatacaataacaatccttaaactactatataattattcttccgtataacgac

SEQ ID NO: 5505 - DNA, 519 bp, Artificial Sequence
  chemically treated genomic DNA (Homo sapiens) CpG-island No: 5505
gcggcggcggcggatgagttgggacgcgtgtttttcgtatttagttatattatgtaaaaattggaagaagagttggatgtggtgttgtttgatcgttcgggttatcgtattaaatttattaatgtcgggaggatgttgttggagcgaaggcgcgtttagttggaagtcgtagataaattgattattgatgcggaagttttcgcgcgcgggtgggaaacgtattttattttgtgatcgaagcgttggtatcgatatttgtttttttttcgttaatcgataaattggcggtaaaagttaatatttaattggtaattattatagaagtgttggcgggggcgtgggaacggttggagtaggggcgggcggaaattgtatcgcgtcggatatgtattttcgtttttcgtcggagattaattcgcgtaagttttatacgttaatgaacgtttacgttgtcgcgtttgattattcgatttattaggagtcggaatcgtaatttgaagtgacgcgtgtgaaatatcg

SEQ ID NO: 5506 - DNA, 519 bp, Artificial Sequence
  chemically treated genomic DNA (Homo sapiens) CpG-island No: 5506
cgatatttcacacgcgtcacttcaaattacgattccgactcctaataaatcgaataatcaaacgcgacaacgtaaacgttcattaacgtataaaacttacgcgaattaatctccgacgaaaaacgaaaatacatatccgacgcgatacaatttccgcccgcccctactccaaccgttcccacgcccccgccaacacttctataataattaccaattaaatattaacttttaccgccaatttatcgattaacgaaaaaaaaacaaatatcgataccaacgcttcgatcacaaaataaaatacgtttcccacccgcgcgcgaaaacttccgcatcaataatcaatttatctacgacttccaactaaacgcgccttcgctccaacaacatcctcccgacattaataaatttaatacgataacccgaacgatcaaacaacaccacatccaactcttcttccaatttttacataatataactaaatacgaaaaacacgcgtcccaactcatccgccgccgccgc

SEQ ID NO: 5507 - DNA, 519 bp, Artificial Sequence
  chemically treated genomic DNA (Homo sapiens) CpG-island No: 5507
cgatattttatacgcgttattttagattacggtttcggtttttgatgaatcgggtgattaggcgcggtaacgtagacgtttattaacgtatagagtttgcgcgagttgattttcgacgaggaacgaaaatgtatattcggcgcgatataattttcgttcgtttttgttttagtcgtttttacgttttcgttagtatttttgtgatgattgttagttgggtattggtttttgtcgttagtttgtcgattaacgggaaaaaggtaggtgtcggtattagcgtttcggttataaggtgaaatgcgttttttattcgcgcgcgagagttttcgtattagtagttagtttatttgcggtttttagttaaacgcgttttcgttttaataatattttttcgatattggtgaatttggtacgatggttcgagcggttaaatagtattatatttagttttttttttagtttttgtatggtgtagttaagtgcggaaggtacgcgttttagtttattcgtcgtcgtcgt

SEQ ID NO: 5508 - DNA, 519 bp, Artificial Sequence
  chemically treated genomic DNA (Homo sapiens) CpG-island No: 5508
acgacgacgacgaataaactaaaacgcgtaccttccgcacttaactacaccatacaaaaactaaaaaaaaaactaaatataatactatttaaccgctcgaaccatcgtaccaaattcaccaatatcgaaaaaatattattaaaacgaaaacgcgtttaactaaaaaccgcaaataaactaactactaatacgaaaactctcgcgcgcgaataaaaaacgcatttcaccttataaccgaaacgctaataccgacacctacctttttcccgttaatcgacaaactaacgacaaaaaccaatacccaactaacaatcatcacaaaaatactaacgaaaacgtaaaaacgactaaaacaaaaacgaacgaaaattatatcgcgccgaatatacattttcgttcctcgtcgaaaatcaactcgcgcaaactctatacgttaataaacgtctacgttaccgcgcctaatcacccgattcatcaaaaaccgaaaccgtaatctaaaataacgcgtataaaatatcg

SEQ ID NO: 5509 - DNA, 514 bp, Artificial Sequence
  chemically treated genomic DNA (Homo sapiens) CpG-island No: 5509
tcggagcgaatattgcgcgaaggattgcgttaggtagtgtcgcgttcggcggtttttcgtgcgttgacgtaggtagggttggtgttgcgatcgtttttatcggaataggttagagtaaaattgtttgttgaaacggtgaaagttaaatcgcgttcgtcgttgcgttataagcgtcgggttttaatgttggaaggttgcgtttagtttacgttttcgtttaatattacgcggtaattgcgcgagtgttggatcgtttggggattagcgttatgttagttaacgaagtaggttgttgtggcgcggtggattattattttaatgcgtaggagaaagggttggtacgggcgcgtaataatattgatgtttggtggttcgcgattgaagtaggtgtcgaggtaattttgtaaatcgttagcggttgcggcgcgtttgttaaagagtatgggtagatgttgaaaaacgatgcgttatatgtcgataaagtacgttaggttagtgaattggcggtcgattt

SEQ ID NO: 5510 - DNA, 514 bp, Artificial Sequence
  chemically treated genomic DNA (Homo sapiens) CpG-island No: 5510
aaatcgaccgccaattcactaacctaacgtactttatcgacatataacgcatcgtttttcaacatctacccatactctttaacaaacgcgccgcaaccgctaacgatttacaaaattacctcgacacctacttcaatcgcgaaccaccaaacatcaatattattacgcgcccgtaccaaccctttctcctacgcattaaaataataatccaccgcgccacaacaacctacttcgttaactaacataacgctaatccccaaacgatccaacactcgcgcaattaccgcgtaatattaaacgaaaacgtaaactaaacgcaaccttccaacattaaaacccgacgcttataacgcaacgacgaacgcgatttaactttcaccgtttcaacaaacaattttactctaacctattccgataaaaacgatcgcaacaccaaccctacctacgtcaacgcacgaaaaaccgccgaacgcgacactacctaacgcaatccttcgcgcaatattcgctccga

SEQ ID NO: 5511 - DNA, 514 bp, Artificial Sequence
  chemically treated genomic DNA (Homo sapiens) CpG-island No: 5511
aaatcgatcgttagtttattgatttgacgtgttttatcggtatataacgtatcgttttttagtatttgtttatattttttgataaacgcgtcgtagtcgttggcggtttgtaaaattgtttcggtatttgttttaatcgcgggttattaggtattaatattattgcgcgttcgtgttagtttttttttttgcgtattaagatgatagtttatcgcgttataatagtttgtttcgttagttggtatgacgttgatttttagacgatttagtattcgcgtagttgtcgcgtggtgttgggcgaaagcgtaggttgggcgtagttttttaatattaaaattcgacgtttatggcgtagcggcggacgcggtttagtttttatcgttttagtaggtagttttgttttgatttgtttcggtaaaaacggtcgtagtattagttttatttgcgttagcgtacggaagatcgtcggacgcggtattatttggcgtaatttttcgcgtagtattcgtttcgg

SEQ ID NO: 5512 - DNA, 514 bp, Artificial Sequence
  chemically treated genomic DNA (Homo sapiens) CpG-island No: 5512
ccgaaacgaatactacgcgaaaaattacgccaaataataccgcgtccgacgatcttccgtacgctaacgcaaataaaactaatactacgaccgtttttaccgaaacaaatcaaaacaaaactacctactaaaacgataaaaactaaaccgcgtccgccgctacgccataaacgtcgaattttaatattaaaaaactacgcccaacctacgctttcgcccaacaccacgcgacaactacgcgaatactaaatcgtctaaaaatcaacgtcataccaactaacgaaacaaactattataacgcgataaactatcatcttaatacgcaaaaaaaaaaactaacacgaacgcgcaataatattaatacctaataacccgcgattaaaacaaataccgaaacaattttacaaaccgccaacgactacgacgcgtttatcaaaaaatataaacaaatactaaaaaacgatacgttatataccgataaaacacgtcaaatcaataaactaacgatcgattt

SEQ ID NO: 5513 - DNA, 1316 bp, Artificial Sequence
  chemically treated genomic DNA (Homo sapiens) CpG-island No: 5513
  misc_feature (207)..(208): n is either a, c, g or t
gtcgttagttcgcggtcggtaatgtcgttttcggttattacgcgatttatcgcgaggttaagttgttgtttaatttgggcgacgtttagttcgggtaaatcggtatcgtttcggcgtcggtttttttgtagggcgtgggcggcgtcgatcgttttttcgtttttttttacggtaacgtatattagtatatttttatatgagtggttnncgcggaatagttagtaggcgttcgttataggttaggattaggtcgatgtcgagcgggaacggatgcgggcgttcggtgagttcgtgtagaatgtatttcggtagttgcggagcgattattcgtttttcggtaatattcgtattagtaaggcgtaatatgcgttcgtcgtttaggttggcgatttgtaaaattagcgtcgtattcgttttcggcgtaacggcggtgtcggtggaaagggcgttgagttgttcgttggaaatcgttttattcgttatcgcgaaggtcgtttgtttcggttggttgattagcggcgcgttggtatgaaaacgtaggttttggttgacgatatcgttatttaatggggtagaaagttatatcggcgtgtcgttatcggttagcgttagtagtacgttggtggtggcgatatttagcggttgttagtcgcgtttgagttgatgtagggcgataattacgttcggttcgtttatggtttttaataggcgacgaaaattgtgttgggtattttgtacgggaagtataaaagcggtttttagggttatgcgttgttttcgcgaattatcgtaaagaagtcgattcggttggcgtttatttcggtttggcgtgcggtaatgcgtgttatacggttagcgtttagcggggtaataagggtttttgataagttttgaaagtggcgagattgttgtattagcgcgttaattagcgcgtagcgttcggcgtgttgtttattacgtttttgtatttagttgtagtcgagcgtgtcgttagttaggcgtacggcggcgcgggttagcgtggcgtcgtcggtaaaaaaacgttcgtcggtgtcgtttattcgcgtttgaatttgtattaggttagttttagcggcgcggattattttatagtcggcggtgatgtttagcgcgtttaggcgtgttgttagtttagtcggttggttgtgcgttagtacggatatttagtgttggcgggtcgcggtatttgcgtgtatttagtgttttatagtgaatttaattatgtcggcgcgcgtttaggttgacggagtatttcgtcggttggttttatcgtttcgcggttaggttgttacgtt

SEQ ID NO: 5514 - DNA, 1316 bp, Artificial Sequence
  chemically treated genomic DNA (Homo sapiens) CpG-island No: 5514
  misc_feature (1109)..(1110): n is either a, c, g or t
aacgtaacaacctaaccgcgaaacgataaaaccaaccgacgaaatactccgtcaacctaaacgcgcgccgacataattaaattcactataaaacactaaatacacgcaaataccgcgacccgccaacactaaatatccgtactaacgcacaaccaaccgactaaactaacaacacgcctaaacgcgctaaacatcaccgccgactataaaataatccgcgccgctaaaactaacctaatacaaattcaaacgcgaataaacgacaccgacgaacgtttttttaccgacgacgccacgctaacccgcgccgccgtacgcctaactaacgacacgctcgactacaactaaatacaaaaacgtaataaacaacacgccgaacgctacgcgctaattaacgcgctaatacaacaatctcgccactttcaaaacttatcaaaaacccttattaccccgctaaacgctaaccgtataacacgcattaccgcacgccaaaccgaaataaacgccaaccgaatcgacttctttacgataattcgcgaaaacaacgcataaccctaaaaaccgcttttatacttcccgtacaaaatacccaacacaattttcgtcgcctattaaaaaccataaacgaaccgaacgtaattatcgccctacatcaactcaaacgcgactaacaaccgctaaatatcgccaccaccaacgtactactaacgctaaccgataacgacacgccgatataactttctaccccattaaataacgatatcgtcaaccaaaacctacgttttcataccaacgcgccgctaatcaaccaaccgaaacaaacgaccttcgcgataacgaataaaacgatttccaacgaacaactcaacgccctttccaccgacaccgccgttacgccgaaaacgaatacgacgctaattttacaaatcgccaacctaaacgacgaacgcatattacgccttactaatacgaatattaccgaaaaacgaataatcgctccgcaactaccgaaatacattctacacgaactcaccgaacgcccgcatccgttcccgctcgacatcgacctaatcctaacctataacgaacgcctactaactattccgcgnnaaccactcatataaaaatatactaatatacgttaccgtaaaaaaaaacgaaaaaacgatcgacgccgcccacgccctacaaaaaaaccgacgccgaaacgataccgatttacccgaactaaacgtcgcccaaattaaacaacaacttaacctcgcgataaatcgcgtaataaccgaaaacgacattaccgaccgcgaactaacgac

SEQ ID NO: 5515 - DNA, 1316 bp, Artificial Sequence
  chemically treated genomic DNA (Homo sapiens) CpG-island No: 5515
  misc_feature (1109)..(1110): n is either a, c, g or t
ggcgtggtaatttaatcgcgggacggtgaaattagtcggcggagtatttcgttagtttagacgcgcgtcgatatgattgaatttattatggagtattgaatgtacgtagatatcgcgattcgttagtattggatgttcgtgttggcgtatagttaatcggttgaattggtagtacgtttgaacgcgttaaatattatcgtcgattatgaggtgattcgcgtcgttgaaattggtttggtatagatttaggcgcggatgggcggtatcggcgaacgtttttttgtcggcgacgttacgttgattcgcgtcgtcgtgcgtttgattgacggtacgttcggttatagttgggtgtaggggcgtgataaatagtacgtcgaacgttgcgcgttgattgacgcgttgatgtagtaatttcgttatttttaaaatttattagaaatttttattgtttcgttggacgttgatcgtatggtacgtattgtcgtacgttaggtcgaagtgaacgttagtcgggtcgatttttttacgatggttcgcggagataacgtatgattttggaaatcgtttttatgtttttcgtgtaggatgtttagtatagttttcgtcgtttgttaaaggttatgagcgagtcgggcgtgattgtcgttttgtattagtttaaacgcggttggtaatcgttgaatatcgttattattagcgtgttgttgacgttggtcgataacgatacgtcggtgtggttttttattttattaaataacgatatcgttaattagagtttgcgtttttatattaacgcgtcgttggttagttagtcggaataggcgattttcgcggtgacggatgaggcgatttttagcgaatagtttaacgttttttttatcggtatcgtcgttgcgtcggaagcgggtgcgacgttgattttataggtcgttagtttgagcggcggacgtatgttgcgttttattggtgcgggtattgtcgaagaacgaatgatcgtttcgtagttgtcggagtgtattttgtacgaatttatcgagcgttcgtattcgttttcgttcggtatcgatttgattttgatttgtggcgagcgtttgttggttatttcgcgnnaattatttatgtggaggtgtgttgatgtacgttgtcgtgaaagggggcgagaaggcgatcgacgtcgtttacgttttgtaagagagtcgacgtcgaggcgatatcgatttgttcgaattgagcgtcgtttagattgaatagtagtttaatttcgcggtagatcgcgtgatgatcgaaggcggtattgtcgatcgcgaattggcggt

SEQ ID NO: 5516 - DNA, 1316 bp, Artificial Sequence
  chemically treated genomic DNA (Homo sapiens) CpG-island No: 5516
  misc_feature (207)..(208): n is either a, c, g or t
accgccaattcgcgatcgacaataccgccttcgatcatcacgcgatctaccgcgaaattaaactactattcaatctaaacgacgctcaattcgaacaaatcgatatcgcctcgacgtcgactctcttacaaaacgtaaacgacgtcgatcgccttctcgccccctttcacgacaacgtacatcaacacacctccacataaataattnncgcgaaataaccaacaaacgctcgccacaaatcaaaatcaaatcgataccgaacgaaaacgaatacgaacgctcgataaattcgtacaaaatacactccgacaactacgaaacgatcattcgttcttcgacaatacccgcaccaataaaacgcaacatacgtccgccgctcaaactaacgacctataaaatcaacgtcgcacccgcttccgacgcaacgacgataccgataaaaaaaacgttaaactattcgctaaaaatcgcctcatccgtcaccgcgaaaatcgcctattccgactaactaaccaacgacgcgttaatataaaaacgcaaactctaattaacgatatcgttatttaataaaataaaaaaccacaccgacgtatcgttatcgaccaacgtcaacaacacgctaataataacgatattcaacgattaccaaccgcgtttaaactaatacaaaacgacaatcacgcccgactcgctcataacctttaacaaacgacgaaaactatactaaacatcctacacgaaaaacataaaaacgatttccaaaatcatacgttatctccgcgaaccatcgtaaaaaaatcgacccgactaacgttcacttcgacctaacgtacgacaatacgtaccatacgatcaacgtccaacgaaacaataaaaatttctaataaattttaaaaataacgaaattactacatcaacgcgtcaatcaacgcgcaacgttcgacgtactatttatcacgcccctacacccaactataaccgaacgtaccgtcaatcaaacgcacgacgacgcgaatcaacgtaacgtcgccgacaaaaaaacgttcgccgataccgcccatccgcgcctaaatctataccaaaccaatttcaacgacgcgaatcacctcataatcgacgataatatttaacgcgttcaaacgtactaccaattcaaccgattaactatacgccaacacgaacatccaatactaacgaatcgcgatatctacgtacattcaatactccataataaattcaatcatatcgacgcgcgtctaaactaacgaaatactccgccgactaatttcaccgtcccgcgattaaattaccacgcc

SEQ ID NO: 5517 - DNA, 504 bp, Artificial Sequence
  chemically treated genomic DNA (Homo sapiens) CpG-island No: 5517
  misc_feature (401)..(401): n is either a, c, g or t
  misc_feature (403)..(404): n is either a, c, g or t
gttgaatgtttggcggttaattaattagtaggtgattatcgtagtgatgcgttggcggttgaagagatattgacgttggcgaattggtgtttgtagaattatttcgggttgaaaacgttaatcgggagtgtattatgagtattttgattcgaggttgtttattcgtcggttacgtacggtttatcggcgtaacgcgagtacgacgttagtgcgtcgtttaaagcgagttcgttgtttggatatttgacggaattatacgtgtatatagtcgaggtatcgcgaataaacgttcgattagtatcgcgataggatcgggtattatacgtggttgtcgatcgtaaattatcgggttggtaaggattagggagcgttaagttagattgtggttttttgttcgtttntnntggaacgatagtatagacgtatcgcgcgacggatgtataagtaagatataatcgtagtatatatagagtaaatataacgcgagtaagaaataagaagacg

SEQ ID NO: 5518 - DNA, 504 bp, Artificial Sequence
  chemically treated genomic DNA (Homo sapiens) CpG-island No: 5518
  misc_feature (101)..(102): n is either a, c, g or t
  misc_feature (104)..(104): n is either a, c, g or t
cgtcttcttatttcttactcgcgttatatttactctatatatactacgattatatcttacttatacatccgtcgcgcgatacgtctatactatcgttccannanaaacgaacaaaaaaccacaatctaacttaacgctccctaatccttaccaacccgataatttacgatcgacaaccacgtataatacccgatcctatcgcgatactaatcgaacgtttattcgcgatacctcgactatatacacgtataattccgtcaaatatccaaacaacgaactcgctttaaacgacgcactaacgtcgtactcgcgttacgccgataaaccgtacgtaaccgacgaataaacaacctcgaatcaaaatactcataatacactcccgattaacgttttcaacccgaaataattctacaaacaccaattcgccaacgtcaatatctcttcaaccgccaacgcatcactacgataatcacctactaattaattaaccgccaaacattcaac

SEQ ID NO: 5519 - DNA, 504 bp, Artificial Sequence
  chemically treated genomic DNA (Homo sapiens) CpG-island No: 5519
  misc_feature (101)..(102): n is either a, c, g or t
  misc_feature (104)..(104): n is either a, c, g or t
cgtttttttgttttttgttcgcgttgtgtttgttttgtgtgtgttacggttgtgttttgtttgtgtattcgtcgcgcggtgcgtttgtgttatcgttttannangagcgagtagggagttatagtttagtttgacgttttttggtttttgttagttcggtggtttgcggtcgataattacgtgtgatattcggttttgtcgcggtgttaatcgaacgtttattcgcgatatttcggttgtgtatacgtataatttcgttaggtatttagatagcgagttcgttttaagcgacgtattggcgtcgtattcgcgttacgtcgataagtcgtgcgtgatcggcggataagtaatttcgggttaggatatttatgatgtattttcgattggcgtttttagttcggagtagttttataggtattagttcgttagcgttagtatttttttagtcgttagcgtattattgcgatagttatttattggttggttagtcgttaggtatttagt

SEQ ID NO: 5520 - DNA, 504 bp, Artificial Sequence
  chemically treated genomic DNA (Homo sapiens) CpG-island No: 5520
  misc_feature (401)..(401): n is either a, c, g or t
  misc_feature (403)..(404): n is either a, c, g or t
actaaatacctaacgactaaccaaccaataaataactatcgcaataatacgctaacgactaaaaaaatactaacgctaacgaactaatacctataaaactactccgaactaaaaacgccaatcgaaaatacatcataaatatcctaacccgaaattacttatccgccgatcacgcacgacttatcgacgtaacgcgaatacgacgccaatacgtcgcttaaaacgaactcgctatctaaatacctaacgaaattatacgtatacacaaccgaaatatcgcgaataaacgttcgattaacaccgcgacaaaaccgaatatcacacgtaattatcgaccgcaaaccaccgaactaacaaaaaccaaaaaacgtcaaactaaactataactccctactcgctcntnntaaaacgataacacaaacgcaccgcgcgacgaatacacaaacaaaacacaaccgtaacacacacaaaacaaacacaacgcgaacaaaaaacaaaaaaacg

SEQ ID NO: 5521 - DNA, 906 bp, Artificial Sequence
  chemically treated genomic DNA (Homo sapiens) CpG-island No: 5521
tttatcggcgatgtttttttttagtaataggcgcgtttcggcgatgtatatttgtttttggttgtagaaaatgtttgttgcggtggcgtttgtcgtttgttgtaaattcgggtagttagcgaaaacgatgttggcgtttttgtcgttcgtttttagttagacgcgttttatgttgttgtcgttcgtattttttagtagttgtttttcggtacgggttgaatcggtaaaggtaatggcgtcgatatcgttatgacgcgatagcgtttgttcggttttatgattaaaattcgttattacgtttaatatattattcggtaagtttgtttttttcgttagtttcgcgagacgaatcgtattgagcggtgattttttagacggttttagaattacgttgtttttcgtcgttagcgtcgggtcgagtttttagtaagttagtaatagcgggaagttttacggtacgatggcggtaattacgtcgatcggtttacgtacgattatcgttagtttatggttattggtggtcgttatttcgttatatattttgtcgatcgtttcggcgtattagcgaatggcgcgcgtcgcgtcgggaatattattacgtagattgtgacgaatcggtttgtcggtgtcgagagtttttagtagtgttagtttttcggcgtgggtttttattaaatcggcgagtttatttagtatcgttttacgtttagtcggagaagagagtgattagtcgtcgcgtttaaatacgtcgcgtgttgcgtttatcgtacggtcgatatcgacgtttttgtcgcgggtaattttcgttagcggtgtttgggtgatcggattaacggttttaaagggtttatttttcgtcgagttagtatatttatcggttatatataagcgggttttaatggggag

SEQ ID NO: 5522 - DNA, 906 bp, Artificial Sequence
  chemically treated genomic DNA (Homo sapiens) CpG-island No: 5522
ctccccattaaaacccgcttatatataaccgataaatatactaactcgacgaaaaataaaccctttaaaaccgttaatccgatcacccaaacaccgctaacgaaaattacccgcgacaaaaacgtcgatatcgaccgtacgataaacgcaacacgcgacgtatttaaacgcgacgactaatcactctcttctccgactaaacgtaaaacgatactaaataaactcgccgatttaataaaaacccacgccgaaaaactaacactactaaaaactctcgacaccgacaaaccgattcgtcacaatctacgtaataatattcccgacgcgacgcgcgccattcgctaatacgccgaaacgatcgacaaaatatataacgaaataacgaccaccaataaccataaactaacgataatcgtacgtaaaccgatcgacgtaattaccgccatcgtaccgtaaaacttcccgctattactaacttactaaaaactcgacccgacgctaacgacgaaaaacaacgtaattctaaaaccgtctaaaaaatcaccgctcaatacgattcgtctcgcgaaactaacgaaaaaaacaaacttaccgaataatatattaaacgtaataacgaattttaatcataaaaccgaacaaacgctatcgcgtcataacgatatcgacgccattacctttaccgattcaacccgtaccgaaaaacaactactaaaaaatacgaacgacaacaacataaaacgcgtctaactaaaaacgaacgacaaaaacgccaacatcgttttcgctaactacccgaatttacaacaaacgacaaacgccaccgcaacaaacattttctacaaccaaaaacaaatatacatcgccgaaacgcgcctattactaaaaaaaaacatcgccgataaa

SEQ ID NO: 5523 - DNA, 906 bp, Artificial Sequence
  chemically treated genomic DNA (Homo sapiens) CpG-island No: 5523
ttttttattgaaattcgtttatgtataatcggtgaatatattggttcggcggaaaatgaattttttgaaatcgttgattcggttatttaggtatcgttggcgaaaattgttcgcggtaagagcgtcgatatcgatcgtgcgatgagcgtagtacgcggcgtatttgaacgcggcgattggttattttttttttcggttaaacgtaaagcggtattgaataaattcgtcgatttaatggaagtttacgtcgaagagttggtattgttggaaattttcgatatcggtaaatcgattcgttatagtttgcgtgatgatattttcggcgcggcgcgcgttattcgttggtacgtcgaagcgatcgataaagtgtatggcgaagtggcgattattagtagttatgagttggcgatgatcgtgcgtgaatcggtcggcgtgattgtcgttatcgtgtcgtggaatttttcgttgttgttgatttgttggaaattcggttcggcgttggcggcgggaaatagcgtgattttaaaatcgtttgaaaaattatcgtttagtgcgattcgtttcgcggggttggcgaaagaagtaggtttgtcggatggtgtgttgaacgtggtgacgggttttggttatgaagtcgggtaggcgttgtcgcgttataacgatatcgacgttattgtttttatcggtttaattcgtatcgggaaatagttgttgaaagatgcgggcgatagtaatatgaaacgcgtttggttggaagcgggcggtaaaagcgttaatatcgttttcgttgattgttcggatttgtaataggcggtaagcgttatcgtagtaggtattttttataattagggataggtgtgtatcgtcggaacgcgtttgttgttggaagagagtatcgtcgatgaa

SEQ ID NO: 5524 - DNA, 906 bp, Artificial Sequence
  chemically treated genomic DNA (Homo sapiens) CpG-island No: 5524
ttcatcgacgatactctcttccaacaacaaacgcgttccgacgatacacacctatccctaattataaaaaatacctactacgataacgcttaccgcctattacaaatccgaacaatcaacgaaaacgatattaacgcttttaccgcccgcttccaaccaaacgcgtttcatattactatcgcccgcatctttcaacaactatttcccgatacgaattaaaccgataaaaacaataacgtcgatatcgttataacgcgacaacgcctacccgacttcataaccaaaacccgtcaccacgttcaacacaccatccgacaaacctacttctttcgccaaccccgcgaaacgaatcgcactaaacgataatttttcaaacgattttaaaatcacgctatttcccgccgccaacgccgaaccgaatttccaacaaatcaacaacaacgaaaaattccacgacacgataacgacaatcacgccgaccgattcacgcacgatcatcgccaactcataactactaataatcgccacttcgccatacactttatcgatcgcttcgacgtaccaacgaataacgcgcgccgcgccgaaaatatcatcacgcaaactataacgaatcgatttaccgatatcgaaaatttccaacaataccaactcttcgacgtaaacttccattaaatcgacgaatttattcaataccgctttacgtttaaccgaaaaaaaaaataaccaatcgccgcgttcaaatacgccgcgtactacgctcatcgcacgatcgatatcgacgctcttaccgcgaacaattttcgccaacgatacctaaataaccgaatcaacgatttcaaaaaattcattttccgccgaaccaatatattcaccgattatacataaacgaatttcaataaaaaa

SEQ ID NO: 5525 - DNA, 750 bp, Artificial Sequence
  chemically treated genomic DNA (Homo sapiens) CpG-island No: 5525
tcgagttacggttcgttatttttagcgtttgattgttgaagtagaacgggaagtgcgtttaggaagttgacgaaataaataagtagttttatttgttcgttaattaaacggtatttttttagtttttgtttttcgggaacggtatcgcgttatttacgttacggatttggaatattacgtttttaatatggaacgtttgcggttcgttcgcgcgtatcgtttagcgtttttacgttttttgttgcgcggtgatattaatacggttgacgttttatagttgtttattaatattcgggttattatttagattgatatcgcgattgcgaattggcgaattagttatgattttagttggtagtaagcgtatcggaagattgtttgtgattagcggtagaaggtcggttgggcgtagcgttagtattagggtagaaattagaatattggatggtttaaagaagttacgaatacgattaataatgttcgtcgtttcgttataggtgatcgatattttatcgtcgttgtttatatttattagaatttcgcggcgttcgttcggtgttagcgaaagttgttttatcgatataggagtaggtaggaatttttgatcgttagaaattatatgtaacgggcgattatcgtttatttgtagttgatagcgacgagagttcgacgcgtttagtagtcgtaagcgtatttagttacgcgagattttaacgtacgggtttgtatatcgtgtattagtagcgtatt

SEQ ID NO: 5526 - DNA, 750 bp, Artificial Sequence
  chemically treated genomic DNA (Homo sapiens) CpG-island No: 5526
aatacgctactaatacacgatatacaaacccgtacgttaaaatctcgcgtaactaaatacgcttacgactactaaacgcgtcgaactctcgtcgctatcaactacaaataaacgataatcgcccgttacatataatttctaacgatcaaaaattcctacctactcctatatcgataaaacaactttcgctaacaccgaacgaacgccgcgaaattctaataaatataaacaacgacgataaaatatcgatcacctataacgaaacgacgaacattattaatcgtattcgtaacttctttaaaccatccaatattctaatttctaccctaatactaacgctacgcccaaccgaccttctaccgctaatcacaaacaatcttccgatacgcttactaccaactaaaatcataactaattcgccaattcgcaatcgcgatatcaatctaaataataacccgaatattaataaacaactataaaacgtcaaccgtattaatatcaccgcgcaacaaaaaacgtaaaaacgctaaacgatacgcgcgaacgaaccgcaaacgttccatattaaaaacgtaatattccaaatccgtaacgtaaataacgcgataccgttcccgaaaaacaaaaactaaaaaaataccgtttaattaacgaacaaataaaactacttatttatttcgtcaacttcctaaacgcacttcccgttctacttcaacaatcaaacgctaaaaataacgaaccgtaactcga

SEQ ID NO: 5527 - DNA, 750 bp, Artificial Sequence
  chemically treated genomic DNA (Homo sapiens) CpG-island No: 5527
gatacgttgttggtatacggtgtataagttcgtacgttgaagtttcgcgtggttgggtgcgtttgcgattgttgaacgcgtcgaattttcgtcgttattaattatagatgaacgatggtcgttcgttatatgtgatttttggcgattagggatttttgtttgtttttgtatcggtgaagtaattttcgttggtatcgggcgagcgtcgcgagattttggtggatatgagtaacggcgatgaagtgtcgattatttgtggcgaagcggcgagtattgttgatcgtattcgtggtttttttgagttatttagtattttggtttttattttggtgttaacgttgcgtttaatcggttttttgtcgttggttatagatagtttttcgatgcgtttgttgttaattgaaattatggttggttcgttaattcgtagtcgcgatattagtttgggtgatgattcgggtattaatggatagttgtgggacgttaatcgtattgatgttatcgcgtagtaaggaacgtgggaacgttggacggtacgcgcggacgagtcgtaagcgttttatattgaaggcgtaatgttttagattcgtaacgtgaatggcgcgatgtcgttttcggaagatagaggttggaaagatatcgtttggttgacggataagtggagttgtttgtttatttcgttagttttttgggcgtatttttcgttttattttaatagttagacgttggaaatggcggatcgtggttcga

SEQ ID NO: 5528 - DNA, 750 bp, Artificial Sequence
  chemically treated genomic DNA (Homo sapiens) CpG-island No: 5528
tcgaaccacgatccgccatttccaacgtctaactattaaaataaaacgaaaaatacgcccaaaaaactaacgaaataaacaaacaactccacttatccgtcaaccaaacgatatctttccaacctctatcttccgaaaacgacatcgcgccattcacgttacgaatctaaaacattacgccttcaatataaaacgcttacgactcgtccgcgcgtaccgtccaacgttcccacgttccttactacgcgataacatcaatacgattaacgtcccacaactatccattaatacccgaatcatcacccaaactaatatcgcgactacgaattaacgaaccaaccataatttcaattaacaacaaacgcatcgaaaaactatctataaccaacgacaaaaaaccgattaaacgcaacgttaacaccaaaataaaaaccaaaatactaaataactcaaaaaaaccacgaatacgatcaacaatactcgccgcttcgccacaaataatcgacacttcatcgccgttactcatatccaccaaaatctcgcgacgctcgcccgataccaacgaaaattacttcaccgatacaaaaacaaacaaaaatccctaatcgccaaaaatcacatataacgaacgaccatcgttcatctataattaataacgacgaaaattcgacgcgttcaacaatcgcaaacgcacccaaccacgcgaaacttcaacgtacgaacttatacaccgtataccaacaacgtatc

SEQ ID NO: 5529 - DNA, 501 bp, Artificial Sequence
  chemically treated genomic DNA (Homo sapiens) CpG-island No: 5529
cgtttagcgttttacggaatgcggtaatttggttgtttttatagtttagattaattattagtattgcgtttgcgttcgggtggcgtattatgttttgtagtatggtgcgggtattaatgtgatcgtcgtttagttgtgagtagtcgtaggtgtggttgaagaggaatacgtcgttagtattttcggcgttgttggttttttttagaaaacggttttggatttgtcgcgcgatgtcgttgatatagtttacggttggtaggatttatagtttattacgtatttcgatatcgtcgttagcgcgacgatagatttgtattttacgatttgtcgtttgcgtaggtagattttgaaaattaggttgatagcgatattgatttagatcgtttagattcgtgcgcgtattgtgggcgtgaacgtgaatatttgtcgtaatattcgttaatgtataattaatcggtaggttatatttgatgatattggttttttttgcgatattcgtta

SEQ ID NO: 5530 - DNA, 501 bp, Artificial Sequence
  chemically treated genomic DNA (Homo sapiens) CpG-island No: 5530
taacgaatatcgcaaaaaaaaccaatatcatcaaatataacctaccgattaattatacattaacgaatattacgacaaatattcacgttcacgcccacaatacgcgcacgaatctaaacgatctaaatcaatatcgctatcaacctaattttcaaaatctacctacgcaaacgacaaatcgtaaaatacaaatctatcgtcgcgctaacgacgatatcgaaatacgtaataaactataaatcctaccaaccgtaaactatatcaacgacatcgcgcgacaaatccaaaaccgttttctaaaaaaaaccaacaacgccgaaaatactaacgacgtattcctcttcaaccacacctacgactactcacaactaaacgacgatcacattaatacccgcaccatactacaaaacataatacgccacccgaacgcaaacgcaatactaataattaatctaaactataaaaacaaccaaattaccgcattccgtaaaacgctaaacg

SEQ ID NO: 5531 - DNA, 501 bp, Artificial Sequence
  chemically treated genomic DNA (Homo sapiens) CpG-island No: 5531
taacggatatcgtaaaaggggttaatgttattaaatatggtttgtcgattggttatgtattggcggatattgcggtaggtgtttacgtttacgtttataatacgcgtacgaatttgagcgatttggattagtatcgttattaatttgatttttaggatttgtttgcgtaagcggtagatcgtgaagtgtagatttatcgtcgcgttaacggcgatgtcggggtgcgtaatgagttgtggattttgttaatcgtgggttgtgttaacggtatcgcgcggtagatttagaatcgttttttgaaagagattaataacgtcgaaggtattgacggcgtgtttttttttagttatatttacggttgtttatagttgggcgacgattatattaatattcgtattatgttgtaaaatatggtgcgttattcgaacgtaggcgtagtgttggtgattggtttgggttgtgaaaataattaggttgtcgtatttcgtgaaacgttgggcg

SEQ ID NO: 5532 - DNA, 501 bp, Artificial Sequence
  chemically treated genomic DNA (Homo sapiens) CpG-island No: 5532
cgcccaacgtttcacgaaatacgacaacctaattattttcacaacccaaaccaatcaccaacactacgcctacgttcgaataacgcaccatattttacaacataatacgaatattaatataatcgtcgcccaactataaacaaccgtaaatataactaaaaaaaaacacgccgtcaataccttcgacgttattaatctctttcaaaaaacgattctaaatctaccgcgcgataccgttaacacaacccacgattaacaaaatccacaactcattacgcaccccgacatcgccgttaacgcgacgataaatctacacttcacgatctaccgcttacgcaaacaaatcctaaaaatcaaattaataacgatactaatccaaatcgctcaaattcgtacgcgtattataaacgtaaacgtaaacacctaccgcaatatccgccaatacataaccaatcgacaaaccatatttaataacattaaccccttttacgatatccgtta

SEQ ID NO: 5533 - DNA, 562 bp, Artificial Sequence
  chemically treated genomic DNA (Homo sapiens) CpG-island No: 5533
gatggggtattcggcgtattgtttatgtgtagcgattgtattagtgtaaacgtttgggcgtatattaggaagtaaaatgtttgtttaacgtcgataaagtgacgtgacggtggtaggatgatatgtggatcggtagcgacgatgtcgttgtttttcgcggcgatggcgattatacgtattgtttggttgttacggcgaagtttagttagtagattaagattatattgacgggtgtaagggtggttggagataaatattattattagcgtttcgttatcgattagcgattttggtttatgacggaattcggttggagaattataaaaggtcgttagtttattcgtcgttagttttagtatttttagcgtcgattcgcgtgttgcgttttgtaagttatcgttatcgagataaacgattcgtttttacggtgcgtaattaaatatattttcgttgaaatcgtttagtgaggttaggatcgtttggtaacgattcgttacgtcgcggaaggtttggttgttgatcgttttaggtgcgaaaatcgcgaggtagttggttattatgg

SEQ ID NO: 5534 - DNA, 562 bp, Artificial Sequence
  chemically treated genomic DNA (Homo sapiens) CpG-island No: 5534
ccataataaccaactacctcgcgattttcgcacctaaaacgatcaacaaccaaaccttccgcgacgtaacgaatcgttaccaaacgatcctaacctcactaaacgatttcaacgaaaatatatttaattacgcaccgtaaaaacgaatcgtttatctcgataacgataacttacaaaacgcaacacgcgaatcgacgctaaaaatactaaaactaacgacgaataaactaacgaccttttataattctccaaccgaattccgtcataaaccaaaatcgctaatcgataacgaaacgctaataataatatttatctccaaccacccttacacccgtcaatataatcttaatctactaactaaacttcgccgtaacaaccaaacaatacgtataatcgccatcgccgcgaaaaacaacgacatcgtcgctaccgatccacatatcatcctaccaccgtcacgtcactttatcgacgttaaacaaacattttacttcctaatatacgcccaaacgtttacactaatacaatcgctacacataaacaatacgccgaataccccatc

SEQ ID NO: 5535 - DNA, 562 bp, Artificial Sequence
  chemically treated genomic DNA (Homo sapiens) CpG-island No: 5535
ttatgatggttagttgtttcgcggttttcgtatttgagacgattaatagttaaatttttcgcgacgtggcggatcgttgttaggcgattttgattttattgggcgattttagcgaaggtgtgtttggttacgtatcgtggaaacggatcgtttatttcggtagcggtggtttatagggcgtagtacgcgagtcggcgttgaaagtgttggaattgacggcgggtaaattggcggttttttatgattttttaatcggatttcgttatggattaaaatcgttggtcgatgacgaaacgttggtggtggtatttgtttttagttatttttatattcgttagtatgattttgatttgttggttgaatttcgtcgtgataattaggtaatgcgtgtaatcgttatcgtcgcggaaagtagcgatatcgtcgttgtcggtttatatattattttgttatcgttacgttattttatcgacgttgagtaggtattttgttttttgatgtacgtttagacgtttgtattgatgtagtcgttgtatatgggtaatacgtcggatattttatt

SEQ ID NO: 5536 - DNA, 562 bp, Artificial Sequence
  chemically treated genomic DNA (Homo sapiens) CpG-island No: 5536
aataaaatatccgacgtattacccatatacaacgactacatcaatacaaacgtctaaacgtacatcaaaaaacaaaatacctactcaacgtcgataaaataacgtaacgataacaaaataatatataaaccgacaacgacgatatcgctactttccgcgacgataacgattacacgcattacctaattatcacgacgaaattcaaccaacaaatcaaaatcatactaacgaatataaaaataactaaaaacaaataccaccaccaacgtttcgtcatcgaccaacgattttaatccataacgaaatccgattaaaaaatcataaaaaaccgccaatttacccgccgtcaattccaacactttcaacgccgactcgcgtactacgccctataaaccaccgctaccgaaataaacgatccgtttccacgatacgtaaccaaacacaccttcgctaaaatcgcccaataaaatcaaaatcgcctaacaacgatccgccacgtcgcgaaaaatttaactattaatcgtctcaaatacgaaaaccgcgaaacaactaaccatcataa

SEQ ID NO: 5537 - DNA, 628 bp, Artificial Sequence
  chemically treated genomic DNA (Homo sapiens) CpG-island No: 5537
ggtttgacgtttgggcgtttatacgcgtattgataaattatcgtttaggttattggttcggtttatgttggtaatttgtatgttaatcgtaatatggtgggcgtagtggttggtgtgtagtcgttcggcggcgaagggttgttcggtatcgggtcgaaagtaggcggttcgttttatttttatcgtttgttggcgaatcgttcggaaagtgcgttggtagtgacgttcgcgcgttaggatgtaaagtattcggtcgatgcgtagttgaaagtcgtattgatttagtcgttaaatgtattgcgggaatgggtagtaaatcgtttagaattgtaggcgttatgtacgtaatatggcgagttggcgtaggtaggaatataacgattgttgtcggggtcgacgggtgaacgtaatatttggacgttgttgtcgcgtgagcgcgtgttgtgtattgtcgatgatgagtaggatgcgttgatttagttcgtcgtcgtgttggcggtgggtagttaggtattgtggtcggatgacgcgttgtatcgttagttagtgaaggtattgttatcggtagttagcgaacgtatttaattggcgaaagcggaaaatattatcgtttaatcgtttgatgcgg

SEQ ID NO: 5538 - DNA, 628 bp, Artificial Sequence
  chemically treated genomic DNA (Homo sapiens) CpG-island No: 5538
ccgcatcaaacgattaaacgataatattttccgctttcgccaattaaatacgttcgctaactaccgataacaataccttcactaactaacgatacaacgcgtcatccgaccacaatacctaactacccaccgccaacacgacgacgaactaaatcaacgcatcctactcatcatcgacaatacacaacacgcgctcacgcgacaacaacgtccaaatattacgttcacccgtcgaccccgacaacaatcgttatattcctacctacgccaactcgccatattacgtacataacgcctacaattctaaacgatttactacccattcccgcaatacatttaacgactaaatcaatacgactttcaactacgcatcgaccgaatactttacatcctaacgcgcgaacgtcactaccaacgcactttccgaacgattcgccaacaaacgataaaaataaaacgaaccgcctactttcgacccgataccgaacaacccttcgccgccgaacgactacacaccaaccactacgcccaccatattacgattaacatacaaattaccaacataaaccgaaccaataacctaaacgataatttatcaatacgcgtataaacgcccaaacgtcaaacc

SEQ ID NO: 5539 - DNA, 628 bp, Artificial Sequence
  chemically treated genomic DNA (Homo sapiens) CpG-island No: 5539
tcgtattaaacggttgagcggtaatatttttcgttttcgttagttgaatacgttcgttgattgtcgatggtaatgtttttattaattgacgatgtagcgcgttattcggttatagtatttggttgtttatcgttagtacggcggcgagttgagttagcgtattttgtttattatcggtaatatataatacgcgtttacgcggtagtagcgtttaggtgttgcgtttattcgtcggtttcggtagtaatcgttgtgtttttgtttgcgttagttcgttatattgcgtatataacgtttgtaattttggacgatttgttgtttattttcgtagtgtatttagcggttgagttaatgcggtttttaattgcgtatcgatcggatattttgtattttgacgcgcgagcgttattgttagcgtatttttcgggcgattcgttagtagacggtagagatagagcggatcgtttgttttcggttcggtatcggataatttttcgtcgtcgaacggttgtatattaattattgcgtttattatattacggttaatatataggttattaatatgggtcgagttagtgatttgggcgatggtttattaatgcgcgtatggacgtttaagcgttagatt

SEQ ID NO: 5540 - DNA, 628 bp, Artificial Sequence
  chemically treated genomic DNA (Homo sapiens) CpG-island No: 5540
aatctaacgcttaaacgtccatacgcgcattaataaaccatcgcccaaatcactaactcgacccatattaataacctatatattaaccgtaatataataaacgcaataattaatatacaaccgttcgacgacgaaaaattatccgataccgaaccgaaaacaaacgatccgctctatctctaccgtctactaacgaatcgcccgaaaaatacgctaacaataacgctcgcgcgtcaaaatacaaaatatccgatcgatacgcaattaaaaaccgcattaactcaaccgctaaatacactacgaaaataaacaacaaatcgtccaaaattacaaacgttatatacgcaatataacgaactaacgcaaacaaaaacacaacgattactaccgaaaccgacgaataaacgcaacacctaaacgctactaccgcgtaaacgcgtattatatattaccgataataaacaaaatacgctaactcaactcgccgccgtactaacgataaacaaccaaatactataaccgaataacgcgctacatcgtcaattaataaaaacattaccatcgacaatcaacgaacgtattcaactaacgaaaacgaaaaatattaccgctcaaccgtttaatacga

SEQ ID NO: 5541 - DNA, 545 bp, Artificial Sequence
  chemically treated genomic DNA (Homo sapiens) CpG-island No: 5541
ttaggcggttatggtttagacggtttattgttggtaaaattttgagttttcggttatagttttattttattaagatttcgattttagttcgtagttttgcgagtataaatagatttttagcgagtcggtgttagttttttaaattatgttagattttaggttcgtttagattacggttatttattttttttatttttaatttgtcggttttaaggttattgcgatcgtttaattgtaagtcggtgaaatagaaggcggtttatagtcgaatcgtagaaagttttggtatatcgtttttcgttcggaggattaaaggagttttgaacgggataagggtcgcggtgaaataatttggcgtagtaataagtggggtttggttttaatggaagtgtttcgggagttgattatgtttcgatttaatttttttaatcgcgtaatatgcgttgatttgttcggtggtttatagtatttttttaggcgaaattttcgggtttaaagtttatattggaggagtggattaaatcgttttattttaaaaatttagt

SEQ ID NO: 5542 - DNA, 545 bp, Artificial Sequence
  chemically treated genomic DNA (Homo sapiens) CpG-island No: 5542
actaaatttttaaaataaaacgatttaatccactcctccaatataaactttaaacccgaaaatttcgcctaaaaaaatactataaaccaccgaacaaatcaacgcatattacgcgattaaaaaaattaaatcgaaacataatcaactcccgaaacacttccattaaaaccaaaccccacttattactacgccaaattatttcaccgcgacccttatcccgttcaaaactcctttaatcctccgaacgaaaaacgatataccaaaactttctacgattcgactataaaccgccttctatttcaccgacttacaattaaacgatcgcaataaccttaaaaccgacaaattaaaaataaaaaaaataaataaccgtaatctaaacgaacctaaaatctaacataatttaaaaaactaacaccgactcgctaaaaatctatttatactcgcaaaactacgaactaaaatcgaaatcttaataaaataaaactataaccgaaaactcaaaattttaccaacaataaaccgtctaaaccataaccgcctaa

SEQ ID NO: 5543 - DNA, 545 bp, Artificial Sequence
  chemically treated genomic DNA (Homo sapiens) CpG-island No: 5543
gttaagtttttggaatagaacggtttggtttatttttttaatgtgagttttgggttcgggggtttcgtttgggagaatattataggttatcggataagttaacgtatgttgcgcggttagaagggttgaatcgagatatagttagttttcgagatatttttattggggttaagttttatttgttgttgcgttaagttattttatcgcggtttttgtttcgtttagaatttttttgatttttcgagcgagaaacggtgtgttagagttttttgcggttcggttgtgggtcgttttttgttttatcggtttgtaattaagcggtcgtaatggttttggagtcggtaaattaggggtgggagaagtagatggtcgtagtttagacgggtttggagtttgatatggtttagagagttgatatcggttcgttaagagtttgtttgtattcgtaaggttgcgaattgaaatcggggttttggtgagatagaattgtaatcgggggtttaaggttttgttaataataggtcgtttggattatagtcgtttgg

SEQ ID NO: 5544 - DNA, 545 bp, Artificial Sequence
  chemically treated genomic DNA (Homo sapiens) CpG-island No: 5544
ccaaacgactataatccaaacgacctattattaacaaaaccttaaacccccgattacaattctatctcaccaaaaccccgatttcaattcgcaaccttacgaatacaaacaaactcttaacgaaccgatatcaactctctaaaccatatcaaactccaaacccgtctaaactacgaccatctacttctcccacccctaatttaccgactccaaaaccattacgaccgcttaattacaaaccgataaaacaaaaaacgacccacaaccgaaccgcaaaaaactctaacacaccgtttctcgctcgaaaaatcaaaaaaattctaaacgaaacaaaaaccgcgataaaataacttaacgcaacaacaaataaaacttaaccccaataaaaatatctcgaaaactaactatatctcgattcaacccttctaaccgcgcaacatacgttaacttatccgataacctataatattctcccaaacgaaacccccgaacccaaaactcacattaaaaaaataaaccaaaccgttctattccaaaaacttaac

SEQ ID NO: 5545 - DNA, 560 bp, Artificial Sequence
  chemically treated genomic DNA (Homo sapiens) CpG-island No: 5545
ttatcgagcgcgggtcggatgcgtcgtataatttatcgttcggtttaattataatgttttgtgtattgtttatcgttttttttagcgttattttttgattttttgtttttagtagtttgagcgtattcgggttaaattttttttcgatacgtagttcgttcggtaattattgatggtggaaattcggcgtattggtcgtttcggcgacgtttaagttataatcgatgttatttattattatttgtagtattgtagtgatgattcggttatcgtttgggttatcggtaattagttaggttttatcgttttttattataatggtcggcgatatcgacgatagcgggcgtttgttcggttcgacggcgttggtattatcgtttattagttcgtaaacgttcggtacgttcggtttggcggagaaattatttatttggttattaagtagaatatcgttttcgttcgcgataatgttcgtatcgaaggtggtgtttagcgtataggttatcgttatcgcgttattatttttatttattattgagtaatgggtagtttgattattt

SEQ ID NO: 5546 - DNA, 560 bp, Artificial Sequence
  chemically treated genomic DNA (Homo sapiens) CpG-island No: 5546
aaataatcaaactacccattactcaataataaataaaaataataacgcgataacgataacctatacgctaaacaccaccttcgatacgaacattatcgcgaacgaaaacgatattctacttaataaccaaataaataatttctccgccaaaccgaacgtaccgaacgtttacgaactaataaacgataataccaacgccgtcgaaccgaacaaacgcccgctatcgtcgatatcgccgaccattataataaaaaacgataaaacctaactaattaccgataacccaaacgataaccgaatcatcactacaatactacaaataataataaataacatcgattataacttaaacgtcgccgaaacgaccaatacgccgaatttccaccatcaataattaccgaacgaactacgtatcgaaaaaaaatttaacccgaatacgctcaaactactaaaaacaaaaaatcaaaaaataacgctaaaaaaaacgataaacaatacacaaaacattataattaaaccgaacgataaattatacgacgcatccgacccgcgctcgataa

SEQ ID NO: 5547 - DNA, 560 bp, Artificial Sequence
  chemically treated genomic DNA (Homo sapiens) CpG-island No: 5547
gagtaattaaattatttattatttagtggtggataaagatggtaacgcggtggcggtgatttatacgttgaatattattttcggtacgggtattgtcgcgggcgagagcggtattttgtttaataattagatggatgattttttcgttaaatcgggcgtatcgaacgtttacgggttggtgggcggtgatgttaacgtcgtcgggtcgaataaacgttcgttgtcgtcgatgtcgtcgattattgtggtgaaagacggtaaaatttggttggttatcggtagtttaggcggtagtcggattattattatagtgttgtaaatggtggtgaatagtatcgattatggtttgaacgtcgtcgaagcgattaatgcgtcgggtttttattattagtggttgtcggacgagttgcgtgtcgaaaaagggtttagttcggatacgtttaagttgttggaagtaaaaggttagaaagtggcgttgaaagaggcgatgggtagtatataaagtattatggttgggtcggacggtgagttgtacggcgtattcgattcgcgttcggtgg

SEQ ID NO: 5548 - DNA, 560 bp, Artificial Sequence
  chemically treated genomic DNA (Homo sapiens) CpG-island No: 5548
ccaccgaacgcgaatcgaatacgccgtacaactcaccgtccgacccaaccataatactttatatactacccatcgcctctttcaacgccactttctaaccttttacttccaacaacttaaacgtatccgaactaaaccctttttcgacacgcaactcgtccgacaaccactaataataaaaacccgacgcattaatcgcttcgacgacgttcaaaccataatcgatactattcaccaccatttacaacactataataataatccgactaccgcctaaactaccgataaccaaccaaattttaccgtctttcaccacaataatcgacgacatcgacgacaacgaacgtttattcgacccgacgacgttaacatcaccgcccaccaacccgtaaacgttcgatacgcccgatttaacgaaaaaatcatccatctaattattaaacaaaataccgctctcgcccgcgacaatacccgtaccgaaaataatattcaacgtataaatcaccgccaccgcgttaccatctttatccaccactaaataataaataatttaattactc

SEQ ID NO: 5549 - DNA, 556 bp, Artificial Sequence
  chemically treated genomic DNA (Homo sapiens) CpG-island No: 5549
tttcgatcgatattttcgacgtttaggatgaggaatatcgggagtcggtgttgttttttaacgttgcggttcgcgtggcggtggaagtaggtattgtcgattattggtataagtatgttggtttgaaaggggtaattgtcgggatgacgggttacggggaatttgtttcggcggataagttgttttcgttttttggttttatcgtcgagaatattgtggtaaaagcgtataaggtgttgggagtgaaaggtgtttgatggtgattgtcggatgttgattgtcggatgcgacgttgacgcgttttattcggtttatagcgttttattcggtttatatgtttcgttattttgtttaacgggtgatttataacgtgggttaggcgtttggtttatgttagttatcgtaggtgggttttgcggcgtaacgtattaggcgaaaacgttgatcgttaaagcgttagcgcgtttgaatgttataatcgtttaattcgcgttttttcgttaaggttattagtttacgcgattttttattaaatgttgcgtttattagttttagt

SEQ ID NO: 5550 - DNA, 556 bp, Artificial Sequence
  chemically treated genomic DNA (Homo sapiens) CpG-island No: 5550
actaaaactaataaacgcaacatttaataaaaaatcgcgtaaactaataaccttaacgaaaaaacgcgaattaaacgattataacattcaaacgcgctaacgctttaacgatcaacgttttcgcctaatacgttacgccgcaaaacccacctacgataactaacataaaccaaacgcctaacccacgttataaatcacccgttaaacaaaataacgaaacatataaaccgaataaaacgctataaaccgaataaaacgcgtcaacgtcgcatccgacaatcaacatccgacaatcaccatcaaacacctttcactcccaacaccttatacgcttttaccacaatattctcgacgataaaaccaaaaaacgaaaacaacttatccgccgaaacaaattccccgtaacccgtcatcccgacaattacccctttcaaaccaacatacttataccaataatcgacaatacctacttccaccgccacgcgaaccgcaacgttaaaaaacaacaccgactcccgatattcctcatcctaaacgtcgaaaatatcgatcgaaa

SEQ ID NO: 5551 - DNA, 556 bp, Artificial Sequence
  chemically treated genomic DNA (Homo sapiens) CpG-island No: 5551
attggaattgatgaacgtaatatttgatgagaaatcgcgtgaattggtgattttagcgaaagggcgcggattaagcgattgtggtatttaggcgcgttggcgttttgacggttagcgttttcgtttggtgcgttacgtcgtagaatttatttgcgataattggtatgggttagacgtttggtttacgttgtggattattcgttaaataaaatggcgggatatgtaggtcggataagacgttgtaggtcggataagacgcgttagcgtcgtattcggtaattagtattcggtaattattattaggtattttttatttttagtattttatgcgtttttgttataatattttcggcggtaaagttaaagaacgggaatagtttattcgtcggagtagatttttcgtaattcgttatttcgataattgttttttttagattaatatatttgtattagtaatcggtaatatttgtttttatcgttacgcgagtcgtaacgttagaaggtaatatcgattttcgatattttttattttgggcgtcgaaaatatcggtcgagg

SEQ ID NO: 5552 - DNA, 556 bp, Artificial Sequence
  chemically treated genomic DNA (Homo sapiens) CpG-island No: 5552
cctcgaccgatattttcgacgcccaaaataaaaaatatcgaaaatcgatattaccttctaacgttacgactcgcgtaacgataaaaacaaatattaccgattactaatacaaatatattaatctaaaaaaaacaattatcgaaataacgaattacgaaaaatctactccgacgaataaactattcccgttctttaactttaccgccgaaaatattataacaaaaacgcataaaatactaaaaataaaaaatacctaataataattaccgaatactaattaccgaatacgacgctaacgcgtcttatccgacctacaacgtcttatccgacctacatatcccgccattttatttaacgaataatccacaacgtaaaccaaacgtctaacccataccaattatcgcaaataaattctacgacgtaacgcaccaaacgaaaacgctaaccgtcaaaacgccaacgcgcctaaataccacaatcgcttaatccgcgccctttcgctaaaatcaccaattcacgcgatttctcatcaaatattacgttcatcaattccaat

SEQ ID NO: 5553 - DNA, 657 bp, Artificial Sequence
  chemically treated genomic DNA (Homo sapiens) CpG-island No: 5553
tcgcgttttattgtcgtttattagtaatgaattggttacgttattagttagcgagggttggaaagcgtttttattagttattgacgcggattttggaataggtgtaattggttttggataacgtttagggaaaaatcggacgttatttatttgatcggcggtagcgttcgtttttcgtgattaaaaaagcgttggtagaatagttgtcgggtatttcgatgtaggcgggatgattttggtttcgttatcgtcgggttggtacgttgggcggaagtggtgtttcgttaattgaaaaatggtttagtagcggtttaaatttgtttgcgtttgagttagtttttttgttgtttgacgtaacggttttattacggtatggttcgtgttggagtatgaaggcggaatcgttgattttgtcgcgtcgattgttacgtcgattttagtcgatgtcgtttggcggttattttcgttattatcgtttgtttgtttgttggcgttattagcgtttaattttcgggttatgaatataaaacggcgtttatagttcgttttttagtcgataatcgtttgggttagatggtcgttaaatttttttatttgggtttaacgttacgacgggtaatatttgcggttgtattaatattagaagatcgtaacgtt

SEQ ID NO: 5554 - DNA, 657 bp, Artificial Sequence
  chemically treated genomic DNA (Homo sapiens) CpG-island No: 5554
aacgttacgatcttctaatattaatacaaccgcaaatattacccgtcgtaacgttaaacccaaataaaaaaatttaacgaccatctaacccaaacgattatcgactaaaaaacgaactataaacgccgttttatattcataacccgaaaattaaacgctaataacgccaacaaacaaacaaacgataataacgaaaataaccgccaaacgacatcgactaaaatcgacgtaacaatcgacgcgacaaaatcaacgattccgccttcatactccaacacgaaccataccgtaataaaaccgttacgtcaaacaacaaaaaaactaactcaaacgcaaacaaatttaaaccgctactaaaccatttttcaattaacgaaacaccacttccgcccaacgtaccaacccgacgataacgaaaccaaaatcatcccgcctacatcgaaatacccgacaactattctaccaacgcttttttaatcacgaaaaacgaacgctaccgccgatcaaataaataacgtccgatttttccctaaacgttatccaaaaccaattacacctattccaaaatccgcgtcaataactaataaaaacgctttccaaccctcgctaactaataacgtaaccaattcattactaataaacgacaataaaacgcga

SEQ ID NO: 5555 - DNA, 657 bp, Artificial Sequence
  chemically treated genomic DNA (Homo sapiens) CpG-island No: 5555
ggcgttacggttttttggtattgatatagtcgtagatgttattcgtcgtggcgttaagtttaagtgaaagggtttggcgattatttgatttaggcggttatcgattggaaagcgagttgtgaacgtcgttttgtgtttatggttcggaaattgaacgttgataacgttagtagatagataagcggtaatggcgaaaatgatcgttaaacgatatcggttggaatcggcgtgatagtcggcgcgatagagttagcgatttcgtttttatgttttagtacggattatgtcgtgatggaatcgttacgttaggtagtagaaaaattggtttaggcgtaggtagatttaagtcgttgttgagttattttttaattaacgaaatattattttcgtttagcgtgttagttcggcggtgacggagttaaagttatttcgtttgtatcggaatgttcggtaattgttttgttagcgtttttttaattacggagaacgggcgttatcgtcggttaggtagataacgttcggtttttttttgggcgttatttagggttagttgtatttgttttagaattcgcgttagtggttggtgagggcgttttttagttttcgttggttaatagcgtagttagtttattgttgataaacggtagtgaggcgcgg

SEQ ID NO: 5556 - DNA, 657 bp, Artificial Sequence
  chemically treated genomic DNA (Homo sapiens) CpG-island No: 5556
ccgcgcctcactaccgtttatcaacaataaactaactacgctattaaccaacgaaaactaaaaaacgccctcaccaaccactaacgcgaattctaaaacaaatacaactaaccctaaataacgcccaaaaaaaaaccgaacgttatctacctaaccgacgataacgcccgttctccgtaattaaaaaaacgctaacaaaacaattaccgaacattccgatacaaacgaaataactttaactccgtcaccgccgaactaacacgctaaacgaaaataatatttcgttaattaaaaaataactcaacaacgacttaaatctacctacgcctaaaccaatttttctactacctaacgtaacgattccatcacgacataatccgtactaaaacataaaaacgaaatcgctaactctatcgcgccgactatcacgccgattccaaccgatatcgtttaacgatcattttcgccattaccgcttatctatctactaacgttatcaacgttcaatttccgaaccataaacacaaaacgacgttcacaactcgctttccaatcgataaccgcctaaatcaaataatcgccaaaccctttcacttaaacttaacgccacgacgaataacatctacgactatatcaataccaaaaaaccgtaacgcc

SEQ ID NO: 5557 - DNA, 525 bp, Artificial Sequence
  chemically treated genomic DNA (Homo sapiens) CpG-island No: 5557
gtcgttattttttatttttatggattttttttcggtttgacgagtcgggatgtttcgtttcggacgatggaattcgtgatgttacgttgggtagttaaatcgtgttgttttatattaattcggtaacgttttgtatcggttttcgttcgtaatagcgtttgttacgtatggttagtttattgttttgtatttgttttttcgaggattttatgatatttttagcgtatcgatttttcggcgggtaaacggatcgcgtaaggttttaattaataatagcgtaattatcgggtcgatgcggttgaattgatattcgtcgcgtacgtttattagcggtattcgcgtagttcgtatatcgttgtatttattaaacgttatagtaattttgtttagtcgaatagggaaagagcgattcgttttagatcggtaattttgtttcgtttgtaattgttcggtaagtcgatatataaacgcgtagggtgtagaattaattttagcgtatatagattattatcgttcggtattaga

SEQ ID NO: 5558 - DNA, 525 bp, Artificial Sequence
  chemically treated genomic DNA (Homo sapiens) CpG-island No: 5558
tctaataccgaacgataataatctatatacgctaaaattaattctacaccctacgcgtttatatatcgacttaccgaacaattacaaacgaaacaaaattaccgatctaaaacgaatcgctctttccctattcgactaaacaaaattactataacgtttaataaatacaacgatatacgaactacgcgaataccgctaataaacgtacgcgacgaatatcaattcaaccgcatcgacccgataattacgctattattaattaaaaccttacgcgatccgtttacccgccgaaaaatcgatacgctaaaaatatcataaaatcctcgaaaaaacaaatacaaaacaataaactaaccatacgtaacaaacgctattacgaacgaaaaccgatacaaaacgttaccgaattaatataaaacaacacgatttaactacccaacgtaacatcacgaattccatcgtccgaaacgaaacatcccgactcgtcaaaccgaaaaaaaatccataaaaataaaaaataacgac

SEQ ID NO: 5559 - DNA, 525 bp, Artificial Sequence
  chemically treated genomic DNA (Homo sapiens) CpG-island No: 5559
tttggtgtcggacgatagtgatttatatgcgttgagattgattttgtattttgcgcgtttatgtgtcggtttgtcgaatagttataaacgaggtagagttgtcgatttgagacggatcgttttttttttattcggttgggtaaaattgttgtggcgtttgataagtatagcggtgtgcgaattgcgcgagtatcgttgatgggcgtgcgcgacgagtattagtttagtcgtatcggttcggtgattgcgttgttattgattgaagttttacgcgattcgtttgttcgtcggaagatcgatgcgttggagatgttatgggattttcggaagagtaagtatagggtagtgaattaattatgcgtggtaagcgttattgcgggcgggagtcgatataaggcgttatcgagttggtatgaaatagtacgatttaattatttagcgtaatattacgggttttatcgttcgaggcggggtatttcggttcgttaggtcgggaagaagtttatagagatggagggtggcggt

SEQ ID NO: 5560 - DNA, 525 bp, Artificial Sequence
  chemically treated genomic DNA (Homo sapiens) CpG-island No: 5560
accgccaccctccatctctataaacttcttcccgacctaacgaaccgaaataccccgcctcgaacgataaaacccgtaatattacgctaaataattaaatcgtactatttcataccaactcgataacgccttatatcgactcccgcccgcaataacgcttaccacgcataattaattcactaccctatacttactcttccgaaaatcccataacatctccaacgcatcgatcttccgacgaacaaacgaatcgcgtaaaacttcaatcaataacaacgcaatcaccgaaccgatacgactaaactaatactcgtcgcgcacgcccatcaacgatactcgcgcaattcgcacaccgctatacttatcaaacgccacaacaattttacccaaccgaataaaaaaaaaacgatccgtctcaaatcgacaactctacctcgtttataactattcgacaaaccgacacataaacgcgcaaaatacaaaatcaatctcaacgcatataaatcactatcgtccgacaccaaa

SEQ ID NO: 5561 - DNA, 805 bp, Artificial Sequence
  chemically treated genomic DNA (Homo sapiens) CpG-island No: 5561
  misc_feature (530)..(530): n is either a, c, g or t
tatttcggtacgaaaacgcgtaatgagtgtcgttagtttttcgcgtcgtgtattatttttattattgcgaatgatcgttagcgacgtacgtaatgtttgcgtttgagcgggcggtatattggtgttgtagataaggtggcgggcgaattgtagtagataattcgttatcgtattggagtaaagtatcgttgtttcgttgacgttaaattttttgttaaaagttattattagtaattttggttttattttttgtagttagtagttgtcgcgtttttgtttttcgataacgttcgtgtcgtgggtattatcgattattaattagttattgtgttgttgcgttatttgttggattttcgttagtggcgtattatcgtcgtttatgttgaatacgttttttgttattattatttgttgtttcggatagggggaagtaagtaatcgcgttaaatgagtgatatcgttatgagtaaaacggcgaagttgcgaagggtttgaagtgatagtttttagtaatggaggtatggttgaangtcggtgcggtagtaatgcgggttttgtttcggcgatgattacgggtaataatttgcgtagatgagataggcgaaaattagagagaaagtacgtagtgtatcgcgaatagttagagttaatacggttaggttttgttattagcgtttgatagtacgtacgatataatcgcggatagtgatcggagtcgttgcgtattgatgttaaattgtttcgttatttgatgttaggtacggataagttgcggatgatgggatagatttaaataattataatt

SEQ ID NO: 5562 - DNA, 805 bp, Artificial Sequence
  chemically treated genomic DNA (Homo sapiens) CpG-island No: 5562
  misc_feature (276)..(276): n is either a, c, g or t
aattataattatttaaatctatcccatcatccgcaacttatccgtacctaacatcaaataacgaaacaatttaacatcaatacgcaacgactccgatcactatccgcgattatatcgtacgtactatcaaacgctaataacaaaacctaaccgtattaactctaactattcgcgatacactacgtactttctctctaattttcgcctatctcatctacgcaaattattacccgtaatcatcgccgaaacaaaacccgcattactaccgcaccgacnttcaaccatacctccattactaaaaactatcacttcaaacccttcgcaacttcgccgttttactcataacgatatcactcatttaacgcgattacttacttccccctatccgaaacaacaaataataataacaaaaaacgtattcaacataaacgacgataatacgccactaacgaaaatccaacaaataacgcaacaacacaataactaattaataatcgataatacccacgacacgaacgttatcgaaaaacaaaaacgcgacaactactaactacaaaaaataaaaccaaaattactaataataacttttaacaaaaaatttaacgtcaacgaaacaacgatactttactccaatacgataacgaattatctactacaattcgcccgccaccttatctacaacaccaatataccgcccgctcaaacgcaaacattacgtacgtcgctaacgatcattcgcaataataaaaataatacacgacgcgaaaaactaacgacactcattacgcgttttcgtaccgaaata

SEQ ID NO: 5563 - DNA, 805 bp, Artificial Sequence
  chemically treated genomic DNA (Homo sapiens) CpG-island No: 5563
  misc_feature (276)..(276): n is either a, c, g or t
agttatgattatttaggtttattttattattcgtaatttattcgtgtttgatattaggtggcggagtaatttggtattagtacgtagcggtttcggttattattcgcggttatatcgtgcgtgttattaggcgttgataataaaatttggtcgtattggttttggttattcgcggtgtattgcgtgttttttttttggttttcgtttgttttatttgcgtagattattgttcgtgattatcgtcgaaataggattcgtattgttgtcgtatcggtntttaattatgtttttattgttggaaattgttattttaagtttttcgtagtttcgtcgttttgtttataacgatgttatttatttggcgcgattgtttgtttttttttgttcggggtagtaaatggtggtgatagaaggcgtgtttagtatggacggcgatagtgcgttattggcggaaatttagtaggtaacgtaatagtataatggttggttgatggtcgatgatgtttacggtacgggcgttatcggggagtaggggcgcggtagttgttggttgtaaaaggtaaaattagaattgttggtagtgatttttggtaaaggatttggcgttagcggggtagcggtgttttgttttagtacggtggcggattatttgttgtaattcgttcgttattttatttatagtattagtatgtcgttcgtttaggcgtaggtattacgtgcgtcgttggcggttattcgtagtgatgagggtgatgtacggcgcgaaaaattggcggtatttattacgcgttttcgtgtcggagta

SEQ ID NO: 5564 - DNA, 805 bp, Artificial Sequence
  chemically treated genomic DNA (Homo sapiens) CpG-island No: 5564
  misc_feature (530)..(530): n is either a, c, g or t
tactccgacacgaaaacgcgtaataaataccgccaatttttcgcgccgtacatcaccctcatcactacgaataaccgccaacgacgcacgtaatacctacgcctaaacgaacgacatactaatactataaataaaataacgaacgaattacaacaaataatccgccaccgtactaaaacaaaacaccgctaccccgctaacgccaaatcctttaccaaaaatcactaccaacaattctaattttaccttttacaaccaacaactaccgcgcccctactccccgataacgcccgtaccgtaaacatcatcgaccatcaaccaaccattatactattacgttacctactaaatttccgccaataacgcactatcgccgtccatactaaacacgccttctatcaccaccatttactaccccgaacaaaaaaaaacaaacaatcgcgccaaataaataacatcgttataaacaaaacgacgaaactacgaaaaacttaaaataacaatttccaacaataaaaacataattaaanaccgatacgacaacaatacgaatcctatttcgacgataatcacgaacaataatctacgcaaataaaacaaacgaaaaccaaaaaaaaaacacgcaatacaccgcgaataaccaaaaccaatacgaccaaattttattatcaacgcctaataacacgcacgatataaccgcgaataataaccgaaaccgctacgtactaataccaaattactccgccacctaatatcaaacacgaataaattacgaataataaaataaacctaaataatcataact

SEQ ID NO: 5565 - DNA, 691 bp, Artificial Sequence
  chemically treated genomic DNA (Homo sapiens) CpG-island No: 5565
ggggcgttggtgtcgatttacggtacgttggtgatttcgtttatcgcgttgttgatcgtcgtttcggtgagtttcggtatcgttttgtttttgattgagtttgcgtttggttggttgaaacgttcgttgggtatcgttattgagttgttggtagttattttaagtatcgtttacggtatgtggggtttgtttatttttgcgtcgttgttcgtcgtttatttttaggagtcggtcggtaatattatgtcgaatatttcgattgttggcgcgttgttttttggtttcgtatttggtatcggtattttcgcggtaggcgtgattttcgttattatgattatttcgtatattgcggcggtaatgcgtgatgtgttcgaataaatttcggtgatgatgaaagagtcggtttacggtattggttgtattatttgggaagttatttggcgtatcgttttttcgtttattaaaaatggtgttatcggcggtattatgttggggttgggtcgcgcgttcggtgaaattatggcggtgatttttattatcggtaatatttattagttcgatagcgtttcgttgtatatgtcgggtaatagtattatttttgcgttggcgaacgaatttgcggaagcggaattcggtttgtacgttgtcgtattgatggaattgggtttgattttgtttgtgattattttta

SEQ ID NO: 5566 - DNA, 691 bp, Artificial Sequence
  chemically treated genomic DNA (Homo sapiens) CpG-island No: 5566
taaaaataatcacaaacaaaatcaaacccaattccatcaatacgacaacgtacaaaccgaattccgcttccgcaaattcgttcgccaacgcaaaaataatactattacccgacatatacaacgaaacgctatcgaactaataaatattaccgataataaaaatcaccgccataatttcaccgaacgcgcgacccaaccccaacataataccgccgataacaccatttttaataaacgaaaaaacgatacgccaaataacttcccaaataatacaaccaataccgtaaaccgactctttcatcatcaccgaaatttattcgaacacatcacgcattaccgccgcaatatacgaaataatcataataacgaaaatcacgcctaccgcgaaaataccgataccaaatacgaaaccaaaaaacaacgcgccaacaatcgaaatattcgacataatattaccgaccgactcctaaaaataaacgacgaacaacgacgcaaaaataaacaaaccccacataccgtaaacgatacttaaaataactaccaacaactcaataacgatacccaacgaacgtttcaaccaaccaaacgcaaactcaatcaaaaacaaaacgataccgaaactcaccgaaacgacgatcaacaacgcgataaacgaaatcaccaacgtaccgtaaatcgacaccaacgcccc

SEQ ID NO: 5567 - DNA, 691 bp, Artificial Sequence
  chemically treated genomic DNA (Homo sapiens) CpG-island No: 5567
tgaaggtaattataaataggattaggtttagttttattagtgcggtaacgtgtagatcggatttcgttttcgtaaattcgttcgttagcgtagaggtgatattgttgttcggtatatatagcgaggcgttgtcgagttggtaggtgttatcgatgataaaggttatcgttatggttttatcgagcgcgcggtttagttttagtatgatgtcgtcgataatattatttttggtgaacggaagaacgatacgttagataattttttaggtggtgtagttaatatcgtaggtcgatttttttattattatcggggtttgttcgaatatattacgtattatcgtcgtaatgtacggaataattatgatggcgaggattacgtttgtcgcgaggatatcgatattaaatgcggggttagagaatagcgcgttaataatcgggatattcgatatgatattgtcgatcggtttttgaaagtaaacggcgaatagcggcgtaaagataaataggttttatatgtcgtaaacgatatttggaatggttgttagtagtttaatggcgatatttagcgggcgttttagttagttaggcgtaagtttagttaggaatagggcgatatcgaaatttatcgggacggcgattagtagcgcgataaacgaagttattaacgtatcgtagatcggtattagcgtttt

SEQ ID NO: 5568 - DNA, 691 bp, Artificial Sequence
  chemically treated genomic DNA (Homo sapiens) CpG-island No: 5568
aaaacgctaataccgatctacgatacgttaataacttcgtttatcgcgctactaatcgccgtcccgataaatttcgatatcgccctattcctaactaaacttacgcctaactaactaaaacgcccgctaaatatcgccattaaactactaacaaccattccaaatatcgtttacgacatataaaacctatttatctttacgccgctattcgccgtttactttcaaaaaccgatcgacaatatcatatcgaatatcccgattattaacgcgctattctctaaccccgcatttaatatcgatatcctcgcgacaaacgtaatcctcgccatcataattattccgtacattacgacgataatacgtaatatattcgaacaaaccccgataataataaaaaaatcgacctacgatattaactacaccacctaaaaaattatctaacgtatcgttcttccgttcaccaaaaataatattatcgacgacatcatactaaaactaaaccgcgcgctcgataaaaccataacgataacctttatcatcgataacacctaccaactcgacaacgcctcgctatatataccgaacaacaatatcacctctacgctaacgaacgaatttacgaaaacgaaatccgatctacacgttaccgcactaataaaactaaacctaatcctatttataattaccttca

SEQ ID NO: 5569 - DNA, 577 bp, Artificial Sequence
  chemically treated genomic DNA (Homo sapiens) CpG-island No: 5569
ttcgtcgtcgtgtagttttttcgggggtcgatatcgttatcggtcgagttttttacgtttttcgaaatggtgtgtaagcggaagggggtcggggttttcgtttgtattttttggaagtagttcgttgcggcggcgggggttgcggcggcggtcggcggcggcggttggcgggggagggtttgcggggggagttttcgcgttcgggtttttcgacgtcgttgttgttaggtttcggagtagttttcgtagtcgttttgtttttcgttttttttttttattttcgaaggtgtttttatcgaagttggcggggacgttgttcggatgtcgtatcgtttttttgttcgtttagtagtagtatgaatgtggcgacgcggattgtcgggagtttttcgaaaatttttgcgattgttatagggagtcgtttttcgaaattttagatattaattagttgtcgtcgtttattttgtttaaggtgggtttgggcgagaggcgtagggatgttcgtttttttttattttcggttttcgttttcgaggtttttttttttttttttttaagcgcggaggaggggggtttt

SEQ ID NO: 5570 - DNA, 577 bp, Artificial Sequence
  chemically treated genomic DNA (Homo sapiens) CpG-island No: 5570
aaaacccccctcctccgcgcttaaaaaaaaaaaaaaaaaaacctcgaaaacgaaaaccgaaaataaaaaaaaacgaacatccctacgcctctcgcccaaacccaccttaaacaaaataaacgacgacaactaattaatatctaaaatttcgaaaaacgactccctataacaatcgcaaaaattttcgaaaaactcccgacaatccgcgtcgccacattcatactactactaaacgaacaaaaaaacgatacgacatccgaacaacgtccccgccaacttcgataaaaacaccttcgaaaataaaaaaaaaaaacgaaaaacaaaacgactacgaaaactactccgaaacctaacaacaacgacgtcgaaaaacccgaacgcgaaaactccccccgcaaaccctcccccgccaaccgccgccgccgaccgccgccgcaacccccgccgccgcaacgaactacttccaaaaaatacaaacgaaaaccccgacccccttccgcttacacaccatttcgaaaaacgtaaaaaactcgaccgataacgatatcgacccccgaaaaaactacacgacgacgaa

SEQ ID NO: 5571 - DNA, 577 bp, Artificial Sequence
  chemically treated genomic DNA (Homo sapiens) CpG-island No: 5571
ggaatttttttttttcgcgtttagggggaggagagagaaagtttcggaggcgggggtcgggggtgggggaaagcgagtatttttgcgtttttcgtttagatttattttgagtaggatggacggcggtagttggttgatgtttggggtttcggggggcggttttttgtgatagtcgtaggggttttcgggggattttcgatagttcgcgtcgttatatttatgttgttgttgggcggataagggggcggtgcggtattcggatagcgttttcgttagtttcggtgggggtattttcggaggtgggagaagagggcggagggtagagcggttgcgggggttgtttcggggtttggtagtagcggcgtcggggggttcgggcgcgaaggtttttttcgtaggttttttttcgttagtcgtcgtcgtcggtcgtcgtcgtagttttcgtcgtcgtagcgggttgtttttagggggtgtaggcggggatttcggttttttttcgtttgtatattatttcggggggcgtagggagttcggtcggtgacggtgtcggttttcggaagagttgtacggcggcggg

SEQ ID NO: 5572 - DNA, 577 bp, Artificial Sequence
  chemically treated genomic DNA (Homo sapiens) CpG-island No: 5572
cccgccgccgtacaactcttccgaaaaccgacaccgtcaccgaccgaactccctacgccccccgaaataatatacaaacgaaaaaaaaccgaaatccccgcctacaccccctaaaaacaacccgctacgacgacgaaaactacgacgacgaccgacgacgacgactaacgaaaaaaaacctacgaaaaaaaccttcgcgcccgaaccccccgacgccgctactaccaaaccccgaaacaacccccgcaaccgctctaccctccgccctcttctcccacctccgaaaatacccccaccgaaactaacgaaaacgctatccgaataccgcaccgcccccttatccgcccaacaacaacataaatataacgacgcgaactatcgaaaatcccccgaaaacccctacgactatcacaaaaaaccgccccccgaaaccccaaacatcaaccaactaccgccgtccatcctactcaaaataaatctaaacgaaaaacgcaaaaatactcgctttcccccacccccgacccccgcctccgaaactttctctctcctccccctaaacgcgaaaaaaaaaaattcc

SEQ ID NO: 5573 - DNA, 1131 bp, Artificial Sequence
  chemically treated genomic DNA (Homo sapiens) CpG-island No: 5573
  misc_feature (112)..(112): n is either a, c, g or t
  misc_feature (826)..(826): n is either a, c, g or t
  misc_feature (865)..(865): n is either a, c, g or t
tgttgtcgtgttttatgattgtcgtcgtttgattttggttagttttgcgttgttgttcgatgttttgtgcggtttgttcgtttacggttattgttgttgtgtcgatggtagnttgttttggtgatggtttcgttgcgttgtgtgttttgatggcggttgtggattgttggcgtgcgtgtgtgtttgatgtcgtttgttttggaatgtatgtggattgagttggagtcgtttgtgtatcgatgatgtttgcgtgtgatcgtgtggcggcgtcgtcgttacgatcggttgcgtggtggtggcgtcgtttgtgtttgttgcgatgtgtttggttgtcgatgtgttcgttgttggtgtgtttggcggtttgacgtacgttttgttgatggttagttgcgttcgtgtgatttgtggtgaggtgcgtgtgttgttgtatagtggttcggtgtgttgatcgttgttgtttgtgtggtgtagtttgtcgtcgtgttacggattgatttcgtggtggttttttggtcgcgcgtgcgcgtgtttagtggtgtgcgtgtgcggttgtgagttttcgtgcggttgtttgcgtgtttcgtgtattcgagatgatgacgacgtgtttgtgtcgcgcgtgtgtggttgtgcgttttgttgttttggcgattgtacgttttgtgttggcgtgtgtgttcgtgtgttggcgatttgtttgtcggcgtgtcgcgttgcgtgatatggttcgtggttgacgtgtttgatgatggttgttggtcgtgcggtcgtgcgcgtatacgtggattgatttgagtgattttgtgtttggtgttgttcggtntcgtagtttgatagtaatcgttacgtatgcgtgatagtngtgttcgtgttcggttgacgtagtgtgcgtggtgggacggtggcgttttgtcgacggtatgttgattggttagcgtcgatgcgtgattgcggagcgttagcgtttggcgagcgcgtttgtgcgtgttgcgagtgcgtgttgtgtgtagtagtgttgttagttgtggcgatttgttggcgatgtttgatttagtagagagtgattatatggtggtgtcgttcgtatgttgtcgtggtatgatgttttgttcgatttgatgtatcgtg

SEQ ID NO: 5574 - DNA, 1131 bp, Artificial Sequence
  chemically treated genomic DNA (Homo sapiens) CpG-island No: 5574
  misc_feature (267)..(267): n is either a, c, g or t
  misc_feature (306)..(306): n is either a, c, g or t
  misc_feature (1020)..(1020): n is either a, c, g or t
cacgatacatcaaatcgaacaaaacatcataccacgacaacatacgaacgacaccaccatataatcactctctactaaatcaaacatcgccaacaaatcgccacaactaacaacactactacacacaacacgcactcgcaacacgcacaaacgcgctcgccaaacgctaacgctccgcaatcacgcatcgacgctaaccaatcaacataccgtcgacaaaacgccaccgtcccaccacgcacactacgtcaaccgaacacgaacacnactatcacgcatacgtaacgattactatcaaactacganaccgaacaacaccaaacacaaaatcactcaaatcaatccacgtatacgcgcacgaccgcacgaccaacaaccatcatcaaacacgtcaaccacgaaccatatcacgcaacgcgacacgccgacaaacaaatcgccaacacacgaacacacacgccaacacaaaacgtacaatcgccaaaacaacaaaacgcacaaccacacacgcgcgacacaaacacgtcgtcatcatctcgaatacacgaaacacgcaaacaaccgcacgaaaactcacaaccgcacacgcacaccactaaacacgcgcacgcgcgaccaaaaaaccaccacgaaatcaatccgtaacacgacgacaaactacaccacacaaacaacaacgatcaacacaccgaaccactatacaacaacacacgcacctcaccacaaatcacacgaacgcaactaaccatcaacaaaacgtacgtcaaaccgccaaacacaccaacaacgaacacatcgacaaccaaacacatcgcaacaaacacaaacgacgccaccaccacgcaaccgatcgtaacgacgacgccgccacacgatcacacgcaaacatcatcgatacacaaacgactccaactcaatccacatacattccaaaacaaacgacatcaaacacacacgcacgccaacaatccacaaccgccatcaaaacacacaacgcaacgaaaccatcaccaaaacaanctaccatcgacacaacaacaataaccgtaaacgaacaaaccgcacaaaacatcgaacaacaacgcaaaactaaccaaaatcaaacgacgacaatcataaaacacgacaaca

SEQ ID NO: 5575 - DNA, 1131 bp, Artificial Sequence
  chemically treated genomic DNA (Homo sapiens) CpG-island No: 5575
  misc_feature (267)..(267): n is either a, c, g or t
  misc_feature (306)..(306): n is either a, c, g or t
  misc_feature (1020)..(1020): n is either a, c, g or t
tacgatatattagatcgagtagagtattatattacgatagtatgcgaacgatattattatatgattattttttgttagattaagtatcgttagtagatcgttatagttagtaatattgttatatatagtacgtattcgtagtacgtatagacgcgttcgttagacgttgacgtttcgtagttacgtatcgacgttaattagttagtatatcgtcggtagagcgttatcgttttattacgtatattacgttagtcgagtacgagtatngttattacgtatgcgtagcgattattgttagattgcgangtcgagtagtattaagtatagagttatttagattagtttacgtatacgcgtacgatcgtacgattagtagttattattaagtacgttagttacgagttatattacgtaacgcgatacgtcgatagataagtcgttagtatacgaatatatacgttagtatagagcgtatagtcgttaggatagtaggacgtataattatatacgcgcgatataagtacgtcgttattatttcggatgtacgaagtacgtagatagtcgtacgaagatttatagtcgtatacgtatattattaagtacgcgtacgcgcggttagaaagttattacgagattaattcgtagtacgacgatagattatattatatagatagtaacgattagtatatcgaattattatataatagtatacgtattttattataagttatacgggcgtaattagttattagtagaacgtacgttagatcgttaagtatattagtagcgagtatatcggtagttaagtatatcgtagtagatataagcgacgttattattacgtaatcggtcgtagcgacgacgtcgttatacggttatacgtaagtattatcgatgtataggcgattttaatttagtttatatatattttaggatagacgatattaagtatatacgtacgttagtagtttatagtcgttattaaagtatataacgtagcgagattattattaagatagnttattatcgatataataatagtagtcgtgaacgagtaagtcgtatagagtatcgagtagtagcgtagggttagttagggttagacggcgataattataagatacgataata

SEQ ID NO: 5576 - DNA, 1131 bp, Artificial Sequence
  chemically treated genomic DNA (Homo sapiens) CpG-island No: 5576
  misc_feature (112)..(112): n is either a, c, g or t
  misc_feature (826)..(826): n is either a, c, g or t
  misc_feature (865)..(865): n is either a, c, g or t
tattatcgtatcttataattatcgccgtctaaccctaactaaccctacgctactactcgatactctatacgacttactcgttcacgactactattattatatcgataataanctatcttaataataatctcgctacgttatatactttaataacgactataaactactaacgtacgtatatacttaatatcgtctatcctaaaatatatataaactaaattaaaatcgcctatacatcgataatacttacgtataaccgtataacgacgtcgtcgctacgaccgattacgtaataataacgtcgcttatatctactacgatatacttaactaccgatatactcgctactaatatacttaacgatctaacgtacgttctactaataactaattacgcccgtataacttataataaaatacgtatactattatataataattcgatatactaatcgttactatctatataatataatctatcgtcgtactacgaattaatctcgtaataactttctaaccgcgcgtacgcgtacttaataatatacgtatacgactataaatcttcgtacgactatctacgtacttcgtacatccgaaataataacgacgtacttatatcgcgcgtatataattatacgtcctactatcctaacgactatacgctctatactaacgtatatattcgtatactaacgacttatctatcgacgtatcgcgttacgtaatataactcgtaactaacgtacttaataataactactaatcgtacgatcgtacgcgtatacgtaaactaatctaaataactctatacttaatactactcgacntcgcaatctaacaataatcgctacgcatacgtaataacnatactcgtactcgactaacgtaatatacgtaataaaacgataacgctctaccgacgatatactaactaattaacgtcgatacgtaactacgaaacgtcaacgtctaacgaacgcgtctatacgtactacgaatacgtactatatataacaatattactaactataacgatctactaacgatacttaatctaacaaaaaataatcatataataatatcgttcgcatactatcgtaatataatactctactcgatctaatatatcgta

SEQ ID NO: 5577 - DNA, 537 bp, Artificial Sequence
  chemically treated genomic DNA (Homo sapiens) CpG-island No: 5577
attcgagacggtaaggatataaatagttacggagaaacggaggagatagtcgaaggggtcgagaaacgcgagtcgttagaaagtcgtacgatataagaggattttcgggtatcgagcgcgaaggcggaattacggttagagacggtagttagggagaaatcgcgagtcgtatataaggttatataatagacgagtcggaagcgtaaagcgtaaagttaggggagtcgaaagcgggagcgaacgtataaaagaaggcggagcgcgtaaggattcgcgggttaggcgggaaaatcgaagagttagtcggtaaaaagaaacggttaacgcgcggggagaggcggggttgcggaaaagggtcgtatattcgtaaattacggaagacgaattcggtagtagttacgggcggagacggtaggcggtcgagtacggaaagtagacggtatacgaaaagggcggtaaagaacgggttaattttattaggaattataggtgagtaaacgtttaggaaaggaattattgtgaagttaaaagggttag

SEQ ID NO: 5578 - DNA, 537 bp, Artificial Sequence
  chemically treated genomic DNA (Homo sapiens) CpG-island No: 5578
ctaacccttttaacttcacaataattcctttcctaaacgtttactcacctataattcctaataaaattaacccgttctttaccgcccttttcgtataccgtctactttccgtactcgaccgcctaccgtctccgcccgtaactactaccgaattcgtcttccgtaatttacgaatatacgacccttttccgcaaccccgcctctccccgcgcgttaaccgtttctttttaccgactaactcttcgattttcccgcctaacccgcgaatccttacgcgctccgccttcttttatacgttcgctcccgctttcgactcccctaactttacgctttacgcttccgactcgtctattatataaccttatatacgactcgcgatttctccctaactaccgtctctaaccgtaattccgccttcgcgctcgatacccgaaaatcctcttatatcgtacgactttctaacgactcgcgtttctcgaccccttcgactatctcctccgtttctccgtaactatttatatccttaccgtctcgaat

SEQ ID NO: 5579 - DNA, 537 bp, Artificial Sequence
  chemically treated genomic DNA (Homo sapiens) CpG-island No: 5579
ttggtttttttggttttataatggttttttttttgggcgtttatttatttgtgatttttggtgggattaattcgttttttgtcgtttttttcgtgtgtcgtttgtttttcgtgttcggtcgtttgtcgttttcgttcgtggttgttgtcgggttcgtttttcgtggtttgcggatgtgcggttttttttcgtaatttcgttttttttcgcgcgttggtcgtttttttttgtcggttggtttttcggttttttcgtttggttcgcgggtttttgcgcgtttcgtttttttttgtgcgttcgttttcgttttcggtttttttggttttgcgttttgcgttttcggttcgtttgttgtgtggttttgtgtgcggttcgcggtttttttttggttgtcgtttttggtcgtggtttcgttttcgcgttcggtgttcggggatttttttgtgtcgtgcggttttttggcggttcgcgtttttcggttttttcggttgtttttttcgttttttcgtggttgtttgtgtttttgtcgtttcggat

SEQ ID NO: 5580 - DNA, 537 bp, Artificial Sequence
  chemically treated genomic DNA (Homo sapiens) CpG-island No: 5580
atccgaaacgacaaaaacacaaacaaccacgaaaaaacgaaaaaaacaaccgaaaaaaccgaaaaacgcgaaccgccaaaaaaccgcacgacacaaaaaaatccccgaacaccgaacgcgaaaacgaaaccacgaccaaaaacgacaaccaaaaaaaaaccgcgaaccgcacacaaaaccacacaacaaacgaaccgaaaacgcaaaacgcaaaaccaaaaaaaccgaaaacgaaaacgaacgcacaaaaaaaaacgaaacgcgcaaaaacccgcgaaccaaacgaaaaaaccgaaaaaccaaccgacaaaaaaaaacgaccaacgcgcgaaaaaaaacgaaattacgaaaaaaaaccgcacatccgcaaaccacgaaaaacgaacccgacaacaaccacgaacgaaaacgacaaacgaccgaacacgaaaaacaaacgacacacgaaaaaaacgacaaaaaacgaattaatcccaccaaaaatcacaaataaataaacgcccaaaaaaaaaaccattataaaaccaaaaaaaccaa

SEQ ID NO: 5581 - DNA, 760 bp, Artificial Sequence
  chemically treated genomic DNA (Homo sapiens) CpG-island No: 5581
gtcggcgggggggataagaaagtagagttgaagggagagggaaatacgcgggggggaaggttggtcggtaggggggataaagtaggggggacggggggaagcggggtaagagggagggaaaaggggagaaaagaatagatcgaacgggtagagggagaagaagggtatttgagaagaatgggtcgatagagcgaatggagggtaatttgaaggggaattggattagataaaacgtgtaggacgggggagtggaatacgggaaagtgacgggtagaggaggtaaacggaatttgggttggataacgacggggcggtgcgttgcggtagaggtggggtaagagtaaaacggtatagaaatggcgaagagagtaggaggggggcggatcgtatattgcggcgtacgttggcgggggaatggtgcgggtagtgtatatgtgtgaaatgcgttagattgggggcgcggtaaacgcggagtaaagtaaatatggggggggttgcgagaaatatatattttggggtgtatcgggcggtttgcgaagattgtttataagagattatacggtatcgtaaatttaatgtatacggtaacggttcgttatgtacgggcggggcggcggaataaggcggaaagtggttgagacgtgcggtatatataaatacgcgcgggggaatgttggggtggggtttattttgcggaggaattaatcggttgttaatttgggtgaaaagttttttttaatattaggttattcggtttatt

SEQ ID NO: 5582 - DNA, 760 bp, Artificial Sequence
  chemically treated genomic DNA (Homo sapiens) CpG-island No: 5582
aataaaccgaataacctaatattaaaaaaaacttttcacccaaattaacaaccgattaattcctccgcaaaataaaccccaccccaacattcccccgcgcgtatttatatataccgcacgtctcaaccactttccgccttattccgccgccccgcccgtacataacgaaccgttaccgtatacattaaatttacgataccgtataatctcttataaacaatcttcgcaaaccgcccgatacaccccaaaatatatatttctcgcaaccccccccatatttactttactccgcgtttaccgcgcccccaatctaacgcatttcacacatatacactacccgcaccattcccccgccaacgtacgccgcaatatacgatccgcccccctcctactctcttcgccatttctataccgttttactcttaccccacctctaccgcaacgcaccgccccgtcgttatccaacccaaattccgtttacctcctctacccgtcactttcccgtattccactcccccgtcctacacgttttatctaatccaattccccttcaaattaccctccattcgctctatcgacccattcttctcaaatacccttcttctccctctacccgttcgatctattcttttctccccttttccctccctcttaccccgcttccccccgtcccccctactttatcccccctaccgaccaaccttcccccccgcgtatttccctctcccttcaactctactttcttatcccccccgccgac

SEQ ID NO: 5583 - DNA, 760 bp, Artificial Sequence
  chemically treated genomic DNA (Homo sapiens) CpG-island No: 5583
aataaatcgggtaatttaatattgggaagagttttttatttaaattggtaatcggttaattttttcgtaaggtggattttattttagtattttttcgcgcgtgtttatatgtatcgtacgttttagttatttttcgttttatttcgtcgtttcgttcgtatatagcgggtcgttatcgtgtatattaggtttacggtgtcgtgtagttttttataagtagttttcgtaagtcgttcggtatattttaaaatgtgtgtttttcgtagttttttttatatttgttttgtttcgcgtttatcgcgtttttagtttaacgtattttatatatatatattattcgtattattttttcgttagcgtacgtcgtagtgtacggttcgttttttttttgtttttttcgttatttttatgtcgttttatttttattttatttttgtcgtagcgtatcgtttcgtcgttatttagtttaagtttcgtttgttttttttattcgttattttttcgtattttattttttcgttttgtacgttttatttggtttagtttttttttaaattattttttattcgttttatcggtttattttttttaagtgttttttttttttttttgttcgttcggtttattttttttttttttttttttttttttttgtttcgttttttttcgttttttttattttattttttttgtcggttaattttttttttcgcgtatttttttttttttttagttttatttttttatttttttcgtcggt

SEQ ID NO: 5584 - DNA, 760 bp, Artificial Sequence
  chemically treated genomic DNA (Homo sapiens) CpG-island No: 5584
accgacgaaaaaaataaaaaaataaaactaaaaaaaaaaaaaaatacgcgaaaaaaaaaattaaccgacaaaaaaaataaaataaaaaaaacgaaaaaaaacgaaacaaaaaaaaaaaaaaaaaaaaaaaaaaaataaaccgaacgaacaaaaaaaaaaaaaaaacacttaaaaaaaataaaccgataaaacgaataaaaaataatttaaaaaaaaactaaaccaaataaaacgtacaaaacgaaaaaataaaatacgaaaaaataacgaataaaaaaaacaaacgaaacttaaactaaataacgacgaaacgatacgctacgacaaaaataaaataaaaataaaacgacataaaaataacgaaaaaaacaaaaaaaaaacgaaccgtacactacgacgtacgctaacgaaaaaataatacgaataatatatatatataaaatacgttaaactaaaaacgcgataaacgcgaaacaaaacaaatataaaaaaaactacgaaaaacacacattttaaaatataccgaacgacttacgaaaactacttataaaaaactacacgacaccgtaaacctaatatacacgataacgacccgctatatacgaacgaaacgacgaaataaaacgaaaaataactaaaacgtacgatacatataaacacgcgcgaaaaaatactaaaataaaatccaccttacgaaaaaattaaccgattaccaatttaaataaaaaactcttcccaatattaaattacccgatttatt

SEQ ID NO: 5585 - DNA, 575 bp, Artificial Sequence
  chemically treated genomic DNA (Homo sapiens) CpG-island No: 5585
tgcggggaggcggtgtaggaattcgtttcgtcgagtgtcgtcggtttttgtgggtttgtttgcgcgtttggggttggtcgtattttgggcgcgggtgtttgcgtgtcggggtggtagtttcgagtttgcgcgcgtgcgatcgggtacgggagggggaagagtgtcgtaaaaatttagacgagtggttcgtatgtaaatgtagttcgcggggagtagggaggcggtaatgatagtcgttggcgtttagtttcgtcggcggtttttagttttttcgttaagtgtagtcggaggatagatagttatgcgtgtttttggcgggagagtttttattcgtcgcgcgcgttcgattttcgcgtatacgtatatatttttttcgtaggcgtggggtttaatggttacgaatatgttaggaaaataaagttggggttgcgaggtggaacgatgaaacggtatatttggcggtcgagggtagagcggagaagtcgttattatagttatcggcgttttttttttgtttgttcgtagatttgtttttcggtttagaagaggtcgaggattattttttagttgtttta

SEQ ID NO: 5586 - DNA, 575 bp, Artificial Sequence
  chemically treated genomic DNA (Homo sapiens) CpG-island No: 5586
taaaacaactaaaaaataatcctcgacctcttctaaaccgaaaaacaaatctacgaacaaacaaaaaaaaaacgccgataactataataacgacttctccgctctaccctcgaccgccaaatataccgtttcatcgttccacctcgcaaccccaactttattttcctaacatattcgtaaccattaaaccccacgcctacgaaaaaaatatatacgtatacgcgaaaatcgaacgcgcgcgacgaataaaaactctcccgccaaaaacacgcataactatctatcctccgactacacttaacgaaaaaactaaaaaccgccgacgaaactaaacgccaacgactatcattaccgcctccctactccccgcgaactacatttacatacgaaccactcgtctaaatttttacgacactcttccccctcccgtacccgatcgcacgcgcgcaaactcgaaactaccaccccgacacgcaaacacccgcgcccaaaatacgaccaaccccaaacgcgcaaacaaacccacaaaaaccgacgacactcgacgaaacgaattcctacaccgcctccccgca

SEQ ID NO: 5587 - DNA, 575 bp, Artificial Sequence
  chemically treated genomic DNA (Homo sapiens) CpG-island No: 5587
tggggtagttaagaaatggttttcggttttttttgggtcggagggtagatttacgagtaggtaagaaaggggcgtcggtggttgtggtggcgattttttcgttttgttttcggtcgttaagtgtgtcgttttatcgttttatttcgtagttttagttttgtttttttgatatgttcgtggttattgggttttacgtttgcgaggggagtgtgtgcgtgtgcgcgggggtcgggcgcgcgcggcgggtgggggttttttcgttaaggatacgtatggttgtttgtttttcggttgtatttggcgggaaagttaggggtcgtcggcggggttgagcgttagcggttgttattatcgtttttttgtttttcgcgggttgtatttatatacgggttattcgtttgaatttttacggtatttttttttttttcgtattcggtcgtacgcgcgtaggttcggaattattatttcggtacgtagatattcgcgtttagaatgcggttagttttaggcgcgtaaataggtttataggggtcgacggtattcggcgggacggatttttgtatcgttttttcgta

SEQ ID NO: 5588 - DNA, 575 bp, Artificial Sequence
  chemically treated genomic DNA (Homo sapiens) CpG-island No: 5588
tacgaaaaaacgatacaaaaatccgtcccgccgaataccgtcgacccctataaacctatttacgcgcctaaaactaaccgcattctaaacgcgaatatctacgtaccgaaataataattccgaacctacgcgcgtacgaccgaatacgaaaaaaaaaaaaataccgtaaaaattcaaacgaataacccgtatataaatacaacccgcgaaaaacaaaaaaacgataataacaaccgctaacgctcaaccccgccgacgacccctaactttcccgccaaatacaaccgaaaaacaaacaaccatacgtatccttaacgaaaaaacccccacccgccgcgcgcgcccgacccccgcgcacacgcacacactcccctcgcaaacgtaaaacccaataaccacgaacatatcaaaaaaacaaaactaaaactacgaaataaaacgataaaacgacacacttaacgaccgaaaacaaaacgaaaaaatcgccaccacaaccaccgacgcccctttcttacctactcgtaaatctaccctccgacccaaaaaaaaccgaaaaccatttcttaactacccca

SEQ ID NO: 5589 - DNA, 586 bp, Artificial Sequence
  chemically treated genomic DNA (Homo sapiens) CpG-island No: 5589
gtaaaatcgttagagtttgaatagtttgttgtcgtcgttacgtgaataattggacggttttcgtcgttaggtttaggatagtttcggtaaagaagtataagaacgttatattttggattacgaaattcgtaatttttagtaatttaacgcgtaaatggtttaggaagcgattaatttgacgcgcgcgttgaaaggcgattataaaatttagggtatttgggtcgaggtattattgacgcggtcgttggaggttttcggtttgcgtgaagggtatgaatatgaaatttaggttagtatcgaaaatgacgttcgtttcgcggatgtagttcggatgttattcgtgcgttttgtcgatagggaaaagatcgtggtgattcgattgtcgaaattgacgtttgtttcgtcgtattgaattgttatgtttaatcgtcggaagatcgattattaatttcgcgaaagtcgttgttattacggaatagtatttgcgtcggttagcgtaattatgatgtcgtttgttagggacgttaaagatttattaatacgttgtttgggttttgcgaatatttggattatcgtgtttgatcgt

SEQ ID NO: 5590 - DNA, 586 bp, Artificial Sequence
  chemically treated genomic DNA (Homo sapiens) CpG-island No: 5590
acgatcaaacacgataatccaaatattcgcaaaacccaaacaacgtattaataaatctttaacgtccctaacaaacgacatcataattacgctaaccgacgcaaatactattccgtaataacaacgactttcgcgaaattaataatcgatcttccgacgattaaacataacaattcaatacgacgaaacaaacgtcaatttcgacaatcgaatcaccacgatcttttccctatcgacaaaacgcacgaataacatccgaactacatccgcgaaacgaacgtcattttcgatactaacctaaatttcatattcatacccttcacgcaaaccgaaaacctccaacgaccgcgtcaataatacctcgacccaaataccctaaattttataatcgcctttcaacgcgcgcgtcaaattaatcgcttcctaaaccatttacgcgttaaattactaaaaattacgaatttcgtaatccaaaatataacgttcttatacttctttaccgaaactatcctaaacctaacgacgaaaaccgtccaattattcacgtaacgacgacaacaaactattcaaactctaacgattttac

SEQ ID NO: 5591 - DNA, 586 bp, Artificial Sequence
  chemically treated genomic DNA (Homo sapiens) CpG-island No: 5591
acgattaggtacgataatttagatgttcgtagagtttaggtagcgtgttgataaatttttgacgtttttagtaaacggtattatggttacgttagtcgacgtagatattgtttcgtagtagtagcggttttcgcggggttgatagtcggtttttcggcggttaaatatagtagtttaatacggcgagatagacgttaatttcggtagtcggattattacgattttttttttgtcggtagagcgtacgagtgatattcgggttgtattcgcgaagcgggcgttattttcgatgttgatttgggttttatatttatattttttacgtagatcggaagtttttagcgatcgcgttaatagtatttcggtttaggtgttttgggttttatggtcgttttttagcgcgcgcgttaggttgatcgttttttgggttatttgcgcgttgagttgttggagattgcgaatttcgtggtttagggtatggcgtttttgtgtttttttatcgaagttgttttgaatttgacggcggaaatcgtttagttgtttacgtagcggcgataataggttgtttagattttgacggttttgt

SEQ ID NO: 5592 - DNA, 586 bp, Artificial Sequence
  chemically treated genomic DNA (Homo sapiens) CpG-island No: 5592
acaaaaccgtcaaaatctaaacaacctattatcgccgctacgtaaacaactaaacgatttccgccgtcaaattcaaaacaacttcgataaaaaaacacaaaaacgccataccctaaaccacgaaattcgcaatctccaacaactcaacgcgcaaataacccaaaaaacgatcaacctaacgcgcgcgctaaaaaacgaccataaaacccaaaacacctaaaccgaaatactattaacgcgatcgctaaaaacttccgatctacgtaaaaaatataaatataaaacccaaatcaacatcgaaaataacgcccgcttcgcgaatacaacccgaatatcactcgtacgctctaccgacaaaaaaaaaatcgtaataatccgactaccgaaattaacgtctatctcgccgtattaaactactatatttaaccgccgaaaaaccgactatcaaccccgcgaaaaccgctactactacgaaacaatatctacgtcgactaacgtaaccataataccgtttactaaaaacgtcaaaaatttatcaacacgctacctaaactctacgaacatctaaattatcgtacctaatcgt

SEQ ID NO: 5593 - DNA, 598 bp, Artificial Sequence
  chemically treated genomic DNA (Homo sapiens) CpG-island No: 5593
gacgttcgatgttatggggtttcgtttttatggtggaagagtatttcggcgttacgttggataagagtgaatcgcgtatcgattggttggttagatcgttgatcgaacgttagtgtgaatacgtagcggcggatgtttggtatttgttatcgattatcgttaagtttatggtagaaacggaggttttcggttggttatttgcggcgttggatgaatgtcgtttgatgtaaatgcgtcgttaggaagtcgttgcgtcggaagatgtttggcgtgatattattaatgtttggtaattacgtatacgttaattggtttgtttgtaattgttagtcgattggcgattgcgtaaggcgcgagagcgcgatttggcggtgaattttgtcgtgcgtgaagagtatttgtggtcggtagcgcgttatatgtcgggaagtttaggcgaattggatagtttgggtttattcggtagcgaaattcgtttttacggtaaaacgttgttagcgttggtggaaaaagcgtagatattgtcggaagatgttttatcgtagtcgatgtttaatttgatggatatgtcgggttatcgtaaagcgtttaaagcgat

SEQ ID NO: 5594 - DNA, 598 bp, Artificial Sequence
  chemically treated genomic DNA (Homo sapiens) CpG-island No: 5594
atcgctttaaacgctttacgataacccgacatatccatcaaattaaacatcgactacgataaaacatcttccgacaatatctacgctttttccaccaacgctaacaacgttttaccgtaaaaacgaatttcgctaccgaataaacccaaactatccaattcgcctaaacttcccgacatataacgcgctaccgaccacaaatactcttcacgcacgacaaaattcaccgccaaatcgcgctctcgcgccttacgcaatcgccaatcgactaacaattacaaacaaaccaattaacgtatacgtaattaccaaacattaataatatcacgccaaacatcttccgacgcaacgacttcctaacgacgcatttacatcaaacgacattcatccaacgccgcaaataaccaaccgaaaacctccgtttctaccataaacttaacgataatcgataacaaataccaaacatccgccgctacgtattcacactaacgttcgatcaacgatctaaccaaccaatcgatacgcgattcactcttatccaacgtaacgccgaaatactcttccaccataaaaacgaaaccccataacatcgaacgtc

SEQ ID NO: 5595 - DNA, 598 bp, Artificial Sequence
  chemically treated genomic DNA (Homo sapiens) CpG-island No: 5595
atcgttttaaacgttttacgataattcggtatgtttattaggttaagtatcggttgcggtaaggtatttttcggtaatgtttgcgttttttttattagcgttagtagcgttttatcgtgaaagcggatttcgttatcggataaatttaggttgtttagttcgtttaaatttttcggtatataacgcgttatcgattataaatgttttttacgtacgataaagtttatcgttagatcgcgttttcgcgttttgcgtagtcgttagtcggttaatagttgtagataggttagttggcgtgtgcgtaattgttaggtattggtgatattacgttaggtatttttcggcgtaacgattttttgacgacgtatttgtattaggcggtatttatttagcgtcgtaggtagttagtcggaggttttcgtttttattataagtttggcggtgatcggtaatagatattagatattcgtcgttgcgtatttatattgacgttcggttagcggtttggttagttagtcggtgcgcgatttatttttgtttagcgtaacgtcggaatatttttttattatggaagcgaaattttatgatatcgggcgtt

SEQ ID NO: 5596 - DNA, 598 bp, Artificial Sequence
  chemically treated genomic DNA (Homo sapiens) CpG-island No: 5596
aacgcccgatatcataaaatttcgcttccataataaaaaaatattccgacgttacgctaaacaaaaataaatcgcgcaccgactaactaaccaaaccgctaaccgaacgtcaatataaatacgcaacgacgaatatctaatatctattaccgatcaccgccaaacttataataaaaacgaaaacctccgactaactacctacgacgctaaataaataccgcctaatacaaatacgtcgtcaaaaaatcgttacgccgaaaaatacctaacgtaatatcaccaatacctaacaattacgcacacgccaactaacctatctacaactattaaccgactaacgactacgcaaaacgcgaaaacgcgatctaacgataaactttatcgtacgtaaaaaacatttataatcgataacgcgttatataccgaaaaatttaaacgaactaaacaacctaaatttatccgataacgaaatccgctttcacgataaaacgctactaacgctaataaaaaaaacgcaaacattaccgaaaaataccttaccgcaaccgatacttaacctaataaacataccgaattatcgtaaaacgtttaaaacgat

SEQ ID NO: 5597 - DNA, 694 bp, Artificial Sequence
  chemically treated genomic DNA (Homo sapiens) CpG-island No: 5597
gttacgtcgttgaggttgttgcggggtttggaaaggaagcgggaatggtagggagaggcgggattaggttgaggtgggcggggagtcgggggcggagttatgagtggatttcgtgtcggtttaggtggagttcggggcgcgcggggagaggcgggatcgagtcgaggtgggtgtggcgtggggcggggtaatggcggggcggggttcgtcgttttttggggtttagtttagttattcgattagttcgtcggtttcggagcggttttgttttttcgagcgcgggacgcggcgttttgggggaggagggcgaagcgacgcggcgatggtttcgcgggtattttcggggttcgtcgttttagtcgttgttgttttcgtgggaggcgtcgtgagttcgtcgttggtggtttcgggtgagtgttcggtcgtagtcggggcgtcgggtgttgagttcggtttcgggagcgcggaaggaagcgaggggtcgggacggtagtttcgcggcgttttgttttttggtatagtcgcgggatttcggtattgaataattggttgtttcgcggcggttcgggtagggcgcggtgcgtggtaacggttttcgttttttttttttcgcgggtttcgttttcgttttttttttttggggtttttttcgaggatttgtgttttttagcgttgggtagtgcggggcgtaggg

SEQ ID NO: 5598 - DNA, 694 bp, Artificial Sequence
  chemically treated genomic DNA (Homo sapiens) CpG-island No: 5598
ccctacgccccgcactacccaacgctaaaaaacacaaatcctcgaaaaaaaccccaaaaaaaaaaaacgaaaacgaaacccgcgaaaaaaaaaaaacgaaaaccgttaccacgcaccgcgccctacccgaaccgccgcgaaacaaccaattattcaataccgaaatcccgcgactataccaaaaaacaaaacgccgcgaaactaccgtcccgacccctcgcttccttccgcgctcccgaaaccgaactcaacacccgacgccccgactacgaccgaacactcacccgaaaccaccaacgacgaactcacgacgcctcccacgaaaacaacaacgactaaaacgacgaaccccgaaaatacccgcgaaaccatcgccgcgtcgcttcgccctcctcccccaaaacgccgcgtcccgcgctcgaaaaaacaaaaccgctccgaaaccgacgaactaatcgaataactaaactaaaccccaaaaaacgacgaaccccgccccgccattaccccgccccacgccacacccacctcgactcgatcccgcctctccccgcgcgccccgaactccacctaaaccgacacgaaatccactcataactccgcccccgactccccgcccacctcaacctaatcccgcctctccctaccattcccgcttcctttccaaaccccgcaacaacctcaacgacgtaac

SEQ ID NO: 5599 - DNA, 694 bp, Artificial Sequence
  chemically treated genomic DNA (Homo sapiens) CpG-island No: 5599
ttttacgtttcgtattgtttagcgttggggaatatagattttcggaggaggttttagggagggaaggcgggagcggggttcgcgggaggggagggacgggagtcgttgttacgtatcgcgttttgttcggatcgtcgcgggatagttagttgtttagtgtcgggatttcgcggttgtgttagaaagtaggacgtcgcggggttgtcgtttcgatttttcgttttttttcgcgttttcgggatcgggtttagtattcggcgtttcggttacgatcggatatttattcggagttattagcggcgaatttacggcgttttttacgaagatagtagcggttaggacggcggatttcgggagtgttcgcggagttatcgtcgcgtcgtttcgttttttttttttagggcgtcgcgtttcgcgttcgggaaggtagagtcgtttcggagtcggcgggttgatcgagtggttgggttgggttttagggagcggcgaatttcgtttcgttattgtttcgttttacgttatatttatttcggttcggtttcgttttttttcgcgcgtttcgggttttatttaagtcggtacgaggtttatttatggtttcgttttcgatttttcgtttattttagtttgatttcgtttttttttgttattttcgttttttttttaaatttcgtagtagttttagcggcgtagt

SEQ ID NO: 5600 - DNA, 694 bp, Artificial Sequence
  chemically treated genomic DNA (Homo sapiens) CpG-island No: 5600
actacgccgctaaaactactacgaaatttaaaaaaaaaacgaaaataacaaaaaaaaacgaaatcaaactaaaataaacgaaaaatcgaaaacgaaaccataaataaacctcgtaccgacttaaataaaacccgaaacgcgcgaaaaaaaacgaaaccgaaccgaaataaatataacgtaaaacgaaacaataacgaaacgaaattcgccgctccctaaaacccaacccaaccactcgatcaacccgccgactccgaaacgactctaccttcccgaacgcgaaacgcgacgccctaaaaaaaaaaaacgaaacgacgcgacgataactccgcgaacactcccgaaatccgccgtcctaaccgctactatcttcgtaaaaaacgccgtaaattcgccgctaataactccgaataaatatccgatcgtaaccgaaacgccgaatactaaacccgatcccgaaaacgcgaaaaaaaacgaaaaatcgaaacgacaaccccgcgacgtcctactttctaacacaaccgcgaaatcccgacactaaacaactaactatcccgcgacgatccgaacaaaacgcgatacgtaacaacgactcccgtccctcccctcccgcgaaccccgctcccgccttccctccctaaaacctcctccgaaaatctatattccccaacgctaaacaatacgaaacgtaaaa

SEQ ID NO: 5601 - DNA, 810 bp, Artificial Sequence
  chemically treated genomic DNA (Homo sapiens) CpG-island No: 5601
tcggttttcggggatagaaaggggacgtttcggattgcggaatttagtttcgggcgggagaaggcgaagaggaagcgggatttttatacgtttgtttttgttttttcgggaggaggtttttttcgggttttcggcggaggaaagagaaagagtcgcggtcggtatatcgttttcgaggtgggggcggcggtttttttcgtatttatcggcgaatttgagttatcgttttttatggttgttttttgttaggtgttattagcggtacgttttatttatatcggttatcgagcgtagggtttggtgggcgggtttttgcggcggtcgtggagtttcggttcgaagttggaagatgagttggttagttgtacgtggttagcggatcgacgcggggagaagtaagtcggggtaggtaaaagtataggcgcgggagaagcgagttttgtttttagcgattatttcgggaatttcgtttagttgtcggttgtagtagcggtttttgcggattgcggttgggaacggcgtcgcgtagagatttgggcggggtatcgcggggcgtggatagggcgtggtttggtcgttgtttaggtaatagcgttagtcgtataaaagaggcggggtcgtttggggttggtaggtcgggtgtttgagtggtaggttgagcgggattcggttgggcgtgggtgtggtacgcggttgggattcggcgtttttcgtcgttattttttttttacgtatttagttttttttttttattcgggtagtcgttcgtcgttttatgttaggttggggggttttgaggaacggaagtga

SEQ ID NO: 5602 - DNA, 810 bp, Artificial Sequence
  chemically treated genomic DNA (Homo sapiens) CpG-island No: 5602
tcacttccgttcctcaaaaccccccaacctaacataaaacgacgaacgactacccgaataaaaaaaaaaaactaaatacgtaaaaaaaaaataacgacgaaaaacgccgaatcccaaccgcgtaccacacccacgcccaaccgaatcccgctcaacctaccactcaaacacccgacctaccaaccccaaacgaccccgcctcttttatacgactaacgctattacctaaacaacgaccaaaccacgccctatccacgccccgcgataccccgcccaaatctctacgcgacgccgttcccaaccgcaatccgcaaaaaccgctactacaaccgacaactaaacgaaattcccgaaataatcgctaaaaacaaaactcgcttctcccgcgcctatacttttacctaccccgacttacttctccccgcgtcgatccgctaaccacgtacaactaaccaactcatcttccaacttcgaaccgaaactccacgaccgccgcaaaaacccgcccaccaaaccctacgctcgataaccgatataaataaaacgtaccgctaataacacctaacaaaaaacaaccataaaaaacgataactcaaattcgccgataaatacgaaaaaaaccgccgcccccacctcgaaaacgatataccgaccgcgactctttctctttcctccgccgaaaacccgaaaaaaacctcctcccgaaaaaacaaaaacaaacgtataaaaatcccgcttcctcttcgccttctcccgcccgaaactaaattccgcaatccgaaacgtcccctttctatccccgaaaaccga

SEQ ID NO: 5603 - DNA, 810 bp, Artificial Sequence
  chemically treated genomic DNA (Homo sapiens) CpG-island No: 5603
ttattttcgttttttagagttttttagtttggtatagggcgacgggcgattattcgggtgggagggaggggttgaatgcgtagggggaaggtggcggcggagggcgtcgagttttaatcgcgtgttatatttacgtttagtcgagtttcgtttagtttattatttagatattcggtttattagttttaggcggtttcgttttttttgtgcgattggcgttgttgtttgggtaacgattaggttacgttttgtttacgtttcgcggtgtttcgtttaggtttttgcgcggcgtcgtttttagtcgtagttcgtaggagtcgttgttgtagtcggtagttgggcgggattttcggggtagtcgttgggagtaaagttcgtttttttcgcgtttgtgtttttgtttgtttcggtttattttttttcgcgtcggttcgttggttacgtatagttgattagtttattttttagtttcggatcgaggttttacggtcgtcgtagggattcgtttattagattttgcgttcggtagtcggtgtgagtggaacgtgtcgttgatgatatttggtagaaggtagttatggagggcgatggtttagattcgtcggtgagtgcggaggggatcgtcgtttttatttcgagggcggtgtgtcgatcgcggttttttttttttttttcgtcgggagttcggagggagttttttttcgggagagtaaaggtaggcgtgtggggatttcgtttttttttcgttttttttcgttcggggttaggtttcgtaattcggggcgttttttttttattttcgagagtcgg

SEQ ID NO: 5604 - DNA, 810 bp, Artificial Sequence
  chemically treated genomic DNA (Homo sapiens) CpG-island No: 5604
ccgactctcgaaaataaaaaaaaaacgccccgaattacgaaacctaaccccgaacgaaaaaaaacgaaaaaaaaacgaaatccccacacgcctacctttactctcccgaaaaaaaactccctccgaactcccgacgaaaaaaaaaaaaaaaaccgcgatcgacacaccgccctcgaaataaaaacgacgatcccctccgcactcaccgacgaatctaaaccatcgccctccataactaccttctaccaaatatcatcaacgacacgttccactcacaccgactaccgaacgcaaaatctaataaacgaatccctacgacgaccgtaaaacctcgatccgaaactaaaaaataaactaatcaactatacgtaaccaacgaaccgacgcgaaaaaaaataaaccgaaacaaacaaaaacacaaacgcgaaaaaaacgaactttactcccaacgactaccccgaaaatcccgcccaactaccgactacaacaacgactcctacgaactacgactaaaaacgacgccgcgcaaaaacctaaacgaaacaccgcgaaacgtaaacaaaacgtaacctaatcgttacccaaacaacaacgccaatcgcacaaaaaaaacgaaaccgcctaaaactaataaaccgaatatctaaataataaactaaacgaaactcgactaaacgtaaatataacacgcgattaaaactcgacgccctccgccgccaccttccccctacgcattcaacccctccctcccacccgaataatcgcccgtcgccctataccaaactaaaaaactctaaaaaacgaaaataa

SEQ ID NO: 5605 - DNA, 535 bp, Artificial Sequence
  chemically treated genomic DNA (Homo sapiens) CpG-island No: 5605
ttgttaagcgtatatatatatatatatatatacgtatatatatacgcgtatatatatattcgggtttttaacggcgcgtacgtacgtagcgttcggggtagattagcgcggcggtcgtttttcgggacgttcggacgtcggagggtttcgattttcgcgcggtttatgcgttcgcgttcgtttcgttgtttcgcgaggttcgcgggatttttttcgtcgtcgtcgtcgcgttcgtcgttttcggaggagcgggttggtcgatcgttatcgcgtcgtttttcggtcgttttcgaagtcgttttatcgcggtttttgtcgttttggggtcgcgtttcgttttcgcgttttgggggttgagtcgagtaaatttcgcgtatcggtcgacgttcggcggggatttcgttgcgtattcgcgcgttcgggtgggcgttgggcgcgcggatttttggggagcgggttgtttttttcgttgtatttgttcggtttttttttcgtttgtaggggattttagagatatcgttatttcgtaaatttt

SEQ ID NO: 5606 - DNA, 535 bp, Artificial Sequence
  chemically treated genomic DNA (Homo sapiens) CpG-island No: 5606
aaaatttacgaaataacgatatctctaaaatcccctacaaacgaaaaaaaaaccgaacaaatacaacgaaaaaaacaacccgctccccaaaaatccgcgcgcccaacgcccacccgaacgcgcgaatacgcaacgaaatccccgccgaacgtcgaccgatacgcgaaatttactcgactcaacccccaaaacgcgaaaacgaaacgcgaccccaaaacgacaaaaaccgcgataaaacgacttcgaaaacgaccgaaaaacgacgcgataacgatcgaccaacccgctcctccgaaaacgacgaacgcgacgacgacgacgaaaaaaatcccgcgaacctcgcgaaacaacgaaacgaacgcgaacgcataaaccgcgcgaaaatcgaaaccctccgacgtccgaacgtcccgaaaaacgaccgccgcgctaatctaccccgaacgctacgtacgtacgcgccgttaaaaacccgaatatatatatacgcgtatatatatacgtatatatatatatatatatatacgcttaacaa

SEQ ID NO: 5607 - DNA, 535 bp, Artificial Sequence
  chemically treated genomic DNA (Homo sapiens) CpG-island No: 5607
aaagtttgcgaagtggcggtgtttttggagttttttgtaagcggggagggggtcgagtaggtgtagcgggaggggtagttcgttttttaaaggttcgcgcgtttagcgtttattcgggcgcgcgggtgcgtagcggggttttcgtcgggcgtcggtcggtgcgcgaagtttgttcggtttaatttttaaggcgcgggagcggggcgcggttttaggacggtagggatcgcgatggagcggtttcgggggcggtcgggggacggcgcggtggcggtcggttagttcgttttttcgggggcggcgggcgcggcggcggcggcgggaggggtttcgcgggtttcgcggagtagcggggcggacgcgggcgtatgagtcgcgcgggggtcggggtttttcggcgttcgggcgtttcgggaggcggtcgtcgcgttggtttgtttcgggcgttacgtgcgtgcgcgtcgttgggagttcgaatgtgtgtgtgcgcgtgtgtatgtgcgtgtgtgtgtgtgtgtgtgtgtgcgtttggtag

SEQ ID NO: 5608 - DNA, 535 bp, Artificial Sequence
  chemically treated genomic DNA (Homo sapiens) CpG-island No: 5608
ctaccaaacgcacacacacacacacacacacacgcacatacacacgcgcacacacacattcgaactcccaacgacgcgcacgcacgtaacgcccgaaacaaaccaacgcgacgaccgcctcccgaaacgcccgaacgccgaaaaaccccgacccccgcgcgactcatacgcccgcgtccgccccgctactccgcgaaacccgcgaaacccctcccgccgccgccgccgcgcccgccgcccccgaaaaaacgaactaaccgaccgccaccgcgccgtcccccgaccgcccccgaaaccgctccatcgcgatccctaccgtcctaaaaccgcgccccgctcccgcgccttaaaaattaaaccgaacaaacttcgcgcaccgaccgacgcccgacgaaaaccccgctacgcacccgcgcgcccgaataaacgctaaacgcgcgaacctttaaaaaacgaactacccctcccgctacacctactcgaccccctccccgcttacaaaaaactccaaaaacaccgccacttcgcaaacttt

SEQ ID NO: 5609 - DNA, 804 bp, Artificial Sequence
  chemically treated genomic DNA (Homo sapiens) CpG-island No: 5609
ggcggcggcggcggcggcggaggaggaggcggcggcggtcgtcgggcgttgtagtgggacgcgcgcggttgtgagtttgcgggatatgtttttcgcgtcggttttttgttggcggttatgaagaggtagaacgtgcggattttgttttttatcgtttgtatttttatttatttgttggtgggcgtcgtcgtgttcgacgttttcgagtcggattacgagatgcgcgaggaggagaaatttaaagtcgaggagattcggattaaggggaagtataatattagtagcgaggattatcggtagttggagttggtgattttgtagtcggaatcgtatcgcgtcggcgtttagtggaaattcgtcggttttttttattttgcgattacggttattattattataggtaagggttgggcgcgtcgttgggttttcgcgtttcgggaggagttcggggaggcggttgagcgcgtcgcgtcgggttgggtgtagggcgtcgagggttaaacgtagttttttttgggggttttttcgtagcgtttttttttttttagggagtttttttttcgcggcgttttcgagttttatttttcggggattttattcggtgttttttatcgcgttggtgtttgggtcgggcgtgcgagtttcgagcgagtgtgtttgagtcgggagggcggaggcgttatttttgcgaagagagtggagcgttaagaataattttatagtagatatttatttatttatcgtttcggcgcgggttgggttgcgcggggttttgagttttatatttattatttttttgggagt

SEQ ID NO: 5610 - DNA, 804 bp, Artificial Sequence
  chemically treated genomic DNA (Homo sapiens) CpG-island No: 5610
actcccaaaaaaataataaatataaaactcaaaaccccgcgcaacccaacccgcgccgaaacgataaataaataaatatctactataaaattattcttaacgctccactctcttcgcaaaaataacgcctccgccctcccgactcaaacacactcgctcgaaactcgcacgcccgacccaaacaccaacgcgataaaaaacaccgaataaaatccccgaaaaataaaactcgaaaacgccgcgaaaaaaaaactccctaaaaaaaaaaaaacgctacgaaaaaacccccaaaaaaaactacgtttaaccctcgacgccctacacccaacccgacgcgacgcgctcaaccgcctccccgaactcctcccgaaacgcgaaaacccaacgacgcgcccaacccttacctataataataataaccgtaatcgcaaaataaaaaaaaccgacgaatttccactaaacgccgacgcgatacgattccgactacaaaatcaccaactccaactaccgataatcctcgctactaatattatacttccccttaatccgaatctcctcgactttaaatttctcctcctcgcgcatctcgtaatccgactcgaaaacgtcgaacacgacgacgcccaccaacaaataaataaaaatacaaacgataaaaaacaaaatccgcacgttctacctcttcataaccgccaacaaaaaaccgacgcgaaaaacatatcccgcaaactcacaaccgcgcgcgtcccactacaacgcccgacgaccgccgccgcctcctcctccgccgccgccgccgccgcc

SEQ ID NO: 5611 - DNA, 804 bp, Artificial Sequence
  chemically treated genomic DNA (Homo sapiens) CpG-island No: 5611
atttttagagaggtagtaagtgtaaggtttagagtttcgcgtagtttagttcgcgtcggggcggtgggtgggtgggtgtttgttatgggattatttttagcgttttatttttttcgtaaaagtggcgttttcgttttttcggtttaggtatattcgttcggggttcgtacgttcggtttagatattagcgcggtggagagtatcgggtggggttttcgaagggtgaggttcggaggcgtcgcggagggggggttttttagagaggagggggcgttgcgggaaggtttttaagggaggttgcgtttaattttcgacgttttgtatttagttcggcgcggcgcgtttagtcgttttttcggatttttttcggggcgcgggagtttagcggcgcgtttagtttttatttatggtggtgatgatcgtgatcgtaaagtagaaggagtcggcgaatttttattggacgtcggcgcggtgcggtttcgattgtaggattattagttttagttgtcggtagttttcgttgttgatgttgtatttttttttgattcggattttttcggttttgagtttttttttttcgcgtatttcgtggttcgattcgagggcgtcgaatacggcggcgtttattagtaggtaggtgaaggtgtagacgatgagggatagagttcgtacgttttgtttttttatggtcgttagtaaggagtcggcgcggggggtatgtttcgtaggtttatagtcgcgcgcgttttattgtagcgttcggcggtcgtcgtcgttttttttttcgtcgtcgtcgtcgtcgtt

SEQ ID NO: 5612 - DNA, 804 bp, Artificial Sequence
  chemically treated genomic DNA (Homo sapiens) CpG-island No: 5612
aacgacgacgacgacgacgaaaaaaaaaacgacgacgaccgccgaacgctacaataaaacgcgcgcgactataaacctacgaaacataccccccgcgccgactccttactaacgaccataaaaaaacaaaacgtacgaactctatccctcatcgtctacaccttcacctacctactaataaacgccgccgtattcgacgccctcgaatcgaaccacgaaatacgcgaaaaaaaaaaactcaaaaccgaaaaaatccgaatcaaaaaaaaatacaacatcaacaacgaaaactaccgacaactaaaactaataatcctacaatcgaaaccgcaccgcgccgacgtccaataaaaattcgccgactccttctactttacgatcacgatcatcaccaccataaataaaaactaaacgcgccgctaaactcccgcgccccgaaaaaaatccgaaaaaacgactaaacgcgccgcgccgaactaaatacaaaacgtcgaaaattaaacgcaacctcccttaaaaaccttcccgcaacgccccctcctctctaaaaaaccccccctccgcgacgcctccgaacctcacccttcgaaaaccccacccgatactctccaccgcgctaatatctaaaccgaacgtacgaaccccgaacgaatatacctaaaccgaaaaaacgaaaacgccacttttacgaaaaaaataaaacgctaaaaataatcccataacaaacacccacccacccaccgccccgacgcgaactaaactacgcgaaactctaaaccttacacttactacctctctaaaaat

SEQ ID NO: 5613 - DNA, 557 bp, Artificial Sequence
  chemically treated genomic DNA (Homo sapiens) CpG-island No: 5613
ggagtatttgtagcgtggcggtggtcgagcgcggaggttcgttattgtttttgattagtattattagtttgtgtttggttacgtcgcgttcgtttagtagtttggcggtgcgtatttcgttattgtgcgtttatacgtcgaatagttcgggtttcgtggttttgagtagttggtacgatagttaggcgttttggttcgagtcgtcgtttatcgttattattttggttattaggtagttcggttcggtcgttcggggtattagttcggtgtagggcgcggagtcgttttgtagcgggtatagtacgaagggcgagttgtcgttggcgtttagtattagtacgcgtattagcgtttcgttgtttagcgtcggggagtcgcggtttgtggcgtttacgcggaattcgaattttcgtagggtttcgtagtttagcgatttgagggcgaataggtggtcgttgttcgcgttgatggagattagggatgtgaggggtaggtgcgggttttggggcggtagtagcgagtaggtgatttgggcgttggtgtttgagtttttgttt

SEQ ID NO: 5614 - DNA, 557 bp, Artificial Sequence
  chemically treated genomic DNA (Homo sapiens) CpG-island No: 5614
aaacaaaaactcaaacaccaacgcccaaatcacctactcgctactaccgccccaaaacccgcacctacccctcacatccctaatctccatcaacgcgaacaacgaccacctattcgccctcaaatcgctaaactacgaaaccctacgaaaattcgaattccgcgtaaacgccacaaaccgcgactccccgacgctaaacaacgaaacgctaatacgcgtactaatactaaacgccaacgacaactcgcccttcgtactatacccgctacaaaacgactccgcgccctacaccgaactaataccccgaacgaccgaaccgaactacctaataaccaaaataataacgataaacgacgactcgaaccaaaacgcctaactatcgtaccaactactcaaaaccacgaaacccgaactattcgacgtataaacgcacaataacgaaatacgcaccgccaaactactaaacgaacgcgacgtaaccaaacacaaactaataatactaatcaaaaacaataacgaacctccgcgctcgaccaccgccacgctacaaatactcc

SEQ ID NO: 5615 - DNA, 557 bp, Artificial Sequence
  chemically treated genomic DNA (Homo sapiens) CpG-island No: 5615
agatagagatttaggtattaacgtttaggttatttattcgttgttgtcgttttaggattcgtatttgttttttatatttttggtttttattaacgcggataacggttatttgttcgtttttaggtcgttggattacgaggttttgcgggagttcgagtttcgcgtgggcgttatagatcgcggtttttcggcgttgagtagcgaggcgttggtgcgcgtgttggtgttggacgttaacgataattcgtttttcgtgttgtattcgttgtagaacggtttcgcgttttgtatcgagttggtgtttcgggcggtcgagtcgggttatttggtgattaaggtggtggcggtggacggcgattcgggttagaacgtttggttgtcgtattagttgtttaaggttacggagttcgggttgttcggcgtgtgggcgtataatggcgaggtgcgtatcgttaggttgttgagcgagcgcgacgtggttaagtataggttagtggtgttggttaaggataatggcgagttttcgcgttcggttatcgttacgttgtaagtgtttt

SEQ ID NO: 5616 - DNA, 557 bp, Artificial Sequence
  chemically treated genomic DNA (Homo sapiens) CpG-island No: 5616
aaaacacttacaacgtaacgataaccgaacgcgaaaactcgccattatccttaaccaacaccactaacctatacttaaccacgtcgcgctcgctcaacaacctaacgatacgcacctcgccattatacgcccacacgccgaacaacccgaactccgtaaccttaaacaactaatacgacaaccaaacgttctaacccgaatcgccgtccaccgccaccaccttaatcaccaaataacccgactcgaccgcccgaaacaccaactcgatacaaaacgcgaaaccgttctacaacgaatacaacacgaaaaacgaattatcgttaacgtccaacaccaacacgcgcaccaacgcctcgctactcaacgccgaaaaaccgcgatctataacgcccacgcgaaactcgaactcccgcaaaacctcgtaatccaacgacctaaaaacgaacaaataaccgttatccgcgttaataaaaaccaaaaatataaaaaacaaatacgaatcctaaaacgacaacaacgaataaataacctaaacgttaatacctaaatctctatct

SEQ ID NO: 5617 - DNA, 659 bp, Artificial Sequence
  chemically treated genomic DNA (Homo sapiens) CpG-island No: 5617
  misc_feature (331)..(331): n is either a, c, g or t
tagcgttggatgcggcgtgcggtcggtaaagattagatcgtttatatagaattggcgatcgttcggcgtatcgttaaaattatcgtcgtaagtcgattacgggttgtcgtttttattatatttaattagcgattgatttatttagttttagacgaagtcgttttgtaaacggggatattgacgaaacgtttgttagtatttagcgaaatcgttaagattgttatttatcgcgtgggcgtattcgtaaaggattagcgggcgcgtttttttaggtagcgaaagttattttttgatggattatttcggtatagtcgggaagggttggttttantttacgcgcgcgtatatcgggtaaataatatcggtggtcgtggtgtcggtttcgtcgtttttatattgtatcgggcgggaaggatcgatagatttgatttagcgatatagcgcgtcgtgattagcgtcgtggcgttgatttattacgttatcgaatttagtatgaattaaattcggttagattattattgattcggcgcgtgggcggaatcgcgtcgtatagtcgaatcgtcggtttaagtcgatttgataagggtagtggcgtcgacgtcgtgcgtagattttgttgttataattaaatggttcgatacgtttggttattattaatt

SEQ ID NO: 5618 - DNA, 659 bp, Artificial Sequence
  chemically treated genomic DNA (Homo sapiens) CpG-island No: 5618
  misc_feature (329)..(329): n is either a, c, g or t
aattaataataaccaaacgtatcgaaccatttaattataacaacaaaatctacgcacgacgtcgacgccactacccttatcaaatcgacttaaaccgacgattcgactatacgacgcgattccgcccacgcgccgaatcaataataatctaaccgaatttaattcatactaaattcgataacgtaataaatcaacgccacgacgctaatcacgacgcgctatatcgctaaatcaaatctatcgatccttcccgcccgatacaatataaaaacgacgaaaccgacaccacgaccaccgatattatttacccgatatacgcgcgcgtaaantaaaaccaacccttcccgactataccgaaataatccatcaaaaaataactttcgctacctaaaaaaacgcgcccgctaatcctttacgaatacgcccacgcgataaataacaatcttaacgatttcgctaaatactaacaaacgtttcgtcaatatccccgtttacaaaacgacttcgtctaaaactaaataaatcaatcgctaattaaatataataaaaacgacaacccgtaatcgacttacgacgataattttaacgatacgccgaacgatcgccaattctatataaacgatctaatctttaccgaccgcacgccgcatccaacgcta

SEQ ID NO: 5619 - DNA, 659 bp, Artificial Sequence
  chemically treated genomic DNA (Homo sapiens) CpG-island No: 5619
  misc_feature (329)..(329): n is either a, c, g or t
gattagtgataattaagcgtatcgaattatttgattataatagtagaatttgcgtacgacgtcggcgttattgtttttgttaagtcggtttaagtcgacggttcgattatacgacgcgatttcgtttacgcgtcgagttagtgatggtttgatcgagtttaatttatgttgagttcggtggcgtaatgaattagcgttacggcgttaattacgacgcgttgtatcgttggattaaatttgtcgatttttttcgttcggtgtagtatgaaggcggcggagtcgatattacggttatcgatattatttgttcgatgtacgcgcgcgtggantaagattagtttttttcggttgtgtcgaaatggtttattaaaaaatggttttcgttatttggagagacgcgttcgttgattttttgcgaatacgtttacgcgatgggtaatagttttggcggtttcgttaaatattggtaggcgtttcgttagtattttcgtttatagggcggtttcgtttgggattgggtggattagtcgttgattaaatatgatgaaaacggtaattcgtggtcggtttacggcggtgattttggcgatacgtcgaacgatcgttagttttgtatgaacggtttggtttttgtcgatcgtacgtcgtatttagcgttg

SEQ ID NO: 5620 - DNA, 659 bp, Artificial Sequence
  chemically treated genomic DNA (Homo sapiens) CpG-island No: 5620
  misc_feature (331)..(331): n is either a, c, g or t
caacgctaaatacgacgtacgatcgacaaaaaccaaaccgttcatacaaaactaacgatcgttcgacgtatcgccaaaatcaccgccgtaaaccgaccacgaattaccgttttcatcatatttaatcaacgactaatccacccaatcccaaacgaaaccgccctataaacgaaaatactaacgaaacgcctaccaatatttaacgaaaccgccaaaactattacccatcgcgtaaacgtattcgcaaaaaatcaacgaacgcgtctctccaaataacgaaaaccattttttaataaaccatttcgacacaaccgaaaaaaactaatcttantccacgcgcgcgtacatcgaacaaataatatcgataaccgtaatatcgactccgccgccttcatactacaccgaacgaaaaaaatcgacaaatttaatccaacgatacaacgcgtcgtaattaacgccgtaacgctaattcattacgccaccgaactcaacataaattaaactcgatcaaaccatcactaactcgacgcgtaaacgaaatcgcgtcgtataatcgaaccgtcgacttaaaccgacttaacaaaaacaataacgccgacgtcgtacgcaaattctactattataatcaaataattcgatacgcttaattatcactaatc

SEQ ID NO: 5621 - DNA, 553 bp, Artificial Sequence
  chemically treated genomic DNA (Homo sapiens) CpG-island No: 5621
gttggcgggagtggggtatgcgacgttgaatgaaggggtaatagcgaaaatttattagattagatttggtcgggattttcggatgcgtttttttaaagcgttttagtagttttagcgattagttgtaatttgtattaggtcgtatttgattgttggttttttgttggaacgaatatattttgaagtcggaatatatttcgttgtaggattttaacgataattttttcgttaatatttagaaagacggtatttattcggtgatttcgcgtttttcgggcggtgaaattatttcggaagggttgatggcggtaggtcgtatcgcgcgtgaatttaatttttatattaagattattggtttttagtcgtttggacgatgtttggcgtatagaaagacgatttgtcggagatttggcgttagttgattgaagtcggtttcgaaatcggttatgtttatgcgaaagtattgcgtatggcgaaaatttgcgtggggtagtatttggtgtcgttacggcgttggcgataggcgtcgattcgggtggtattgggaaatcgt

SEQ ID NO: 5622 - DNA, 553 bp, Artificial Sequence
  chemically treated genomic DNA (Homo sapiens) CpG-island No: 5622
acgatttcccaataccacccgaatcgacgcctatcgccaacgccgtaacgacaccaaatactaccccacgcaaattttcgccatacgcaatactttcgcataaacataaccgatttcgaaaccgacttcaatcaactaacgccaaatctccgacaaatcgtctttctatacgccaaacatcgtccaaacgactaaaaaccaataatcttaatataaaaattaaattcacgcgcgatacgacctaccgccatcaacccttccgaaataatttcaccgcccgaaaaacgcgaaatcaccgaataaataccgtctttctaaatattaacgaaaaaattatcgttaaaatcctacaacgaaatatattccgacttcaaaatatattcgttccaacaaaaaaccaacaatcaaatacgacctaatacaaattacaactaatcgctaaaactactaaaacgctttaaaaaaacgcatccgaaaatcccgaccaaatctaatctaataaattttcgctattaccccttcattcaacgtcgcataccccactcccgccaac

SEQ ID NO: 5623 - DNA, 553 bp, Artificial Sequence
  chemically treated genomic DNA (Homo sapiens) CpG-island No: 5623
acggttttttagtattattcgagtcgacgtttgtcgttaacgtcgtagcggtattaggtgttattttacgtaggttttcgttatacgtagtgttttcgtataggtatgatcggtttcgaagtcggttttaattagttgacgttagattttcggtagatcgtttttttgtgcgttaaatatcgtttagacgattgggagttagtgattttggtgtagagattaaatttacgcgcgatacgatttatcgttattagttttttcggggtgattttatcgttcggagaacgcgggattatcgagtaggtgtcgtttttttggatgttagcgaggaagttgtcgttagaattttgtagcggagtatgtttcggttttagaatgtattcgttttagtaggaggttagtagttaggtacggtttggtgtagattataattggtcgttgaagttgttggaacgttttaaagaagcgtattcggaaatttcgattaagtttggtttgatggattttcgttgttatttttttatttagcgtcgtatgttttattttcgttagt

SEQ ID NO: 5624 - DNA, 553 bp, Artificial Sequence
  chemically treated genomic DNA (Homo sapiens) CpG-island No: 5624
actaacgaaaataaaacatacgacgctaaataaaaaaataacaacgaaaatccatcaaaccaaacttaatcgaaatttccgaatacgcttctttaaaacgttccaacaacttcaacgaccaattataatctacaccaaaccgtacctaactactaacctcctactaaaacgaatacattctaaaaccgaaacatactccgctacaaaattctaacgacaacttcctcgctaacatccaaaaaaacgacacctactcgataatcccgcgttctccgaacgataaaatcaccccgaaaaaactaataacgataaatcgtatcgcgcgtaaatttaatctctacaccaaaatcactaactcccaatcgtctaaacgatatttaacgcacaaaaaaacgatctaccgaaaatctaacgtcaactaattaaaaccgacttcgaaaccgatcatacctatacgaaaacactacgtataacgaaaacctacgtaaaataacacctaataccgctacgacgttaacgacaaacgtcgactcgaataatactaaaaaaccgt

SEQ ID NO: 5625 - DNA, 1011 bp, Artificial Sequence
  chemically treated genomic DNA (Homo sapiens) CpG-island No: 5625
  misc_feature (793)..(793): n is either a, c, g or t
  misc_feature (803)..(804): n is either a, c, g or t
  misc_feature (815)..(815): n is either a, c, g or t
  misc_feature (821)..(822): n is either a, c, g or t
  misc_feature (826)..(826): n is either a, c, g or t
  misc_feature (828)..(829): n is either a, c, g or t
  misc_feature (835)..(835): n is either a, c, g or t
  misc_feature (837)..(838): n is either a, c, g or t
  misc_feature (844)..(844): n is either a, c, g or t
  misc_feature (846)..(847): n is either a, c, g or t
  misc_feature (859)..(860): n is either a, c, g or t
  misc_feature (868)..(869): n is either a, c, g or t
  misc_feature (880)..(881): n is either a, c, g or t
  misc_feature (885)..(886): n is either a, c, g or t
  misc_feature (897)..(897): n is either a, c, g or t
  misc_feature (901)..(902): n is either a, c, g or t
  misc_feature (921)..(922): n is either a, c, g or t
  misc_feature (950)..(950): n is either a, c, g or t
tacgtattcgttcgcgttgacggtgagcgaggcgcgattgaggacgggtaggcgtacgtcgttttgttggtgtaggatgaaggttttattgacgttttgtacgttaattatttttcgtttcgtggttcgggtgtcggatgcgacgttgacgcgttttattcgatttacggggagcgtatttgtaggtcggataaggcgtttacgtcgtattcggtatcggtttaattttgtaaaatcgatgatattagtagttgtgtatacggatgatgcgggtcgtcgagtacgcggtcggttaatttattttttattatttgtttttgttttattattagtaaacggttcgttagtaggcgggcgacgtttaaattatgggttgataattattatcgcgaggtttagttttattattaggtcgcgtagtaggtcgagtaggcgggtttgtatcgatatatttagttcgtcggtcggtttatttataaatattagtttcggatgcgttattaggttgcgggtaatttgtaaacgttgttgtatatcgtcggaaaaggtggtcggtaggtcgtcgattcggttggcgggaatttttattttttttagttatttttgcgcggtggtacgaatatcgtcgtaatgacgtgtttcggtcgttattagtcgttcgtcgatattgtcgtttgtcgatatttggcggcgtaggtcgtcgagtggatgttgatgtattacgttttattcggtacgtagtaggcgacggcggtcggtttcgtttattgtatatagcgaacggttttcgttnacgtgaattnntttttttgggnttgcgnngcgntnntaggtngnncgcggnanngattcgattttnnagtagcgnntggtttttttnngganngtcggattttntcgnnataagtgtttagtattttnntttcggttataatattaataagagatantcgttaaagtttttgttcggcgcgtaaaggtgggttaggttattgatcgaaagtaacggtt

SEQ ID NO: 5626 - DNA, 1011 bp, Artificial Sequence
  chemically treated genomic DNA (Homo sapiens) CpG-island No: 5626
  misc_feature (62)..(62): n is either a, c, g or t
  misc_feature (90)..(91): n is either a, c, g or t
  misc_feature (110)..(111): n is either a, c, g or t
  misc_feature (115)..(115): n is either a, c, g or t
  misc_feature (126)..(127): n is either a, c, g or t
  misc_feature (131)..(132): n is either a, c, g or t
  misc_feature (143)..(144): n is either a, c, g or t
  misc_feature (152)..(153): n is either a, c, g or t
  misc_feature (165)..(166): n is either a, c, g or t
  misc_feature (168)..(168): n is either a, c, g or t
  misc_feature (174)..(175): n is either a, c, g or t
  misc_feature (177)..(177): n is either a, c, g or t
  misc_feature (183)..(184): n is either a, c, g or t
  misc_feature (186)..(186): n is either a, c, g or t
  misc_feature (190)..(191): n is either a, c, g or t
  misc_feature (197)..(197): n is either a, c, g or t
  misc_feature (208)..(209): n is either a, c, g or t
  misc_feature (219)..(219): n is either a, c, g or t
aaccgttactttcgatcaataacctaacccacctttacgcgccgaacaaaaactttaacgantatctcttattaatattataaccgaaannaaaatactaaacacttatnncganaaaatccgacnntccnnaaaaaaaccanncgctactnnaaaatcgaatcnntnccgcgnncnacctannancgcnncgcaancccaaaaaaannaattcacgtnaacgaaaaccgttcgctatatacaataaacgaaaccgaccgccgtcgcctactacgtaccgaataaaacgtaatacatcaacatccactcgacgacctacgccgccaaatatcgacaaacgacaatatcgacgaacgactaataacgaccgaaacacgtcattacgacgatattcgtaccaccgcgcaaaaataactaaaaaaaataaaaattcccgccaaccgaatcgacgacctaccgaccaccttttccgacgatatacaacaacgtttacaaattacccgcaacctaataacgcatccgaaactaatatttataaataaaccgaccgacgaactaaatatatcgatacaaacccgcctactcgacctactacgcgacctaataataaaactaaacctcgcgataataattatcaacccataatttaaacgtcgcccgcctactaacgaaccgtttactaataataaaacaaaaacaaataataaaaaataaattaaccgaccgcgtactcgacgacccgcatcatccgtatacacaactactaatatcatcgattttacaaaattaaaccgataccgaatacgacgtaaacgccttatccgacctacaaatacgctccccgtaaatcgaataaaacgcgtcaacgtcgcatccgacacccgaaccacgaaacgaaaaataattaacgtacaaaacgtcaataaaaccttcatcctacaccaacaaaacgacgtacgcctacccgtcctcaatcgcgcctcgctcaccgtcaacgcgaacgaatacgta

SEQ ID NO: 5627 - DNA, 1011 bp, Artificial Sequence
  chemically treated genomic DNA (Homo sapiens) CpG-island No: 5627
  misc_feature (62)..(62): n is either a, c, g or t
  misc_feature (90)..(91): n is either a, c, g or t
  misc_feature (110)..(111): n is either a, c, g or t
  misc_feature (115)..(115): n is either a, c, g or t
  misc_feature (126)..(127): n is either a, c, g or t
  misc_feature (131)..(132): n is either a, c, g or t
  misc_feature (143)..(144): n is either a, c, g or t
  misc_feature (152)..(153): n is either a, c, g or t
  misc_feature (165)..(166): n is either a, c, g or t
  misc_feature (168)..(168): n is either a, c, g or t
  misc_feature (174)..(175): n is either a, c, g or t
  misc_feature (177)..(177): n is either a, c, g or t
  misc_feature (183)..(184): n is either a, c, g or t
  misc_feature (186)..(186): n is either a, c, g or t
  misc_feature (190)..(191): n is either a, c, g or t
  misc_feature (197)..(197): n is either a, c, g or t
  misc_feature (208)..(209): n is either a, c, g or t
  misc_feature (219)..(219): n is either a, c, g or t
aatcgttattttcggttaataatttgatttatttttacgcgtcgggtaaaggttttagcgantgttttttgttgatgttatggtcggggnngaagtgttgggtatttgtnncggnggaattcggtnntttnngggaagattanncgttgttnngaagtcgagttnntntcgcgnntngtttgnnancgtnncgtagntttagggggannaatttacgtnagcgagaatcgttcgttgtatgtaatgagcgaggtcgatcgtcgtcgtttgttgcgtatcgaatggggcgtggtgtattagtatttattcgacggtttgcgtcgttaggtgtcggtaggcggtaatatcggcgagcggttgatggcgatcggggtacgttattacggcgatattcgtgttatcgcgtagaagtggttggaagaggtggagattttcgttaatcggatcgacgatttgtcgattatttttttcggcggtatgtagtagcgtttgtagattgttcgtaatttggtgacgtattcgaagttggtgtttatggatgaatcgatcggcgggttggatgtgtcggtgtaggttcgtttgttcgatttgttgcgcggtttggtggtggagttgaatttcgcggtggtgattgttaatttatgatttaggcgtcgttcgtttgttggcggatcgtttgttggtgatgaagtaggggtaagtggtggagagtgggttaatcgatcgcgtgttcgacgattcgtattattcgtatatatagttgttggtgttatcggttttgtagaattgagtcggtgtcggatgcggcgtaaacgttttattcggtttataaatgcgtttttcgtaggtcggataagacgcgttagcgtcgtattcgatattcgaattacgaggcgaaaaatgattaacgtataaaacgttagtaaaatttttattttgtattagtaaaacggcgtgcgtttgttcgtttttaatcgcgtttcgtttatcgttaacgcgggcgaatgcgtg

SEQ ID NO: 5628 - DNA, 1011 bp, Artificial Sequence
  chemically treated genomic DNA (Homo sapiens) CpG-island No: 5628
  misc_feature (793)..(793): n is either a, c, g or t
  misc_feature (803)..(804): n is either a, c, g or t
  misc_feature (815)..(815): n is either a, c, g or t
  misc_feature (821)..(822): n is either a, c, g or t
  misc_feature (826)..(826): n is either a, c, g or t
  misc_feature (828)..(829): n is either a, c, g or t
  misc_feature (835)..(835): n is either a, c, g or t
  misc_feature (837)..(838): n is either a, c, g or t
  misc_feature (844)..(844): n is either a, c, g or t
  misc_feature (846)..(847): n is either a, c, g or t
  misc_feature (859)..(860): n is either a, c, g or t
  misc_feature (868)..(869): n is either a, c, g or t
  misc_feature (880)..(881): n is either a, c, g or t
  misc_feature (885)..(886): n is either a, c, g or t
  misc_feature (897)..(897): n is either a, c, g or t
  misc_feature (901)..(902): n is either a, c, g or t
  misc_feature (921)..(922): n is either a, c, g or t
  misc_feature (950)..(950): n is either a, c, g or t
cacgcattcgcccgcgttaacgataaacgaaacgcgattaaaaacgaacaaacgcacgccgttttactaatacaaaataaaaattttactaacgttttatacgttaatcatttttcgcctcgtaattcgaatatcgaatacgacgctaacgcgtcttatccgacctacgaaaaacgcatttataaaccgaataaaacgtttacgccgcatccgacaccgactcaattctacaaaaccgataacaccaacaactatatatacgaataatacgaatcgtcgaacacgcgatcgattaacccactctccaccacttacccctacttcatcaccaacaaacgatccgccaacaaacgaacgacgcctaaatcataaattaacaatcaccaccgcgaaattcaactccaccaccaaaccgcgcaacaaatcgaacaaacgaacctacaccgacacatccaacccgccgatcgattcatccataaacaccaacttcgaatacgtcaccaaattacgaacaatctacaaacgctactacataccgccgaaaaaaataatcgacaaatcgtcgatccgattaacgaaaatctccacctcttccaaccacttctacgcgataacacgaatatcgccgtaataacgtaccccgatcgccatcaaccgctcgccgatattaccgcctaccgacacctaacgacgcaaaccgtcgaataaatactaatacaccacgccccattcgatacgcaacaaacgacgacgatcgacctcgctcattacatacaacgaacgattctcgctnacgtaaattnntccccctaaanctacgnnacgntnncaaacnanncgcganannaactcgacttcnnaacaacgnntaatcttcccnnaaannaccgaattccnccgnnacaaatacccaacacttcnnccccgaccataacatcaacaaaaaacantcgctaaaacctttacccgacgcgtaaaaataaatcaaattattaaccgaaaataacgatt

SEQ ID NO: 5629 - DNA, 1057 bp, Artificial Sequence
  chemically treated genomic DNA (Homo sapiens) CpG-island No: 5629
  misc_feature (391)..(391): n is either a, c, g or t
  misc_feature (399)..(399): n is either a, c, g or t
  misc_feature (401)..(401): n is either a, c, g or t
  misc_feature (404)..(404): n is either a, c, g or t
  misc_feature (406)..(406): n is either a, c, g or t
  misc_feature (408)..(408): n is either a, c, g or t
  misc_feature (412)..(412): n is either a, c, g or t
  misc_feature (414)..(414): n is either a, c, g or t
  misc_feature (417)..(417): n is either a, c, g or t
  misc_feature (419)..(419): n is either a, c, g or t
  misc_feature (433)..(433): n is either a, c, g or t
  misc_feature (750)..(751): n is either a, c, g or t
  misc_feature (758)..(758): n is either a, c, g or t
atagttgtgggtcgattcgtagatggcgtatggtttattttattgttgaacggtgaacgggtgatcgtcgaaatcgagattttttacgcgggtaaacggcggtatcgtatagatgcgtttttcgcgtttcgcgtcgaatagttgtagggcgggtattatgtttatttttgggttatcgaatttcgggatcggcgacgggtttattacgtagcgtttatttatttttatcggataggcgtaggtggtggcgatatgatcgaagcgggcgatatttttatatagttttatttgtattacgtcgtatttttttagcgcgtgtatggtgcgggttttcgtttcgcgcggttcgataaagcgtagcggttcggggattggtatttggaagataatnatttgaantnttntntngggntntangncggggtcgtttttnggggatgcggtgacgcgtttggataatcgtcgtatcgttcgtacgtttcgtggtgtttatttcggttacgcgtttgaagaagttgcgaatcgatacggcgttggtggtgtattcgcgttttggttaattatttttagtacgtcgttttcgttaattacgttggcggtaagttgaatgtcgtcggttttttagtcgtacggtatcggtatttcgcgttcgttaaacggtatttgataatcggggatcgttatcgtttttaagatggcgcggcggattatgcgtttggtttgttcgtcgaggtaggtaaagttgtagtnncgtttangattagttatggttttgtttttgttgtagacgtttgagtagttttagttcggtttggaaatcgacgtagtgggggagtttgaggtgtgagataaagtttgcggtttcgacgttgtcggtatgtgttagtacgaattttttattttgcgtcgggtttgtcgcgtgttcgtcgtatttcggggtttgtagagcgcggtcgattagcgttatcgttatcgttttgcgttcgtttatgtcgaatattagttcgtagtcgcgcgtgaagtgcggcggtttattcggcgggtcgataaaatcgtt

SEQ ID NO: 5630 - DNA, 1057 bp, Artificial Sequence
  chemically treated genomic DNA (Homo sapiens) CpG-island No: 5630
  misc_feature (300)..(300): n is either a, c, g or t
  misc_feature (307)..(308): n is either a, c, g or t
  misc_feature (625)..(625): n is either a, c, g or t
  misc_feature (639)..(639): n is either a, c, g or t
  misc_feature (641)..(641): n is either a, c, g or t
  misc_feature (644)..(644): n is either a, c, g or t
  misc_feature (646)..(646): n is either a, c, g or t
  misc_feature (650)..(650): n is either a, c, g or t
  misc_feature (652)..(652): n is either a, c, g or t
  misc_feature (654)..(654): n is either a, c, g or t
  misc_feature (657)..(657): n is either a, c, g or t
  misc_feature (659)..(659): n is either a, c, g or t
  misc_feature (667)..(667): n is either a, c, g or t
aacgattttatcgacccgccgaataaaccgccgcacttcacgcgcgactacgaactaatattcgacataaacgaacgcaaaacgataacgataacgctaatcgaccgcgctctacaaaccccgaaatacgacgaacacgcgacaaacccgacgcaaaataaaaaattcgtactaacacataccgacaacgtcgaaaccgcaaactttatctcacacctcaaactcccccactacgtcgatttccaaaccgaactaaaactactcaaacgtctacaacaaaaacaaaaccataactaatcntaaacgnnactacaactttacctacctcgacgaacaaaccaaacgcataatccgccgcgccatcttaaaaacgataacgatccccgattatcaaataccgtttaacgaacgcgaaataccgataccgtacgactaaaaaaccgacgacattcaacttaccgccaacgtaattaacgaaaacgacgtactaaaaataattaaccaaaacgcgaatacaccaccaacgccgtatcgattcgcaacttcttcaaacgcgtaaccgaaataaacaccacgaaacgtacgaacgatacgacgattatccaaacgcgtcaccgcatccccnaaaaacgaccccgncntanancccnananaananttcaaatnattatcttccaaataccaatccccgaaccgctacgctttatcgaaccgcgcgaaacgaaaacccgcaccatacacgcgctaaaaaaatacgacgtaatacaaataaaactatataaaaatatcgcccgcttcgatcatatcgccaccacctacgcctatccgataaaaataaataaacgctacgtaataaacccgtcgccgatcccgaaattcgataacccaaaaataaacataatacccgccctacaactattcgacgcgaaacgcgaaaaacgcatctatacgataccgccgtttacccgcgtaaaaaatctcgatttcgacgatcacccgttcaccgttcaacaataaaataaaccatacgccatctacgaatcgacccacaactat

SEQ ID NO: 5631 - DNA, 1057 bp, Artificial Sequence
  chemically treated genomic DNA (Homo sapiens) CpG-island No: 5631
  misc_feature (300)..(300): n is either a, c, g or t
  misc_feature (307)..(308): n is either a, c, g or t
  misc_feature (625)..(625): n is either a, c, g or t
  misc_feature (639)..(639): n is either a, c, g or t
  misc_feature (641)..(641): n is either a, c, g or t
  misc_feature (644)..(644): n is either a, c, g or t
  misc_feature (646)..(646): n is either a, c, g or t
  misc_feature (650)..(650): n is either a, c, g or t
  misc_feature (652)..(652): n is either a, c, g or t
  misc_feature (654)..(654): n is either a, c, g or t
  misc_feature (657)..(657): n is either a, c, g or t
  misc_feature (659)..(659): n is either a, c, g or t
  misc_feature (667)..(667): n is either a, c, g or t
aacggttttatcgattcgtcgggtgagtcgtcgtattttacgcgcggttacgggttggtgttcggtatgagcgagcgtaaagcgatggcgatggcgttggtcgatcgcgttttgtaagtttcggagtacggcgagtacgcgataggttcggcgtaggatgaagagttcgtgttggtatatgtcgataacgtcgaagtcgtaggttttgttttatattttaaatttttttattacgtcgatttttaggtcgaattggagttatttaaacgtttgtaataggagtagaattatggttaattntgagcgnngttataattttgtttatttcgacgagtagattaaacgtatgattcgtcgcgttattttaaaagcggtggcgattttcggttattaggtgtcgtttggcgggcgcgagatgtcgatgtcgtacggttggggaatcggcggtatttagtttatcgttagcgtgattggcgaaagcgacgtgttgaaggtgattgattagggcgcggatatattattaacgtcgtgtcgattcgtaatttttttaagcgcgtgatcggggtaaatattacggaacgtacggacgatgcgacggttatttagacgcgttatcgtatttttngaaagcggtttcgntntgnantttngnanagnantttagatnattattttttaggtgttaattttcgagtcgttgcgttttatcgagtcgcgcgaaacggaaattcgtattatgtacgcgttggaagagtacggcgtgatgtaggtgaaattgtatgaagatatcgttcgtttcggttatatcgttattatttacgtttattcggtgaaggtaaatgggcgttacgtgatggattcgtcgtcgatttcgaaattcgataatttaaaaatggatatgatgttcgttttgtaattgttcggcgcggggcgcgagaagcgtatttatgcggtgtcgtcgtttattcgcgtggaaagtttcgatttcgacgattattcgtttatcgtttagtagtgggatgagttatgcgttatttgcggatcgatttatagttat

SEQ ID NO: 5632 - DNA, 1057 bp, Artificial Sequence
  chemically treated genomic DNA (Homo sapiens) CpG-island No: 5632
  misc_feature (391)..(391): n is either a, c, g or t
  misc_feature (399)..(399): n is either a, c, g or t
  misc_feature (401)..(401): n is either a, c, g or t
  misc_feature (404)..(404): n is either a, c, g or t
  misc_feature (406)..(406): n is either a, c, g or t
  misc_feature (408)..(408): n is either a, c, g or t
  misc_feature (412)..(412): n is either a, c, g or t
  misc_feature (414)..(414): n is either a, c, g or t
  misc_feature (417)..(417): n is either a, c, g or t
  misc_feature (419)..(419): n is either a, c, g or t
  misc_feature (433)..(433): n is either a, c, g or t
  misc_feature (750)..(751): n is either a, c, g or t
  misc_feature (758)..(758): n is either a, c, g or t
ataactataaatcgatccgcaaataacgcataactcatcccactactaaacgataaacgaataatcgtcgaaatcgaaactttccacgcgaataaacgacgacaccgcataaatacgcttctcgcgccccgcgccgaacaattacaaaacgaacatcatatccatttttaaattatcgaatttcgaaatcgacgacgaatccatcacgtaacgcccatttaccttcaccgaataaacgtaaataataacgatataaccgaaacgaacgatatcttcatacaatttcacctacatcacgccgtactcttccaacgcgtacataatacgaatttccgtttcgcgcgactcgataaaacgcaacgactcgaaaattaacacctaaaaaataatnatctaaantnctntncnaaantncanancgaaaccgctttcnaaaaatacgataacgcgtctaaataaccgtcgcatcgtccgtacgttccgtaatatttaccccgatcacgcgcttaaaaaaattacgaatcgacacgacgttaataatatatccgcgccctaatcaatcaccttcaacacgtcgctttcgccaatcacgctaacgataaactaaataccgccgattccccaaccgtacgacatcgacatctcgcgcccgccaaacgacacctaataaccgaaaatcgccaccgcttttaaaataacgcgacgaatcatacgtttaatctactcgtcgaaataaacaaaattataacnncgctcanaattaaccataattctactcctattacaaacgtttaaataactccaattcgacctaaaaatcgacgtaataaaaaaatttaaaatataaaacaaaacctacgacttcgacgttatcgacatataccaacacgaactcttcatcctacgccgaacctatcgcgtactcgccgtactccgaaacttacaaaacgcgatcgaccaacgccatcgccatcgctttacgctcgctcataccgaacaccaacccgtaaccgcgcgtaaaatacgacgactcacccgacgaatcgataaaaccgtt

SEQ ID NO: 5633 - DNA, 1431 bp, Artificial Sequence
  chemically treated genomic DNA (Homo sapiens) CpG-island No: 5633
  misc_feature (1371)..(1372): n is either a, c, g or t
tcggcgcgtttgttttcgttaattatttcgcgattttggagattaagcgtttgcgttggatttttagttattagttttatcgtttgcggtagcgtaaagcggttgttttggttatcggcgacgcgaaatgtcgtatcgagtaggttggcggggtagtagtcggaagagaggatatttagtaggttaagttgcgttagtttattggtcgttacgttgtcggagtgcgagtcgtcgcgtataatattcggcgcgtttattagtacgtttatgttatgtttgcgcgaggttttcgtcgtttcgaacgtggtgggaaattcggcgattacgttgttaagttggtgagatttagtaacgtgggcgtgggtggcgttatcgtggttggtaagcgtaatttttcgcgcgcggtatagggcggcgatggattcgcgattcggttgcgattagcgtgcggcgagcgttagttgttttttttcgtattgttgtatttgcgtattagtgagggagtatttgttttgataatattcgcgatatttttcgcggttggcgaattggcgttggttcggcgagtggtttattagcgatattagcgttatcggttcgcgttgtattagttttttaaatagcggtagcgtggtgtgatgcggtagttcgtagcgtagatgtagacggtgttcggcgcggttgacgtcgcgtttttgcgttttttcgatggcgttgattattttttttagattttttagtcgatcgtcgtcgtcgcgtacgtcgttaattgttacggtatttagtacggtggtgatgtcgttcgttattattagcgcgtcgtggttgtttatcgtcgagtgggtaggttagttaattttcgggcgcggggtgaagaatttatttagattatcggtatgtagtttaattagtttcggtagtagttagtcgttttcgtcgtttatcgttttcggtaggcggttttggttttcggtaaaggcgcggatttcgtcgttttgtatttttagcgaatcgtttattatttcgttttttagtattagtttaacgttattgataattatgaagaggtttttattgggtgtacgcggtcggcgacgttattacgtatagtttcgttatggaagatgtttacgatggttgcgttacgggtttggtttcgcgaattagtttattacggcggcgttgttttgggttagcgagcggtggtcgtaatcgtaatgggtgttagatagtcgggtatttgttttgtgtcgtcgggagtttggttcggtaggtcgattcggggtaaatcgataggcgtacggacgatacgggtatcggaagggttagttcgggtgttgcgttttttttttgtttcgtttcgtttttttnntaaaagaaagaataagagaacgaggagagtataagagtaagaggataaagagaagtaga

SEQ ID NO: 5634 - DNA, 1431 bp, Artificial Sequence
  chemically treated genomic DNA (Homo sapiens) CpG-island No: 5634
  misc_feature (60)..(61): n is either a, c, g or t
tctacttctctttatcctcttactcttatactctcctcgttctcttattctttcttttannaaaaaaacgaaacgaaacaaaaaaaaaacgcaacacccgaactaacccttccgatacccgtatcgtccgtacgcctatcgatttaccccgaatcgacctaccgaaccaaactcccgacgacacaaaacaaatacccgactatctaacacccattacgattacgaccaccgctcgctaacccaaaacaacgccgccgtaataaactaattcgcgaaaccaaacccgtaacgcaaccatcgtaaacatcttccataacgaaactatacgtaataacgtcgccgaccgcgtacacccaataaaaacctcttcataattatcaataacgttaaactaatactaaaaaacgaaataataaacgattcgctaaaaatacaaaacgacgaaatccgcgcctttaccgaaaaccaaaaccgcctaccgaaaacgataaacgacgaaaacgactaactactaccgaaactaattaaactacataccgataatctaaataaattcttcaccccgcgcccgaaaattaactaacctacccactcgacgataaacaaccacgacgcgctaataataacgaacgacatcaccaccgtactaaataccgtaacaattaacgacgtacgcgacgacgacgatcgactaaaaaatctaaaaaaaataatcaacgccatcgaaaaaacgcaaaaacgcgacgtcaaccgcgccgaacaccgtctacatctacgctacgaactaccgcatcacaccacgctaccgctatttaaaaaactaatacaacgcgaaccgataacgctaatatcgctaataaaccactcgccgaaccaacgccaattcgccaaccgcgaaaaatatcgcgaatattatcaaaacaaatactccctcactaatacgcaaatacaacaatacgaaaaaaaacaactaacgctcgccgcacgctaatcgcaaccgaatcgcgaatccatcgccgccctataccgcgcgcgaaaaattacgcttaccaaccacgataacgccacccacgcccacgttactaaatctcaccaacttaacaacgtaatcgccgaatttcccaccacgttcgaaacgacgaaaacctcgcgcaaacataacataaacgtactaataaacgcgccgaatattatacgcgacgactcgcactccgacaacgtaacgaccaataaactaacgcaacttaacctactaaatatcctctcttccgactactaccccgccaacctactcgatacgacatttcgcgtcgccgataaccaaaacaaccgctttacgctaccgcaaacgataaaactaataactaaaaatccaacgcaaacgcttaatctccaaaatcgcgaaataattaacgaaaacaaacgcgccga

SEQ ID NO: 5635 - DNA, 1431 bp, Artificial Sequence
  chemically treated genomic DNA (Homo sapiens) CpG-island No: 5635
  misc_feature (60)..(61): n is either a, c, g or t
tttgtttttttttgtttttttgtttttgtgtttttttcgtttttttgtttttttttttannagaagagcgggacgaggtagaagaggagcgtagtattcggattggttttttcggtattcgtatcgttcgtacgtttatcggtttatttcgagtcgatttgtcggattagattttcggcgatataggataaatgttcggttatttgatatttattgcggttacgattatcgttcgttgatttaaaatagcgtcgtcgtggtgaattgattcgcgaagttaaattcgtggcgtagttatcgtaggtattttttatgacgaagttgtacgtaatgacgtcgtcgatcgcgtgtatttaatgggagtttttttatgattattaataacgttaagttggtgttggaaaacgaggtggtaagcggttcgttggaggtgtagaacggcgaaattcgcgtttttgtcgaaagttagagtcgtttgtcggaggcgatggacggcgaaggcggttggttgttgtcggggttgattgagttgtatatcgataatttggataaattttttatttcgcgttcgaaagttgattggtttgtttattcggcgatgagtagttacgacgcgttgatggtggcgagcggtattattatcgtattggatgtcgtggtaattggcgacgtgcgcgacggcggcgatcggttggagaatttggagaagatgattaacgttatcgaagagacgtagaaacgcggcgttaatcgcgtcgagtatcgtttgtatttgcgttgcgaattgtcgtattatattacgttgtcgttgtttgaaaaattggtgtagcgcgagtcggtgacgttggtgtcgttgatggattattcgtcgggttagcgttagttcgttaatcgcgagaagtatcgcgaatattattagggtaaatatttttttattgatgcgtagatgtagtagtacgaagaagagtaattggcgttcgtcgtacgttggtcgtagtcgaatcgcgaatttatcgtcgttttgtgtcgcgcgcgaaaaattgcgtttgttagttacgatgacgttatttacgtttacgttgttgaattttattagtttggtagcgtgatcgtcgaattttttattacgttcgaagcggcggaagtttcgcgtaagtatggtatgaacgtgttgatgggcgcgtcgaatattgtgcgcggcggttcgtatttcggtaacgtggcggttagtgaattggcgtagtttggtttgttggatattttttttttcgattattatttcgttagtttgttcgatgcggtatttcgcgtcgtcgatgattagagtaatcgttttacgttgtcgtaggcggtgaagttggtgattaaaaatttagcgtaggcgtttaatttttaggatcgcggggtgattggcgagggtaaacgcgtcga

SEQ ID NO: 5636 - DNA, 1431 bp, Artificial Sequence
  chemically treated genomic DNA (Homo sapiens) CpG-island No: 5636
  misc_feature (1371)..(1372): n is either a, c, g or t
tcgacgcgtttaccctcgccaatcaccccgcgatcctaaaaattaaacgcctacgctaaatttttaatcaccaacttcaccgcctacgacaacgtaaaacgattactctaatcatcgacgacgcgaaataccgcatcgaacaaactaacgaaataataatcgaaaaaaaaaatatccaacaaaccaaactacgccaattcactaaccgccacgttaccgaaatacgaaccgccgcgcacaatattcgacgcgcccatcaacacgttcataccatacttacgcgaaacttccgccgcttcgaacgtaataaaaaattcgacgatcacgctaccaaactaataaaattcaacaacgtaaacgtaaataacgtcatcgtaactaacaaacgcaatttttcgcgcgcgacacaaaacgacgataaattcgcgattcgactacgaccaacgtacgacgaacgccaattactcttcttcgtactactacatctacgcatcaataaaaaaatatttaccctaataatattcgcgatacttctcgcgattaacgaactaacgctaacccgacgaataatccatcaacgacaccaacgtcaccgactcgcgctacaccaatttttcaaacaacgacaacgtaatataatacgacaattcgcaacgcaaatacaaacgatactcgacgcgattaacgccgcgtttctacgtctcttcgataacgttaatcatcttctccaaattctccaaccgatcgccgccgtcgcgcacgtcgccaattaccacgacatccaatacgataataataccgctcgccaccatcaacgcgtcgtaactactcatcgccgaataaacaaaccaatcaactttcgaacgcgaaataaaaaatttatccaaattatcgatatacaactcaatcaaccccgacaacaaccaaccgccttcgccgtccatcgcctccgacaaacgactctaactttcgacaaaaacgcgaatttcgccgttctacacctccaacgaaccgcttaccacctcgttttccaacaccaacttaacgttattaataatcataaaaaaactcccattaaatacacgcgatcgacgacgtcattacgtacaacttcgtcataaaaaatacctacgataactacgccacgaatttaacttcgcgaatcaattcaccacgacgacgctattttaaatcaacgaacgataatcgtaaccgcaataaatatcaaataaccgaacatttatcctatatcgccgaaaatctaatccgacaaatcgactcgaaataaaccgataaacgtacgaacgatacgaataccgaaaaaaccaatccgaatactacgctcctcttctacctcgtcccgctcttctnntaaaaaaaaaaacaaaaaaacgaaaaaaacacaaaaacaaaaaaacaaaaaaaaacaaa

SEQ ID NO: 5637 - DNA, 690 bp, Artificial Sequence
  chemically treated genomic DNA (Homo sapiens) CpG-island No: 5637
  misc_feature (348)..(348): n is either a, c, g or t
ggaaaacgcgcgacgaaatcgattaacgcgttgatgatcgttagtatcgcggcgtaacgtataggtagcgaggcgggaagcgttagtacgtacgcgttagttttgggattaagatttagttgaattagcgtttgttgttaggtttttattagattcgttttattaatcgggatcgttatcggtaaattgcgtagcggtagtttgtacgtttttaagttagattgttgttgtagagagcgaaagggtattcgcgttcgtgttaaattacgtgtgtgtcgttacggattgcgtcggaaattgtacgtttattttacgtaggcgcggatggttttgtagcgtaatttgtantagcgggttatatcggtaaatagaacggtcggcggttgtgggatatatcgttaagcggtagaaaaggtaagagtcggcgtaatcgtggtataacggttgtatagtttgtgacgtatacgttcgaatttttatatagttttcgcggattttatatgtcgattagggtgtttttcgttattaatttcggttaattttcgtttttattttaggcgatatcggaaggttttaaatcgagttttattttttttttttttttagttgtatagatcgtaaaaaacgagttatacgtaatatattagaagtttttacgtttataatagttattaataataaacgtagttt

SEQ ID NO: 5638 - DNA, 690 bp, Artificial Sequence
  chemically treated genomic DNA (Homo sapiens) CpG-island No: 5638
  misc_feature (343)..(343): n is either a, c, g or t
aaactacgtttattattaataactattataaacgtaaaaacttctaatatattacgtataactcgttttttacgatctatacaactaaaaaaaaaaaaaaaataaaactcgatttaaaaccttccgatatcgcctaaaataaaaacgaaaattaaccgaaattaataacgaaaaacaccctaatcgacatataaaatccgcgaaaactatataaaaattcgaacgtatacgtcacaaactatacaaccgttataccacgattacgccgactcttaccttttctaccgcttaacgatatatcccacaaccgccgaccgttctatttaccgatataacccgctantacaaattacgctacaaaaccatccgcgcctacgtaaaataaacgtacaatttccgacgcaatccgtaacgacacacacgtaatttaacacgaacgcgaataccctttcgctctctacaacaacaatctaacttaaaaacgtacaaactaccgctacgcaatttaccgataacgatcccgattaataaaacgaatctaataaaaacctaacaacaaacgctaattcaactaaatcttaatcccaaaactaacgcgtacgtactaacgcttcccgcctcgctacctatacgttacgccgcgatactaacgatcatcaacgcgttaatcgatttcgtcgcgcgttttcc

SEQ ID NO: 5639 - DNA, 690 bp, Artificial Sequence
  chemically treated genomic DNA (Homo sapiens) CpG-island No: 5639
  misc_feature (343)..(343): n is either a, c, g or t
aagttgcgtttgttgttggtggttgttgtagacgtgagggtttttggtgtgttgcgtgtggttcgttttttgcggtttgtgtaattggagagagagaggggataagattcggtttagggtttttcgatatcgtttagggtggaaacgggggttaatcggaattgatagcggaagatattttgatcggtatgtggagttcgcgggaattgtgtaagggttcgaacgtgtacgttatagattatgtaatcgttgtgttacggttacgtcgatttttattttttttgtcgtttggcgatgtattttatagtcgtcgatcgttttgtttgtcgatatggttcgttgntgtaaattgcgttgtaggattattcgcgtttgcgtgagatgaacgtatagttttcggcgtaattcgtggcggtatatacgtgatttggtacgggcgcgaatattttttcgttttttgtagtaataatttggtttgagggcgtataaattgtcgttgcgtaatttgtcggtggcgatttcgattgatgaaacggatttggtgggggtttggtaataggcgttgatttagttggattttgattttaaaattgacgcgtacgtgttggcgtttttcgtttcgttgtttgtgcgttacgtcgcggtattgacggttattaacgcgttggtcgatttcgtcgcgcgtttttt

SEQ ID NO: 5640 - DNA, 690 bp, Artificial Sequence
  chemically treated genomic DNA (Homo sapiens) CpG-island No: 5640
  misc_feature (348)..(348): n is either a, c, g or t
aaaaaacgcgcgacgaaatcgaccaacgcgttaataaccgtcaataccgcgacgtaacgcacaaacaacgaaacgaaaaacgccaacacgtacgcgtcaattttaaaatcaaaatccaactaaatcaacgcctattaccaaacccccaccaaatccgtttcatcaatcgaaatcgccaccgacaaattacgcaacgacaatttatacgccctcaaaccaaattattactacaaaaaacgaaaaaatattcgcgcccgtaccaaatcacgtatataccgccacgaattacgccgaaaactatacgttcatctcacgcaaacgcgaataatcctacaacgcaatttacancaacgaaccatatcgacaaacaaaacgatcgacgactataaaatacatcgccaaacgacaaaaaaaataaaaatcgacgtaaccgtaacacaacgattacataatctataacgtacacgttcgaacccttacacaattcccgcgaactccacataccgatcaaaatatcttccgctatcaattccgattaacccccgtttccaccctaaacgatatcgaaaaaccctaaaccgaatcttatcccctctctctctccaattacacaaaccgcaaaaaacgaaccacacgcaacacaccaaaaaccctcacgtctacaacaaccaccaacaacaaacgcaactt

SEQ ID NO: 5641 - DNA, 578 bp, Artificial Sequence
  chemically treated genomic DNA (Homo sapiens) CpG-island No: 5641
tgtcgttcgataaaatcgtagcgacgatggaaaaagggatgggaggtattttcggttttttggcggtggttgtcgttttgggagttatgtttggtaagattttatatgaaatcggcgtagtcgattagattgtcgttaaaatgtttaaatttttcggttatagtcgcgcgtattatgttatcggttttgcggggttggtttgtgcgttatttgttgttttttgaacgtggcgatatgttttgttgattacgcgttgtttttttaatggcgcgttacgatcggtacgaatttgagtgaagttggtaattttattatttgtaggcgatggcggtagcggcggtatttttggtgtttggattagcgtcgatgttgttggtatcgtagatgaattgttcgaatttttgggggtatggatgattttgattggtttgtgtgcggtaatttcgggtaatgattattgtcgggtcgttgtggggtaattttattagtcgtttacgttgagttgtatatttttgacgatattagcgaatcgtatttcgcgcgaaggtaaaatgttattttttcggattttagttttt

SEQ ID NO: 5642 - DNA, 578 bp, Artificial Sequence
  chemically treated genomic DNA (Homo sapiens) CpG-island No: 5642
aaaaactaaaatccgaaaaaataacattttaccttcgcgcgaaatacgattcgctaatatcgtcaaaaatatacaactcaacgtaaacgactaataaaattaccccacaacgacccgacaataatcattacccgaaattaccgcacacaaaccaatcaaaatcatccatacccccaaaaattcgaacaattcatctacgataccaacaacatcgacgctaatccaaacaccaaaaataccgccgctaccgccatcgcctacaaataataaaattaccaacttcactcaaattcgtaccgatcgtaacgcgccattaaaaaaacaacgcgtaatcaacaaaacatatcgccacgttcaaaaaacaacaaataacgcacaaaccaaccccgcaaaaccgataacataatacgcgcgactataaccgaaaaatttaaacattttaacgacaatctaatcgactacgccgatttcatataaaatcttaccaaacataactcccaaaacgacaaccaccgccaaaaaaccgaaaatacctcccatccctttttccatcgtcgctacgattttatcgaacgaca

SEQ ID NO: 5643 - DNA, 578 bp, Artificial Sequence
  chemically treated genomic DNA (Homo sapiens) CpG-island No: 5643
aagggttgaaattcgaaaagatggtattttgttttcgcgcgagatgcggttcgttgatgtcgttaggaatatgtagtttaacgtagacggttgatgaagttattttatagcggttcggtaataattattgttcggaattgtcgtatataggttaattaggattatttatgtttttaaaagttcgggtaatttatttgcgatgttagtagtatcggcgttggtttaggtattagaaatgtcgtcgttgtcgttatcgtttgtaaataatgggattattagttttatttaggttcgtatcggtcgtggcgcgttattgagaaagtaacgcgtaattagtagaatatatcgttacgtttaaagaatagtaggtagcgtatagattagtttcgtaaggtcgatggtataatgcgcgcggttgtgatcgaaggatttgagtattttgacggtaatttgatcgattgcgtcggttttatgtaagattttgttaaatatagtttttagggcgataattatcgttaggaagtcgagggtgttttttatttttttttttatcgtcgttgcgattttatcgagcggta

SEQ ID NO: 5644 - DNA, 578 bp, Artificial Sequence
  chemically treated genomic DNA (Homo sapiens) CpG-island No: 5644
taccgctcgataaaatcgcaacgacgataaaaaaaaaaataaaaaacaccctcgacttcctaacgataattatcgccctaaaaactatatttaacaaaatcttacataaaaccgacgcaatcgatcaaattaccgtcaaaatactcaaatccttcgatcacaaccgcgcgcattataccatcgaccttacgaaactaatctatacgctacctactattctttaaacgtaacgatatattctactaattacgcgttactttctcaataacgcgccacgaccgatacgaacctaaataaaactaataatcccattatttacaaacgataacgacaacgacgacatttctaatacctaaaccaacgccgatactactaacatcgcaaataaattacccgaacttttaaaaacataaataatcctaattaacctatatacgacaattccgaacaataattattaccgaaccgctataaaataacttcatcaaccgtctacgttaaactacatattcctaacgacatcaacgaaccgcatctcgcgcgaaaacaaaataccatcttttcgaatttcaaccctt

SEQ ID NO: 5645 - DNA, 527 bp, Artificial Sequence
  chemically treated genomic DNA (Homo sapiens) CpG-island No: 5645
gaacgaattttagatattagtatttaattgaacgtttttttcggttgtgaagttgttgttagcgacgcgtcgagcggttagttgattgtggtggtggaagtagaagatagcgaaacgttgatttaaattattgagttagtacgtaacgtagagggcgtgttggcggtgtcgttggtttattattagtaggaagagtaaggtgaggaaatattatgaaatttagtcgtcgtagttttatgaaagttaacgtcgttgcggtcgttgcggcggttgtcggttttagcgtgtcgggcgttgttcgcgtcgttgttggttagtaggaagttattaaatgggataaagcgtcgtgtcgtttttgcggtattggttgcggcgttttggtcggaacgtagtagggacgtgtggtggtttgttagggcgattcggacgtatcggttaatcgtggtttgaattgtattaagggttattttttgtttaaaattatgtacggtaaagatcgtttgacgtagtcgttgttgcgtatgaaa

SEQ ID NO: 5646 - DNA, 527 bp, Artificial Sequence
  chemically treated genomic DNA (Homo sapiens) CpG-island No: 5646
tttcatacgcaacaacgactacgtcaaacgatctttaccgtacataattttaaacaaaaaataacccttaatacaattcaaaccacgattaaccgatacgtccgaatcgccctaacaaaccaccacacgtccctactacgttccgaccaaaacgccgcaaccaataccgcaaaaacgacacgacgctttatcccatttaataacttcctactaaccaacaacgacgcgaacaacgcccgacacgctaaaaccgacaaccgccgcaacgaccgcaacgacgttaactttcataaaactacgacgactaaatttcataatatttcctcaccttactcttcctactaataataaaccaacgacaccgccaacacgccctctacgttacgtactaactcaataatttaaatcaacgtttcgctatcttctacttccaccaccacaatcaactaaccgctcgacgcgtcgctaacaacaacttcacaaccgaaaaaaacgttcaattaaatactaatatctaaaattcgttc

SEQ ID NO: 5647 - DNA, 527 bp, Artificial Sequence
  chemically treated genomic DNA (Homo sapiens) CpG-island No: 5647
ttttatacgtagtagcggttgcgttaaacggtttttatcgtatatgattttgggtaggaaatagtttttaatgtagtttaggttacggttaatcggtgcgttcgggtcgttttgataggttattatacgtttttgttgcgtttcgattagaacgtcgtaattagtatcgtagaaacggtacggcgttttattttatttgatggttttttgttgattaataacggcgcgggtaacgttcggtacgttgagatcggtagtcgtcgtagcggtcgtaacggcgttagtttttataaagttacgacgattgagttttatggtgtttttttattttgttttttttgttggtgataaattagcgatatcgttagtacgttttttacgttgcgtattgatttaatggtttggattagcgtttcgttgttttttgtttttattattataattaattgatcgttcggcgcgtcgttgatagtaattttatagtcgggaaaggcgtttagttgggtgttgatgtttgaaattcgttt

SEQ ID NO: 5648 - DNA, 527 bp, Artificial Sequence
  chemically treated genomic DNA (Homo sapiens) CpG-island No: 5648
aaacgaatttcaaacatcaacacccaactaaacgcctttcccgactataaaattactatcaacgacgcgccgaacgatcaattaattataataataaaaacaaaaaacaacgaaacgctaatccaaaccattaaatcaatacgcaacgtaaaaaacgtactaacgatatcgctaatttatcaccaacaaaaaaaacaaaataaaaaaacaccataaaactcaatcgtcgtaactttataaaaactaacgccgttacgaccgctacgacgactaccgatctcaacgtaccgaacgttacccgcgccgttattaatcaacaaaaaaccatcaaataaaataaaacgccgtaccgtttctacgatactaattacgacgttctaatcgaaacgcaacaaaaacgtataataacctatcaaaacgacccgaacgcaccgattaaccgtaacctaaactacattaaaaactatttcctacccaaaatcatatacgataaaaaccgtttaacgcaaccgctactacgtataaaa

SEQ ID NO: 5649 - DNA, 530 bp, Artificial Sequence
  chemically treated genomic DNA (Homo sapiens) CpG-island No: 5649
tgttggcggtgtcgaatttaatttattcgtagttcgcgacgtataacgtttatacgttggcggcgatttattaattggcggggtagaattattattcgggttagtacgagttttagtgtttgtatggtatgggcgagttattgtatgagtaggttatcgggaaagttgtcgacggtaaatttaatcgttcgtgtcgtatttatgtttcggttggtatatatgaaacgttgttggcgtatttggtgcgtcgtttgttggaaaacggtgttaatatttcgtttgttaatcgtattggcgatatttttttgttattggatgaattggtcgtcgattcggttattgttgtagaaaaattggcgtaataggaagggtaaattggattatcgtattcgaaaatttttttgtcgcgcgatttttacggttacgggcgcgataattcggtagggttggatttcgttaacgaatatcgtttggtttcgtttttttttgttttgtttaatagtgtattgtaaaaatggtaggttttgtta

SEQ ID NO: 5650 - DNA, 530 bp, Artificial Sequence
  chemically treated genomic DNA (Homo sapiens) CpG-island No: 5650
taacaaaacctaccatttttacaatacactattaaacaaaacaaaaaaaaacgaaaccaaacgatattcgttaacgaaatccaaccctaccgaattatcgcgcccgtaaccgtaaaaatcgcgcgacaaaaaaattttcgaatacgataatccaatttacccttcctattacgccaatttttctacaacaataaccgaatcgacgaccaattcatccaataacaaaaaaatatcgccaatacgattaacaaacgaaatattaacaccgttttccaacaaacgacgcaccaaatacgccaacaacgtttcatatataccaaccgaaacataaatacgacacgaacgattaaatttaccgtcgacaactttcccgataacctactcatacaataactcgcccataccatacaaacactaaaactcgtactaacccgaataataattctaccccgccaattaataaatcgccgccaacgtataaacgttatacgtcgcgaactacgaataaattaaattcgacaccgccaaca

SEQ ID NO: 5651 - DNA, 530 bp, Artificial Sequence
  chemically treated genomic DNA (Homo sapiens) CpG-island No: 5651
tggtaaggtttgttatttttgtagtgtattattgagtagggtagaggagagcgaggttaggcggtgttcgttagcgagatttagttttgtcgagttgtcgcgttcgtgatcgtaaagatcgcgcggtaggggaattttcggatgcggtaatttagtttgttttttttgttgcgttagtttttttatagtagtgatcggatcggcgattagtttatttagtggtaaagaggtgtcgttaatacggttaataaacgaggtgttagtatcgttttttagtaggcgacgtattagatacgttaatagcgttttatgtgtgttaatcggagtataaatacgatacggacggttaagtttgtcgtcggtaattttttcggtgatttgtttatatagtggttcgtttatattatgtaggtattggaattcgtattgattcgggtagtagttttgtttcgttagttgataaatcgtcgttagcgtatgggcgttgtgcgtcgcgaattgcgggtagattagattcggtatcgttagta

SEQ ID NO: 5652 - DNA, 530 bp, Artificial Sequence
  chemically treated genomic DNA (Homo sapiens) CpG-island No: 5652
tactaacgataccgaatctaatctacccgcaattcgcgacgcacaacgcccatacgctaacgacgatttatcaactaacgaaacaaaactactacccgaatcaatacgaattccaatacctacataatataaacgaaccactatataaacaaatcaccgaaaaaattaccgacgacaaacttaaccgtccgtatcgtatttatactccgattaacacacataaaacgctattaacgtatctaatacgtcgcctactaaaaaacgatactaacacctcgtttattaaccgtattaacgacacctctttaccactaaataaactaatcgccgatccgatcactactataaaaaaactaacgcaacaaaaaaaacaaactaaattaccgcatccgaaaattcccctaccgcgcgatctttacgatcacgaacgcgacaactcgacaaaactaaatctcgctaacgaacaccgcctaacctcgctctcctctaccctactcaataatacactacaaaaataacaaaccttacca

SEQ ID NO: 5653 - DNA, 579 bp, Artificial Sequence
  chemically treated genomic DNA (Homo sapiens) CpG-island No: 5653
tacgggcgggtggattgttagcgatcggcgtcgtaattcgcgcgagataggttatcgggtatgtcggttttatcgtcgtaatattgtagtaggttgttgaaggtgtgtattttattcggcgtatatttgttttttagtattaggtcgtcgatgcgggtggcgttgtgttcgcgttagttattgtcgcgcgtgtcggagtagagtagcgcggtgttaaaatcgttgttcgttgtgtcgtttattattaggttgtgcgtttttttcgggttgttttgtgaagaggttgggttgagttgattttttacgttcgtttcgatattaaagttttgcggaatggtacgggtattatagtttattacgcggttacgttttgcggttcgaacgtatcggattattacgcgtattcgtttatggtttttggtgtcggcgaacggagtttttgagcggggttgtttatgggcgaggcgcgggtcgtttttagggggtcggtgtggaggggttttttattttttttttcggggttggcgcgcgtgttggcgcggtcggagtgggattttcggtgcgggtgatttcggggtt

SEQ ID NO: 5654 - DNA, 579 bp, Artificial Sequence
  chemically treated genomic DNA (Homo sapiens) CpG-island No: 5654
aaccccgaaatcacccgcaccgaaaatcccactccgaccgcgccaacacgcgcgccaaccccgaaaaaaaaaataaaaaacccctccacaccgaccccctaaaaacgacccgcgcctcgcccataaacaaccccgctcaaaaactccgttcgccgacaccaaaaaccataaacgaatacgcgtaataatccgatacgttcgaaccgcaaaacgtaaccgcgtaataaactataatacccgtaccattccgcaaaactttaatatcgaaacgaacgtaaaaaatcaactcaacccaacctcttcacaaaacaacccgaaaaaaacgcacaacctaataataaacgacacaacgaacaacgattttaacaccgcgctactctactccgacacgcgcgacaataactaacgcgaacacaacgccacccgcatcgacgacctaatactaaaaaacaaatatacgccgaataaaatacacaccttcaacaacctactacaatattacgacgataaaaccgacatacccgataacctatctcgcgcgaattacgacgccgatcgctaacaatccacccgcccgta

SEQ ID NO: 5655 - DNA, 579 bp, Artificial Sequence
  chemically treated genomic DNA (Homo sapiens) CpG-island No: 5655
agtttcgaggttattcgtatcgggagttttatttcggtcgcgttaatacgcgcgttaatttcggagaaggaggtggggaatttttttatatcggttttttaggggcgattcgcgtttcgtttatgggtagtttcgtttaagggtttcgttcgtcggtattaggagttatgaacgggtacgcgtggtggttcggtgcgttcggatcgtagagcgtggtcgcgtggtgaattgtggtattcgtgttatttcgtaggattttggtatcgaggcgggcgtggaaggttagtttagtttaatttttttataaaataattcgaaagagacgtataatttgatggtgggcggtatagcggataacggttttggtatcgcgttgttttatttcggtacgcgcggtagtgattggcgcgagtatagcgttattcgtatcgacgatttgatgttgaaaagtaaatatgcgtcggatgaggtgtatatttttaatagtttgttgtaatattacgacggtgaagtcgatatgttcggtggtttgtttcgcgcggattacgacgtcgatcgttggtaatttattcgttcgta

SEQ ID NO: 5656 - DNA, 579 bp, Artificial Sequence
  chemically treated genomic DNA (Homo sapiens) CpG-island No: 5656
tacgaacgaataaattaccaacgatcgacgtcgtaatccgcgcgaaacaaaccaccgaacatatcgacttcaccgtcgtaatattacaacaaactattaaaaatatacacctcatccgacgcatatttacttttcaacatcaaatcgtcgatacgaataacgctatactcgcgccaatcactaccgcgcgtaccgaaataaaacaacgcgataccaaaaccgttatccgctataccgcccaccatcaaattatacgtctctttcgaattattttataaaaaaattaaactaaactaaccttccacgcccgcctcgataccaaaatcctacgaaataacacgaataccacaattcaccacgcgaccacgctctacgatccgaacgcaccgaaccaccacgcgtacccgttcataactcctaataccgacgaacgaaacccttaaacgaaactacccataaacgaaacgcgaatcgcccctaaaaaaccgatataaaaaaattccccacctccttctccgaaattaacgcgcgtattaacgcgaccgaaataaaactcccgatacgaataacctcgaaact

SEQ ID NO: 5657 - DNA, 850 bp, Artificial Sequence
  chemically treated genomic DNA (Homo sapiens) CpG-island No: 5657
ggttcgggttcggtgagtagttgcggatagtaagcgtaaacgcgtgggttgaaatatttgttcgtgatggtagatagttttttgtattaggtagggatatcgtcgggttgacgcgtagtttgatcgttaaaggtatcgttatgacgttttggttatgttcggtgggcgaatcgtgtattatcgacgtgtgtgtagtcgtggcgtagttgcgtgagttaggttgtgatggggtgatcgcgtttggcggcggttcggtgttggatgcggcgaaagtcgtgacgttgttggtgacgaattcggatagtacgttggtagagatgttagaaattagcgttttgtaatcgcgtttgtcgttgattgttattttaattatcgtcggaatcggttttgaaattattaatgtaacggtgattatcgacgcggtgagcgggcgtaagtaggtgttagtttatgtttcgttgatgtcggatgtggcgattttcgacgtcgtattgatcgaaggtgtgtcgtcgtatgttacggcgatgatcggtattgatgcgttaatttatgttattgaagtatatagcgttttgaacgttatatcgtttatcgatagtttggcgattggtgttattgcgtatgattggtaaatcgttgtcgaaagcggtgggttacggttacgaatttgtcgcgcgcgagagtatgttgttgggtttatgtattggcgggaatggcgttttttagtgcgggttttgggttgggtttcgcgaatggtttatttagtcgtgggtgacggtgtttgtattttttcgaacgggttttcgaagttttgtttgtgtttcgcgtagggaattttaatcgcgggaag

SEQ ID NO: 5658 - DNA, 850 bp, Artificial Sequence
  chemically treated genomic DNA (Homo sapiens) CpG-island No: 5658
cttcccgcgattaaaattccctacgcgaaacacaaacaaaacttcgaaaacccgttcgaaaaaatacaaacaccgtcacccacgactaaataaaccattcgcgaaacccaacccaaaacccgcactaaaaaacgccattcccgccaatacataaacccaacaacatactctcgcgcgcgacaaattcgtaaccgtaacccaccgctttcgacaacgatttaccaatcatacgcaataacaccaatcgccaaactatcgataaacgatataacgttcaaaacgctatatacttcaataacataaattaacgcatcaataccgatcatcgccgtaacatacgacgacacaccttcgatcaatacgacgtcgaaaatcgccacatccgacatcaacgaaacataaactaacacctacttacgcccgctcaccgcgtcgataatcaccgttacattaataatttcaaaaccgattccgacgataattaaaataacaatcaacgacaaacgcgattacaaaacgctaatttctaacatctctaccaacgtactatccgaattcgtcaccaacaacgtcacgactttcgccgcatccaacaccgaaccgccgccaaacgcgatcaccccatcacaacctaactcacgcaactacgccacgactacacacacgtcgataatacacgattcgcccaccgaacataaccaaaacgtcataacgatacctttaacgatcaaactacgcgtcaacccgacgatatccctacctaatacaaaaaactatctaccatcacgaacaaatatttcaacccacgcgtttacgcttactatccgcaactactcaccgaacccgaacc

SEQ ID NO: 5659 - DNA, 850 bp, Artificial Sequence
  chemically treated genomic DNA (Homo sapiens) CpG-island No: 5659
tttttcgcggttaaaattttttacgcggggtataaatagggtttcggaggttcgttcggaaaaatgtaggtatcgttatttacggttagatgggttattcgcggggtttaatttaagattcgtattggaaaacgttattttcgttaatatatgaatttagtaatatgttttcgcgcgcggtaagttcgtgatcgtagtttatcgttttcggtagcgatttgttaattatgcgtaatggtattaatcgttagattgtcggtaaacggtgtagcgtttagggcgttgtatgttttaatggtatgggttaacgtattaatgtcggttatcgtcgtgatatgcgacggtatattttcggttaatgcggcgtcgaggatcgttatattcggtattagcgaggtatgggttaatatttgtttgcgttcgtttatcgcgtcgataattatcgttatattggtggttttagagtcggtttcggcggtagttggaatggtaattagcggtaagcgcggttgtagaacgttggtttttgatatttttgttagcgtgttattcgggttcgttattagtaacgttacggttttcgtcgtatttagtatcgagtcgtcgttaaacgcgattattttattatagtttgatttacgtaattgcgttacggttgtatatacgtcggtaatgtacggttcgtttatcggatatggttagagcgttatggcgatatttttaacggttaggttacgcgttagttcggcggtatttttgtttgatgtaaaaagttgtttgttattacgaatagatgttttagtttacgcgtttgcgtttgttgttcgtaattgtttatcgagttcggatt

SEQ ID NO: 5660 - DNA, 850 bp, Artificial Sequence
  chemically treated genomic DNA (Homo sapiens) CpG-island No: 5660
aatccgaactcgataaacaattacgaacaacaaacgcaaacgcgtaaactaaaacatctattcgtaataacaaacaactttttacatcaaacaaaaataccgccgaactaacgcgtaacctaaccgttaaaaatatcgccataacgctctaaccatatccgataaacgaaccgtacattaccgacgtatatacaaccgtaacgcaattacgtaaatcaaactataataaaataatcgcgtttaacgacgactcgatactaaatacgacgaaaaccgtaacgttactaataacgaacccgaataacacgctaacaaaaatatcaaaaaccaacgttctacaaccgcgcttaccgctaattaccattccaactaccgccgaaaccgactctaaaaccaccaatataacgataattatcgacgcgataaacgaacgcaaacaaatattaacccatacctcgctaataccgaatataacgatcctcgacgccgcattaaccgaaaatataccgtcgcatatcacgacgataaccgacattaatacgttaacccataccattaaaacatacaacgccctaaacgctacaccgtttaccgacaatctaacgattaataccattacgcataattaacaaatcgctaccgaaaacgataaactacgatcacgaacttaccgcgcgcgaaaacatattactaaattcatatattaacgaaaataacgttttccaatacgaatcttaaattaaaccccgcgaataacccatctaaccgtaaataacgatacctacatttttccgaacgaacctccgaaaccctatttataccccgcgtaaaaaattttaaccgcgaaaaa

SEQ ID NO: 5661 - DNA, 789 bp, Artificial Sequence
  chemically treated genomic DNA (Homo sapiens) CpG-island No: 5661
cgtcgtatatcggtagttatgcgtcgatgttaaatgcgttattttaaagtagcgtattcgtaatgatgtatttattttttcggtttaaatcgtagtaatcggttggcgttatttattacggtaatcgacgagagcgttattgtcgtttcggtaattatcgggttaagtagtgttttagtgaacggttataaaatatcggcggcgatcggaatatcgatattgttgtagataaacgtatcgagtaggttttgttttatgttgtgtagcgttgcgcgggaaatagcgagcgtattcgtaacgtttattaggttatggcgtattagggtaatcgtcgcggttttaatggtaatattattgtcgttatttatcgtaatgtcgatattcgtttgagttagcgttggcgcgtcgttaatgtcgtcgtttattattgttatttgacgttttttattttgtagatgtttgatcgtttcggttttatcgttcggtagtatttcggcgattattttattaatttttgtttttttggcgatcgtattggcggtggttgggttattttcggttaatattattagacgatatttcgttttatgtaggcgttgtagcgtcgttacgttattattacgtaacggatcgcgtattgttagtagggttatcgttttttcgttaatcgttagtagtataggcgttgttttttgcgatgtttgagtagtaattttcgtttcgatagttttggtattaatttgttgtttatttaatagcgtttgattgtttagtaataacgtatgattt

SEQ ID NO: 5662 - DNA, 789 bp, Artificial Sequence
  chemically treated genomic DNA (Homo sapiens) CpG-island No: 5662
aaatcatacgttattactaaacaatcaaacgctattaaataaacaacaaattaataccaaaactatcgaaacgaaaattactactcaaacatcgcaaaaaacaacgcctatactactaacgattaacgaaaaaacgataaccctactaacaatacgcgatccgttacgtaataataacgtaacgacgctacaacgcctacataaaacgaaatatcgtctaataatattaaccgaaaataacccaaccaccgccaatacgatcgccaaaaaaacaaaaattaataaaataatcgccgaaatactaccgaacgataaaaccgaaacgatcaaacatctacaaaataaaaaacgtcaaataacaataataaacgacgacattaacgacgcgccaacgctaactcaaacgaatatcgacattacgataaataacgacaataatattaccattaaaaccgcgacgattaccctaatacgccataacctaataaacgttacgaatacgctcgctatttcccgcgcaacgctacacaacataaaacaaaacctactcgatacgtttatctacaacaatatcgatattccgatcgccgccgatattttataaccgttcactaaaacactacttaacccgataattaccgaaacgacaataacgctctcgtcgattaccgtaataaataacgccaaccgattactacgatttaaaccgaaaaaataaatacatcattacgaatacgctactttaaaataacgcatttaacatcgacgcataactaccgatatacgacg

SEQ ID NO: 5663 - DNA, 789 bp, Artificial Sequence
  chemically treated genomic DNA (Homo sapiens) CpG-island No: 5663
aggttatgcgttattgttgggtaattaggcgttgttaaatgagtaataggttggtattaaagttatcgaagcggagattattgtttaggtatcgtaaggggtaacgtttgtgttgttggcggttgacgggaaagcggtagttttgttggtagtacgcgattcgttgcgtagtgatagcgtggcggcgttgtaacgtttgtataaagcgggatatcgtttggtgatgttgatcggggataatttaattatcgttaatgcgatcgttaaagaagtagggattgatgaggtgatcgtcggggtgttgtcggacggtaaagtcgaagcgattaaatatttgtaaagtgaaggacgttaggtggtaatggtgggcgacggtattaacgacgcgttagcgttggtttaggcggatgtcggtattgcgatgggtggcggtagtgatgttgttattgaaatcgcggcgattattttgatgcgttatagtttgatgggcgttgcggatgcgttcgttatttttcgcgtaacgttgtataatatgaagtagaatttgttcggtgcgtttatttataatagtatcggtatttcggtcgtcgtcggtattttgtggtcgtttattggaatattgtttaattcggtagttgtcggagcggtaatggcgttttcgtcgattatcgtagtgagtaacgttaatcggttgttgcggtttaaatcgaaggaataagtatattattgcggatgcgttgttttagggtggcgtatttggtatcgacgtatgattgtcggtatgcggcg

SEQ ID NO: 5664 - DNA, 789 bp, Artificial Sequence
  chemically treated genomic DNA (Homo sapiens) CpG-island No: 5664
cgccgcataccgacaatcatacgtcgataccaaatacgccaccctaaaacaacgcatccgcaataatatacttattccttcgatttaaaccgcaacaaccgattaacgttactcactacgataatcgacgaaaacgccattaccgctccgacaactaccgaattaaacaatattccaataaacgaccacaaaataccgacgacgaccgaaataccgatactattataaataaacgcaccgaacaaattctacttcatattatacaacgttacgcgaaaaataacgaacgcatccgcaacgcccatcaaactataacgcatcaaaataatcgccgcgatttcaataacaacatcactaccgccacccatcgcaataccgacatccgcctaaaccaacgctaacgcgtcgttaataccgtcgcccaccattaccacctaacgtccttcactttacaaatatttaatcgcttcgactttaccgtccgacaacaccccgacgatcacctcatcaatccctacttctttaacgatcgcattaacgataattaaattatccccgatcaacatcaccaaacgatatcccgctttatacaaacgttacaacgccgccacgctatcactacgcaacgaatcgcgtactaccaacaaaactaccgctttcccgtcaaccgccaacaacacaaacgttaccccttacgatacctaaacaataatctccgcttcgataactttaataccaacctattactcatttaacaacgcctaattacccaacaataacgcataacct

SEQ ID NO: 5665 - DNA, 576 bp, Artificial Sequence
  chemically treated genomic DNA (Homo sapiens) CpG-island No: 5665
agatcgtgcgataaatgttatggttatggtcgtgttgagcgtagtaaaacgttgttcgttaaaatttcggtaggggtggatattggagatcgtattcgttttgcgggcgaagtaagcgggcgagtatggcgtatcggtaggcgatttgtacgtttaggtttaggttaaatagtattcgattttcgagcgtgaaggtataatttgtattgcgaatttcgattaatttcgttatggcggcgttggtggcgaaatcgaagtatcgatttttgatggtcgcgttaaattgaaagtgtttggcgaaatttagatcggtagttatttcgtatgcgcggtaaaggcgttagtttgttcgcggtggcgtatagggtgatttgttgtgtcgcgttgtcgttaaatatcggtaggtttgaacgaaaggtagaaatagttgttgtaagagttgtaagaaagtttcggtggtttaatcggcgagtataatagttcgcgtttaagagtttttttgatggtgtgaagaagttttttgacgatttgattcgttatttttttaaaagtttgttcgtgggtaggtttgggtaa

SEQ ID NO: 5666 - DNA, 576 bp, Artificial Sequence
  chemically treated genomic DNA (Homo sapiens) CpG-island No: 5666
ttacccaaacctacccacgaacaaacttttaaaaaaataacgaatcaaatcgtcaaaaaacttcttcacaccatcaaaaaaactcttaaacgcgaactattatactcgccgattaaaccaccgaaactttcttacaactcttacaacaactatttctacctttcgttcaaacctaccgatatttaacgacaacgcgacacaacaaatcaccctatacgccaccgcgaacaaactaacgcctttaccgcgcatacgaaataactaccgatctaaatttcgccaaacactttcaatttaacgcgaccatcaaaaatcgatacttcgatttcgccaccaacgccgccataacgaaattaatcgaaattcgcaatacaaattataccttcacgctcgaaaatcgaatactatttaacctaaacctaaacgtacaaatcgcctaccgatacgccatactcgcccgcttacttcgcccgcaaaacgaatacgatctccaatatccacccctaccgaaattttaacgaacaacgttttactacgctcaacacgaccataaccataacatttatcgcacgatct

SEQ ID NO: 5667 - DNA, 576 bp, Artificial Sequence
  chemically treated genomic DNA (Homo sapiens) CpG-island No: 5667
ttatttaggtttgtttacgggtaggtttttggggaggtagcgggttaggtcgttaaaaaatttttttatattattaaagaagtttttgagcgcgggttgttgtgttcgtcggttgggttatcgaagtttttttgtagtttttgtagtagttgtttttgtttttcgtttaggtttatcggtgtttgacgataacgcggtatagtaaattattttgtgcgttatcgcggatagattgacgtttttatcgcgtatacggaatagttatcggtttgggtttcgttaggtatttttagtttgacgcgattattaagggtcggtatttcgatttcgttattagcgtcgttatagcgaagttgatcgggattcgtaatataggttgtgtttttacgttcgaaaatcgggtgttgtttaatttgaatttgaacgtatagatcgtttgtcggtgcgttatgttcgttcgtttatttcgttcgtaagacggatgcggtttttagtgtttatttttgtcgggattttaacggatagcgttttgttgcgtttaatacgattatgattatgatatttgtcgtacgattt

SEQ ID NO: 5668 - DNA, 576 bp, Artificial Sequence
  chemically treated genomic DNA (Homo sapiens) CpG-island No: 5668
aaatcgtacgacaaatatcataatcataatcgtattaaacgcaacaaaacgctatccgttaaaatcccgacaaaaataaacactaaaaaccgcatccgtcttacgaacgaaataaacgaacgaacataacgcaccgacaaacgatctatacgttcaaattcaaattaaacaacacccgattttcgaacgtaaaaacacaacctatattacgaatcccgatcaacttcgctataacgacgctaataacgaaatcgaaataccgacccttaataatcgcgtcaaactaaaaatacctaacgaaacccaaaccgataactattccgtatacgcgataaaaacgtcaatctatccgcgataacgcacaaaataatttactataccgcgttatcgtcaaacaccgataaacctaaacgaaaaacaaaaacaactactacaaaaactacaaaaaaacttcgataacccaaccgacgaacacaacaacccgcgctcaaaaacttctttaataatataaaaaaattttttaacgacctaacccgctacctccccaaaaacctacccgtaaacaaacctaaataa

SEQ ID NO: 5669 - DNA, 729 bp, Artificial Sequence
  chemically treated genomic DNA (Homo sapiens) CpG-island No: 5669
cgtattatcgatgtggaacgtacgtatggttagttgtgtattcggtttatcgatggattgtgtcgcgataatatcgattgttttatttttgttgatgattggttacgcgttaggttacgatcgtagtagtgcgtatatatattaaagtcggtgttataagatataatagaacgtattttaatcgcgtcgatagagtttttttttagtaggttatattattgttcgtgtagtagcgtgttgcgcggaacgaggatattagtagtattcggttttagaacgtttttagtagttatacgatttagtacgcgatcgcgtagcggttttttaacgttattattttcgatatcggagttattatgatatttttatgggtattataatcgttttcggtaattattaggttttgcgttacgttaattagacgacgagttaggtaatcggagttcgtagtttttagtgcggtattcgttagatttttacgagtatcgtgggtggtagatgaagtattggagtacgttttagatttttacggaagtttcgcggtgattggcgtttcgatgatggagttattcggtttcgttattagattacgtatattagtaagttgacgaatttgtgtcgtagaattacgcgtatcggagtcggttattatgtagatgttgttgaaggaaatttgtttttttttttgatcgttacggttaattacggttttagtttgtaggttattta

SEQ ID NO: 5670 - DNA, 729 bp, Artificial Sequence
  chemically treated genomic DNA (Homo sapiens) CpG-island No: 5670
taaataacctacaaactaaaaccgtaattaaccgtaacgatcaaaaaaaaaaacaaatttccttcaacaacatctacataataaccgactccgatacgcgtaattctacgacacaaattcgtcaacttactaatatacgtaatctaataacgaaaccgaataactccatcatcgaaacgccaatcaccgcgaaacttccgtaaaaatctaaaacgtactccaatacttcatctaccacccacgatactcgtaaaaatctaacgaataccgcactaaaaactacgaactccgattacctaactcgtcgtctaattaacgtaacgcaaaacctaataattaccgaaaacgattataatacccataaaaatatcataataactccgatatcgaaaataataacgttaaaaaaccgctacgcgatcgcgtactaaatcgtataactactaaaaacgttctaaaaccgaatactactaatatcctcgttccgcgcaacacgctactacacgaacaataatataacctactaaaaaaaaactctatcgacgcgattaaaatacgttctattatatcttataacaccgactttaatatatatacgcactactacgatcgtaacctaacgcgtaaccaatcatcaacaaaaataaaacaatcgatattatcgcgacacaatccatcgataaaccgaatacacaactaaccatacgtacgttccacatcgataatacg

SEQ ID NO: 5671 - DNA, 729 bp, Artificial Sequence
  chemically treated genomic DNA (Homo sapiens) CpG-island No: 5671
tggataatttgtaaattgaaatcgtgattaatcgtgacggttaggaagagaagtaggttttttttaatagtatttatatgatggtcgatttcggtgcgcgtggttttgcggtatagattcgttagtttgttggtatgcgtggtttgatggcgaagtcggatggttttattatcgaaacgttaattatcgcggaattttcgtgaaggtttgaaacgtattttagtattttatttgttatttacggtgttcgtaaaggtttggcggatatcgtattgaaaattgcgaatttcggttatttgattcgtcgtttggttgacgtggcgtaggatttggtggttatcgaagacgattgtggtatttatgaaggtattatgatgatttcggtatcgagggtggtgacgttaaagagtcgttgcgcgatcgcgtattgggtcgtgtaattgttgaagacgttttgaagtcgggtattgttgatattttcgtttcgcgtaatacgttgttgtacgaatagtggtgtgatttgttggaagagaattttgtcgacgcggttaaagtacgttttgttgtattttgtgatatcgattttggtgtatgtgcgtattgttacggtcgtgatttggcgcgtggttaattattaataagggtgaagtaatcggtgttatcgcggtatagtttatcggtgaatcgggtatatagttgattatgcgtacgttttatatcggtggtgcg

SEQ ID NO: 5672 - DNA, 729 bp, Artificial Sequence
  chemically treated genomic DNA (Homo sapiens) CpG-island No: 5672
cgcaccaccgatataaaacgtacgcataatcaactatatacccgattcaccgataaactataccgcgataacaccgattacttcacccttattaataattaaccacgcgccaaatcacgaccgtaacaatacgcacatacaccaaaatcgatatcacaaaatacaacaaaacgtactttaaccgcgtcgacaaaattctcttccaacaaatcacaccactattcgtacaacaacgtattacgcgaaacgaaaatatcaacaatacccgacttcaaaacgtcttcaacaattacacgacccaatacgcgatcgcgcaacgactctttaacgtcaccaccctcgataccgaaatcatcataataccttcataaataccacaatcgtcttcgataaccaccaaatcctacgccacgtcaaccaaacgacgaatcaaataaccgaaattcgcaattttcaatacgatatccgccaaacctttacgaacaccgtaaataacaaataaaatactaaaatacgtttcaaaccttcacgaaaattccgcgataattaacgtttcgataataaaaccatccgacttcgccatcaaaccacgcataccaacaaactaacgaatctataccgcaaaaccacgcgcaccgaaatcgaccatcatataaatactattaaaaaaaacctacttctcttcctaaccgtcacgattaatcacgatttcaatttacaaattatcca

SEQ ID NO: 5673 - DNA, 504 bp, Artificial Sequence
  chemically treated genomic DNA (Homo sapiens) CpG-island No: 5673
agtacggcgataatgtttaacgtattatttaacgttagcgaatttatatcgtttataaagatttgcgtcggataggtgttaaattataggaagtttagttttgtttcgattatcgcggtatagataataattagtttttcggcgtgtcgtagatacggtatatgtaagtagttggtaaagtttatattgtcggtcgtttacgttattagcgtaaaattatcggcgataaatacggtcggtataattgttaggtcgtcgagattatcggttaggtttatcgcgttgttagtatttataatgacgaagtaagttagtagaatgtagaatagttttagttgcggtattatatttttaaagaatgggattattagttgcgttgcgggcgtgtttttgtcggtaaggtatagggcgaaggcgatatttagcgtaatgatcgatatttagaaatatttttaacgagcgattaattttttggtgtttttacgtattattttgcgataatta

SEQ ID NO: 5674 - DNA, 504 bp, Artificial Sequence
  chemically treated genomic DNA (Homo sapiens) CpG-island No: 5674
taattatcgcaaaataatacgtaaaaacaccaaaaaattaatcgctcgttaaaaatatttctaaatatcgatcattacgctaaatatcgccttcgccctataccttaccgacaaaaacacgcccgcaacgcaactaataatcccattctttaaaaatataataccgcaactaaaactattctacattctactaacttacttcgtcattataaatactaacaacgcgataaacctaaccgataatctcgacgacctaacaattataccgaccgtatttatcgccgataattttacgctaataacgtaaacgaccgacaatataaactttaccaactacttacatataccgtatctacgacacgccgaaaaactaattattatctataccgcgataatcgaaacaaaactaaacttcctataatttaacacctatccgacgcaaatctttataaacgatataaattcgctaacgttaaataatacgttaaacattatcgccgtact

SEQ ID NO: 5675 - DNA, 504 bp, Artificial Sequence
  chemically treated genomic DNA (Homo sapiens) CpG-island No: 5675
tgattatcgtaaagtggtgcgtaaagatattaaagggttgatcgttcgttggaagtatttttggatgtcggttattgcgttgggtgtcgttttcgttttgtattttgtcggtaaagatacgttcgtaacgtagttggtggttttattttttaaagatgtgatgtcgtagttggggttgttttatattttgttggtttatttcgttattgtgggtattggtaacgcggtaaatttgatcgatggtttcgacggtttggtaattatgtcgatcgtatttgtcgtcggtggttttgcgttggtggcgtgggcgatcggtaatatgaattttgttagttatttgtatatatcgtatttgcgatacgtcggggaattggttattgtttgtatcgcgatagtcggggtaggattgggttttttgtggtttaatatttattcggcgtaggtttttatgggcgatgtaggttcgttggcgttaggtggtgcgttaggtattatcgtcgtatt

SEQ ID NO: 5676 - DNA, 504 bp, Artificial Sequence
  chemically treated genomic DNA (Homo sapiens) CpG-island No: 5676
aatacgacgataatacctaacgcaccacctaacgccaacgaacctacatcgcccataaaaacctacgccgaataaatattaaaccacaaaaaacccaatcctaccccgactatcgcgatacaaacaataaccaattccccgacgtatcgcaaatacgatatatacaaataactaacaaaattcatattaccgatcgcccacgccaccaacgcaaaaccaccgacgacaaatacgatcgacataattaccaaaccgtcgaaaccatcgatcaaatttaccgcgttaccaatacccacaataacgaaataaaccaacaaaatataaaacaaccccaactacgacatcacatctttaaaaaataaaaccaccaactacgttacgaacgtatctttaccgacaaaatacaaaacgaaaacgacacccaacgcaataaccgacatccaaaaatacttccaacgaacgatcaaccctttaatatctttacgcaccactttacgataatca

SEQ ID NO: 5677 - DNA, 874 bp, Artificial Sequence
  chemically treated genomic DNA (Homo sapiens) CpG-island No: 5677
ttttattttcgttagtaattaggcgtgtcgtcggcggggttaaatcgagtaatttttttagcgttttagaagaacgttggcgtgcgcgcgtttttagtatatggtcgagattgattagatcgataattatcgcgttggtttcgtaataaagatgtcgcgtttttatcgggaattattgcggttataggttgacgtttatcgaatagagttacgttacgttagtatttagcgttattagcgtatttatcgtcgtcgtatcgtttagtaggtttttttatgtattgcggtaaaaatggtcgtcggcgaaaattattattgttagggttattaggtcgataattaattataggttgcggttgttagcggtgattattatgttatcgtcgattattttttagattattatcgggatatttatcgttagtgcgataattgtttgttagcggaagcgttttatcgtagcgacggcggttttttgttggcgttcgcggcgtttagcgttatttttaatcgttttcgcgtcgtagttcgttttttttatcgtttgtattaaattttgtggggaggtattgtttattattagcgtagtacgtttcgttaggtttattcgtgtttgagtgacgttcggtacgttttgtagcgtattttgtacgcgggtgatatagttggcgtagtttatgtcgtttagtagtaattgttggttgttatcgttatcggcggtcgttgtcggaagcgttttagaaatcgttgttagtgttttcgacgggattgatgatttcgttagcggtttagtttttgggttggtttatagatgcgttataattcgtttgtttgatggtttcgattagttgttttgtattggtagtttcgtacg

SEQ ID NO: 5678 - DNA, 874 bp, Artificial Sequence
  chemically treated genomic DNA (Homo sapiens) CpG-island No: 5678
cgtacgaaactaccaatacaaaacaactaatcgaaaccatcaaacaaacgaattataacgcatctataaaccaacccaaaaactaaaccgctaacgaaatcatcaatcccgtcgaaaacactaacaacgatttctaaaacgcttccgacaacgaccgccgataacgataacaaccaacaattactactaaacgacataaactacgccaactatatcacccgcgtacaaaatacgctacaaaacgtaccgaacgtcactcaaacacgaataaacctaacgaaacgtactacgctaataataaacaatacctccccacaaaatttaatacaaacgataaaaaaaacgaactacgacgcgaaaacgattaaaaataacgctaaacgccgcgaacgccaacaaaaaaccgccgtcgctacgataaaacgcttccgctaacaaacaattatcgcactaacgataaatatcccgataataatctaaaaaataatcgacgataacataataatcaccgctaacaaccgcaacctataattaattatcgacctaataaccctaacaataataattttcgccgacgaccatttttaccgcaatacataaaaaaacctactaaacgatacgacgacgataaatacgctaataacgctaaatactaacgtaacgtaactctattcgataaacgtcaacctataaccgcaataattcccgataaaaacgcgacatctttattacgaaaccaacgcgataattatcgatctaatcaatctcgaccatatactaaaaacgcgcgcacgccaacgttcttctaaaacgctaaaaaaattactcgatttaaccccgccgacgacacgcctaattactaacgaaaataaaa

SEQ ID NO: 5679 - DNA, 874 bp, Artificial Sequence
  chemically treated genomic DNA (Homo sapiens) CpG-island No: 5679
cgtacgggattgttagtgtagaatagttgatcgaaattattaaataagcgggttatgacgtatttgtaagttaatttaaaggttaaatcgttggcggagttattaatttcgtcggaagtattgatagcggtttttgaggcgttttcggtagcgatcgtcgatgacgatgatagttagtagttgttgttgagcggtatgagttgcgttagttgtgttattcgcgtataaaatgcgttgtaaagcgtatcgggcgttatttaggtacgggtaaatttggcggagcgtattgcgttggtgatgggtagtgtttttttataagatttagtgtaggcggtggaaaaagcgggttacggcgcggaagcgattgaagatgacgttaaacgtcgcgagcgttagtaagaaatcgtcgtcgttacgatgaagcgttttcgttggtaggtaattgtcgtattggcggtgggtatttcggtgatggtttgggggatgatcggcgataatatgatggttatcgttgataatcgtagtttgtggttggttatcggtttgataattttggtagtgatggttttcgtcggcggttatttttatcgtagtgtatggaaaagtttgttgaacggtgcggcgacgatggatacgttggtggcgttgggtattggcgtggcgtggttttattcgatgagcgttaatttgtggtcgtagtggttttcgatggaagcgcgatatttttattacgaagttagcgcgatgattatcggtttgattaatttcggttatatgttggaagcgcgcgtacgttagcgtttttttaaggcgttggaaaagttattcgatttaatttcgtcgacggtacgtttggttattgacgaaggtgaaa

SEQ ID NO: 5680 - DNA, 874 bp, Artificial Sequence
  chemically treated genomic DNA (Homo sapiens) CpG-island No: 5680
tttcaccttcgtcaataaccaaacgtaccgtcgacgaaattaaatcgaataacttttccaacgccttaaaaaaacgctaacgtacgcgcgcttccaacatataaccgaaattaatcaaaccgataatcatcgcgctaacttcgtaataaaaatatcgcgcttccatcgaaaaccactacgaccacaaattaacgctcatcgaataaaaccacgccacgccaatacccaacgccaccaacgtatccatcgtcgccgcaccgttcaacaaacttttccatacactacgataaaaataaccgccgacgaaaaccatcactaccaaaattatcaaaccgataaccaaccacaaactacgattatcaacgataaccatcatattatcgccgatcatcccccaaaccatcaccgaaatacccaccgccaatacgacaattacctaccaacgaaaacgcttcatcgtaacgacgacgatttcttactaacgctcgcgacgtttaacgtcatcttcaatcgcttccgcgccgtaacccgctttttccaccgcctacactaaatcttataaaaaaacactacccatcaccaacgcaatacgctccgccaaatttacccgtacctaaataacgcccgatacgctttacaacgcattttatacgcgaataacacaactaacgcaactcataccgctcaacaacaactactaactatcatcgtcatcgacgatcgctaccgaaaacgcctcaaaaaccgctatcaatacttccgacgaaattaataactccgccaacgatttaacctttaaattaacttacaaatacgtcataacccgcttatttaataatttcgatcaactattctacactaacaatcccgtacg

SEQ ID NO: 5681 - DNA, 625 bp, Artificial Sequence
  chemically treated genomic DNA (Homo sapiens) CpG-island No: 5681
ttttttggcgtttttggtttgttatttggcgaacgataaagcgttgttcggtatttagtcgggtgcgggatttttcgcgtcgcgcgttggtgttgcgcgcgttggcgatttggttatttcgttttttggtttcgtaaatgtgcgttttggtaagagtagttataattcgttgttcggtttattgttgatttcgttcgttatttttgtttggttttcggttgtgtttatttattacgttatcgggtcggtgatgttcgattttatgggtcgggttgttttattttttgaatattatttttttattaatgaagtttgcggtagcgtttttggtcggtcgcgatcgttggcgttcgatatgggcggttttattaataaaattagtcgatgtacgttggcgtaaaatgtgggacgtcggtttggttatcggtagtttggtatcgtcggtagttttcggtatcgttttcggtaatttgttgtatcggcgtagtcgttaggtcgtttatatcgtaattacgcgtggagtatttcgggtagtattttggtaattgttgacgttaatttcgttttattgtacggattgtttagttttgggatggtgattttgtaaggtggcgttatggttata

SEQ ID NO: 5682 - DNA, 625 bp, Artificial Sequence
  chemically treated genomic DNA (Homo sapiens) CpG-island No: 5682
tataaccataacgccaccttacaaaatcaccatcccaaaactaaacaatccgtacaataaaacgaaattaacgtcaacaattaccaaaatactacccgaaatactccacgcgtaattacgatataaacgacctaacgactacgccgatacaacaaattaccgaaaacgataccgaaaactaccgacgataccaaactaccgataaccaaaccgacgtcccacattttacgccaacgtacatcgactaattttattaataaaaccgcccatatcgaacgccaacgatcgcgaccgaccaaaaacgctaccgcaaacttcattaataaaaaaataatattcaaaaaataaaacaacccgacccataaaatcgaacatcaccgacccgataacgtaataaataaacacaaccgaaaaccaaacaaaaataacgaacgaaatcaacaataaaccgaacaacgaattataactactcttaccaaaacgcacatttacgaaaccaaaaaacgaaataaccaaatcgccaacgcgcgcaacaccaacgcgcgacgcgaaaaatcccgcacccgactaaataccgaacaacgctttatcgttcgccaaataacaaaccaaaaacgccaaaaaa

SEQ ID NO: 5683 - DNA, 625 bp, Artificial Sequence
  chemically treated genomic DNA (Homo sapiens) CpG-island No: 5683
tgtaattatgacgttattttgtaaaattattattttaaggttgagtaattcgtataataaagcggaattggcgttagtagttgttagaatgttgttcgagatattttacgcgtaattgcggtgtgaacggtttaacggttacgtcgatgtaataagttgtcgaaggcgatatcgaagattatcggcggtattagattgtcgatgattagatcggcgttttatattttacgttagcgtgtatcggttggttttattgatggggtcgtttatatcgaacgttagcgatcgcgatcgattagaaacgttgtcgtaaattttattgatggaggaatggtatttaggaagtggagtagttcggtttatgaggtcggatattatcggttcgataacgtagtaagtgagtatagtcgaaaattaagtaggagtaacgaacgggattagtaatgaatcgagtagcggattgtaattgtttttgttaaggcgtatatttgcggaattagaagacgaaatagttaagtcgttagcgcgcgtagtattagcgcgcggcgcgaggaatttcgtattcgattgggtgtcgagtagcgttttgtcgttcgttagatagtaaattagaaacgttaggagg

SEQ ID NO: 5684 - DNA, 625 bp, Artificial Sequence
  chemically treated genomic DNA (Homo sapiens) CpG-island No: 5684
cctcctaacgtttctaatttactatctaacgaacgacaaaacgctactcgacacccaatcgaatacgaaattcctcgcgccgcgcgctaatactacgcgcgctaacgacttaactatttcgtcttctaattccgcaaatatacgccttaacaaaaacaattacaatccgctactcgattcattactaatcccgttcgttactcctacttaattttcgactatactcacttactacgttatcgaaccgataatatccgacctcataaaccgaactactccacttcctaaataccattcctccatcaataaaatttacgacaacgtttctaatcgatcgcgatcgctaacgttcgatataaacgaccccatcaataaaaccaaccgatacacgctaacgtaaaatataaaacgccgatctaatcatcgacaatctaataccgccgataatcttcgatatcgccttcgacaacttattacatcgacgtaaccgttaaaccgttcacaccgcaattacgcgtaaaatatctcgaacaacattctaacaactactaacgccaattccgctttattatacgaattactcaaccttaaaataataattttacaaaataacgtcataattaca

SEQ ID NO: 5685 - DNA, 696 bp, Artificial Sequence
  chemically treated genomic DNA (Homo sapiens) CpG-island No: 5685
gcgattaacggtatgagtaatggtatttttgttcggttcggtacgtttatagtatcgcgtattggtgcggcgaggatttttttcgtgcggttggttcgtttaacgttaataatcgcgcgaggttattttgatgtaaataaggatagcggcgttatgtattaatatttattgcgcgtcgttagcggtttttagattgttagtacggaatcggtacgtttattatcgttatttataacggtgattgcggatgattcgttagaggaagttgtgtaaaacggttatcgttaggattatggtaatgacgatacgttttattcggggatgcgttagtagcgtatgttcgagtgtttaagaatggtttgattatcgattgagagatattgtttaggtatttcgtttgtattcgacggttaaattcggtcgtcggaattacggcgtaatatttaaatgagtggttgttatgttaattttcgggttgatttatcgatgttttgtttcgtagattgtgcgcgtttcgacgcgttaggtattagacgtaaaaagtttcgttcggtttggttatgttgagtttattacgcgtacgttttcgagcgttttttggtcgttattgagatcgttaatttcggtaaaaagtgatcgtttcgcgttttaagtttcgcgtttgtagtttgttgtgtcgttatttattattgacgt

SEQ ID NO: 5686 - DNA, 696 bp, Artificial Sequence
  chemically treated genomic DNA (Homo sapiens) CpG-island No: 5686
acgtcaataataaataacgacacaacaaactacaaacgcgaaacttaaaacgcgaaacgatcactttttaccgaaattaacgatctcaataacgaccaaaaaacgctcgaaaacgtacgcgtaataaactcaacataaccaaaccgaacgaaactttttacgtctaatacctaacgcgtcgaaacgcgcacaatctacgaaacaaaacatcgataaatcaacccgaaaattaacataacaaccactcatttaaatattacgccgtaattccgacgaccgaatttaaccgtcgaatacaaacgaaatacctaaacaatatctctcaatcgataatcaaaccattcttaaacactcgaacatacgctactaacgcatccccgaataaaacgtatcgtcattaccataatcctaacgataaccgttttacacaacttcctctaacgaatcatccgcaatcaccgttataaataacgataataaacgtaccgattccgtactaacaatctaaaaaccgctaacgacgcgcaataaatattaatacataacgccgctatccttatttacatcaaaataacctcgcgcgattattaacgttaaacgaaccaaccgcacgaaaaaaatcctcgccgcaccaatacgcgatactataaacgtaccgaaccgaacaaaaataccattactcataccgttaatcgc

SEQ ID NO: 5687 - DNA, 696 bp, Artificial Sequence
  chemically treated genomic DNA (Homo sapiens) CpG-island No: 5687
gcgttaatgatgagtggcggtatagtaagttataaacgcgaaatttaaagcgcgaaacgattattttttgtcgaaattgacgattttaatggcggttaggaggcgttcgaaagcgtgcgcgtaatgaatttagtatgattaggtcgggcgaaattttttacgtttggtgtttgacgcgtcgaagcgcgtatagtttgcggggtaaaatatcgataaattagttcgggaattaatatggtaattatttatttggatgttgcgtcgtggtttcggcggtcggatttggtcgtcgaatgtaaacggaatgtttaagtaatattttttaatcggtaattaaattatttttgaatattcgggtatgcgttgttggcgtattttcgggtgaaacgtgtcgttattgttatagttttggcgatagtcgttttgtataattttttttggcgaattattcgtaattatcgttgtagatggcggtgatgagcgtgtcgatttcgtgttggtagtttgaaagtcgttggcgacgcgtagtgggtattggtgtatgacgtcgttgtttttgtttgtattaggatgatttcgcgcgattgttggcgttgagcgaattagtcgtacgggggggattttcgtcgtattagtgcgcgatattatgaacgtgtcgaatcgggtaaaaatgttattgtttatatcgttgatcgt

SEQ ID NO: 5688 - DNA, 696 bp, Artificial Sequence
  chemically treated genomic DNA (Homo sapiens) CpG-island No: 5688
acgatcaacgatataaacaataacatttttacccgattcgacacgttcataatatcgcgcactaatacgacgaaaatcccccccgtacgactaattcgctcaacgccaacaatcgcgcgaaatcatcctaatacaaacaaaaacaacgacgtcatacaccaatacccactacgcgtcgccaacgactttcaaactaccaacacgaaatcgacacgctcatcaccgccatctacaacgataattacgaataattcgccaaaaaaaattatacaaaacgactatcgccaaaactataacaataacgacacgtttcacccgaaaatacgccaacaacgcatacccgaatattcaaaaataatttaattaccgattaaaaaatattacttaaacattccgtttacattcgacgaccaaatccgaccgccgaaaccacgacgcaacatccaaataaataattaccatattaattcccgaactaatttatcgatattttaccccgcaaactatacgcgcttcgacgcgtcaaacaccaaacgtaaaaaatttcgcccgacctaatcatactaaattcattacgcgcacgctttcgaacgcctcctaaccgccattaaaatcgtcaatttcgacaaaaaataatcgtttcgcgctttaaatttcgcgtttataacttactataccgccactcatcattaacgc

SEQ ID NO: 5689 - DNA, 626 bp, Artificial Sequence
  chemically treated genomic DNA (Homo sapiens) CpG-island No: 5689
aacgttagtcggatattatttggtacgtggtgcgcgtgtagttgttaggttagtttttataatggttggtagagaagtcgttcgtgcggtggagttaggtttttggggcgtggattttaattgcgttgttcgtcgaaaacggttaacggtagcggcggcggggcgacgttatttaagattttgaatttatttattagggtgtaaaagcgatgcgtgaagttgttcggcgtatttgttcgttagcgtgaaagtgcgtttgggttgggatagcgtgagaagaaatttgaaatcgtcgatgcggtttaataggttggcgttacgagttggtggtgtatgggcggacgaaagagtagggttatcgcgcggagtaattgattggtaggcgattggcgatattcgttagcggttgaatatttcgggattgttaacggtgaaatttgggattggtagagcgcgtaataatgtatgcgattagcggttgcgacgtagtgatgattggtcgcggggcgtttaatattttaatttgagtcgggtggtaaaatataacgaatcgcgaatgtcgtggcggaggtggttgttttgttgtaaaaatatattcgtttggaaaagtagggtatatcgggtta

SEQ ID NO: 5690 - DNA, 626 bp, Artificial Sequence
  chemically treated genomic DNA (Homo sapiens) CpG-island No: 5690
taacccgatataccctacttttccaaacgaatatatttttacaacaaaacaaccacctccgccacgacattcgcgattcgttatattttaccacccgactcaaattaaaatattaaacgccccgcgaccaatcatcactacgtcgcaaccgctaatcgcatacattattacgcgctctaccaatcccaaatttcaccgttaacaatcccgaaatattcaaccgctaacgaatatcgccaatcgcctaccaatcaattactccgcgcgataaccctactctttcgtccgcccatacaccaccaactcgtaacgccaacctattaaaccgcatcgacgatttcaaatttcttctcacgctatcccaacccaaacgcactttcacgctaacgaacaaatacgccgaacaacttcacgcatcgcttttacaccctaataaataaattcaaaatcttaaataacgtcgccccgccgccgctaccgttaaccgttttcgacgaacaacgcaattaaaatccacgccccaaaaacctaactccaccgcacgaacgacttctctaccaaccattataaaaactaacctaacaactacacgcgcaccacgtaccaaataatatccgactaacgtt

SEQ ID NO: 5691 - DNA, 626 bp, Artificial Sequence
  chemically treated genomic DNA (Homo sapiens) CpG-island No: 5691
taattcggtatgttttgtttttttagacgggtatatttttgtagtaaagtaattattttcgttacggtattcgcggttcgttatattttattattcggtttaggttgggatattgagcgtttcgcgattaattattattgcgtcgtagtcgttgatcgtatgtattgttgcgcgttttgttagttttagattttatcgttggtaatttcggaatatttagtcgttggcgaatatcgttaatcgtttgttagttaattgtttcgcgcggtaattttgttttttcgttcgtttatgtattattagttcgtagcgttagtttgttgaatcgtatcggcgattttaaatttttttttacgttgttttagtttagacgtatttttacgttgacgggtaaatgcgtcggatagttttacgtatcgtttttgtattttggtagatgagtttaggattttgagtaacgtcgtttcgtcgtcgttatcgttaatcgttttcgacgggtagcgtaattgagatttacgttttaggaatttaattttatcgtacgggcggtttttttgttagttattgtgggaattgatttaataattgtacgcgtattacgtattagatggtgttcggttggcgtt

SEQ ID NO: 5692 - DNA, 626 bp, Artificial Sequence
  chemically treated genomic DNA (Homo sapiens) CpG-island No: 5692
aacgccaaccgaacaccatctaatacgtaatacgcgtacaattattaaatcaattcccacaataactaacaaaaaaaccgcccgtacgataaaattaaattcctaaaacgtaaatctcaattacgctacccgtcgaaaacgattaacgataacgacgacgaaacgacgttactcaaaatcctaaactcatctaccaaaatacaaaaacgatacgtaaaactatccgacgcatttacccgtcaacgtaaaaatacgtctaaactaaaacaacgtaaaaaaaaatttaaaatcgccgatacgattcaacaaactaacgctacgaactaataatacataaacgaacgaaaaaacaaaattaccgcgcgaaacaattaactaacaaacgattaacgatattcgccaacgactaaatattccgaaattaccaacgataaaatctaaaactaacaaaacgcgcaacaatacatacgatcaacgactacgacgcaataataattaatcgcgaaacgctcaatatcccaacctaaaccgaataataaaatataacgaaccgcgaataccgtaacgaaaataattactttactacaaaaatatacccgtctaaaaaaacaaaacataccgaatta

SEQ ID NO: 5693 - DNA, 1060 bp, Artificial Sequence
  chemically treated genomic DNA (Homo sapiens) CpG-island No: 5693
taaagttaattatcgtggtattgtcgttgtcgggttttagtaattcgttaatattcgtattagcgtggttttatttgtatcgttcggttttattatttcgttatataatcggcgtgaatggtataatcgagcggcgcgacggcggtttgtttatgttcggaaagcgtttttttaggtcgtttagcgtgataacgtattatttatgttttgtttcgttatcgaattgtatcgttattggtatttttggcgtaacgtattatcggcgtcggttattataatacgtaggcgataacgaggtcggtacgtagattcggcgtttcgacggttttcggggtaaattagtagtcggcgaaacgaaattaatttgttcgtgatacggtttgttcggggattatcggtataaagtagtattttgcgtttcggttgggtttggttaagttacgtttattaatataagcgcgtatttatatcggacgcgttagtgaaaggtaaatatcgtgttatttttattgaggatcgtgtttggttttatcgcggcgttaatagcgtgttattagacggggttattaacgtggagttttgtaatttaatttcgtttgcgttagttgcgtttgcgtttgttcgagtttggtttcgtttgagcgatgttttgtttacggttatcggaacggtattgacgtaattattttgtgttgattttaagttttgtttgcgtttggtcgcgcgaggagcggtattttttaggttatttgtcgaaatagtgcggtttttttataattttgttggcggttatagaagttttgcgtatagttataggcggtttgcgtttgtttatcgttgcggcggtttgagcgatttttttattgcgatattcggtaatattaggttatattgcgtttgtgttatcgaaatattcgttttcgtttgtttagggtaattttatacggtttgtgatttagttcgtttagtatttggtcgttttgatagtattattttcgtttatcgttagcgatttaacgcgtttttaatataggaaattaagatttatcgtaagaatatt

SEQ ID NO: 5694 - DNA, 1060 bp, Artificial Sequence
  chemically treated genomic DNA (Homo sapiens) CpG-island No: 5694
aatattcttacgataaatcttaatttcctatattaaaaacgcgttaaatcgctaacgataaacgaaaataatactatcaaaacgaccaaatactaaacgaactaaatcacaaaccgtataaaattaccctaaacaaacgaaaacgaatatttcgataacacaaacgcaatataacctaatattaccgaatatcgcaataaaaaaatcgctcaaaccgccgcaacgataaacaaacgcaaaccgcctataactatacgcaaaacttctataaccgccaacaaaattataaaaaaaccgcactatttcgacaaataacctaaaaaataccgctcctcgcgcgaccaaacgcaaacaaaacttaaaatcaacacaaaataattacgtcaataccgttccgataaccgtaaacaaaacatcgctcaaacgaaaccaaactcgaacaaacgcaaacgcaactaacgcaaacgaaattaaattacaaaactccacgttaataaccccgtctaataacacgctattaacgccgcgataaaaccaaacacgatcctcaataaaaataacacgatatttacctttcactaacgcgtccgatataaatacgcgcttatattaataaacgtaacttaaccaaacccaaccgaaacgcaaaatactactttataccgataatccccgaacaaaccgtatcacgaacaaattaatttcgtttcgccgactactaatttaccccgaaaaccgtcgaaacgccgaatctacgtaccgacctcgttatcgcctacgtattataataaccgacgccgataatacgttacgccaaaaataccaataacgatacaattcgataacgaaacaaaacataaataatacgttatcacgctaaacgacctaaaaaaacgctttccgaacataaacaaaccgccgtcgcgccgctcgattataccattcacgccgattatataacgaaataataaaaccgaacgatacaaataaaaccacgctaatacgaatattaacgaattactaaaacccgacaacgacaataccacgataattaacttta

SEQ ID NO: 5695 - DNA, 1060 bp, Artificial Sequence
  chemically treated genomic DNA (Homo sapiens) CpG-island No: 5695
gatatttttacggtaaattttagttttttgtgttgggggcgcgttgaatcgttggcggtggacgaaggtgatgttattaaagcggttaggtgttgggcgaattggattataagtcgtatgagattgttttgagtaggcgaaagcgggtgtttcggtggtataggcgtagtatgatttgatgttgtcgggtatcgtaatgaagaaatcgtttaggtcgtcgtagcggtgaataggcgtaagtcgtttatgattatgcgtagaatttttataatcgttagtagggttgtggaaaagtcgtattatttcggtaaatgatttggaaaatgtcgtttttcgcgcgattaggcgtaggtaaagtttgaaattagtataggataattgcgttagtatcgtttcggtaatcgtgaataggatatcgtttaggcgaagttaggttcgaataggcgtaggcgtaattggcgtaggcggagttgaattataggattttacgttgatagtttcgtttgatggtacgttgttaacgtcgcggtggagttaggtacggtttttaatgaaggtggtacggtgtttattttttattaacgcgttcggtgtgggtgcgcgtttatgttgatgaacgtaatttgattaggtttagtcggggcgtaaagtgttgttttatatcgatggttttcggataagtcgtattacgggtagattggtttcgtttcgtcgattgttaatttatttcgaaaatcgtcgaaacgtcggatttgcgtatcgatttcgttatcgtttgcgtattgtggtgatcgacgtcgatgatgcgttacgttaggaatgttagtgacggtataattcggtgacgaggtaggatatgaatgatgcgttattacgttgaacggtttggaaaaacgtttttcgggtatggataagtcgtcgtcgcgtcgttcgattgtattatttacgtcggttatgtgacggggtggtggggtcggacggtgtaggtaaaattacgttgatgcggatgttggcggattattgaaattcgatagcggtagtgttacggtgattggttttg

SEQ ID NO: 5696 - DNA, 1060 bp, Artificial Sequence
  chemically treated genomic DNA (Homo sapiens) CpG-island No: 5696
caaaaccaatcaccgtaacactaccgctatcgaatttcaataatccgccaacatccgcatcaacgtaattttacctacaccgtccgaccccaccaccccgtcacataaccgacgtaaataatacaatcgaacgacgcgacgacgacttatccatacccgaaaaacgtttttccaaaccgttcaacgtaataacgcatcattcatatcctacctcgtcaccgaattataccgtcactaacattcctaacgtaacgcatcatcgacgtcgatcaccacaatacgcaaacgataacgaaatcgatacgcaaatccgacgtttcgacgattttcgaaataaattaacaatcgacgaaacgaaaccaatctacccgtaatacgacttatccgaaaaccatcgatataaaacaacactttacgccccgactaaacctaatcaaattacgttcatcaacataaacgcgcacccacaccgaacgcgttaataaaaaataaacaccgtaccaccttcattaaaaaccgtacctaactccaccgcgacgttaacaacgtaccatcaaacgaaactatcaacgtaaaatcctataattcaactccgcctacgccaattacgcctacgcctattcgaacctaacttcgcctaaacgatatcctattcacgattaccgaaacgatactaacgcaattatcctatactaatttcaaactttacctacgcctaatcgcgcgaaaaacgacattttccaaatcatttaccgaaataatacgacttttccacaaccctactaacgattataaaaattctacgcataatcataaacgacttacgcctattcaccgctacgacgacctaaacgatttcttcattacgatacccgacaacatcaaatcatactacgcctataccaccgaaacacccgctttcgcctactcaaaacaatctcatacgacttataatccaattcgcccaacacctaaccgctttaataacatcaccttcgtccaccgccaacgattcaacgcgcccccaacacaaaaaactaaaatttaccgtaaaaatatc

SEQ ID NO: 5697 - DNA, 869 bp, Artificial Sequence
  chemically treated genomic DNA (Homo sapiens) CpG-island No: 5697
acgttaaattttttgttaaaagttattattagtaattttggttttattttttgtagttagtagttgtcgcgtttttgtttttcgataacgttcgtgtcgtgggtattatcgattattaattagttattgattgtcggtgataatagtcgtgcgttataattggtagaaaaattgcgttagtaaggttgttgggttacggcgattcgttcgttaatcgtattcgttggtattgcgcgattgcgtttaacgttaatcgttgcgtatgaaatgtaggatatcgatcgtttgttggaggtgttgtatggtaacggttaataaataagttattgtagcggtatttggtcgggtagtcgtatattatgagtaatatgtagatttatagcgttagagtgttgacgttttattggtaatgtttttatagcgtaaatatatttacgtattggacgcgggttgtggatttggttggatgagtcgttattggcgggaacgttacgcgtaggtgacggttttagatttttcgtcgttaatgtttgtttaggtacgttagaaggatgtcgtagattattatttggcgggagatatcgaatttttgtcgttagcgattgcgacgttcgattttgtatggagtaatttcgtagtgtagtggtgcggtaattatttacggtatttcgcgagttgtatcgggtggtgcgttttaaaggcgtggtcgcgtttattacgttggtgtagggatcgttattcgaattgtattaggcgtggtaggcggtggacgagcgttcgtatgttaatcgttttttatcgttagatgaaatcgaatagtcgttgaacggcgtgtatagttaatattatatttagtttattacgttgtg

SEQ ID NO: 5698 - DNA, 869 bp, Artificial Sequence
  chemically treated genomic DNA (Homo sapiens) CpG-island No: 5698
cacaacgtaataaactaaatataatattaactatacacgccgttcaacgactattcgatttcatctaacgataaaaaacgattaacatacgaacgctcgtccaccgcctaccacgcctaatacaattcgaataacgatccctacaccaacgtaataaacgcgaccacgcctttaaaacgcaccacccgatacaactcgcgaaataccgtaaataattaccgcaccactacactacgaaattactccatacaaaatcgaacgtcgcaatcgctaacgacaaaaattcgatatctcccgccaaataataatctacgacatccttctaacgtacctaaacaaacattaacgacgaaaaatctaaaaccgtcacctacgcgtaacgttcccgccaataacgactcatccaaccaaatccacaacccgcgtccaatacgtaaatatatttacgctataaaaacattaccaataaaacgtcaacactctaacgctataaatctacatattactcataatatacgactacccgaccaaataccgctacaataacttatttattaaccgttaccatacaacacctccaacaaacgatcgatatcctacatttcatacgcaacgattaacgttaaacgcaatcgcgcaataccaacgaatacgattaacgaacgaatcgccgtaacccaacaaccttactaacgcaatttttctaccaattataacgcacgactattatcaccgacaatcaataactaattaataatcgataatacccacgacacgaacgttatcgaaaaacaaaaacgcgacaactactaactacaaaaaataaaaccaaaattactaataataacttttaacaaaaaatttaacgt

SEQ ID NO: 5699 - DNA, 869 bp, Artificial Sequence
  chemically treated genomic DNA (Homo sapiens) CpG-island No: 5699
tatagcgtgatgggttgaatatgatgttgattatgtacgtcgtttagcgattgttcgattttatttggcggtaaaaagcgattagtatgcggacgttcgtttatcgtttgttacgtttgatgtagttcgggtaacgatttttgtattagcgtggtaaacgcgattacgtttttggggcgtattattcgatatagttcgcggagtgtcgtggataattatcgtattattgtattgcgagattgttttatgtaagatcgaacgtcgtagtcgttaacggtagggattcgatatttttcgttagataatggtttgcggtatttttttggcgtgtttgaataagtattggcggcgagagatttaaggtcgttatttgcgcgtgacgttttcgttagtggcggtttatttagttaggtttataattcgcgtttagtacgtgggtgtatttacgttgtggaagtattgttagtaaggcgttagtattttggcgttgtagatttgtatgttgtttatagtgtgcggttgttcgattaaatgtcgttgtaatggtttgtttattaatcgttgttatgtagtatttttagtagacggtcgatattttgtattttatgcgtagcggttagcgttaagcgtagtcgcgtagtattagcgggtacggttggcgggcgaatcgtcgtgatttagtagttttgttgacgtagtttttttgttagttgtaacgtacggttgttattatcgataattaatggttggttgatggtcgatgatgtttacggtacgggcgttatcggggagtaggggcgcggtagttgttggttgtaaaaggtaaaattagaattgttggtagtgatttttggtaaaggatttggcgt

SEQ ID NO: 5700 - DNA, 869 bp, Artificial Sequence
  chemically treated genomic DNA (Homo sapiens) CpG-island No: 5700
acgccaaatcctttaccaaaaatcactaccaacaattctaattttaccttttacaaccaacaactaccgcgcccctactccccgataacgcccgtaccgtaaacatcatcgaccatcaaccaaccattaattatcgataataacaaccgtacgttacaactaacaaaaaaactacgtcaacaaaactactaaatcacgacgattcgcccgccaaccgtacccgctaatactacgcgactacgcttaacgctaaccgctacgcataaaatacaaaatatcgaccgtctactaaaaatactacataacaacgattaataaacaaaccattacaacgacatttaatcgaacaaccgcacactataaacaacatacaaatctacaacgccaaaatactaacgccttactaacaatacttccacaacgtaaatacacccacgtactaaacgcgaattataaacctaactaaataaaccgccactaacgaaaacgtcacgcgcaaataacgaccttaaatctctcgccgccaatacttattcaaacacgccaaaaaaataccgcaaaccattatctaacgaaaaatatcgaatccctaccgttaacgactacgacgttcgatcttacataaaacaatctcgcaatacaataatacgataattatccacgacactccgcgaactatatcgaataatacgccccaaaaacgtaatcgcgtttaccacgctaatacaaaaatcgttacccgaactacatcaaacgtaacaaacgataaacgaacgtccgcatactaatcgctttttaccgccaaataaaatcgaacaatcgctaaacgacgtacataatcaacatcatattcaacccatcacgctata

SEQ ID NO: 5701 - DNA, 698 bp, Artificial Sequence
  chemically treated genomic DNA (Homo sapiens) CpG-island No: 5701
cggggtagacgatttggggttgatttagcgtgcggcgcgtaagattgacggtttgggtattaagtatgtttagttaagcggtgaaggttgggatgcggatcgttgttgggtattttggtaaggttataaagtttcgaaaggtacgcgtaaagtggtgtggtcggatttggacgatgtttagcgttaggaattggataatcgtttgatgattatcgattgggtgcgtgatattattaacgtatcggtagaagaattgggattatcgtaattggtatagcgtgttgttgatttgattagtaacgtcgcgggcgatcgtgtgatttatcggattattaaaggcgaagatttgcgtgagtaaggttatatggggttgtatatagtcggacgcggtttagaacgtttttcggtattgttggcgttggattataatttaattggcgataaagaagcgttagtgtacgcgtgtttggtaggtaaaggtattatttttgatttcggcggttatagtattaaatagattgcgtttatggattcgatgaagtcggatatgggcggcgcggtaacggttatcggggcgttggtatttgttattacgcgcggattgaataagcgcgtgaagttgtttttttgttgtgcggataatttgattaacggtaatgcgtttaagttgggcgatattattatttatcgtaacggta

SEQ ID NO: 5702 - DNA, 698 bp, Artificial Sequence
  chemically treated genomic DNA (Homo sapiens) CpG-island No: 5702
taccgttacgataaataataatatcgcccaacttaaacgcattaccgttaatcaaattatccgcacaacaaaaaaacaacttcacgcgcttattcaatccgcgcgtaataacaaataccaacgccccgataaccgttaccgcgccgcccatatccgacttcatcgaatccataaacgcaatctatttaatactataaccgccgaaatcaaaaataatacctttacctaccaaacacgcgtacactaacgcttctttatcgccaattaaattataatccaacgccaacaataccgaaaaacgttctaaaccgcgtccgactatatacaaccccatataaccttactcacgcaaatcttcgcctttaataatccgataaatcacacgatcgcccgcgacgttactaatcaaatcaacaacacgctataccaattacgataatcccaattcttctaccgatacgttaataatatcacgcacccaatcgataatcatcaaacgattatccaattcctaacgctaaacatcgtccaaatccgaccacaccactttacgcgtacctttcgaaactttataaccttaccaaaatacccaacaacgatccgcatcccaaccttcaccgcttaactaaacatacttaatacccaaaccgtcaatcttacgcgccgcacgctaaatcaaccccaaatcgtctaccccg

SEQ ID NO: 5703 - DNA, 698 bp, Artificial Sequence
  chemically treated genomic DNA (Homo sapiens) CpG-island No: 5703
tatcgttgcgataggtgatgatatcgtttagtttgaacgtattgtcgttaattaggttattcgtatagtagaggaatagttttacgcgtttgtttagttcgcgcgtaatggtaaatgttagcgtttcggtaatcgttgtcgcgtcgtttatgttcgattttatcgagtttataaacgtagtttgtttgatgttgtagtcgtcggagttaaaagtgatatttttatttattaggtacgcgtatattggcgtttttttatcgttagttgggttgtaatttagcgttagtaatatcggagaacgttttgaatcgcgttcgattgtgtgtagttttatataattttgtttacgtagattttcgtttttggtgattcgataagttatacgatcgttcgcgacgttgttgattagattaatagtacgttgtgttagttgcgatggttttaatttttttgtcggtgcgttgatggtgttacgtatttagtcgatgattattaggcggttatttagtttttggcgttgggtatcgtttagattcggttatattattttacgcgtgtttttcggggttttgtaattttgttagaatgtttagtagcgattcgtattttagtttttatcgtttaattgaatatgtttgatgtttagatcgttaattttgcgcgtcgtacgttggattagttttagatcgtttgtttcg

SEQ ID NO: 5704 - DNA, 698 bp, Artificial Sequence
  chemically treated genomic DNA (Homo sapiens) CpG-island No: 5704
cgaaacaaacgatctaaaactaatccaacgtacgacgcgcaaaattaacgatctaaacatcaaacatattcaattaaacgataaaaactaaaatacgaatcgctactaaacattctaacaaaattacaaaaccccgaaaaacacgcgtaaaataatataaccgaatctaaacgatacccaacgccaaaaactaaataaccgcctaataatcatcgactaaatacgtaacaccatcaacgcaccgacaaaaaaattaaaaccatcgcaactaacacaacgtactattaatctaatcaacaacgtcgcgaacgatcgtataacttatcgaatcaccaaaaacgaaaatctacgtaaacaaaattatataaaactacacacaatcgaacgcgattcaaaacgttctccgatattactaacgctaaattacaacccaactaacgataaaaaaacgccaatatacgcgtacctaataaataaaaatatcacttttaactccgacgactacaacatcaaacaaactacgtttataaactcgataaaatcgaacataaacgacgcgacaacgattaccgaaacgctaacatttaccattacgcgcgaactaaacaaacgcgtaaaactattcctctactatacgaataacctaattaacgacaatacgttcaaactaaacgatatcatcacctatcgcaacgata

SEQ ID NO: 5705 - DNA, 516 bp, Artificial Sequence
  chemically treated genomic DNA (Homo sapiens) CpG-island No: 5705
gttggagcgtaggcgttaattttgtttgtttaattattcgtattattaacgatatgtcgattgtcgattcgtaaggtttcgatgcgttaaatttgttttcgttgtaaattaattcgtattttattaacgcgttgtcggaaggttagttggtcggtttgaatatcgatttgggtaacgttttgtgttagtagttgcgcgaattggaaaacgttattgagcgcgcggtattgttaatacgcggtaacgtgttgtagttgttattgttagatattgttttatcggaatttgaaacgtcgtttgtcgtaacggttgtcgttttggagggcgaagatgaatattagttgattgtgcgcgtgttgaaagaaattaacggcgtggttgtcgggtttaaaggcgttgcgtaacgtttggggttgaaacgtacgattttgttgttacggatgaagcggttgggaattgataaatcggtattgatttaattgtaaattgtcggatagatttgtttgttcggtatat

SEQ ID NO: 5706 - DNA, 516 bp, Artificial Sequence
  chemically treated genomic DNA (Homo sapiens) CpG-island No: 5706
atataccgaacaaacaaatctatccgacaatttacaattaaatcaataccgatttatcaattcccaaccgcttcatccgtaacaacaaaatcgtacgtttcaaccccaaacgttacgcaacgcctttaaacccgacaaccacgccgttaatttctttcaacacgcgcacaatcaactaatattcatcttcgccctccaaaacgacaaccgttacgacaaacgacgtttcaaattccgataaaacaatatctaacaataacaactacaacacgttaccgcgtattaacaataccgcgcgctcaataacgttttccaattcgcgcaactactaacacaaaacgttacccaaatcgatattcaaaccgaccaactaaccttccgacaacgcgttaataaaatacgaattaatttacaacgaaaacaaatttaacgcatcgaaaccttacgaatcgacaatcgacatatcgttaataatacgaataattaaacaaacaaaattaacgcctacgctccaac

SEQ ID NO: 5707 - DNA, 516 bp, Artificial Sequence
  chemically treated genomic DNA (Homo sapiens) CpG-island No: 5707
gtatgtcggataggtagatttgttcggtaatttgtagttaaattaatgtcgatttattaatttttagtcgttttattcgtgatagtagggtcgtgcgttttagttttagacgttgcgtagcgtttttaggttcggtaattacgtcgttggttttttttagtacgcgtataattaattgatatttattttcgttttttagggcgataatcgttgcggtaggcggcgttttaggtttcggtaaaataatatttggtaatgatagttgtagtacgttatcgcgtgttagtaatatcgcgcgtttaatgacgttttttagttcgcgtaattgttggtatagggcgttatttaggtcgatatttaggtcgattaattggtttttcggtagcgcgttggtgaagtgcgggttgatttgtagcgggaatagatttagcgtatcgaaattttgcggatcgataatcggtatatcgttggtggtacgaatagttgggtaagtaaggttagcgtttgcgttttagt

SEQ ID NO: 5708 - DNA, 516 bp, Artificial Sequence
  chemically treated genomic DNA (Homo sapiens) CpG-island No: 5708
actaaaacgcaaacgctaaccttacttacccaactattcgtaccaccaacgatataccgattatcgatccgcaaaatttcgatacgctaaatctattcccgctacaaatcaacccgcacttcaccaacgcgctaccgaaaaaccaattaatcgacctaaatatcgacctaaataacgccctataccaacaattacgcgaactaaaaaacgtcattaaacgcgcgatattactaacacgcgataacgtactacaactatcattaccaaatattattttaccgaaacctaaaacgccgcctaccgcaacgattatcgccctaaaaaacgaaaataaatatcaattaattatacgcgtactaaaaaaaaccaacgacgtaattaccgaacctaaaaacgctacgcaacgtctaaaactaaaacgcacgaccctactatcacgaataaaacgactaaaaattaataaatcgacattaatttaactacaaattaccgaacaaatctacctatccgacatac

SEQ ID NO: 5709 - DNA, 503 bp, Artificial Sequence
  chemically treated genomic DNA (Homo sapiens) CpG-island No: 5709
cgtatttatttgtaatatggtagtgtgcgtttttagatcggagtaattatcggtgtcgttcgaattttagtaatcgtgtttaagggtgacgttaagattttgttggcgatagaggttcgtcgtatcgttgcgtacgttacgttttagttagttatttttttcgtcgttacgggttagtcgggtaaaggtgtcgttattttgcggacgcgtcgtagttatatcggatgcgattatggcgtttttgtaggtttttattttttgcgttggatcgttcgtttgcgttttaaatttcgtattattacgtagtattatcgcgttttttatcgacgggtggttgaaattttgtttgcgggattaattttataaacggtcgttgcgttgttgcggtatcgttaaattgcgtttgtgtaagcgtaacgcgtcgttttgtgtttatagtttggaatatgggttttcggtatttaattaatagatttcgttttgtcgagatttgaaaatcgcga

SEQ ID NO: 5710 - DNA, 503 bp, Artificial Sequence
  chemically treated genomic DNA (Homo sapiens) CpG-island No: 5710
tcgcgattttcaaatctcgacaaaacgaaatctattaattaaataccgaaaacccatattccaaactataaacacaaaacgacgcgttacgcttacacaaacgcaatttaacgataccgcaacaacgcaacgaccgtttataaaattaatcccgcaaacaaaatttcaaccacccgtcgataaaaaacgcgataatactacgtaataatacgaaatttaaaacgcaaacgaacgatccaacgcaaaaaataaaaacctacaaaaacgccataatcgcatccgatataactacgacgcgtccgcaaaataacgacacctttacccgactaacccgtaacgacgaaaaaaataactaactaaaacgtaacgtacgcaacgatacgacgaacctctatcgccaacaaaatcttaacgtcacccttaaacacgattactaaaattcgaacgacaccgataattactccgatctaaaaacgcacactaccatattacaaataaatacg

SEQ ID NO: 5711 - DNA, 503 bp, Artificial Sequence
  chemically treated genomic DNA (Homo sapiens) CpG-island No: 5711
tcgcgatttttaaatttcggtaaagcgggatttattgattaagtgtcgagagtttatattttaaattgtgaatataaagcggcgcgttgcgtttgtataggcgtagtttggcgatatcgtagtagcgtagcgatcgtttataaagttgatttcgtaggtaaaattttagttattcgtcgatggaaagcgcgatggtgttgcgtgatggtgcgaagtttgaagcgtaggcgggcgatttaacgtagggggtgaaaatttataaagacgttatggtcgtattcggtgtgattacgacgcgttcgtaggataacgatatttttattcgattgattcgtaacgacgagaaagatgattggttgaaacgtggcgtgcgtagcgatgcggcggatttttatcgttagtaggattttaacgttatttttgagtacgattattggggttcgagcggtatcggtggttatttcgatttgaaagcgtatattattatgttgtaggtggatgcg

SEQ ID NO: 5712 - DNA, 503 bp, Artificial Sequence
  chemically treated genomic DNA (Homo sapiens) CpG-island No: 5712
cgcatccacctacaacataataatatacgctttcaaatcgaaataaccaccgataccgctcgaaccccaataatcgtactcaaaaataacgttaaaatcctactaacgataaaaatccgccgcatcgctacgcacgccacgtttcaaccaatcatctttctcgtcgttacgaatcaatcgaataaaaatatcgttatcctacgaacgcgtcgtaatcacaccgaatacgaccataacgtctttataaattttcaccccctacgttaaatcgcccgcctacgcttcaaacttcgcaccatcacgcaacaccatcgcgctttccatcgacgaataactaaaattttacctacgaaatcaactttataaacgatcgctacgctactacgatatcgccaaactacgcctatacaaacgcaacgcgccgctttatattcacaatttaaaatataaactctcgacacttaatcaataaatcccgctttaccgaaatttaaaaatcgcga

SEQ ID NO: 5713 - DNA, 519 bp, Artificial Sequence
  chemically treated genomic DNA (Homo sapiens) CpG-island No: 5713
gggtttttttgtagaacggcgtgggtaatgtttaataagcgcgtaaggcgtgtggcggtttatttttttttcgcggcgggattagtggttttttttatcgggtgggggcggcgggtgacgggcgtgttttttttttaatgagaggcggggggaggcgggttttgcgtcgttatgtcgcggaggttgttgtttcgggcggagaagcggcgtcggcggttggagtagaggtagtagtcggacgagtagcggaggcggtcgggagcgatggtgaagatggcggcggcgggcggcggaggcggcggtggtcgttattacggcggcggtagtgagggcggtcgggtttttaagcggtttaagattgataacgtcggcgattagtacggaggcggcggcggtggcggtggaggagtcggggcggcgggcggcggcggcggtggggtgaggttagggttttatgcgttgggaaggtcgggaattgggggataattttttagtttgagggtattttaatttttgagg

SEQ ID NO: 5714 - DNA, 519 bp, Artificial Sequence
  chemically treated genomic DNA (Homo sapiens) CpG-island No: 5714
cctcaaaaattaaaataccctcaaactaaaaaattatcccccaattcccgaccttcccaacgcataaaaccctaacctcaccccaccgccgccgccgcccgccgccccgactcctccaccgccaccgccgccgcctccgtactaatcgccgacgttatcaatcttaaaccgcttaaaaacccgaccgccctcactaccgccgccgtaataacgaccaccgccgcctccgccgcccgccgccgccatcttcaccatcgctcccgaccgcctccgctactcgtccgactactacctctactccaaccgccgacgccgcttctccgcccgaaacaacaacctccgcgacataacgacgcaaaacccgcctccccccgcctctcattaaaaaaaaaacacgcccgtcacccgccgcccccacccgataaaaaaaaccactaatcccgccgcgaaaaaaaaataaaccgccacacgccttacgcgcttattaaacattacccacgccgttctacaaaaaaaccc

SEQ ID NO: 5715 - DNA, 519 bp, Artificial Sequence
  chemically treated genomic DNA (Homo sapiens) CpG-island No: 5715
ttttaaaaattaaaatgtttttaagttgggaaattgttttttagttttcggtttttttagcgtatagggttttggttttattttatcgtcgtcgtcgttcgtcgtttcggtttttttatcgttatcgtcgtcgttttcgtgttggtcgtcggcgttgttagttttgagtcgtttaggggttcggtcgtttttattgtcgtcgtcgtagtagcggttatcgtcgttttcgtcgttcgtcgtcgttatttttattatcgttttcgatcgttttcgttgttcgttcggttgttgtttttgttttagtcgtcgacgtcgttttttcgttcggggtagtagttttcgcgatatggcggcgtagaattcgttttttttcgttttttattgggggagggatacgttcgttattcgtcgtttttattcgatagggggagttattggtttcgtcgcggggggagggtaggtcgttatacgttttgcgcgtttattggatattgtttacgtcgttttgtaggagggttt

SEQ ID NO: 5716 - DNA, 519 bp, Artificial Sequence
  chemically treated genomic DNA (Homo sapiens) CpG-island No: 5716
aaaccctcctacaaaacgacgtaaacaatatccaataaacgcgcaaaacgtataacgacctaccctccccccgcgacgaaaccaataactccccctatcgaataaaaacgacgaataacgaacgtatccctcccccaataaaaaacgaaaaaaaacgaattctacgccgccatatcgcgaaaactactaccccgaacgaaaaaacgacgtcgacgactaaaacaaaaacaacaaccgaacgaacaacgaaaacgatcgaaaacgataataaaaataacgacgacgaacgacgaaaacgacgataaccgctactacgacgacgacaataaaaacgaccgaacccctaaacgactcaaaactaacaacgccgacgaccaacacgaaaacgacgacgataacgataaaaaaaccgaaacgacgaacgacgacgacgataaaataaaaccaaaaccctatacgctaaaaaaaccgaaaactaaaaaacaatttcccaacttaaaaacattttaatttttaaaa

SEQ ID NO: 5717 - DNA, 748 bp, Artificial Sequence
  chemically treated genomic DNA (Homo sapiens) CpG-island No: 5717
aagtttattttcgtttttttcgggggttcgggtagttgggtttaggttacgcggggcggcggtttagagtataggtaggggtagttcggcgggcggaggcggaagcggcgcggggttgttagttatttttttttgtttttcgcgtagtcgcgttatattcggggcgcgtaacggaattagggtaggggtcggggtcgaagggggcgaggggtcggggggcgtttttacggtgggcgtttttatgacgggttcgcgggttttagcgcggcgtgtgagttttgaattagcgtttgcgtaggcggcgcggttcggtagttgtttagcgttcgcgcgttcgtttttaggtatcgcgcgtttcgcgtttaggaggtcgcgttcgtcgtcgtcgttgttgttcgcgttcgcgtcgttcgttgtcgtattttatacgtgtatgttttcgtcgtcgtcgtttcgtagcgggtttcgagtagtaggtcgtttgttaggtatcgagacgttttttcggtgcgggtttagttaggcgtcgcgtggcggtcgcgtttttttatacgtttcgtttttcgcggtacgtcggaagtaagcgcgtaggtttcgttttcgatacgtttagttcgcgtaggtttcgtttttaggggagtgcgtttgatgcgaatcgcgtggttggggttggcggtgttcgcgttgggttgcgtttgtatttttttggaagtttatattttatgtcgatattttttttttttttttt

SEQ ID NO: 5718 - DNA, 748 bp, Artificial Sequence
  chemically treated genomic DNA (Homo sapiens) CpG-island No: 5718
aaaaaaaaaaaaaaaaatatcgacataaaatataaacttccaaaaaaatacaaacgcaacccaacgcgaacaccgccaaccccaaccacgcgattcgcatcaaacgcactcccctaaaaacgaaacctacgcgaactaaacgtatcgaaaacgaaacctacgcgcttacttccgacgtaccgcgaaaaacgaaacgtataaaaaaacgcgaccgccacgcgacgcctaactaaacccgcaccgaaaaaacgtctcgatacctaacaaacgacctactactcgaaacccgctacgaaacgacgacgacgaaaacatacacgtataaaatacgacaacgaacgacgcgaacgcgaacaacaacgacgacgacgaacgcgacctcctaaacgcgaaacgcgcgatacctaaaaacgaacgcgcgaacgctaaacaactaccgaaccgcgccgcctacgcaaacgctaattcaaaactcacacgccgcgctaaaacccgcgaacccgtcataaaaacgcccaccgtaaaaacgccccccgacccctcgcccccttcgaccccgacccctaccctaattccgttacgcgccccgaatataacgcgactacgcgaaaaacaaaaaaaaataactaacaaccccgcgccgcttccgcctccgcccgccgaactacccctacctatactctaaaccgccgccccgcgtaacctaaacccaactacccgaacccccgaaaaaaacgaaaataaactt

SEQ ID NO: 5719 - DNA, 748 bp, Artificial Sequence
  chemically treated genomic DNA (Homo sapiens) CpG-island No: 5719
aaaaaaaaagaaagaaatatcggtataaaatgtaagtttttagagggatataaacgtagtttagcgcggatatcgttagttttagttacgcggttcgtattaagcgtatttttttgggggcggggtttgcgcgagttgggcgtgtcgggggcggggtttgcgcgtttgttttcggcgtgtcgcgagaggcggggcgtgtggggaggcgcggtcgttacgcgacgtttggttgggttcgtatcggagaggcgtttcggtatttggtaggcggtttgttattcggagttcgttgcggggcggcggcggcggggatatgtacgtgtgagatgcggtagcgggcggcgcggacgcgaatagtagcggcggcggcgggcgcggttttttgggcgcggggcgcgcggtgtttgagggcgggcgcgcgggcgttgggtaattgtcgggtcgcgtcgtttgcgtaggcgttggtttaggatttatacgtcgcgttgaggttcgcgggttcgttatggaggcgtttatcgtggagacgtttttcgatttttcgtttttttcggtttcggtttttgttttggtttcgttgcgcgtttcggatgtggcgcggttgcgcgaggagtaggaaaaggtaattagtagtttcgcgtcgttttcgttttcgttcgtcgggttgtttttgtttgtgttttgggtcgtcgtttcgcgtggtttaggtttagttgttcgggttttcggagggaacggggataaattt

SEQ ID NO: 5720 - DNA, 748 bp, Artificial Sequence
  chemically treated genomic DNA (Homo sapiens) CpG-island No: 5720
aaatttatccccgttccctccgaaaacccgaacaactaaacctaaaccacgcgaaacgacgacccaaaacacaaacaaaaacaacccgacgaacgaaaacgaaaacgacgcgaaactactaattaccttttcctactcctcgcgcaaccgcgccacatccgaaacgcgcaacgaaaccaaaacaaaaaccgaaaccgaaaaaaacgaaaaatcgaaaaacgtctccacgataaacgcctccataacgaacccgcgaacctcaacgcgacgtataaatcctaaaccaacgcctacgcaaacgacgcgacccgacaattacccaacgcccgcgcgcccgccctcaaacaccgcgcgccccgcgcccaaaaaaccgcgcccgccgccgccgctactattcgcgtccgcgccgcccgctaccgcatctcacacgtacatatccccgccgccgccgccccgcaacgaactccgaataacaaaccgcctaccaaataccgaaacgcctctccgatacgaacccaaccaaacgtcgcgtaacgaccgcgcctccccacacgccccgcctctcgcgacacgccgaaaacaaacgcgcaaaccccgcccccgacacgcccaactcgcgcaaaccccgcccccaaaaaaatacgcttaatacgaaccgcgtaactaaaactaacgatatccgcgctaaactacgtttatatccctctaaaaacttacattttataccgatatttctttcttttttttt

SEQ ID NO: 5721 - DNA, 692 bp, Artificial Sequence
  chemically treated genomic DNA (Homo sapiens) CpG-island No: 5721
  misc_feature (579)..(579): n is either a, c, g or t
  misc_feature (587)..(587): n is either a, c, g or t
  misc_feature (600)..(601): n is either a, c, g or t
  misc_feature (607)..(609): n is either a, c, g or t
  misc_feature (617)..(618): n is either a, c, g or t
  misc_feature (621)..(621): n is either a, c, g or t
  misc_feature (626)..(627): n is either a, c, g or t
  misc_feature (631)..(632): n is either a, c, g or t
  misc_feature (635)..(635): n is either a, c, g or t
  misc_feature (637)..(637): n is either a, c, g or t
  misc_feature (642)..(643): n is either a, c, g or t
  misc_feature (646)..(646): n is either a, c, g or t
  misc_feature (652)..(653): n is either a, c, g or t
  misc_feature (656)..(656): n is either a, c, g or t
  misc_feature (661)..(662): n is either a, c, g or t
  misc_feature (670)..(671): n is either a, c, g or t
  misc_feature (673)..(673): n is either a, c, g or t
  misc_feature (680)..(680): n is either a, c, g or t
  misc_feature (682)..(682): n is either a, c, g or t
tgaatatcggacgcgtatcgtgttggtcgcgtttagtaataagttgttttcgttttcggagattaagggtttttttttaggtaagtgcggataagtttcgacggtcggttgttcggtggaatgtgtttttttcgttttttagcgttacgatgtggatggattttacggatagagggggcgaggggagaagggaagtacggttagcgcgcgggtttttttcggaataggaagtgcgggggatagcgcgcggcgaggatgggtttagtttttgtttttggggcgtacggtacgcgttggagagagataatggaggacggcggcgcgtacgtatatgattttaaatttaagggtagggcggtattcggagaaaagtagcggtttacggtttcgcggggttttcgggcggcggtttattcgtaattcgtttattttcggtcgcgttttttcgcgcgttttttcgcggcggggtcgacgtagagcggggtcggggtcgcgttagttagcgacgagtcggggattagggcgggttagcgggcgggggataagttgtcgttattagggagtgttcgggaatatcgntcgggcgncgggatcgtcgtnnatattnnnttaagtgnngancgtanngttnngantncgtanngtntttttnnttntcgtnntagcgttnntntttttgngnttgtgtacgt

SEQ ID NO: 5722 - DNA, 692 bp, Artificial Sequence
  chemically treated genomic DNA (Homo sapiens) CpG-island No: 5722
  misc_feature (11)..(11): n is either a, c, g or t
  misc_feature (13)..(13): n is either a, c, g or t
  misc_feature (20)..(20): n is either a, c, g or t
  misc_feature (22)..(23): n is either a, c, g or t
  misc_feature (31)..(32): n is either a, c, g or t
  misc_feature (37)..(37): n is either a, c, g or t
  misc_feature (40)..(41): n is either a, c, g or t
  misc_feature (47)..(47): n is either a, c, g or t
  misc_feature (50)..(51): n is either a, c, g or t
  misc_feature (56)..(56): n is either a, c, g or t
  misc_feature (58)..(58): n is either a, c, g or t
  misc_feature (61)..(62): n is either a, c, g or t
  misc_feature (66)..(67): n is either a, c, g or t
  misc_feature (72)..(72): n is either a, c, g or t
  misc_feature (75)..(76): n is either a, c, g or t
  misc_feature (84)..(86): n is either a, c, g or t
  misc_feature (92)..(93): n is either a, c, g or t
  misc_feature (106)..(106): n is either a, c, g or t
  misc_feature (114)..(114): n is either a, c, g or t
acgtacacaancncaaaaanannaacgctannacganaannaaaaanacnntacgnantcnnaacnntacgntcnncacttaannnaatatnnacgacgatcccgncgcccgancgatattcccgaacactccctaataacgacaacttatcccccgcccgctaacccgccctaatccccgactcgtcgctaactaacgcgaccccgaccccgctctacgtcgaccccgccgcgaaaaaacgcgcgaaaaaacgcgaccgaaaataaacgaattacgaataaaccgccgcccgaaaaccccgcgaaaccgtaaaccgctacttttctccgaataccgccctacccttaaatttaaaatcatatacgtacgcgccgccgtcctccattatctctctccaacgcgtaccgtacgccccaaaaacaaaaactaaacccatcctcgccgcgcgctatcccccgcacttcctattccgaaaaaaacccgcgcgctaaccgtacttcccttctcccctcgccccctctatccgtaaaatccatccacatcgtaacgctaaaaaacgaaaaaaacacattccaccgaacaaccgaccgtcgaaacttatccgcacttacctaaaaaaaaacccttaatctccgaaaacgaaaacaacttattactaaacgcgaccaacacgatacgcgtccgatattca

SEQ ID NO: 5723 - DNA, 692 bp, Artificial Sequence
  chemically treated genomic DNA (Homo sapiens) CpG-island No: 5723
  misc_feature (11)..(11): n is either a, c, g or t
  misc_feature (13)..(13): n is either a, c, g or t
  misc_feature (20)..(20): n is either a, c, g or t
  misc_feature (22)..(23): n is either a, c, g or t
  misc_feature (31)..(32): n is either a, c, g or t
  misc_feature (37)..(37): n is either a, c, g or t
  misc_feature (40)..(41): n is either a, c, g or t
  misc_feature (47)..(47): n is either a, c, g or t
  misc_feature (50)..(51): n is either a, c, g or t
  misc_feature (56)..(56): n is either a, c, g or t
  misc_feature (58)..(58): n is either a, c, g or t
  misc_feature (61)..(62): n is either a, c, g or t
  misc_feature (66)..(67): n is either a, c, g or t
  misc_feature (72)..(72): n is either a, c, g or t
  misc_feature (75)..(76): n is either a, c, g or t
  misc_feature (84)..(86): n is either a, c, g or t
  misc_feature (92)..(93): n is either a, c, g or t
  misc_feature (106)..(106): n is either a, c, g or t
  misc_feature (114)..(114): n is either a, c, g or t
gcgtgtatagntntagaggnannggcgttgnngcggnagnnaggggnatnntgcgngnttnnagtnntgcgnttnntatttggnnnggtgtnngcggcggtttcgncgttcggncgatgttttcgggtattttttgatagcggtagtttatttttcgttcgttagttcgttttggttttcggttcgtcgttggttggcgcggtttcggtttcgttttgcgtcggtttcgtcgcggggaggcgcgcgaggggacgcggtcggggatgagcggattgcgggtgaatcgtcgttcgggggtttcgcgaagtcgtgagtcgttgttttttttcgagtgtcgttttgtttttggatttgagattatgtacgtacgcgtcgtcgttttttattgtttttttttagcgcgtgtcgtgcgttttagggataggggttgggtttattttcgtcgcgcgttgtttttcgtattttttgtttcgaggagagttcgcgcgttgatcgtgtttttttttttttttcgttttttttgttcgtgaggtttatttatatcgtggcgttggggaacgagggggatatattttatcggataatcggtcgtcggggtttattcgtatttatttggggagaagtttttggttttcggggacgagagtagtttgttgttgaacgcggttagtacggtgcgcgttcggtgttta

SEQ ID NO: 5724 - DNA, 692 bp, Artificial Sequence
  chemically treated genomic DNA (Homo sapiens) CpG-island No: 5724
  misc_feature (579)..(579): n is either a, c, g or t
  misc_feature (587)..(587): n is either a, c, g or t
  misc_feature (600)..(601): n is either a, c, g or t
  misc_feature (607)..(609): n is either a, c, g or t
  misc_feature (617)..(618): n is either a, c, g or t
  misc_feature (621)..(621): n is either a, c, g or t
  misc_feature (626)..(627): n is either a, c, g or t
  misc_feature (631)..(632): n is either a, c, g or t
  misc_feature (635)..(635): n is either a, c, g or t
  misc_feature (637)..(637): n is either a, c, g or t
  misc_feature (642)..(643): n is either a, c, g or t
  misc_feature (646)..(646): n is either a, c, g or t
  misc_feature (652)..(653): n is either a, c, g or t
  misc_feature (656)..(656): n is either a, c, g or t
  misc_feature (661)..(662): n is either a, c, g or t
  misc_feature (670)..(671): n is either a, c, g or t
  misc_feature (673)..(673): n is either a, c, g or t
  misc_feature (680)..(680): n is either a, c, g or t
  misc_feature (682)..(682): n is either a, c, g or t
taaacaccgaacgcgcaccgtactaaccgcgttcaacaacaaactactctcgtccccgaaaaccaaaaacttctccccaaataaatacgaataaaccccgacgaccgattatccgataaaatatatccccctcgttccccaacgccacgatataaataaacctcacgaacaaaaaaaacgaaaaaaaaaaaaaaacacgatcaacgcgcgaactctcctcgaaacaaaaaatacgaaaaacaacgcgcgacgaaaataaacccaacccctatccctaaaacgcacgacacgcgctaaaaaaaaacaataaaaaacgacgacgcgtacgtacataatctcaaatccaaaaacaaaacgacactcgaaaaaaaacaacgactcacgacttcgcgaaacccccgaacgacgattcacccgcaatccgctcatccccgaccgcgtcccctcgcgcgcctccccgcgacgaaaccgacgcaaaacgaaaccgaaaccgcgccaaccaacgacgaaccgaaaaccaaaacgaactaacgaacgaaaaataaactaccgctatcaaaaaatacccgaaaacatcgnccgaacgncgaaaccgccgcnnacaccnnnccaaatannaancgcannactnnaancncgcannatncccctnnctnccgcnncaacgccnntncctctananctatacacgc

SEQ ID NO: 5725 - DNA, 570 bp, Artificial Sequence
  chemically treated genomic DNA (Homo sapiens) CpG-island No: 5725
tattttacgtttattaaggacggagtgtattgcgtacggagttggtacgtttttacgttggtatgcgtaattttatgatttttatggaggttggtaattatagatatgcgcggaattatagttgttaaattagggcggagtgcgtattcggatatgagtttttatgcgttaaagtatttcgagttgatatatattatatacgaaatttatcgcgcgtaaggatttcgtcgcgttataatagcgtatattcggcgtggtatattttgatattattagcgtatataacgacgattagtaaataagtgtaatatgtttttagagttattagaggtaattattacgggaggaaaagtgaatacgcggaggaacgcgtaagagagtaaatttaaaatcggtgattcgttcgggtagtacgattttagatacgatgtttagaatatttatgggatagtatattatttgatatcgcgttaacgattagttggtagggatatatcgatagtaggatagtgcgtaattaaattaattaataaagatatacgtaatcgggttattataagattatattta

SEQ ID NO: 5726 - DNA, 570 bp, Artificial Sequence
  chemically treated genomic DNA (Homo sapiens) CpG-island No: 5726
taaatataatcttataataacccgattacgtatatctttattaattaatttaattacgcactatcctactatcgatatatccctaccaactaatcgttaacgcgatatcaaataatatactatcccataaatattctaaacatcgtatctaaaatcgtactacccgaacgaatcaccgattttaaatttactctcttacgcgttcctccgcgtattcacttttcctcccgtaataattacctctaataactctaaaaacatattacacttatttactaatcgtcgttatatacgctaataatatcaaaatataccacgccgaatatacgctattataacgcgacgaaatccttacgcgcgataaatttcgtatataatatatatcaactcgaaatactttaacgcataaaaactcatatccgaatacgcactccgccctaatttaacaactataattccgcgcatatctataattaccaacctccataaaaatcataaaattacgcataccaacgtaaaaacgtaccaactccgtacgcaatacactccgtccttaataaacgtaaaata

SEQ ID NO: 5727 - DNA, 570 bp, Artificial Sequence
  chemically treated genomic DNA (Homo sapiens) CpG-island No: 5727
tgggtgtggttttgtggtggttcggttgcgtgtgtttttattggttggtttggttgcgtattgttttgttgtcggtgtgtttttgttagttggtcgttgacgcggtgttaagtggtgtgttgttttatgggtattttgggtatcgtgtttggggtcgtgttgttcgggcgggttatcggttttgggtttatttttttgcgcgttttttcgcgtgtttattttttttttcgtggtggttgtttttggtggttttgggggtatgttgtatttatttattggtcgtcgttgtgtgcgttgatggtattagggtgtattacgtcggatatgcgttattgtggcgcggcggggtttttacgcgcgatgagtttcgtgtgtgatatgtgttagttcggggtattttggcgtatagaggtttatattcgagtgcgtatttcgttttaatttggtagttgtggtttcgcgtatgtttgtggttattaatttttatgggagttatgaaattacgtatgttagcgtgggaacgtattaatttcgtgcgtagtatatttcgtttttaatggacgtaaggta

SEQ ID NO: 5728 - DNA, 570 bp, Artificial Sequence
  chemically treated genomic DNA (Homo sapiens) CpG-island No: 5728
taccttacgtccattaaaaacgaaatatactacgcacgaaattaatacgttcccacgctaacatacgtaatttcataactcccataaaaattaataaccacaaacatacgcgaaaccacaactaccaaattaaaacgaaatacgcactcgaatataaacctctatacgccaaaataccccgaactaacacatatcacacacgaaactcatcgcgcgtaaaaaccccgccgcgccacaataacgcatatccgacgtaatacaccctaataccatcaacgcacacaacgacgaccaataaataaatacaacatacccccaaaaccaccaaaaacaaccaccacgaaaaaaaaaataaacacgcgaaaaaacgcgcaaaaaaataaacccaaaaccgataacccgcccgaacaacacgaccccaaacacgatacccaaaatacccataaaacaacacaccacttaacaccgcgtcaacgaccaactaacaaaaacacaccgacaacaaaacaatacgcaaccaaaccaaccaataaaaacacacgcaaccgaaccaccacaaaaccacaccca

SEQ ID NO: 5729 - DNA, 600 bp, Artificial Sequence
  chemically treated genomic DNA (Homo sapiens) CpG-island No: 5729
  misc_feature (271)..(271): n is either a, c, g or t
gtttcggttttgcgtagttgttggggttggaatttgatttgtaggtagttgtcgagtttggttcggggcgcgaggcgttggcggggttgtcggggcgcggtgtgtaggtgtgtatttgcgatatttttatgttcgatattttcggtttggagttgttaagttagttgtcgaaaggtatggcgacgattatgtttttcgtttacgatagttttgcgttggttgagtaggcgtttaacgcgggggtacgcggttttttttttaaacgttgtangtcggatggaatttattgttgcggtgtatacggttgttacggcgcgtgttattttgagtcggatatttgttattaaaattggtattcggtcgttaggatttcgttaacgtaaacgtgaacgtttagtgtcggaaaaattggcgtaaggaatggcggtgaaagagattgtcgtcgaattgggtttgttatcgaaaacggtatacgtttatcgcgttaatttgatggaaaaattgggcgttagtaacgacgtagagttggcgcgtcgtatgtttgatggttggtgatgaagacgttgttttttcgtttaattatcgttattgtttgttttt

SEQ ID NO: 5730 - DNA, 600 bp, Artificial Sequence
  chemically treated genomic DNA (Homo sapiens) CpG-island No: 5730
  misc_feature (330)..(330): n is either a, c, g or t
aaaaacaaacaataacgataattaaacgaaaaaacaacgtcttcatcaccaaccatcaaacatacgacgcgccaactctacgtcgttactaacgcccaatttttccatcaaattaacgcgataaacgtataccgttttcgataacaaacccaattcgacgacaatctctttcaccgccattccttacgccaatttttccgacactaaacgttcacgtttacgttaacgaaatcctaacgaccgaataccaattttaataacaaatatccgactcaaaataacacgcgccgtaacaaccgtatacaccgcaacaataaattccatccgacntacaacgtttaaaaaaaaaaccgcgtacccccgcgttaaacgcctactcaaccaacgcaaaactatcgtaaacgaaaaacataatcgtcgccatacctttcgacaactaacttaacaactccaaaccgaaaatatcgaacataaaaatatcgcaaatacacacctacacaccgcgccccgacaaccccgccaacgcctcgcgccccgaaccaaactcgacaactacctacaaatcaaattccaaccccaacaactacgcaaaaccgaaac

SEQ ID NO: 5731 - DNA, 600 bp, Artificial Sequence
  chemically treated genomic DNA (Homo sapiens) CpG-island No: 5731
  misc_feature (330)..(330): n is either a, c, g or t
aaaagtaggtaataacggtaattaagcgggagaataacgtttttattattagttattaaatatgcggcgcgttagttttacgtcgttattgacgtttagtttttttattagattggcgcgatggacgtgtatcgttttcggtgataagtttagttcggcggtaattttttttatcgttattttttgcgttagttttttcggtattgggcgtttacgtttgcgttagcggggttttgacgatcggatgttagttttaatggtaaatattcggtttaagataatacgcgtcgtggtaatcgtatgtatcgtagtaatgagttttattcggtntatagcgtttggaaagaaagtcgcgtgttttcgcgttaagcgtttgtttaattagcgtaggattgtcgtgaacggagagtataatcgtcgttatatttttcggtagttggtttagtagttttagatcggagatatcgggtatggagatatcgtaaatatatatttgtatatcgcgtttcggtagtttcgttagcgtttcgcgtttcgaattaaattcggtaattatttgtaaattaggttttagttttagtagttgcgtaaagtcggagt

SEQ ID NO: 5732 - DNA, 600 bp, Artificial Sequence
  chemically treated genomic DNA (Homo sapiens) CpG-island No: 5732
  misc_feature (271)..(271): n is either a, c, g or t
actccgactttacgcaactactaaaactaaaacctaatttacaaataattaccgaatttaattcgaaacgcgaaacgctaacgaaactaccgaaacgcgatatacaaatatatatttacgatatctccatacccgatatctccgatctaaaactactaaaccaactaccgaaaaatataacgacgattatactctccgttcacgacaatcctacgctaattaaacaaacgcttaacgcgaaaacacgcgactttctttccaaacgctatanaccgaataaaactcattactacgatacatacgattaccacgacgcgtattatcttaaaccgaatatttaccattaaaactaacatccgatcgtcaaaaccccgctaacgcaaacgtaaacgcccaataccgaaaaaactaacgcaaaaaataacgataaaaaaaattaccgccgaactaaacttatcaccgaaaacgatacacgtccatcgcgccaatctaataaaaaaactaaacgtcaataacgacgtaaaactaacgcgccgcatatttaataactaataataaaaacgttattctcccgcttaattaccgttattacctactttt

SEQ ID NO: 5733 - DNA, 894 bp, Artificial Sequence
  chemically treated genomic DNA (Homo sapiens) CpG-island No: 5733
tgtgcgcgcgttgtgcgcgagtgtgcgagcgcgtgtgagcgggtgtgtggtgcggtcgggcgtttttatttttttgattcgttttatttcggcgggcgttcgagtagaggtagcggttcgggtcggggcgggcgagggagggacgcgagtcggggtaagcgggttgcgttatcgtcggcgtcgcgtcgattttgttttttaaatcggtttttaagtcgattatagttgagtttttacgtgacgttttattttttgtttttcggagcgcgttgttcgaggatagttttttttcggttgtcgttttagttcgtcgcgggggttcggttttcgtaattttgggcgaagcggcggtcggttcgggcgttttcgcggggtcgcgttttacgcgggcgttgggggtttggggggtttcgggggttcggtcgggagggtggtggttagggcggagagcgtgtttcggttttagttcgcgtttttgttatcgcgcgtcgcggtttttcgaaagcgggcggggtgttttgcgcgcggcgtggggaaagggggcgtttttcgtcggtcgggatttgagcggtcgcgttttcgagggagttagttgggttatggtcgcgaggtaggggtgagatcggcggttattcgtgagtttttcgtattcgtattatgtagaagagcgtgcgttataacgaggggtacgttttgtatttggtttttttggcgcgtaaggagggtattaagcgcggttttttgagtaagaagacggtcgaggcggagttcgttggtttatcgaggataggtttgcgttgttcggttttttttgtttagttttagaattgttgttcgttttatttttgagggcgagtagagttgtcgttcggcgggtatgtattttttggaggg

SEQ ID NO: 5734 - DNA, 894 bp, Artificial Sequence
  chemically treated genomic DNA (Homo sapiens) CpG-island No: 5734
ccctccaaaaaatacatacccgccgaacgacaactctactcgccctcaaaaataaaacgaacaacaattctaaaactaaacaaaaaaaaccgaacaacgcaaacctatcctcgataaaccaacgaactccgcctcgaccgtcttcttactcaaaaaaccgcgcttaataccctccttacgcgccaaaaaaaccaaatacaaaacgtacccctcgttataacgcacgctcttctacataatacgaatacgaaaaactcacgaataaccgccgatctcacccctacctcgcgaccataacccaactaactccctcgaaaacgcgaccgctcaaatcccgaccgacgaaaaacgccccctttccccacgccgcgcgcaaaacaccccgcccgctttcgaaaaaccgcgacgcgcgataacaaaaacgcgaactaaaaccgaaacacgctctccgccctaaccaccaccctcccgaccgaacccccgaaaccccccaaacccccaacgcccgcgtaaaacgcgaccccgcgaaaacgcccgaaccgaccgccgcttcgcccaaaattacgaaaaccgaacccccgcgacgaactaaaacgacaaccgaaaaaaaactatcctcgaacaacgcgctccgaaaaacaaaaaataaaacgtcacgtaaaaactcaactataatcgacttaaaaaccgatttaaaaaacaaaatcgacgcgacgccgacgataacgcaacccgcttaccccgactcgcgtccctccctcgcccgccccgacccgaaccgctacctctactcgaacgcccgccgaaataaaacgaatcaaaaaaataaaaacgcccgaccgcaccacacacccgctcacacgcgctcgcacactcgcgcacaacgcgcgcaca

SEQ ID NO: 5735 - DNA, 894 bp, Artificial Sequence
  chemically treated genomic DNA (Homo sapiens) CpG-island No: 5735
ttttttaggaggtatatgttcgtcgggcggtagttttgttcgtttttagaagtagaacgagtagtaattttagggttaagtaaggggggtcgaataacgtaaatttattttcgatgggttagcgagtttcgtttcggtcgtttttttatttaggaagtcgcgtttggtgttttttttgcgcgttagaaaggttaggtatagggcgtgtttttcgttgtagcgtacgtttttttgtatggtgcgggtgcggagggtttacgggtggtcgtcggttttatttttgtttcgcggttatggtttagttggttttttcgagggcgcgatcgtttaggtttcggtcggcgaagggcgttttttttttttacgtcgcgcgtagggtatttcgttcgttttcgggaggtcgcggcgcgcggtggtaggggcgcgggttggggtcgaggtacgtttttcgttttaattattattttttcggtcgagttttcggagttttttaagtttttaacgttcgcgtggagcgcggtttcgcgagggcgttcgagtcggtcgtcgtttcgtttaaagttgcgggagtcgagttttcgcggcgggttggggcggtagtcggggaaggattgttttcgggtaacgcgtttcgggagatagaaggtaaaacgttacgtgggagtttagttgtaatcggtttggagatcgatttaaagggtaaagtcggcgcggcgtcggcggtggcgtagttcgtttgtttcggttcgcgtttttttttcgttcgtttcggttcgggtcgttgtttttgttcgggcgttcgtcgggatggggcggattagggaggtggaggcgttcggtcgtattatatattcgtttatacgcgttcgtatattcgcgtataacgcgcgtata

SEQ ID NO: 5736 - DNA, 894 bp, Artificial Sequence
  chemically treated genomic DNA (Homo sapiens) CpG-island No: 5736
tatacgcgcgttatacgcgaatatacgaacgcgtataaacgaatatataatacgaccgaacgcctccacctccctaatccgccccatcccgacgaacgcccgaacaaaaacaacgacccgaaccgaaacgaacgaaaaaaaaacgcgaaccgaaacaaacgaactacgccaccgccgacgccgcgccgactttaccctttaaatcgatctccaaaccgattacaactaaactcccacgtaacgttttaccttctatctcccgaaacgcgttacccgaaaacaatccttccccgactaccgccccaacccgccgcgaaaactcgactcccgcaactttaaacgaaacgacgaccgactcgaacgccctcgcgaaaccgcgctccacgcgaacgttaaaaacttaaaaaactccgaaaactcgaccgaaaaaataataattaaaacgaaaaacgtacctcgaccccaacccgcgcccctaccaccgcgcgccgcgacctcccgaaaacgaacgaaataccctacgcgcgacgtaaaaaaaaaaaacgcccttcgccgaccgaaacctaaacgatcgcgccctcgaaaaaaccaactaaaccataaccgcgaaacaaaaataaaaccgacgaccacccgtaaaccctccgcacccgcaccatacaaaaaaacgtacgctacaacgaaaaacacgccctatacctaacctttctaacgcgcaaaaaaaacaccaaacgcgacttcctaaataaaaaaacgaccgaaacgaaactcgctaacccatcgaaaataaatttacgttattcgaccccccttacttaaccctaaaattactactcgttctacttctaaaaacgaacaaaactaccgcccgacgaacatatacctcctaaaaaa

SEQ ID NO: 5737 - DNA, 786 bp, Artificial Sequence
  chemically treated genomic DNA (Homo sapiens) CpG-island No: 5737
ttgtttgtaggttcgcgaattgaacgaataattggaagagaatttcggttataaattgttcgtcgaatttgtttcggttcgttttatttcgtggatgggcggcgatcgcgacggtaattcgaacgttattgtcgatattattcgttacgttttgttatttagtcgttggaaagttatcgatttgtttttgaaagatatttaggtgttggtttttgaattgtcgatggttgaagcgatttttgaattgttggcgttggttggcgaagaaggtgtcgtagaatcgtatcgttatttgatgaaaaatttgcgttttcgtttgatggcgatataggtatggttggaagcgcgtttgaaaggcgaagaattgttaaaattagaaggtttgttgatataaaacgaagaattgtgggaatcgttttacgtttgttattagttattttaggcgtgtggtatgggtattatcgttaacggcgatttgttcgatattttgcgtcgcgtgaaatgtttcggcgtatcgttggttcgtattgatattcgttaggagagtacgcgttatatcgaagcgttgagggtgtattcgttgtttgtaggttatcgaggaagggatttgttaggtatcgatggatttttacgttacgtcgttttgttttgttagcgtttgtgttagttgttcggcgttaattagtttttgtattagtattgaatcgtttaggcgtagattttcgacgcgattacgtagtgttgtatcgagttgttttttagtgatgatttgattttttagtagaa

SEQ ID NO: 5738 - DNA, 786 bp, Artificial Sequence
  chemically treated genomic DNA (Homo sapiens) CpG-island No: 5738
ttctactaaaaaatcaaatcatcactaaaaaacaactcgatacaacactacgtaatcgcgtcgaaaatctacgcctaaacgattcaatactaatacaaaaactaattaacgccgaacaactaacacaaacgctaacaaaacaaaacgacgtaacgtaaaaatccatcgatacctaacaaatcccttcctcgataacctacaaacaacgaatacaccctcaacgcttcgatataacgcgtactctcctaacgaatatcaatacgaaccaacgatacgccgaaacatttcacgcgacgcaaaatatcgaacaaatcgccgttaacgataatacccataccacacgcctaaaataactaataacaaacgtaaaacgattcccacaattcttcgttttatatcaacaaaccttctaattttaacaattcttcgcctttcaaacgcgcttccaaccatacctatatcgccatcaaacgaaaacgcaaatttttcatcaaataacgatacgattctacgacaccttcttcgccaaccaacgccaacaattcaaaaatcgcttcaaccatcgacaattcaaaaaccaacacctaaatatctttcaaaaacaaatcgataactttccaacgactaaataacaaaacgtaacgaataatatcgacaataacgttcgaattaccgtcgcgatcgccgcccatccacgaaataaaacgaaccgaaacaaattcgacgaacaatttataaccgaaattctcttccaattattcgttcaattcgcgaacctacaaacaa

SEQ ID NO: 5739 - DNA, 786 bp, Artificial Sequence
  chemically treated genomic DNA (Homo sapiens) CpG-island No: 5739
ttttgttggaaaattaggttattattgaagaataattcgatatagtattgcgtaatcgcgtcgaaggtttacgtttgggcggtttaatgttgatgtaggggttgattagcgtcgagtagttggtataggcgttggtagagtaaaacggcgtggcgtgggaatttatcgatgtttggtagatttttttttcgatgatttgtagatagcgagtgtatttttagcgtttcggtatgacgcgtgtttttttgacggatattaatacggattagcggtacgtcgaaatattttacgcggcgtagggtgtcgagtagatcgtcgttggcgataatatttatgttatacgtttgaagtgattggtagtaagcgtagagcggtttttatagtttttcgttttgtgttagtaggttttttggttttggtagtttttcgttttttaggcgcgtttttagttatgtttgtgtcgttattaggcgagaacgtaggttttttattagatagcgatacggttttgcggtatttttttcgttaattagcgttagtagtttaggggtcgttttaattatcgatagtttagaaattagtatttgaatattttttaggaataaatcggtggttttttagcggttgagtagtaggacgtggcgggtgatatcggtagtgacgttcgggttgtcgtcgcggtcgtcgtttatttacgaagtaaaacggatcggaataaattcgacgggtagtttgtagtcgaggtttttttttagttgttcgtttagttcgcggatttgtaggtag

SEQ ID NO: 5740 - DNA, 786 bp, Artificial Sequence
  chemically treated genomic DNA (Homo sapiens) CpG-island No: 5740
ctacctacaaatccgcgaactaaacgaacaactaaaaaaaaacctcgactacaaactacccgtcgaatttattccgatccgttttacttcgtaaataaacgacgaccgcgacgacaacccgaacgtcactaccgatatcacccgccacgtcctactactcaaccgctaaaaaaccaccgatttattcctaaaaaatattcaaatactaatttctaaactatcgataattaaaacgacccctaaactactaacgctaattaacgaaaaaaataccgcaaaaccgtatcgctatctaataaaaaacctacgttctcgcctaataacgacacaaacataactaaaaacgcgcctaaaaaacgaaaaactaccaaaaccaaaaaacctactaacacaaaacgaaaaactataaaaaccgctctacgcttactaccaatcacttcaaacgtataacataaatattatcgccaacgacgatctactcgacaccctacgccgcgtaaaatatttcgacgtaccgctaatccgtattaatatccgtcaaaaaaacacgcgtcataccgaaacgctaaaaatacactcgctatctacaaatcatcgaaaaaaaaatctaccaaacatcgataaattcccacgccacgccgttttactctaccaacgcctataccaactactcgacgctaatcaacccctacatcaacattaaaccgcccaaacgtaaaccttcgacgcgattacgcaatactatatcgaattattcttcaataataacctaattttccaacaaaa

SEQ ID NO: 5741 - DNA, 721 bp, Artificial Sequence
  chemically treated genomic DNA (Homo sapiens) CpG-island No: 5741
attagtattttgcgtttcgataagttgtacgtttttggtaagggcgaataggtgttggtttattcgggtattacgttttattcgttggaaaaagtttttaaatcgttgggacgcgaatcgtatttagtgattggattatcgtgtataggcgttttgtcggttggtgcgtcgatatttagcgtcggtttaatattttgtatcggaatcggttcgtatttgtgtacgatgttgttaatattattttttttttttttttggacgttgtatttttagcggtaggcgttggtgtaggtgttttggttcgggttacgtttgttgatatagttagagagtaggtagcgatcggagtaggttatgtatagcgcgtcgtgaacgaagatttcgatttttatattcggtatttgattgcggatttttttaattttttttagcgatagttcgcgagagaggattacgcgggttaggtttatttgttgttagaattttatcgtcgtttagtttacggcgttagtttgtatcgaaaggtggatcggtattttagggaagtgtttacgtattagtataattagttttggatcggatataattagcgtattcggttttatttttattatcggttttaggttacggataaaggtttttagtttggcgttgtgcggtgtaatgttgattattatataaaattttttttttagcgcgtgggttttattgatgtcgagtt

SEQ ID NO: 5742 - DNA, 721 bp, Artificial Sequence
  chemically treated genomic DNA (Homo sapiens) CpG-island No: 5742
aactcgacatcaataaaacccacgcgctaaaaaaaaaattttatataataatcaacattacaccgcacaacgccaaactaaaaacctttatccgtaacctaaaaccgataataaaaataaaaccgaatacgctaattatatccgatccaaaactaattatactaatacgtaaacacttccctaaaataccgatccacctttcgatacaaactaacgccgtaaactaaacgacgataaaattctaacaacaaataaacctaacccgcgtaatcctctctcgcgaactatcgctaaaaaaaattaaaaaaatccgcaatcaaataccgaatataaaaatcgaaatcttcgttcacgacgcgctatacataacctactccgatcgctacctactctctaactatatcaacaaacgtaacccgaaccaaaacacctacaccaacgcctaccgctaaaaatacaacgtccaaaaaaaaaaaaaaaataatattaacaacatcgtacacaaatacgaaccgattccgatacaaaatattaaaccgacgctaaatatcgacgcaccaaccgacaaaacgcctatacacgataatccaatcactaaatacgattcgcgtcccaacgatttaaaaactttttccaacgaataaaacgtaatacccgaataaaccaacacctattcgcccttaccaaaaacgtacaacttatcgaaacgcaaaatactaat

SEQ ID NO: 5743 - DNA, 721 bp, Artificial Sequence
  chemically treated genomic DNA (Homo sapiens) CpG-island No: 5743
agttcggtattaatgaagtttacgcgttggggaaaaagttttatgtggtggttaatattgtatcgtataacgttaagttgaaaatttttattcgtgatttgaaatcggtggtggaaatggggtcggatgcgttgattatgttcgatttagggttgattatgttggtgcgtgagtatttttttgaaatgtcgatttatttttcggtgtaggttaacgtcgtgaattgggcgacggtgaaattttggtagtaaatgggtttgattcgcgtgattttttttcgcgagttgtcgttggaagagattgaagagattcgtaattaggtgtcggatatggagatcgagattttcgtttacggcgcgttgtgtatggtttatttcggtcgttgtttgttttttggttatattaataagcgtgattcgaattagggtatttgtattaacgtttgtcgttgggagtataacgtttaggaagggaaagaagatgatgttggtaatatcgtatataagtacgagtcgatttcggtgtaaaatgttgagtcgacgttgggtatcggcgtattaatcgataaagcgtttatatacgatgatttaattattgagtgcggttcgcgttttagcggtttgagggttttttttagcgaatagagcgtggtgttcggataggttagtatttgttcgtttttgttaagaacgtgtagtttgtcgagacgtagggtgttgat

SEQ ID NO: 5744 - DNA, 721 bp, Artificial Sequence
  chemically treated genomic DNA (Homo sapiens) CpG-island No: 5744
atcaacaccctacgtctcgacaaactacacgttcttaacaaaaacgaacaaatactaacctatccgaacaccacgctctattcgctaaaaaaaaccctcaaaccgctaaaacgcgaaccgcactcaataattaaatcatcgtatataaacgctttatcgattaatacgccgatacccaacgtcgactcaacattttacaccgaaatcgactcgtacttatatacgatattaccaacatcatcttctttcccttcctaaacgttatactcccaacgacaaacgttaatacaaataccctaattcgaatcacgcttattaatataaccaaaaaacaaacaacgaccgaaataaaccatacacaacgcgccgtaaacgaaaatctcgatctccatatccgacacctaattacgaatctcttcaatctcttccaacgacaactcgcgaaaaaaaatcacgcgaatcaaacccatttactaccaaaatttcaccgtcgcccaattcacgacgttaacctacaccgaaaaataaatcgacatttcaaaaaaatactcacgcaccaacataatcaaccctaaatcgaacataatcaacgcatccgaccccatttccaccaccgatttcaaatcacgaataaaaattttcaacttaacgttatacgatacaatattaaccaccacataaaactttttccccaacgcgtaaacttcattaataccgaact

SEQ ID NO: 5745 - DNA, 908 bp, Artificial Sequence
  chemically treated genomic DNA (Homo sapiens) CpG-island No: 5745
tatttttgttgggcgcgaggaaatagtaaatcgcggaagggggtagagggggaaggaaagggagcgcgaggtagtatgcggcgtaggagagaggatttggagtcgatggatagggaattcgaattatattgagcgggcgggggagagggttttttgggttttgcgattggtaggttgagtcgggttgacgtgcggttataattaatggggaggaagggagggatacggcgggggattatggcgtcgtggattggcgggtatagggcggggcgggacggtagtgcgggattgagattgatcgatcgcgggggttgtcgcgtagagatattcgggtcgtcggtgggtggtcgttagggttgggttagttttttggaggtttacgttcgtcgagtttacgttggttggggtcggggtgtcggcgcgttcgggattcgttttagtagtcgtttacggtttttgtgttttttttttcgtttttttttttgtttgtcgttttcggtcgttacgatgtttttgcgtttcgttgttgtcgtcgcggattggttgcgtcggttgcgcgttgtttgttgcggcggtggtggcgttttatttgttatacgggtttgaagaaggaagaagaggaagcgaagcgcgtttttcggtttatgtcgtagttacgggtttagattcgttacggcgttcgcgtcgtcgttttcgtcggagtttacgagatttgtatggacgggtatgggtttgagagtagtattttttagcgtcgtcgttgtcgtcgtcgaggttgagtagcgtcgtagtttcgggttttgtttttcgtcgttggagttgttgttgttgttgttgtttagtttcgggttgttttacgtaggtaggacgggagcgcgcgaggggagttagtttcggggtttagggtt

SEQ ID NO: 5746 - DNA, 908 bp, Artificial Sequence
  chemically treated genomic DNA (Homo sapiens) CpG-island No: 5746
aaccctaaaccccgaaactaactcccctcgcgcgctcccgtcctacctacgtaaaacaacccgaaactaaacaacaacaacaacaacaactccaacgacgaaaaacaaaacccgaaactacgacgctactcaacctcgacgacgacaacgacgacgctaaaaaatactactctcaaacccatacccgtccatacaaatctcgtaaactccgacgaaaacgacgacgcgaacgccgtaacgaatctaaacccgtaactacgacataaaccgaaaaacgcgcttcgcttcctcttcttccttcttcaaacccgtataacaaataaaacgccaccaccgccgcaacaaacaacgcgcaaccgacgcaaccaatccgcgacgacaacaacgaaacgcaaaaacatcgtaacgaccgaaaacgacaaacaaaaaaaaaaacgaaaaaaaaaacacaaaaaccgtaaacgactactaaaacgaatcccgaacgcgccgacaccccgaccccaaccaacgtaaactcgacgaacgtaaacctccaaaaaactaacccaaccctaacgaccacccaccgacgacccgaatatctctacgcgacaacccccgcgatcgatcaatctcaatcccgcactaccgtcccgccccgccctatacccgccaatccacgacgccataatcccccgccgtatccctcccttcctccccattaattataaccgcacgtcaacccgactcaacctaccaatcgcaaaacccaaaaaaccctctcccccgcccgctcaatataattcgaattccctatccatcgactccaaatcctctctcctacgccgcatactacctcgcgctccctttccttccccctctacccccttccgcgatttactatttcctcgcgcccaacaaaaata

SEQ ID NO: 5747 - DNA, 908 bp, Artificial Sequence
  chemically treated genomic DNA (Homo sapiens) CpG-island No: 5747
agttttaggtttcggggttggtttttttcgcgcgttttcgttttatttgcgtggagtagttcgaggttgaatagtagtagtagtagtagttttagcggcggggggtagagttcggggttgcggcgttgtttaatttcggcggcggtagcggcggcgttggaaggtgttgtttttaagtttatgttcgtttatgtaggtttcgtgggtttcggcgagggcggcggcgcgggcgtcgtggcgggtttgggttcgtggttgcggtatgggtcggggggcgcgtttcgttttttttttttttttttttaggttcgtgtagtagatggggcgttattatcgtcgtagtaagtagcgcgtagtcggcgtagttagttcgcggcggtagtagcggggcgtaggggtatcgtggcggtcggaggcggtaggtagggaaaggggcggaagagaagatataaagatcgtgagcgattgttgagacgagtttcgagcgcgtcggtatttcggttttagttagcgtgggttcggcgggcgtggatttttaagaggttggtttagttttagcgattatttatcggcggttcggatatttttgcgcggtagttttcgcggtcgattaattttagtttcgtattgtcgtttcgtttcgttttgtgttcgttaatttacgacgttataatttttcgtcgtgtttttttttttttttttattggttgtgatcgtacgttagttcgatttagtttgttaatcgtaggatttagagggttttttttttcgttcgtttagtgtaattcgagttttttgtttatcgattttaagtttttttttttgcgtcgtatgttgtttcgcgttttttttttttttttttttattttttttcgcgatttattgttttttcgcgtttaatagaaatg

SEQ ID NO: 5748 - DNA, 908 bp, Artificial Sequence
  chemically treated genomic DNA (Homo sapiens) CpG-island No: 5748
catttctattaaacgcgaaaaaacaataaatcgcgaaaaaaaataaaaaaaaaaaaaaaaaaaacgcgaaacaacatacgacgcaaaaaaaaaaacttaaaatcgataaacaaaaaactcgaattacactaaacgaacgaaaaaaaaaaccctctaaatcctacgattaacaaactaaatcgaactaacgtacgatcacaaccaataaaaaaaaaaaaaaaaacacgacgaaaaattataacgtcgtaaattaacgaacacaaaacgaaacgaaacgacaatacgaaactaaaattaatcgaccgcgaaaactaccgcgcaaaaatatccgaaccgccgataaataatcgctaaaactaaaccaacctcttaaaaatccacgcccgccgaacccacgctaactaaaaccgaaataccgacgcgctcgaaactcgtctcaacaatcgctcacgatctttatatcttctcttccgcccctttccctacctaccgcctccgaccgccacgatacccctacgccccgctactaccgccgcgaactaactacgccgactacgcgctacttactacgacgataataacgccccatctactacacgaacctaaaaaaaaaaaaaaaaaaaacgaaacgcgccccccgacccataccgcaaccacgaacccaaacccgccacgacgcccgcgccgccgccctcgccgaaacccacgaaacctacataaacgaacataaacttaaaaacaacaccttccaacgccgccgctaccgccgccgaaattaaacaacgccgcaaccccgaactctaccccccgccgctaaaactactactactactactattcaacctcgaactactccacgcaaataaaacgaaaacgcgcgaaaaaaaccaaccccgaaacctaaaact

SEQ ID NO: 5749 - DNA, 618 bp, Artificial Sequence
  chemically treated genomic DNA (Homo sapiens) CpG-island No: 5749
tgggaaacggtagtgatagtttcggagcgttcggcgtgtttagcgattttgcggggtttttaggacggtcgtggattttacgttcgttcgtttttttttgtcggtattcgcggttttttttcgttcgtttagggttgttcgtttgtaggtcggtatcggcgtgtaggttttttgttcgtttttgcgtggggacgcggtcgttcggggagaggcgttatagttattgtcgggtttttggtacgtagttttttgttttttcggtcggacgattcgttcgtacgtaggtacgcgcgttttcggtgtttgttatcgcgcggtcgttagcgtagtttagatttattcgcgttgcgttgggggcgggtagcgggcggtaggttttttttagggaaatcgggtttttgggcgcgcggagtgttttattttttttttcgggatcgggttttttttttcgttttttttttttgggtgttttttgtcgcggtcgcggtttttttttttggatttcgatatttgtacggggttttaggtagcgggacggttttaggtttttattgtcgtttgcgttttcgtcgtttgtaattttagtgttcgagcgcggcgtttttttataagcgggta

SEQ ID NO: 5750 - DNA, 618 bp, Artificial Sequence
  chemically treated genomic DNA (Homo sapiens) CpG-island No: 5750
tacccgcttataaaaaaacgccgcgctcgaacactaaaattacaaacgacgaaaacgcaaacgacaataaaaacctaaaaccgtcccgctacctaaaaccccgtacaaatatcgaaatccaaaaaaaaaaaccgcgaccgcgacaaaaaacacccaaaaaaaaaaaacgaaaaaaaaaacccgatcccgaaaaaaaaaataaaacactccgcgcgcccaaaaacccgatttccctaaaaaaaacctaccgcccgctacccgcccccaacgcaacgcgaataaatctaaactacgctaacgaccgcgcgataacaaacaccgaaaacgcgcgtacctacgtacgaacgaatcgtccgaccgaaaaaacaaaaaactacgtaccaaaaacccgacaataactataacgcctctccccgaacgaccgcgtccccacgcaaaaacgaacaaaaaacctacacgccgataccgacctacaaacgaacaaccctaaacgaacgaaaaaaaaccgcgaataccgacaaaaaaaaacgaacgaacgtaaaatccacgaccgtcctaaaaaccccgcaaaatcgctaaacacgccgaacgctccgaaactatcactaccgtttccca

SEQ ID NO: 5751 - DNA, 618 bp, Artificial Sequence
  chemically treated genomic DNA (Homo sapiens) CpG-island No: 5751
tgttcgtttatagaaaggcgtcgcgttcgggtattgaggttgtaggcggcgggggcgtaggcggtagtggagatttgaggtcgtttcgttgtttgggatttcgtgtagatgtcggagtttaggaggaggggtcgcggtcgcggtaagaagtatttagagggaggaagcgggagagggagttcgatttcggggagaaaggtagggtatttcgcgcgtttagaaattcggtttttttgggagaaatttgtcgttcgttattcgtttttagcgtagcgcgggtgagtttaggttgcgttagcggtcgcgcggtgataggtatcgagggcgcgcgtgtttgcgtgcgagcgggtcgttcggtcgggagagtaaggggttgcgtgttaggagttcgatagtggttgtggcgttttttttcgggcggtcgcgtttttacgtaggggcgggtaagaggtttgtacgtcggtatcggtttgtaggcgagtagttttgagcgagcggggaggagtcgcggatatcgataagaaagggcgggcgggcgtggagtttacgatcgttttgggggtttcgtagagtcgttgggtacgtcgagcgtttcgggattgttattgtcgtttttta

SEQ ID NO: 5752 - DNA, 618 bp, Artificial Sequence
  chemically treated genomic DNA (Homo sapiens) CpG-island No: 5752
taaaaaacgacaataacaatcccgaaacgctcgacgtacccaacgactctacgaaacccccaaaacgatcgtaaactccacgcccgcccgccctttcttatcgatatccgcgactcctccccgctcgctcaaaactactcgcctacaaaccgataccgacgtacaaacctcttacccgcccctacgtaaaaacgcgaccgcccgaaaaaaaacgccacaaccactatcgaactcctaacacgcaaccccttactctcccgaccgaacgacccgctcgcacgcaaacacgcgcgccctcgatacctatcaccgcgcgaccgctaacgcaacctaaactcacccgcgctacgctaaaaacgaataacgaacgacaaatttctcccaaaaaaaccgaatttctaaacgcgcgaaataccctacctttctccccgaaatcgaactccctctcccgcttcctccctctaaatacttcttaccgcgaccgcgacccctcctcctaaactccgacatctacacgaaatcccaaacaacgaaacgacctcaaatctccactaccgcctacgcccccgccgcctacaacctcaatacccgaacgcgacgcctttctataaacgaaca

SEQ ID NO: 5753 - DNA, 555 bp, Artificial Sequence
  chemically treated genomic DNA (Homo sapiens) CpG-island No: 5753
ttattcgtaggggcgtttttggaagtttgattagggtcgtcgttagggagcgttaggttttacgtttatttgttaggacggtggtgcggtttagcggtgcggttttgcggtgcggtttagcggtgaggttttgtggtgaggttttgtggtgaggtttagcggtacggttttgtcgtgcggtttagcggtgcggtttagcggtgcggtttagcggtgcggttttgtggtgaggtttagcggtgaggtttagcggtgcggttttgtggtgaggtttagcggtgaggtttagcggtgcggttttgtggtgaggtttagcggtgcggtttagcggtgaggtttagcggtgcggttttgtggtgaggtttagcggtgaggtttagcggtgcggttttgtggtgaggtttagcggtgaggtttagcggtgcggtttagcggtgcggtttagcggtgcggtttagcggtgaggtttagtggtgtggtgggttttgttaagtgatcgcgtgggatattattggcgtttcgttaggtattaattttttatgattatcggggttg

SEQ ID NO: 5754 - DNA, 555 bp, Artificial Sequence
  chemically treated genomic DNA (Homo sapiens) CpG-island No: 5754
caaccccgataatcataaaaaattaatacctaacgaaacgccaataatatcccacgcgatcacttaacaaaacccaccacaccactaaacctcaccgctaaaccgcaccgctaaaccgcaccgctaaaccgcaccgctaaacctcaccgctaaacctcaccacaaaaccgcaccgctaaacctcaccgctaaacctcaccacaaaaccgcaccgctaaacctcaccgctaaaccgcaccgctaaacctcaccacaaaaccgcaccgctaaacctcaccgctaaacctcaccacaaaaccgcaccgctaaacctcaccgctaaacctcaccacaaaaccgcaccgctaaaccgcaccgctaaaccgcaccgctaaaccgcacgacaaaaccgtaccgctaaacctcaccacaaaacctcaccacaaaacctcaccgctaaaccgcaccgcaaaaccgcaccgctaaaccgcaccaccgtcctaacaaataaacgtaaaacctaacgctccctaacgacgaccctaatcaaacttccaaaaacgcccctacgaataa

SEQ ID NO: 5755 - DNA, 555 bp, Artificial Sequence
  chemically treated genomic DNA (Homo sapiens) CpG-island No: 5755
tagtttcggtggttataagaaattggtgtttggcgagacgttagtgatgttttacgcgattatttggtagaatttattatattattggattttatcgttgggtcgtatcgttggatcgtatcgttggatcgtatcgttggattttatcgttggattttattataggatcgtatcgttggattttatcgttggattttattataggatcgtatcgttggattttatcgttggatcgtatcgttggattttattataggatcgtatcgttggattttatcgttggattttattataggatcgtatcgttggattttatcgttggattttattataggatcgtatcgttggatcgtatcgttggatcgtatcgttggatcgtacggtaggatcgtatcgttggattttattataggattttattataggattttatcgttgggtcgtatcgtaggatcgtatcgttggatcgtattatcgttttggtaggtgagcgtggagtttggcgttttttggcgacgattttggttagatttttaggagcgtttttgcgggtaa

SEQ ID NO: 5756 - DNA, 555 bp, Artificial Sequence
  chemically treated genomic DNA (Homo sapiens) CpG-island No: 5756
ttacccgcaaaaacgctcctaaaaatctaaccaaaatcgtcgccaaaaaacgccaaactccacgctcacctaccaaaacgataatacgatccaacgatacgatcctacgatacgacccaacgataaaatcctataataaaatcctataataaaatccaacgatacgatcctaccgtacgatccaacgatacgatccaacgatacgatccaacgatacgatcctataataaaatccaacgataaaatccaacgatacgatcctataataaaatccaacgataaaatccaacgatacgatcctataataaaatccaacgatacgatccaacgataaaatccaacgatacgatcctataataaaatccaacgataaaatccaacgatacgatcctataataaaatccaacgataaaatccaacgatacgatccaacgatacgatccaacgatacgacccaacgataaaatccaataatataataaattctaccaaataatcgcgtaaaacatcactaacgtctcgccaaacaccaatttcttataaccaccgaaacta

SEQ ID NO: 5757 - DNA, 506 bp, Artificial Sequence
  chemically treated genomic DNA (Homo sapiens) CpG-island No: 5757
gaatcgcggcggttatcgttgtttattttgttattcggttagaaaagtttgcggagcgcggggatggattaatcggtttttttgtttcgtttttttagcgtttagaagtttgtagtttcggagtagtggtcgcgttacgtcggttttagcgcgtagaattttgtaggtttcgttcgttcgtttcgggtcgcgttcgttatgttttattcgtagtttggatatttttatttttcggttttttaggtaagcggagtttcgtttcgtttaggttatcgtaggtgtcggtagggcggatggggcggggacggggggtggggagtgttcgatttacgattgtttgcggttttcgagttagtaaggtttgggtcgcgcgttttttacgtttaatttttgttttttaaattttcggggaaaggtcgaggcgttaagaaaattcgacgggtcgggttcgggttttttgatgtttgaattataaggtttaggttgtgttttaggggagttttagg

SEQ ID NO: 5758 - DNA, 506 bp, Artificial Sequence
  chemically treated genomic DNA (Homo sapiens) CpG-island No: 5758
cctaaaactcccctaaaacacaacctaaaccttataattcaaacatcaaaaaacccgaacccgacccgtcgaattttcttaacgcctcgacctttccccgaaaatttaaaaaacaaaaattaaacgtaaaaaacgcgcgacccaaaccttactaactcgaaaaccgcaaacaatcgtaaatcgaacactccccaccccccgtccccgccccatccgccctaccgacacctacgataacctaaacgaaacgaaactccgcttacctaaaaaaccgaaaaataaaaatatccaaactacgaataaaacataacgaacgcgacccgaaacgaacgaacgaaacctacaaaattctacgcgctaaaaccgacgtaacgcgaccactactccgaaactacaaacttctaaacgctaaaaaaacgaaacaaaaaaaccgattaatccatccccgcgctccgcaaacttttctaaccgaataacaaaataaacaacgataaccgccgcgattc

SEQ ID NO: 5759 - DNA, 506 bp, Artificial Sequence
  chemically treated genomic DNA (Homo sapiens) CpG-island No: 5759
tttaggatttttttggggtatagtttgagttttgtggtttaaatattagggaattcgggttcggttcgtcggatttttttagcgtttcggttttttttcgggggtttggggagtaggggttgggcgtgaggggcgcgcgatttaggttttgttagttcggaagtcgtaggtagtcgtaggtcggatattttttatttttcgttttcgttttattcgttttatcggtatttgcggtggtttgggcggggcggggtttcgtttatttggggagtcgaggagtaggggtatttaaattgcgggtaggatatggcgggcgcggttcggggcggacgggcggggtttgtagggttttgcgcgttggggtcggcgtggcgcggttattgtttcggagttgtaggtttttaggcgttgggagggcgaagtaggagagtcggttagtttattttcgcgtttcgtaaatttttttaatcgggtaataaagtgagtagcggtggtcgtcgcgattt

SEQ ID NO: 5760 - DNA, 506 bp, Artificial Sequence
  chemically treated genomic DNA (Homo sapiens) CpG-island No: 5760
aaatcgcgacgaccaccgctactcactttattacccgattaaaaaaatttacgaaacgcgaaaataaactaaccgactctcctacttcgccctcccaacgcctaaaaacctacaactccgaaacaataaccgcgccacgccgaccccaacgcgcaaaaccctacaaaccccgcccgtccgccccgaaccgcgcccgccatatcctacccgcaatttaaatacccctactcctcgactccccaaataaacgaaaccccgccccgcccaaaccaccgcaaataccgataaaacgaataaaacgaaaacgaaaaataaaaaatatccgacctacgactacctacgacttccgaactaacaaaacctaaatcgcgcgcccctcacgcccaacccctactccccaaacccccgaaaaaaaaccgaaacgctaaaaaaatccgacgaaccgaacccgaattccctaatatttaaaccacaaaactcaaactataccccaaaaaaatcctaaa

SEQ ID NO: 5761 - DNA, 603 bp, Artificial Sequence
  chemically treated genomic DNA (Homo sapiens) CpG-island No: 5761
tgtattcgtagcgcgtgagtgtaattggagattttggatttaagatgtttttatgaggaacgattttagttcgcggtaatttcggttagtttgtagcgtggacgataaaataggtattacgtggtttcggcgtcggggcggggttaaaggggtcggaagtgatcgcgcggtgcgtcggttcgttaggaaatacgtttttaaattatggcgatttaagtaaaacgtttacgggtgattggcgggcgcggggtgtagttttttttttcgtgttttatttttttttcgtttatagaatcgttcgtttgcgtttttttcgttttttttcgcgggtttcgcgttttttttcggtcgttcgtttttttatttaaagtttagtatgcgttcgcgtcgcggttttttgtagtttttaacgggttttttgggggtcggatttggttattgcgcgtatttattttaagtggcggggttcgtggacggaggcgatttggattttgtggtttgatttttgagttggtgtcggcgggtggggttagaattgatttttaaggtgagcgaacgagtcggggggcggaggatttttagcggagcgcgggttggtttgat

SEQ ID NO: 5762 - DNA, 603 bp, Artificial Sequence
  chemically treated genomic DNA (Homo sapiens) CpG-island No: 5762
atcaaaccaacccgcgctccgctaaaaatcctccgccccccgactcgttcgctcaccttaaaaatcaattctaaccccacccgccgacaccaactcaaaaatcaaaccacaaaatccaaatcgcctccgtccacgaaccccgccacttaaaataaatacgcgcaataaccaaatccgacccccaaaaaacccgttaaaaactacaaaaaaccgcgacgcgaacgcatactaaactttaaataaaaaaacgaacgaccgaaaaaaaacgcgaaacccgcgaaaaaaaacgaaaaaaacgcaaacgaacgattctataaacgaaaaaaaaataaaacacgaaaaaaaaaactacaccccgcgcccgccaatcacccgtaaacgttttacttaaatcgccataatttaaaaacgtatttcctaacgaaccgacgcaccgcgcgatcacttccgacccctttaaccccgccccgacgccgaaaccacgtaatacctattttatcgtccacgctacaaactaaccgaaattaccgcgaactaaaatcgttcctcataaaaacatcttaaatccaaaatctccaattacactcacgcgctacgaataca

SEQ ID NO: 5763 - DNA, 603 bp, Artificial Sequence
  chemically treated genomic DNA (Homo sapiens) CpG-island No: 5763
gttaggttagttcgcgtttcgttaggggtttttcgtttttcggttcgttcgtttattttgggaattagttttagttttattcgtcggtattagtttaggaattaggttataggatttaggtcgttttcgtttacgggtttcgttatttgagataagtgcgcgtagtgattaggttcgatttttagagagttcgttgggaattgtaggagatcgcggcgcgagcgtatattgggttttgggtggaggagcggacgatcggagaggggcgcgggattcgcgggagggagcggagggggcgtagacggacggttttgtgaacgaagaaggggtgaggtacggaggaaaaggttgtatttcgcgttcgttagttattcgtggacgttttgtttgggtcgttatggtttaagagcgtgttttttagcgggtcggcgtatcgcgcggttattttcggtttttttggtttcgtttcggcgtcggaattacgtggtgtttgttttgtcgtttacgttgtagattggtcggagttatcgcgggttggaatcgttttttatgaaaatattttgagtttaggatttttaattgtatttacgcgttgcgagtgta

SEQ ID NO: 5764 - DNA, 603 bp, Artificial Sequence
  chemically treated genomic DNA (Homo sapiens) CpG-island No: 5764
tacactcgcaacgcgtaaatacaattaaaaatcctaaactcaaaatattttcataaaaaacgattccaacccgcgataactccgaccaatctacaacgtaaacgacaaaacaaacaccacgtaattccgacgccgaaacgaaaccaaaaaaaccgaaaataaccgcgcgatacgccgacccgctaaaaaacacgctcttaaaccataacgacccaaacaaaacgtccacgaataactaacgaacgcgaaatacaaccttttcctccgtacctcaccccttcttcgttcacaaaaccgtccgtctacgccccctccgctccctcccgcgaatcccgcgcccctctccgatcgtccgctcctccacccaaaacccaatatacgctcgcgccgcgatctcctacaattcccaacgaactctctaaaaatcgaacctaatcactacgcgcacttatctcaaataacgaaacccgtaaacgaaaacgacctaaatcctataacctaattcctaaactaataccgacgaataaaactaaaactaattcccaaaataaacgaacgaaccgaaaaacgaaaaacccctaacgaaacgcgaactaacctaac

SEQ ID NO: 5765 - DNA, 731 bp, Artificial Sequence
  chemically treated genomic DNA (Homo sapiens) CpG-island No: 5765
  misc_feature (146)..(146): n is either a, c, g or t
  misc_feature (185)..(186): n is either a, c, g or t
  misc_feature (193)..(195): n is either a, c, g or t
  misc_feature (209)..(209): n is either a, c, g or t
  misc_feature (241)..(242): n is either a, c, g or t
  misc_feature (271)..(272): n is either a, c, g or t
gtcgtcgttaaattgattagtgcgtgttgttgatttgtgatgcgatttacgcgttgttaatttaggtgttcgtaacgatattcgcgtaattgtagtcggtaacggttgtacggatgattgtagtttgagtatttgtcggcgaatancggattagttacgtgttggtgagtgttggtgattttcgnngtttggnnngcggtcgttttttnggaaggttttcggtcgcggttgtttttttttnngtaaaattttcgatatttagcgcgttatnnattgtgatttaggcgcgttcgattgtagggttgtaacgtttgtttatttgttgttgttgtggggggtagatcgtaacggcgttaattcgatgcgtcggaagaggtgtatcgtgttgttaatgaacgtttgatgtagatgattcgtaggtattgttttcgttagacgcgatggggttaaagttatttgaacggtaacggggatcgtttagtcgatttcgtagtaatcggcgataggaaattagttattgcgtttgttgcgtcgatatagtttgttgttaatcgtttttttaaagggttacgtcgtcgtaaagtggtgtttaatcgtttgcgcgtgcgcgggagggtaatagtggcgagttatcgtagttagggacgttgggtaatttgttttttttttttattgcgttgttgttgtaaattatgttttggtcggatatttgattgtttttcggttaaatt

SEQ ID NO: 5766 - DNA, 731 bp, Artificial Sequence
  chemically treated genomic DNA (Homo sapiens) CpG-island No: 5766
  misc_feature (460)..(461): n is either a, c, g or t
  misc_feature (490)..(491): n is either a, c, g or t
  misc_feature (523)..(523): n is either a, c, g or t
  misc_feature (537)..(539): n is either a, c, g or t
  misc_feature (546)..(547): n is either a, c, g or t
  misc_feature (586)..(586): n is either a, c, g or t
aatttaaccgaaaaacaatcaaatatccgaccaaaacataatttacaacaacaacgcaataaaaaaaaaaaacaaattacccaacgtccctaactacgataactcgccactattaccctcccgcgcacgcgcaaacgattaaacaccactttacgacgacgtaaccctttaaaaaaacgattaacaacaaactatatcgacgcaacaaacgcaataactaatttcctatcgccgattactacgaaatcgactaaacgatccccgttaccgttcaaataactttaaccccatcgcgtctaacgaaaacaatacctacgaatcatctacatcaaacgttcattaacaacacgatacacctcttccgacgcatcgaattaacgccgttacgatctaccccccacaacaacaacaaataaacaaacgttacaaccctacaatcgaacgcgcctaaatcacaatnnataacgcgctaaatatcgaaaattttacnnaaaaaaaaacaaccgcgaccgaaaaccttccnaaaaaacgaccgcnnnccaaacnncgaaaatcaccaacactcaccaacacgtaactaatccgntattcgccgacaaatactcaaactacaatcatccgtacaaccgttaccgactacaattacgcgaatatcgttacgaacacctaaattaacaacgcgtaaatcgcatcacaaatcaacaacacgcactaatcaatttaacgacgac

SEQ ID NO: 5767 - DNA, 731 bp, Artificial Sequence
  chemically treated genomic DNA (Homo sapiens) CpG-island No: 5767
  misc_feature (460)..(461): n is either a, c, g or t
  misc_feature (490)..(491): n is either a, c, g or t
  misc_feature (523)..(523): n is either a, c, g or t
  misc_feature (537)..(539): n is either a, c, g or t
  misc_feature (546)..(547): n is either a, c, g or t
  misc_feature (586)..(586): n is either a, c, g or t
agtttggtcggaaaataattaggtattcggttagggtatgatttgtagtaatagcgtaatgaggaaagagagtagattatttagcgtttttggttacgatagttcgttattattgttttttcgcgtacgcgtaggcggttgagtattattttgcggcggcgtagttttttgggagagcgattagtagtaggttgtgtcggcgtagtaggcgtagtagttgattttttgtcgtcggttgttgcggagtcggttgagcgattttcgttgtcgtttaggtaattttggttttatcgcgtttggcgaaggtaatatttgcggattatttgtattagacgtttattagtaatacgatgtatttttttcggcgtatcgggttagcgtcgttacgatttgttttttatagtagtagtagataagtaaacgttgtagttttgtagtcggacgcgtttgaattatagtnnataacgcgttgggtatcggaagttttatnnggaaggagataatcgcgatcggaagttttttngggaaacgatcgtnnnttagatnncggaagttattagtatttattaatacgtaattagttcgntattcgtcggtagatgtttaagttgtaattattcgtataatcgttatcggttgtaattacgcggatatcgttgcgagtatttggattggtagcgcgtgggtcgtattataaattagtagtacgtattggttagtttagcgacggt

SEQ ID NO: 5768 - DNA, 731 bp, Artificial Sequence
  chemically treated genomic DNA (Homo sapiens) CpG-island No: 5768
  misc_feature (146)..(146): n is either a, c, g or t
  misc_feature (185)..(186): n is either a, c, g or t
  misc_feature (193)..(195): n is either a, c, g or t
  misc_feature (209)..(209): n is either a, c, g or t
  misc_feature (241)..(242): n is either a, c, g or t
  misc_feature (271)..(272): n is either a, c, g or t
accgtcgctaaactaaccaatacgtactactaatttataatacgacccacgcgctaccaatccaaatactcgcaacgatatccgcgtaattacaaccgataacgattatacgaataattacaacttaaacatctaccgacgaatancgaactaattacgtattaataaatactaataacttccgnnatctaannnacgatcgtttcccnaaaaaacttccgatcgcgattatctccttccnnataaaacttccgatacccaacgcgttatnnactataattcaaacgcgtccgactacaaaactacaacgtttacttatctactactactataaaaaacaaatcgtaacgacgctaacccgatacgccgaaaaaaatacatcgtattactaataaacgtctaatacaaataatccgcaaatattaccttcgccaaacgcgataaaaccaaaattacctaaacgacaacgaaaatcgctcaaccgactccgcaacaaccgacgacaaaaaatcaactactacgcctactacgccgacacaacctactactaatcgctctcccaaaaaactacgccgccgcaaaataatactcaaccgcctacgcgtacgcgaaaaaacaataataacgaactatcgtaaccaaaaacgctaaataatctactctctttcctcattacgctattactacaaatcataccctaaccgaatacctaattattttccgaccaaact

SEQ ID NO: 5769 - DNA, 725 bp, Artificial Sequence
  chemically treated genomic DNA (Homo sapiens) CpG-island No: 5769
cggtgcgttcgggtcgttttgataggttattatacgtttcgttgcgtttcgattagaacgtcgtaattagtatcgtagaaacggtacgggttttattttatttgatggttttttgttgattaataacggcgcgggtaagttcggtacgttgagatcggtagtcgtcgtagcggtcgtaacggcgttatttttataaagttacgacgattgagttttatggtgtttttttattttgtttttttgttggtgataaattagcggatacgttagtacgttttttaagttcgtattgatttaatggtttggatttagcgtgtcgttgttttttgtttttttattataattaattgtacggttcgggcgtttttgtaaggaaatttatattcggaaacgggttatttgggtgcgaacgggttcgtattagtcgatgattattaggcggttattttgtttttggtttgggtatttgtttagattcggttatattattttacgcgtgtttttcgggttttgtaattttgttagaatgtttagtagcgattcgtattttagttttatcgtttaattgaatatgtttgatgtttagatcgttaattttgcgcgtttacgttggattagttttagatcgtttgtttcgtttaaatgtagggtaattcgttattattaatgttgtaagttgttttttttttttagcgcgcgtcggaggttgggtagagagggtaatt

SEQ ID NO: 5770 - DNA, 725 bp, Artificial Sequence
  chemically treated genomic DNA (Homo sapiens) CpG-island No: 5770
aattaccctctctacccaacctccgacgcgcgctaaaaaaaaaaaacaacttacaacattaataataacgaattaccctacatttaaacgaaacaaacgatctaaaactaatccaacgtaaacgcgcaaaattaacgatctaaacatcaaacatattcaattaaacgataaaactaaaatacgaatcgctactaaacattctaacaaaattacaaaacccgaaaaacacgcgtaaaataatataaccgaatctaaacaaatacccaaaccaaaaacaaaataaccgcctaataatcatcgactaatacgaacccgttcgcacccaaataacccgtttccgaatataaatttccttacaaaaacgcccgaaccgtacaattaattataataaaaaaacaaaaaacaacgacacgctaaatccaaaccattaaatcaatacgaacttaaaaaacgtactaacgtatccgctaatttatcaccaacaaaaaaacaaaataaaaaaacaccataaaactcaatcgtcgtaactttataaaaataacgccgttacgaccgctacgacgactaccgatctcaacgtaccgaacttacccgcgccgttattaatcaacaaaaaaccatcaaataaaataaaacccgtaccgtttctacgatactaattacgacgttctaatcgaaacgcaacgaaacgtataataacctatcaaaacgacccgaacgcaccg

SEQ ID NO: 5771 - DNA, 725 bp, Artificial Sequence
  chemically treated genomic DNA (Homo sapiens) CpG-island No: 5771
gattattttttttatttaattttcgacgcgcgttggggagaaaaagtaatttatagtattaataatgacggattattttgtatttgaacggggtagacgatttggggttgatttagcgtgggcgcgtaagattgacggtttgggtattaagtatgtttagttaagcggtaaggttgggatgcggatcgttgttgggtattttggtaaggttataaagttcgaaaggtacgcgtaaagtggtgtggtcggatttggatagatgtttaggttaggaataggataatcgtttgatgattatcgattaatgcgagttcgttcgtatttaggtgattcgttttcgggtgtgaatttttttatagggacgttcggatcgtataattaattgtggtggggaagtagaagatagcgatacgttggatttaaattattgagttagtacgaatttagagggcgtgttggcgtgttcgttggtttattattagtaggaaggtaaggtgaggaaatattatgaaatttagtcgtcgtagttttatgaaagtaacgtcgttgcggtcgttgcggcggttgtcggttttagcgtgtcgggtttgttcgcgtcgttgttggttagtaggaagttattaaatgggataaagttcgtgtcgtttttgcggtattggttgcggcgttttggtcggaacgtagcgggacgtgtggtggtttgttagggcgattcggacgtatcg

SEQ ID NO: 5772 - DNA, 725 bp, Artificial Sequence
  chemically treated genomic DNA (Homo sapiens) CpG-island No: 5772
cgatacgtccgaatcgccctaacaaaccaccacacgtcccgctacgttccgaccaaaacgccgcaaccaataccgcaaaaacgacacgaactttatcccatttaataacttcctactaaccaacaacgacgcgaacaaacccgacacgctaaaaccgacaaccgccgcaacgaccgcaacgacgttactttcataaaactacgacgactaaatttcataatatttcctcaccttaccttcctactaataataaaccaacgaacacgccaacacgccctctaaattcgtactaactcaataatttaaatccaacgtatcgctatcttctacttccccaccacaattaattatacgatccgaacgtccctataaaaaaattcacacccgaaaacgaatcacctaaatacgaacgaactcgcattaatcgataatcatcaaacgattatcctattcctaacctaaacatctatccaaatccgaccacaccactttacgcgtacctttcgaactttataaccttaccaaaatacccaacaacgatccgcatcccaaccttaccgcttaactaaacatacttaatacccaaaccgtcaatcttacgcgcccacgctaaatcaaccccaaatcgtctaccccgttcaaatacaaaataatccgtcattattaatactataaattactttttctccccaacgcgcgtcgaaaattaaataaaaaaaataatc

SEQ ID NO: 5773 - DNA, 733 bp, Artificial Sequence
  chemically treated genomic DNA (Homo sapiens) CpG-island No: 5773
  misc_feature (29)..(29): n is either a, c, g or t
  misc_feature (51)..(51): n is either a, c, g or t
  misc_feature (85)..(85): n is either a, c, g or t
  misc_feature (140)..(140): n is either a, c, g or t
  misc_feature (152)..(152): n is either a, c, g or t
  misc_feature (161)..(161): n is either a, c, g or t
  misc_feature (164)..(164): n is either a, c, g or t
  misc_feature (166)..(166): n is either a, c, g or t
  misc_feature (170)..(170): n is either a, c, g or t
  misc_feature (191)..(191): n is either a, c, g or t
  misc_feature (193)..(193): n is either a, c, g or t
  misc_feature (195)..(195): n is either a, c, g or t
tagacgtcggcggtggtcgtaggtcgggnttgacgttaatttggagtattnttattcgcgtttttcgtttgttatttgtttggtntttgtttgacgtcgtcgggattagtttgcgtggatggcgtagtacgtggtaggtntaatttagagtnttttagcgnttnanaatngcgcgcggcgaagttagtcgngntntaggttttagttaggtatattcgagggggggattattcgcgacgtgtatttatcgagatttttttggttgaacgtttacgatagtgtttttaattcgagaatttaggtgttttaaagcggaaagtttcggcgggataattcgggggttttcgtcggtttttgttttttggcgtcgtttgtgttgcgttaattatggagggtgtttcggtttttttttttttgtgaatggagtcggtgttttttaatcgttatttcgtcgtcggttttttattggtttgtacgcgttggcgggtttatattttcggattagggcgacgtgtttatacgtttattttttcgggcggggttgtttttttttttcggaaggggttttttttcggtgcggtttcgttttcgttttttttgagcgttcgtttcgtcgtaaacggggagtttttggttgttcgtttgttttttttttttttcgcgatatcgttgagaacgaggttttatatataagtaaaggatttagattgagagtattttttttagaaaatta

SEQ ID NO: 5774 - DNA, 733 bp, Artificial Sequence
  chemically treated genomic DNA (Homo sapiens) CpG-island No: 5774
  misc_feature (539)..(539): n is either a, c, g or t
  misc_feature (541)..(541): n is either a, c, g or t
  misc_feature (543)..(543): n is either a, c, g or t
  misc_feature (564)..(564): n is either a, c, g or t
  misc_feature (568)..(568): n is either a, c, g or t
  misc_feature (570)..(570): n is either a, c, g or t
  misc_feature (573)..(573): n is either a, c, g or t
  misc_feature (582)..(582): n is either a, c, g or t
  misc_feature (594)..(594): n is either a, c, g or t
  misc_feature (649)..(649): n is either a, c, g or t
  misc_feature (683)..(683): n is either a, c, g or t
  misc_feature (705)..(705): n is either a, c, g or t
taattttctaaaaaaaatactctcaatctaaatcctttacttatatataaaacctcgttctcaacgatatcgcgaaaaaaaaaaaaaacaaacgaacaaccaaaaactccccgtttacgacgaaacgaacgctcaaaaaaaacgaaaacgaaaccgcaccgaaaaaaaaccccttccgaaaaaaaaaaacaaccccgcccgaaaaaataaacgtataaacacgtcgccctaatccgaaaatataaacccgccaacgcgtacaaaccaataaaaaaccgacgacgaaataacgattaaaaaacaccgactccattcacaaaaaaaaaaaaaccgaaacaccctccataattaacgcaacacaaacgacgccaaaaaacaaaaaccgacgaaaacccccgaattatcccgccgaaactttccgctttaaaacacctaaattctcgaattaaaaacactatcgtaaacgttcaaccaaaaaaatctcgataaatacacgtcgcgaataatccccccctcgaatatacctaactaaaacctanancncgactaacttcgccgcgcgcnattntnaancgctaaaanactctaaattanacctaccacgtactacgccatccacgcaaactaatcccgacgacgtcaaacaaanaccaaacaaataacaaacgaaaaacgcgaataanaatactccaaattaacgtcaancccgacctacgaccaccgccgacgtcta

SEQ ID NO: 5775 - DNA, 733 bp, Artificial Sequence
  chemically treated genomic DNA (Homo sapiens) CpG-island No: 5775
  misc_feature (539)..(539): n is either a, c, g or t
  misc_feature (541)..(541): n is either a, c, g or t
  misc_feature (543)..(543): n is either a, c, g or t
  misc_feature (564)..(564): n is either a, c, g or t
  misc_feature (568)..(568): n is either a, c, g or t
  misc_feature (570)..(570): n is either a, c, g or t
  misc_feature (573)..(573): n is either a, c, g or t
  misc_feature (582)..(582): n is either a, c, g or t
  misc_feature (594)..(594): n is either a, c, g or t
  misc_feature (649)..(649): n is either a, c, g or t
  misc_feature (683)..(683): n is either a, c, g or t
  misc_feature (705)..(705): n is either a, c, g or t
tagttttttgaagggaatgtttttaatttaggttttttgtttgtatatagaatttcgtttttagcggtgtcgcggagagggggaaaagtaggcgggtagttagggatttttcgtttacggcgggacgggcgtttaaaaaagacggggacggggtcgtatcgggggggaatttttttcgaaggggggagataatttcgttcggggggataagcgtgtaagtacgtcgttttggttcgggggtgtgggttcgttaacgcgtgtaaattagtgggaggtcggcggcgaaatggcggttggaaggtatcggttttatttataaggggggggggatcgaggtattttttataattggcgtagtataagcggcgttagagggtaaaagtcggcgagggttttcgggttgtttcgtcggggtttttcgttttggagtatttggattttcggattgggggtattgtcgtgagcgtttaattaaagaggtttcgatgggtatacgtcgcggataatttttttttcgaatgtatttggttaggatttanantncggttagtttcgtcgcgcgtngttntngancgttggaangttttagattanatttgttacgtgttgcgttatttacgtaagttgatttcgacgacgttaggtagangttaggtagatggtagacggaaagcgcgaatgangatgttttaagttaacgttaanttcgatttacggttatcgtcgacgtttg

SEQ ID NO: 5776 - DNA, 733 bp, Artificial Sequence
  chemically treated genomic DNA (Homo sapiens) CpG-island No: 5776
  misc_feature (29)..(29): n is either a, c, g or t
  misc_feature (51)..(51): n is either a, c, g or t
  misc_feature (85)..(85): n is either a, c, g or t
  misc_feature (140)..(140): n is either a, c, g or t
  misc_feature (152)..(152): n is either a, c, g or t
  misc_feature (161)..(161): n is either a, c, g or t
  misc_feature (164)..(164): n is either a, c, g or t
  misc_feature (166)..(166): n is either a, c, g or t
  misc_feature (170)..(170): n is either a, c, g or t
  misc_feature (191)..(191): n is either a, c, g or t
  misc_feature (193)..(193): n is either a, c, g or t
  misc_feature (195)..(195): n is either a, c, g or t
caaacgtcgacgataaccgtaaatcgaanttaacgttaacttaaaacatcntcattcgcgctttccgtctaccatctacctaacntctacctaacgtcgtcgaaatcaacttacgtaaataacgcaacacgtaacaaatntaatctaaaacnttccaacgntcnanaacnacgcgcgacgaaactaaccgnantntaaatcctaaccaaatacattcgaaaaaaaaattatccgcgacgtatacccatcgaaacctctttaattaaacgctcacgacaatacccccaatccgaaaatccaaatactccaaaacgaaaaaccccgacgaaacaacccgaaaaccctcgccgacttttaccctctaacgccgcttatactacgccaattataaaaaatacctcgatccccccccccttataaataaaaccgataccttccaaccgccatttcgccgccgacctcccactaatttacacgcgttaacgaacccacacccccgaaccaaaacgacgtacttacacgcttatccccccgaacgaaattatctccccccttcgaaaaaaattcccccccgatacgaccccgtccccgtcttttttaaacgcccgtcccgccgtaaacgaaaaatccctaactacccgcctacttttccccctctccgcgacaccgctaaaaacgaaattctatatacaaacaaaaaacctaaattaaaaacattcccttcaaaaaacta

SEQ ID NO: 5777 - DNA, 504 bp, Artificial Sequence
  chemically treated genomic DNA (Homo sapiens) CpG-island No: 5777
ttttaggtcgcgtgggagagtgaggatgcgttatttattttcgcgcgcggagataaaagataggcgacgtttatatttgagaggcgtcgcgttatttatgggggttttttttttttgtttttcgggttaaatttagtttcgtttaaatggggggaaatggggtcgaaattttttttcgcgggagcggttggcgcgtgtttagaatgggcgcggggattcggaagtaggcgttttaaaaaatttttttaatattcgtatagtaaatagggtatatttgtgtagtttttgttcgttaagtttaattatttcgcgattgcgtcgttgtaatagtatttatcgtattgtattaaatcgttcgtttgttttaataggcgtattaatttaacgtagttattgatttatcggagtcggattcgttaataattgttaggttttatcgcgttgtagattaaaagagagattgcggatcgtagttatttttgttggttttgtataaaggtaata

SEQ ID NO: 5778 - DNA, 504 bp, Artificial Sequence
  chemically treated genomic DNA (Homo sapiens) CpG-island No: 5778
tattacctttatacaaaaccaacaaaaataactacgatccgcaatctctcttttaatctacaacgcgataaaacctaacaattattaacgaatccgactccgataaatcaataactacgttaaattaatacgcctattaaaacaaacgaacgatttaatacaatacgataaatactattacaacgacgcaatcgcgaaataattaaacttaacgaacaaaaactacacaaatataccctatttactatacgaatattaaaaaaattttttaaaacgcctacttccgaatccccgcgcccattctaaacacgcgccaaccgctcccgcgaaaaaaaatttcgaccccatttccccccatttaaacgaaactaaatttaacccgaaaaacaaaaaaaaaaaacccccataaataacgcgacgcctctcaaatataaacgtcgcctatcttttatctccgcgcgcgaaaataaataacgcatcctcactctcccacgcgacctaaaa

SEQ ID NO: 5779 - DNA, 504 bp, Artificial Sequence
  chemically treated genomic DNA (Homo sapiens) CpG-island No: 5779
tattgtttttatgtaggattagtagaaatagttgcggttcgtaattttttttttagtttgtaacgcggtgagatttggtaattgttggcgaattcggtttcggtaagttagtgattgcgttggattgatgcgtttgttggaataggcgggcggtttagtatagtgcgataaatgttgttgtagcggcgtagtcgcgaagtgattgaatttagcgagtagaagttgtataaatgtgttttgtttgttgtgcggatattgggaagattttttggggcgtttattttcgggttttcgcgtttattttgaatacgcgttaatcgttttcgcggggaagggtttcggttttatttttttttatttaagcggggttaagtttaattcggggggtagaaggagagggtttttataggtggcgcggcgttttttagatatgggcgtcgtttgttttttattttcgcgcgcgaggatgagtggcgtatttttatttttttacgcgatttgggg

SEQ ID NO: 5780 - DNA, 504 bp, Artificial Sequence
  chemically treated genomic DNA (Homo sapiens) CpG-island No: 5780
ccccaaatcgcgtaaaaaaataaaaatacgccactcatcctcgcgcgcgaaaataaaaaacaaacgacgcccatatctaaaaaacgccgcgccacctataaaaaccctctccttctaccccccgaattaaacttaaccccgcttaaataaaaaaaaataaaaccgaaacccttccccgcgaaaacgattaacgcgtattcaaaataaacgcgaaaacccgaaaataaacgccccaaaaaatcttcccaatatccgcacaacaaacaaaacacatttatacaacttctactcgctaaattcaatcacttcgcgactacgccgctacaacaacatttatcgcactatactaaaccgcccgcctattccaacaaacgcatcaatccaacgcaatcactaacttaccgaaaccgaattcgccaacaattaccaaatctcaccgcgttacaaactaaaaaaaaaattacgaaccgcaactatttctactaatcctacataaaaacaata

SEQ ID NO: 5781 - DNA, 702 bp, Artificial Sequence
  chemically treated genomic DNA (Homo sapiens) CpG-island No: 5781
gtatcgtttgcgtagttttaggcgcgatatttttttcggtgttaaacggtagcgcgatattttttttatggtcgatagtattaagttatcgttatcgttaagcgtagggagtttttttattattatttttcgtaggttttcgcgagatttaattcgtcgtaatttattaacgcggcgtgttatatgtcgttagcgcgcggatgaagatttcgttcgtgtcggtatagaaatcgttatattggcgttattggcgtagtattcggtatttattaaggattatcgttaattcgttcgggtaatttattggttatttcgtttgtggattggttgtcgttaaattgtcgtttaaatttaacgttacggtttttacggttttattttttgttttttatttagtggcgtatcgttatggtcgaggacggtgttttttttttgcgcgttgttagtagttgtttataacgtaaagacgtgagaaaattttcggcgagacgcgttttatgttacgagtaaacgtaaaatttttgttttttcgttaattattattatatgcgggttttgttttattattatcgggcggtaagaatcggattacgtagatgattaacgttcgttatcgtacggtttttagggtgttattatttattatatagcgtattatcgtgttttttataaatgcgtatgtattttttcggtaaatttttt

SEQ ID NO: 5782 - DNA, 702 bp, Artificial Sequence
  chemically treated genomic DNA (Homo sapiens) CpG-island No: 5782
aaaaaatttaccgaaaaaatacatacgcatttataaaaaacacgataatacgctatataataaataataacaccctaaaaaccgtacgataacgaacgttaatcatctacgtaatccgattcttaccgcccgataataataaaacaaaacccgcatataataataattaacgaaaaaacaaaaattttacgtttactcgtaacataaaacgcgtctcgccgaaaattttctcacgtctttacgttataaacaactactaacaacgcgcaaaaaaaaaacaccgtcctcgaccataacgatacgccactaaataaaaaacaaaaaataaaaccgtaaaaaccgtaacgttaaatttaaacgacaatttaacgacaaccaatccacaaacgaaataaccaataaattacccgaacgaattaacgataatccttaataaataccgaatactacgccaataacgccaatataacgatttctataccgacacgaacgaaatcttcatccgcgcgctaacgacatataacacgccgcgttaataaattacgacgaattaaatctcgcgaaaacctacgaaaaataataataaaaaaactccctacgcttaacgataacgataacttaatactatcgaccataaaaaaaatatcgcgctaccgtttaacaccgaaaaaaatatcgcgcctaaaactacgcaaacgatac

SEQ ID NO: 5783 - DNA, 702 bp, Artificial Sequence
  chemically treated genomic DNA (Homo sapiens) CpG-island No: 5783
gagaggtttgtcggaagaatgtatacgtatttataaaagatacgatggtacgttgtgtgatggatggtaatattttgaaagtcgtgcggtggcgggcgttagttatttgcgtaattcggtttttgtcgttcggtggtgatggagtaaagttcgtatgtgatgatgattggcgaaggggtagaaattttgcgtttgttcgtggtatggagcgcgtttcgtcggagatttttttacgtttttgcgttatgaataattattggtagcgcgtaaggaaggggtatcgttttcgattatagcggtgcgttattggatgaaaaatagaaaatgggatcgtgggggtcgtggcgttggatttagacggtaatttggcggtagttagtttataggcggaatgattaataaattattcggacgagttggcgatagtttttagtgggtgtcggatgttacgttaataacgttagtgtggcggtttttgtatcggtacgggcgaagtttttattcgcgcgttggcggtatatgatacgtcgcgttaatggattacggcggattaagtttcgcggaagtttgcgaggggtagtaatggaaaaattttttgcgtttggcggtagcggtggtttaatgttatcgattatgaagggaatgtcgcgttatcgtttaatatcgaaggaagtatcgcgtttggggttacgtaggcgatat

SEQ ID NO: 5784 - DNA, 702 bp, Artificial Sequence
  chemically treated genomic DNA (Homo sapiens) CpG-island No: 5784
atatcgcctacgtaaccccaaacgcgatacttccttcgatattaaacgataacgcgacattcccttcataatcgataacattaaaccaccgctaccgccaaacgcaaaaaatttttccattactacccctcgcaaacttccgcgaaacttaatccgccgtaatccattaacgcgacgtatcatataccgccaacgcgcgaataaaaacttcgcccgtaccgatacaaaaaccgccacactaacgttattaacgtaacatccgacacccactaaaaactatcgccaactcgtccgaataatttattaatcattccgcctataaactaactaccgccaaattaccgtctaaatccaacgccacgacccccacgatcccattttctatttttcatccaataacgcaccgctataatcgaaaacgataccccttccttacgcgctaccaataattattcataacgcaaaaacgtaaaaaaatctccgacgaaacgcgctccataccacgaacaaacgcaaaatttctaccccttcgccaatcatcatcacatacgaactttactccatcaccaccgaacgacaaaaaccgaattacgcaaataactaacgcccgccaccgcacgactttcaaaatattaccatccatcacacaacgtaccatcgtatcttttataaatacgtatacattcttccgacaaacctctc

SEQ ID NO: 5785 - DNA, 967 bp, Artificial Sequence
  chemically treated genomic DNA (Homo sapiens) CpG-island No: 5785
gggttattttggtttgttaatagcgtttgtattttttgataatatgcgtattaataggaattgttgatgtcgttgtcggggaggcgtattgtaggtgtggatcgtgcgcggggtggtgataaatagaaaatcgtaattagtttgtcgttcggcgatatcgtttgcgttcgtatatcggcgggtagggttggagatcgtttaacgaaagtcggggataatatttttgtattatcgtagatagtcgtttttgtatagcgagttttttatttcgtttagttttagcgtagatggttttgtagtattcggcgaattttcgacgagtttaaaattttagcgtgtcgttaaatgagaagtcgcgtttgcgatagttttcgcgttgaaagttagtatcgcgtttggttcgacggttacgttgtcgtcgattatggggtgagatgaacgtttaaaaacggtattgtcgggtcgggaatggggtaattaggtggttaataatttggttatgtttcggcgtaaggcggaaatattgttacggaacggggcgattgataagtttcggtcgagttcgagtatttttttagtcggttagtattaggtcgggaaaggtatcggggtgaagcgttaattgtcgttcgagagggaggatttatcgcggtgtatgttataaaatcggaatagggggtaaaaaatacggtcgggagggaaaattagtggtcgtaagttgtgggaaataacggggcggtaaaatcggatcggtaaatatgttcgtcgaggggtataataattatacgtagggtaatagtcgttattaatagcgaaaaggtattacgataataatgagggatatataggataattagtcgtgttttttttgcgcgattttagcgcgttttatttgtcgtacgtgatcgatagtattagtgttgtaggtcgatttagaggatttttaattttttttattattaagaag

SEQ ID NO: 5786 - DNA, 967 bp, Artificial Sequence
  chemically treated genomic DNA (Homo sapiens) CpG-island No: 5786
cttcttaataataaaaaaaattaaaaatcctctaaatcgacctacaacactaatactatcgatcacgtacgacaaataaaacgcgctaaaatcgcgcaaaaaaaacacgactaattatcctatatatccctcattattatcgtaataccttttcgctattaataacgactattaccctacgtataattattatacccctcgacgaacatatttaccgatccgattttaccgccccgttatttcccacaacttacgaccactaattttccctcccgaccgtattttttaccccctattccgattttataacatacaccgcgataaatcctccctctcgaacgacaattaacgcttcaccccgatacctttcccgacctaatactaaccgactaaaaaaatactcgaactcgaccgaaacttatcaatcgccccgttccgtaacaatatttccgccttacgccgaaacataaccaaattattaaccacctaattaccccattcccgacccgacaataccgtttttaaacgttcatctcaccccataatcgacgacaacgtaaccgtcgaaccaaacgcgatactaactttcaacgcgaaaactatcgcaaacgcgacttctcatttaacgacacgctaaaattttaaactcgtcgaaaattcgccgaatactacaaaaccatctacgctaaaactaaacgaaataaaaaactcgctatacaaaaacgactatctacgataatacaaaaatattatccccgactttcgttaaacgatctccaaccctacccgccgatatacgaacgcaaacgatatcgccgaacgacaaactaattacgattttctatttatcaccaccccgcgcacgatccacacctacaatacgcctccccgacaacgacatcaacaattcctattaatacgcatattatcaaaaaatacaaacgctattaacaaaccaaaataaccc

SEQ ID NO: 5787 - DNA, 967 bp, Artificial Sequence
  chemically treated genomic DNA (Homo sapiens) CpG-island No: 5787
ttttttaatagtgaaaagggttagggattttttagatcgatttatagtattgatgttatcgattacgtacgataagtggagcgcgttgaggtcgcgtaggagagatacgattggttgttttgtgtgttttttattattatcgtggtattttttcgttgttggtggcggttattgttttgcgtgtggttgttatatttttcggcggatatatttgtcggttcgattttgtcgtttcgttgttttttatagtttgcggttattaattttttttttcggtcgtattttttattttttatttcggttttatgatatatatcgcggtgaattttttttttcgggcggtaattgacgttttatttcgatatttttttcggtttgatgttgatcggttggaaaaatgttcgaattcgatcggggtttattaatcgtttcgtttcgtggtagtattttcgttttgcgtcggagtataattagattgttaattatttgattattttattttcgattcggtaatgtcgtttttgggcgtttattttattttatgatcgacggtagcgtgatcgtcgggttaaacgcggtgttggtttttaacgcgaaggttatcgtaagcgcgattttttatttagcgatacgttggaattttgggttcgtcggggattcgtcgggtgttgtaaaattatttacgttaggattgggcgagatgaaaaattcgttgtgtaaaagcggttatttgcggtggtgtaaaagtattgttttcggttttcgttaagcgatttttagttttgttcgtcggtgtgcgggcgtaggcggtatcgtcggacggtaagttgattgcgattttttgtttgttattatttcgcgtacgatttatatttgtaatgcgttttttcggtagcgatattagtaatttttattggtgcgtatattgttagaaggtataaacgttgttggtaagttagagtaattt

SEQ ID NO: 5788 - DNA, 967 bp, Artificial Sequence
  chemically treated genomic DNA (Homo sapiens) CpG-island No: 5788
aaattactctaacttaccaacaacgtttataccttctaacaatatacgcaccaataaaaattactaatatcgctaccgaaaaaacgcattacaaatataaatcgtacgcgaaataataacaaacaaaaaatcgcaatcaacttaccgtccgacgataccgcctacgcccgcacaccgacgaacaaaactaaaaatcgcttaacgaaaaccgaaaacaatacttttacaccaccgcaaataaccgcttttacacaacgaatttttcatctcgcccaatcctaacgtaaataattttacaacacccgacgaatccccgacgaacccaaaattccaacgtatcgctaaataaaaaatcgcgcttacgataaccttcgcgttaaaaaccaacaccgcgtttaacccgacgatcacgctaccgtcgatcataaaataaaataaacgcccaaaaacgacattaccgaatcgaaaataaaataatcaaataattaacaatctaattatactccgacgcaaaacgaaaatactaccacgaaacgaaacgattaataaaccccgatcgaattcgaacatttttccaaccgatcaacatcaaaccgaaaaaaatatcgaaataaaacgtcaattaccgcccgaaaaaaaaaattcaccgcgatatatatcataaaaccgaaataaaaaataaaaaatacgaccgaaaaaaaaaattaataaccgcaaactataaaaaacaacgaaacgacaaaatcgaaccgacaaatatatccgccgaaaaatataacaaccacacgcaaaacaataaccgccaccaacaacgaaaaaataccacgataataataaaaaacacacaaaacaaccaatcgtatctctcctacgcgacctcaacgcgctccacttatcgtacgtaatcgataacatcaatactataaatcgatctaaaaaatccctaacccttttcactattaaaaaa

SEQ ID NO: 5789 - DNA, 923 bp, Artificial Sequence
  chemically treated genomic DNA (Homo sapiens) CpG-island No: 5789
gcggttatacgtaggcggagcgaaaacgttcgggggggaagtaatataaataggtgatatcgtaaacgggatatgtgtcgtgatcggaggttagaatagttgcgattagcggtagcgggatagttaatgggcggcgttaagagttgcgcgtaaaagggaaacgcggaagtttgagcgcgagtgggtaagaagtgcgtttgcgtcggtaacgtagacgcgtcgcgtttttcgtcgtgtaatatatcgcggattgatagaaagggttttggttcgtcgacgggggtgcggtgagagtacggggtcgtataatgcgtacgagcgtttcggattcggtttatttggttgatcgggttgtgataaaaggcgggaagatttagcggacggtagatatgggattatgatcggcgacgttgtaggggggggtatgacggtttattacgaatcgaagtaatattattattattatcgtaaatttagtatattacgcgttgcggtttgcggtttgggacgcgtttgtattatacggtatattaaacgcgttattaaacgaatacggtttttcggggcgtcgggtattcggaaggtcgtaatcggtcgttaatttttatgaaaagagaaggagtagcgcgttatgtatgtataaaggggtcggatgtatttcggcgtcggatttgcgttagtgggcgttcgtcgattgtttatatgcggtacgtttttattttcggtcggtttatgttcgggggtatttttttatttttttattcgttgttatacgggtttgtattttttattatcgggggtgtggtatttttaggtcgtatacggcgtttttttggttgcgtcgcgttttatgtagttatgttaggcgttattagtttgttttttttggttggatttatgtgttgtatttggtaagatcgtgt

SEQ ID NO: 5790 - DNA, 923 bp, Artificial Sequence
  chemically treated genomic DNA (Homo sapiens) CpG-island No: 5790
acacgatcttaccaaatacaacacataaatccaaccaaaaaaaacaaactaataacgcctaacataactacataaaacgcgacgcaaccaaaaaaacgccgtatacgacctaaaaataccacacccccgataataaaaaatacaaacccgtataacaacgaataaaaaaataaaaaaatacccccgaacataaaccgaccgaaaataaaaacgtaccgcatataaacaatcgacgaacgcccactaacgcaaatccgacgccgaaatacatccgacccctttatacatacataacgcgctactccttctcttttcataaaaattaacgaccgattacgaccttccgaatacccgacgccccgaaaaaccgtattcgtttaataacgcgtttaatataccgtataatacaaacgcgtcccaaaccgcaaaccgcaacgcgtaatatactaaatttacgataataataataatattacttcgattcgtaataaaccgtcatacccccccctacaacgtcgccgatcataatcccatatctaccgtccgctaaatcttcccgccttttatcacaacccgatcaaccaaataaaccgaatccgaaacgctcgtacgcattatacgaccccgtactctcaccgcacccccgtcgacgaaccaaaaccctttctatcaatccgcgatatattacacgacgaaaaacgcgacgcgtctacgttaccgacgcaaacgcacttcttacccactcgcgctcaaacttccgcgtttcccttttacgcgcaactcttaacgccgcccattaactatcccgctaccgctaatcgcaactattctaacctccgatcacgacacatatcccgtttacgatatcacctatttatattacttcccccccgaacgttttcgctccgcctacgtataaccgc

SEQ ID NO: 5791 - DNA, 923 bp, Artificial Sequence
  chemically treated genomic DNA (Homo sapiens) CpG-island No: 5791
gtacgattttgttaggtatagtatatgggtttaattaggggggataggttgataacgtttgatatgattatatagagcgcgacgtagttaggaaggcgtcgtgtacggtttaaaaatgttatattttcgataatagaaggtataagttcgtgtggtaacgggtggaaaaatggggaaatattttcggatatgggtcggtcgagggtgaaggcgtgtcgtatataggtaatcggcgggcgtttattagcgtaaattcggcgtcggggtgtattcggtttttttatatatatatggcgcgttattttttttttttttataggggttaacggtcggttgcggtttttcgggtgttcggcgtttcggggagtcgtattcgtttggtagcgcgtttggtatatcgtgtggtataggcgcgttttaggtcgtagatcgtagcgcgtggtgtgttaaatttgcgataatggtgatggtgttgtttcggttcgtggtagatcgttatgtttttttttatagcgtcgtcggttatggttttatgtttgtcgttcgttagattttttcgttttttgttataattcggttagttaaatgggtcgaattcggggcgttcgtgcgtattatgcggtttcgtatttttatcgtattttcgtcggcggattagggttttttttattagttcgcggtgtattgtacggcgaagggcgcggcgcgtttgcgttgtcggcgtaggcgtattttttgtttattcgcgtttaaattttcgcgttttttttttacgcgtagtttttggcgtcgtttattggttatttcgttgtcgttggtcgtagttattttggttttcgattacggtatatgtttcgtttgcgatgttatttatttgtattatttttttttcgggcgttttcgtttcgtttgcgtatggtcgt

SEQ ID NO: 5792 - DNA, 923 bp, Artificial Sequence
  chemically treated genomic DNA (Homo sapiens) CpG-island No: 5792
acgaccatacgcaaacgaaacgaaaacgcccgaaaaaaaaataatacaaataaataacatcgcaaacgaaacatataccgtaatcgaaaaccaaaataactacgaccaacgacaacgaaataaccaataaacgacgccaaaaactacgcgtaaaaaaaaaacgcgaaaatttaaacgcgaataaacaaaaaatacgcctacgccgacaacgcaaacgcgccgcgcccttcgccgtacaatacaccgcgaactaataaaaaaaaccctaatccgccgacgaaaatacgataaaaatacgaaaccgcataatacgcacgaacgccccgaattcgacccatttaactaaccgaattataacaaaaaacgaaaaaatctaacgaacgacaaacataaaaccataaccgacgacgctataaaaaaaaacataacgatctaccacgaaccgaaacaacaccatcaccattatcgcaaatttaacacaccacgcgctacgatctacgacctaaaacgcgcctataccacacgatataccaaacgcgctaccaaacgaatacgactccccgaaacgccgaacacccgaaaaaccgcaaccgaccgttaacccctataaaaaaaaaaaaaataacgcgccatatatatataaaaaaaccgaatacaccccgacgccgaatttacgctaataaacgcccgccgattacctatatacgacacgccttcaccctcgaccgacccatatccgaaaatatttccccatttttccacccgttaccacacgaacttataccttctattatcgaaaatataacatttttaaaccgtacacgacgccttcctaactacgtcgcgctctatataatcatatcaaacgttatcaacctatcccccctaattaaacccatatactatacctaacaaaatcgtac

SEQ ID NO: 5793 - DNA, 928 bp, Artificial Sequence
  chemically treated genomic DNA (Homo sapiens) CpG-island No: 5793
gaatttttcgaataaaatttcgcggggtattttttcgtaatttatttatttcgggttaaagtggcggatattgcgttgtaatgatacgttatattcggtatggtatgcggatgtggcgtatgttgataagacgcgttagcgtcgtattaggtaatcgttcgggcgttagatgttggatgcggcgtaatcgttttatttaatttacgggtggagtattttatagcggtgtaggtttgataagacgcgttagcgtcgattaggtaatcggtttgggcgttagatgtcggatgcggcgtaatcgtttattcgatttacggggtggagtattttatagcggtgtaggtttgataagagcgttagcgtcgtattaggtaatcggttcggacgttggatgtcggatgcgcgtaatcgttttatttaatttacggggtggagtattttatagcggtgtggtttgataagacgcgttagcgtcgtattaggtaatcggtttgggcgttgatgtcggatgcggcgtaatcgttttattcgatttacggggtggagtatttatagcggtgtaggtttgataagacgcgttagcgtcgtattaggtaacggttcgggcgttggatgtcggatgcggcgtgatcgttttgtttgatttaggggtgtcgtattttatagcggtgtaggtttgataagacgcgttagcgtgtattaggtaatcggttcgggcgttggatgtcggatgcggcgtgatcgtttgtttgatttacggggtgtcgtattttacggtagtttagcgaattattcgttgttaattttttttttcgttttttagacgcggtattttatatttatttgtttggcgtatatattacgatcggtagtttgttgttgtaacgtagtatttagtatcgtttagatacgcggtgataaatttttt

SEQ ID NO: 5794 - DNA, 928 bp, Artificial Sequence
  chemically treated genomic DNA (Homo sapiens) CpG-island No: 5794
aaaaaatttatcaccgcgtatctaaacgatactaaatactacgttacaacaacaaactaccgatcgtaatatatacgccaaacaaataaatataaaataccgcgtctaaaaaacgaaaaaaaaaattaacaacgaataattcgctaaactaccgtaaaatacgacaccccgtaaatcaaacaaacgatcacgccgcatccgacatccaacgcccgaaccgattacctaatacacgctaacgcgtcttatcaaacctacaccgctataaaatacgacacccctaaatcaaacaaaacgatcacgccgcatccgacatccaacgcccgaaccgttacctaatacgacgctaacgcgtcttatcaaacctacaccgctataaatactccaccccgtaaatcgaataaaacgattacgccgcatccgacatcaacgcccaaaccgattacctaatacgacgctaacgcgtcttatcaaaccacaccgctataaaatactccaccccgtaaattaaataaaacgattacgcgcatccgacatccaacgtccgaaccgattacctaatacgacgctaacgctcttatcaaacctacaccgctataaaatactccaccccgtaaatcgaataaacgattacgccgcatccgacatctaacgcccaaaccgattacctaatcgacgctaacgcgtcttatcaaacctacaccgctataaaatactccacccgtaaattaaataaaacgattacgccgcatccaacatctaacgcccgaacgattacctaatacgacgctaacgcgtcttatcaacatacgccacatccgcataccataccgaatataacgtatcattacaacgcaatatccgccactttaacccgaaataaataaattacgaaaaaataccccgcgaaattttattcgaaaaattc

SEQ ID NO: 5795 - DNA, 928 bp, Artificial Sequence
  chemically treated genomic DNA (Homo sapiens) CpG-island No: 5795
aagaaatttgttatcgcgtatttgggcgatgttggatgttgcgttataatagtaagttgtcgatcgtggtgtatacgttagataagtagatgtgaagtatcgcgtttggaaggcggaagagaaaattgataacgggtagttcgttaaattgtcgtgaagtgcggtatttcgtaggttagataagcggttacgtcgtattcgatatttaacgttcgagtcggttgtttgatgtacgttggcgcgttttattaggtttatatcgttgtgaagtgcggtatttttaggttagataaggcggttacgtcgtattcgatatttaacgttcgagtcgttgtttgatgcgacgttggcgcgttttattaggtttatatcgttgtgagtgttttatttcgtaggtcggataaggcggttacgtcgtattcgatattaacgtttaagtcggttgtttgatgcgacgttggcgcgttttattaggttatatcgttgtgaagtgttttatttcgtaggttggataaggcggttacgcgtattcgatatttaacgttcgagtcggttgtttgatgcgacgttggcgtttttattaggtttatatcgttgtgaagtgttttatttcgtaggtcggataggcggttacgtcgtattcgatatttaacgtttaagtcggttgtttgatcgacgttggcgcgttttattaggtttatatcgttgtgaagtgttttattcgtaggttggataaggcggttacgtcgtatttaatatttaacgttcgagcggttgtttgatgcgacgttggcgcgttttattagtatacgttatattcgtatattatgtcggatgtggcgtattattataacgtaatattcgttattttggttcgggataagtgagttgcgggggagtgtttcgcggggttttgttcgaggagttt

SEQ ID NO: 5796 - DNA, 928 bp, Artificial Sequence
  chemically treated genomic DNA (Homo sapiens) CpG-island No: 5796
aaactcctcgaacaaaaccccgcgaaacactcccccgcaactcacttatcccgaaccaaaataacgaatattacgttataataatacgccacatccgacataatatacgaatataacgtatactaataaaacgcgccaacgtcgcatcaaacaaccgctcgaacgttaaatattaaatacgacgtaaccgccttatccaacctacgaataaaacacttcacaacgatataaacctaataaaacgcgccaacgtcgatcaaacaaccgacttaaacgttaaatatcgaatacgacgtaaccgcctatccgacctacgaaataaaacacttcacaacgatataaacctaataaaaacgccaacgtcgcatcaaacaaccgactcgaacgttaaatatcgaatacgcgtaaccgccttatccaacctacgaaataaaacacttcacaacgatataacctaataaaacgcgccaacgtcgcatcaaacaaccgacttaaacgttaatatcgaatacgacgtaaccgccttatccgacctacgaaataaaacactcacaacgatataaacctaataaaacgcgccaacgtcgcatcaaacaacgactcgaacgttaaatatcgaatacgacgtaaccgccttatctaacctaaaaataccgcacttcacaacgatataaacctaataaaacgcgccaacgtacatcaaacaaccgactcgaacgttaaatatcgaatacgacgtaaccgcttatctaacctacgaaataccgcacttcacgacaatttaacgaactacccgttatcaattttctcttccgccttccaaacgcgatacttcacatctacttatctaacgtatacaccacgatcgacaacttactattataacgcaacatccaacatcgcccaaatacgcgataacaaatttctt

SEQ ID NO: 5797 - DNA, 633 bp, Artificial Sequence
  chemically treated genomic DNA (Homo sapiens) CpG-island No: 5797
cgaatgggcgattattaacgttggcgtatagatgatgtaggtatgaagtagtagaacgttagcggcgtagttaggaagattagtcgtggaatgttcgataagagtggaatatggcgttgacgtaatatagtcgttgagtaaattttagtttttatcggtgagcgggttatcgagacggaagatttgtattatttcgcgcgttagcgaatacgttgatcgatatgcgtcgatagattttcggtcgttagttcgtcgtttgcggaatacgtatatacgcggaggtatagttacgacggtgtatcgtagagaagtatgcgtatttttagttacggtttcgatagtaatgttttaattttatttagcggtttacgacgaattatcgtataggaatcgtagagaaagtggcgttttatatatcgttgttattttgtattagattatagaacgcgtgttttcgttcggcgttttacggaaacgttttaggttgcgtttaaagggttcggtgagaagaagtggtgcggcgtttgtattatcgttagttgtttttttttaggaattagtttatggttatttgtaagaacgatcgcgtggtagtggtcgtagtcgaaaatcgatacgaattcgtttttggta

SEQ ID NO: 5798 - DNA, 633 bp, Artificial Sequence
  chemically treated genomic DNA (Homo sapiens) CpG-island No: 5798
taccaaaaacgaattcgtatcgattttcgactacgaccactaccacgcgatcgttcttacaaataaccataaactaattcctaaaaaaaaacaactaacgataatacaaacgccgcaccacttcttctcaccgaaccctttaaacgcaacctaaaacgtttccgtaaaacgccgaacgaaaacacgcgttctataatctaatacaaaataacaacgatatataaaacgccactttctctacgattcctatacgataattcgtcgtaaaccgctaaataaaattaaaacattactatcgaaaccgtaactaaaaatacgcatacttctctacgatacaccgtcgtaactatacctccgcgtatatacgtattccgcaaacgacgaactaacgaccgaaaatctatcgacgcatatcgatcaacgtattcgctaacgcgcgaaataatacaaatcttccgtctcgataacccgctcaccgataaaaactaaaatttactcaacgactatattacgtcaacgccatattccactcttatcgaacattccacgactaatcttcctaactacgccgctaacgttctactacttcatacctacatcatctatacgccaacgttaataatcgcccattcg

SEQ ID NO: 5799 - DNA, 633 bp, Artificial Sequence
  chemically treated genomic DNA (Homo sapiens) CpG-island No: 5799
tgttaaaggcgagttcgtgtcgattttcgattgcgattattattacgcgatcgtttttgtaaatgattatgggttggtttttgaaagaaaatagttggcgatgatgtagacgtcgtattatttttttttatcggattttttgaacgtaatttggggcgttttcgtaaaacgtcgaacgaaggtacgcgttttatggtttggtgtaggatggtaacgatatgtgggacgttattttttttgcggtttttgtgcggtgattcgtcgtaagtcgttggatgaaattggggtattgttgtcgaaatcgtgattgaagatgcgtatatttttttgcggtgtatcgtcgtggttatattttcgcgtatatgcgtatttcgtaggcggcgggttggcgatcgaaagtttgtcggcgtatatcggttagcgtattcgttggcgcgcgggatggtataaatttttcgtttcgataattcgtttatcggtaagggttgaagtttgtttagcggttatgttacgttaacgttatgttttatttttgtcgggtattttacggttgatttttttgattgcgtcgttggcgttttgttgttttatgtttatattatttatgcgttagcgttgatgatcgtttattcg

SEQ ID NO: 5800 - DNA, 633 bp, Artificial Sequence
  chemically treated genomic DNA (Homo sapiens) CpG-island No: 5800
cgaataaacgatcatcaacgctaacgcataaataatataaacataaaacaacaaaacgccaacgacgcaatcaaaaaaatcaaccgtaaaatacccgacaaaaataaaacataacgttaacgtaacataaccgctaaacaaacttcaacccttaccgataaacgaattatcgaaacgaaaaatttataccatcccgcgcgccaacgaatacgctaaccgatatacgccgacaaactttcgatcgccaacccgccgcctacgaaatacgcatatacgcgaaaatataaccacgacgatacaccgcaaaaaaatatacgcatcttcaatcacgatttcgacaacaataccccaatttcatccaacgacttacgacgaatcaccgcacaaaaaccgcaaaaaaaataacgtcccacatatcgttaccatcctacaccaaaccataaaacgcgtaccttcgttcgacgttttacgaaaacgccccaaattacgttcaaaaaatccgataaaaaaaaataatacgacgtctacatcatcgccaactattttctttcaaaaaccaacccataatcatttacaaaaacgatcgcgtaataataatcgcaatcgaaaatcgacacgaactcgcctttaaca

SEQ ID NO: 5801 - DNA, 553 bp, Artificial Sequence
  chemically treated genomic DNA (Homo sapiens) CpG-island No: 5801
agaaaagcgacggttcgtgtattaggttattatcgttcgcgtgaagttaggacgttagtattagaaaacgatttgtcggatttgatcgtttcgttcgattaatcgtttttgcgattttcgacggcgtaatcgattcgtataatttcggcgcgtttttgcgtgtgcggacgtcgtaggcgtttatgcggtgattgtgtcgaaagatcgttcgtatagtttaacgttacggcgaaaaaagtagtttgcggcgcggtagaaacgtttcgttgattcgggtgattaattttgcgcgtattatgcgtatgttgaggaagagaatatttggatcgtcggtacggtaggcgaggcggattatatttttattagagtaaaatgatcggacgtttggcgttggtgatgggtgcggaggtgaaggtatgcgtcgtttgattcgtgaatattgcgatgagttgatcgtatttcgatggttggaagcgttttttttttgaacgtttcggttgcgacggaatttgtttatttgaagcggtgcgttagcgtagttaattttttagaa

SEQ ID NO: 5802 - DNA, 553 bp, Artificial Sequence
  chemically treated genomic DNA (Homo sapiens) CpG-island No: 5802
ttctaaaaaattaactacgctaacgcaccgcttcaaataaacaaattccgtcgcaaccgaaacgttcaaaaaaaaaacgcttccaaccatcgaaatacgatcaactcatcgcaatattcacgaatcaaacgacgcataccttcacctccgcacccatcaccaacgccaaacgtccgatcattttactctaataaaaatataatccgcctcgcctaccgtaccgacgatccaaatattctcttcctcaacatacgcataatacgcgcaaaattaatcacccgaatcaacgaaacgtttctaccgcgccgcaaactacttttttcgccgtaacgttaaactatacgaacgatctttcgacacaatcaccgcataaacgcctacgacgtccgcacacgcaaaaacgcgccgaaattatacgaatcgattacgccgtcgaaaatcgcaaaaacgattaatcgaacgaaacgatcaaatccgacaaatcgttttctaatactaacgtcctaacttcacgcgaacgataataacctaatacacgaaccgtcgcttttct

SEQ ID NO: 5803 - DNA, 553 bp, Artificial Sequence
  chemically treated genomic DNA (Homo sapiens) CpG-island No: 5803
ttttgagaaattagttgcgttggcgtatcgttttaaataagtaaatttcgtcgtaatcgaaacgtttagggaagaaacgtttttagttatcgggatgcgattaatttatcgtaatgtttacgagttaggcgacgtatatttttattttcgtatttattattagcgttaggcgttcggttattttgttttgatagaggtatgattcgtttcgtttgtcgtatcgacgatttagatatttttttttttaatatacgtatggtgcgcgtaaggttagttattcgaattagcggaacgtttttgtcgcgtcgtaggttatttttttcgtcgtagcgttgagttgtgcgagcgatttttcggtataattatcgtatgaacgtttgcggcgttcgtatacgtaaggacgcgtcgaggttgtgcggatcggttacgtcgtcgagaatcgtaggaacggttgatcgagcgaagcgattagattcggtagatcgttttttgatattgacgttttggttttacgcgggcgataatggtttgatgtacggatcgtcgttttttt

SEQ ID NO: 5804 - DNA, 553 bp, Artificial Sequence
  chemically treated genomic DNA (Homo sapiens) CpG-island No: 5804
aaaaaaacgacgatccgtacatcaaaccattatcgcccgcgtaaaaccaaaacgtcaatatcaaaaaacgatctaccgaatctaatcgcttcgctcgatcaaccgttcctacgattctcgacgacgtaaccgatccgcacaacctcgacgcgtccttacgtatacgaacgccgcaaacgttcatacgataattataccgaaaaatcgctcgcacaactcaacgctacgacgaaaaaaataacctacgacgcgacaaaaacgttccgctaattcgaataactaaccttacgcgcaccatacgtatattaaaaaaaaaaatatctaaatcgtcgatacgacaaacgaaacgaatcatacctctatcaaaacaaaataaccgaacgcctaacgctaataataaatacgaaaataaaaatatacgtcgcctaactcgtaaacattacgataaattaatcgcatcccgataactaaaaacgtttcttccctaaacgtttcgattacgacgaaatttacttatttaaaacgatacgccaacgcaactaatttctcaaaa

SEQ ID NO: 5805 - DNA, 509 bp, Artificial Sequence
  chemically treated genomic DNA (Homo sapiens) CpG-island No: 5805
agtgtgatatcgatcgcgtgcgcgttattcgtaaaagtcggttggtggaagtggtagaagggtagtttgcgtagggcgattttttagtttgtttggtcgttaatgaaaattattattattttcgcgtggtgttggtgcgtatcgattcggtaatcgagcgtttgattttaatcgtcgtataattggatgtttttaaatgttacgtcggggatcgcgttcgtttggtgcgtttgtgcgtagaggagaaaatagtatgattttatggattaacggtgattggataacgggttagggcgtatcgcgtgtgaagcgtaattcggtatcgggcgaggtgttatggtaaggtaatgatgtcgatgtcgtttaggtcgagtaggtttgtcgggtagttcgtgcggcgttttcgcgttgggcgcggtttttatttgttgaacgttatgtcgttgtcgaacgttttgtcgtattgttggaaagtaataaagtcgaattaatcgttattattgtagaga

SEQ ID NO: 5806 - DNA, 509 bp, Artificial Sequence
  chemically treated genomic DNA (Homo sapiens) CpG-island No: 5806
tctctacaataataacgattaattcgactttattactttccaacaatacgacaaaacgttcgacaacgacataacgttcaacaaataaaaaccgcgcccaacgcgaaaacgccgcacgaactacccgacaaacctactcgacctaaacgacatcgacatcattaccttaccataacacctcgcccgataccgaattacgcttcacacgcgatacgccctaacccgttatccaatcaccgttaatccataaaatcatactattttctcctctacgcacaaacgcaccaaacgaacgcgatccccgacgtaacatttaaaaacatccaattatacgacgattaaaatcaaacgctcgattaccgaatcgatacgcaccaacaccacgcgaaaataataataattttcattaacgaccaaacaaactaaaaaatcgccctacgcaaactacccttctaccacttccaccaaccgacttttacgaataacgcgcacgcgatcgatatcacact

SEQ ID NO: 5807 - DNA, 509 bp, Artificial Sequence
  chemically treated genomic DNA (Homo sapiens) CpG-island No: 5807
tttttgtaataatggcggttaattcggttttattgttttttagtagtgcggtaaagcgttcgataacggtatgacgtttagtaaatgaaagtcgcgtttagcgcggaaacgtcgtacgggttgttcgataagtttgttcgatttgagcggtatcggtattattgttttgttataatatttcgttcgatatcggattacgttttatacgcgatgcgttttggttcgttatttagttatcgttaatttataaagttatgttgtttttttttttgcgtataggcgtattagacgaacgcgattttcggcgtggtatttgagggtatttagttgtgcggcggttaaaattaaacgttcggttgtcggatcggtacgtattagtattacgcggaaatggtgataatttttattggcgattaggtaggttgggaaatcgttttgcgtaggttgtttttttgttatttttattagtcgatttttacggatggcgcgtacgcggtcgatgttatatt

SEQ ID NO: 5808 - DNA, 509 bp, Artificial Sequence
  chemically treated genomic DNA (Homo sapiens) CpG-island No: 5808
aatataacatcgaccgcgtacgcgccatccgtaaaaatcgactaataaaaataacaaaaaaacaacctacgcaaaacgatttcccaacctacctaatcgccaataaaaattatcaccatttccgcgtaatactaatacgtaccgatccgacaaccgaacgtttaattttaaccgccgcacaactaaataccctcaaataccacgccgaaaatcgcgttcgtctaatacgcctatacgcaaaaaaaaaaacaacataactttataaattaacgataactaaataacgaaccaaaacgcatcgcgtataaaacgtaatccgatatcgaacgaaatattataacaaaacaataataccgataccgctcaaatcgaacaaacttatcgaacaacccgtacgacgtttccgcgctaaacgcgactttcatttactaaacgtcataccgttatcgaacgctttaccgcactactaaaaaacaataaaaccgaattaaccgccattattacaaaaa

SEQ ID NO: 5809 - DNA, 547 bp, Artificial Sequence
  chemically treated genomic DNA (Homo sapiens) CpG-island No: 5809
ttacgcgtatcgcgttgtcgaattcggtgtttcgcgttgggcggggggcgggtaggtttgtttatgtaaattatattatttgcgtgtttcgtttcgtcgacgttatttgattttaatatgtaagaaacgtttttttttagattcggttttttatattgcgttttttttttcgcgtaaagggggcggggcggaggatgtaaatgaatttcgtgtaggttacggatcgttgttttttttttttttggtaggggggttgtttcgaattttttcgtttcgtttcggaacgtttcggcggttcgggtttgcgtaggcgttttatttttttcggggcgcggttacgtcgtatcgggcgaggcggggtcggggagtcgcgcgcggtgggggcggggtatggcgcgttgtgcggcgtagggcggttggtataaacggcggcgtcggggtcggaggaaaaattcggtgaggaggtcgcggggcgagaagggagcgggaggagattgtagagggttaaatattaggttgaggagtttatttgtgttttggggttttg

SEQ ID NO: 5810 - DNA, 547 bp, Artificial Sequence
  chemically treated genomic DNA (Homo sapiens) CpG-island No: 5810
caaaaccccaaaacacaaataaactcctcaacctaatatttaaccctctacaatctcctcccgctcccttctcgccccgcgacctcctcaccgaatttttcctccgaccccgacgccgccgtttataccaaccgccctacgccgcacaacgcgccataccccgcccccaccgcgcgcgactccccgaccccgcctcgcccgatacgacgtaaccgcgccccgaaaaaaataaaacgcctacgcaaacccgaaccgccgaaacgttccgaaacgaaacgaaaaaattcgaaacaacccccctaccaaaaaaaaaaaaaacaacgatccgtaacctacacgaaattcatttacatcctccgccccgccccctttacgcgaaaaaaaaaacgcaatataaaaaaccgaatctaaaaaaaaacgtttcttacatattaaaatcaaataacgtcgacgaaacgaaacacgcaaataatataatttacataaacaaacctacccgccccccgcccaacgcgaaacaccgaattcgacaacgcgatacgcgtaa

SEQ ID NO: 5811 - DNA, 547 bp, Artificial Sequence
  chemically treated genomic DNA (Homo sapiens) CpG-island No: 5811
tagggttttaggatataaatgaattttttagtttggtgtttgattttttgtagttttttttcgtttttttttcgtttcgcgatttttttatcgagtttttttttcggtttcggcgtcgtcgtttgtgttagtcgttttgcgtcgtatagcgcgttatatttcgtttttatcgcgcgcgatttttcggtttcgtttcgttcggtgcgacgtgatcgcgtttcggagggggtaaggcgtttgcgtaggttcgagtcgtcgggacgtttcggagcggggcgaggaagttcgggataatttttttattaaggagaaaggaaatagcggttcgtggtttatacgaggtttatttgtatttttcgtttcgttttttttgcgcgggagggggaacgtagtgtgaggggtcgggtttgggagggggcgttttttgtatgttggaattaagtggcgtcggcggggcggggtacgtaaatgatgtgatttatatggataggtttattcgtttttcgtttagcgcggggtatcgagttcggtagcgcggtgcgcgtga

SEQ ID NO: 5812 - DNA, 547 bp, Artificial Sequence
  chemically treated genomic DNA (Homo sapiens) CpG-island No: 5812
tcacgcgcaccgcgctaccgaactcgataccccgcgctaaacgaaaaacgaataaacctatccatataaatcacatcatttacgtaccccgccccgccgacgccacttaattccaacatacaaaaaacgccccctcccaaacccgacccctcacactacgttccccctcccgcgcaaaaaaaacgaaacgaaaaatacaaataaacctcgtataaaccacgaaccgctatttcctttctccttaataaaaaaattatcccgaacttcctcgccccgctccgaaacgtcccgacgactcgaacctacgcaaacgccttaccccctccgaaacgcgatcacgtcgcaccgaacgaaacgaaaccgaaaaatcgcgcgcgataaaaacgaaatataacgcgctatacgacgcaaaacgactaacacaaacgacgacgccgaaaccgaaaaaaaaactcgataaaaaaatcgcgaaacgaaaaaaaaacgaaaaaaaactacaaaaaatcaaacaccaaactaaaaaattcatttatatcctaaaacccta

SEQ ID NO: 5813 - DNA, 1360 bp, Artificial Sequence
  chemically treated genomic DNA (Homo sapiens) CpG-island No: 5813
attatttcgttagtagtagcgtgtagtcggttgaggtgtttttattattaaaattttgttttgcgtggtgtcggtggtgttttacgcgggatgtttattatgttgtcgttttataagtttatcgatgttcgcgtggaggtattagtcggtagttgattaagtatcgcgcggcgtagggcgaggtcgtttcgacgtcgcgatagtcgtattttattaatcggaggtaatatggaaattttaattcgatatttatcggttttaattcggattcgtttttgtgtcgttaggcgaggattattatatcgttatttcgattttcgagtggttttcgggcggcgtatttattattttcgtgatttgaaaaattggtcgttggttagtattcgttggatcgcgtgtcgatgttggatatgaagggtaattcggatttcggggtatttgggcgtcgtgtttgagttacgtcgacggtaaattttggttgtttatatcgacgtgaagattgtcgattcgtcgtggaaaaacggtcgtaatttttcgttatcgcgttttttatcgaggggttatggagcgagttaattttatgggtaacggcgggtttgattcgtttttgttttacgacgacgatggtttaaatattatatttatcgttcgtgggggtcgcgttattatagtaattcgataatattatcgtgttataggcgtttgattcgtagatcggtacgtttttttcgagcgtaatacgttgtttatcggtacgtcgttttgttatatcgaagcgcgtatttgtatcgttacgcgggatggtattatttgatggtcgtcgaggcggtattagttacgagtacgttttcgtggtgttgcgttttaaaaatatgacgggtcgtacgagttgtattcggacgtaacgatgatgattagttggttttgtcggagaattcgttgtagaagagcggttacggttcgttgttgtagcgtatacgggtgaatggtatatggtttattttattagtcgttcgttgcgttgttcggcgtgtcgttgttggttttcggcggacgcggttattgttcgcggggcgcgagatcggtatcgttcgtattgaatggcgcgacggttggtcgacgtggaaggcggtaagtacgcgtagttgatcgtgaaaggttcgtaagtgtcgagtagtttgtagtcgtttcgggtaattggcgggacgatttcgacgtagttcgtttgattcggagttgtagattttgcgtatttcgttcgacgatttttcggttcgtttatcgcgcgttcgggttttttacggatcgggatttttagagttatatatgagagtgatatattattatattttaggttttt

SEQ ID NO: 5814 - DNA, 1360 bp, Artificial Sequence
  chemically treated genomic DNA (Homo sapiens) CpG-island No: 5814
aaaaacctaaaatataataatatatcactctcatatataactctaaaaatcccgatccgtaaaaaacccgaacgcgcgataaacgaaccgaaaaatcgtcgaacgaaatacgcaaaatctacaactccgaatcaaacgaactacgtcgaaatcgtcccgccaattacccgaaacgactacaaactactcgacacttacgaacctttcacgatcaactacgcgtacttaccgccttccacgtcgaccaaccgtcgcgccattcaatacgaacgataccgatctcgcgccccgcgaacaataaccgcgtccgccgaaaaccaacaacgacacgccgaacaacgcaacgaacgactaataaaataaaccatataccattcacccgtatacgctacaacaacgaaccgtaaccgctcttctacaacgaattctccgacaaaaccaactaatcatcatcgttacgtccgaatacaactcgtacgacccgtcatatttttaaaacgcaacaccacgaaaacgtactcgtaactaataccgcctcgacgaccatcaaataataccatcccgcgtaacgatacaaatacgcgcttcgatataacaaaacgacgtaccgataaacaacgtattacgctcgaaaaaaacgtaccgatctacgaatcaaacgcctataacacgataatattatcgaattactataataacgcgacccccacgaacgataaatataatatttaaaccatcgtcgtcgtaaaacaaaaacgaatcaaacccgccgttacccataaaattaactcgctccataacccctcgataaaaaacgcgataacgaaaaattacgaccgtttttccacgacgaatcgacaatcttcacgtcgatataaacaaccaaaatttaccgtcgacgtaactcaaacacgacgcccaaataccccgaaatccgaattacccttcatatccaacatcgacacgcgatccaacgaatactaaccaacgaccaatttttcaaatcacgaaaataataaatacgccgcccgaaaaccactcgaaaatcgaaataacgatataataatcctcgcctaacgacacaaaaacgaatccgaattaaaaccgataaatatcgaattaaaatttccatattacctccgattaataaaatacgactatcgcgacgtcgaaacgacctcgccctacgccgcgcgatacttaatcaactaccgactaatacctccacgcgaacatcgataaacttataaaacgacaacataataaacatcccgcgtaaaacaccaccgacaccacgcaaaacaaaattttaataataaaaacacctcaaccgactacacgctactactaacgaaataat

SEQ ID NO: 5815 - DNA, 1360 bp, Artificial Sequence
  chemically treated genomic DNA (Homo sapiens) CpG-island No: 5815
aaaaatttagaatatgatgatatattatttttatatatgattttagagatttcggttcgtaagaagttcgggcgcgcggtgagcgagtcgaggggtcgtcgaacggaatgcgtagggtttgtagtttcgggttaagcgaattgcgtcgaaatcgtttcgttagttgttcggaacggttgtaggttgttcggtatttgcgggttttttacggttagttgcgcgtgtttgtcgttttttacgtcggttagtcgtcgcgttatttaatgcgggcgatgtcggtttcgcgtttcgcgggtagtagtcgcgttcgtcggaggttagtagcggtacgtcgggtagcgtagcgggcggttggtgaggtaggttatgtattatttattcgtatgcgttgtagtagcgagtcgtggtcgtttttttgtagcgggtttttcggtagggttagttggttattatcgttacgttcgggtgtagttcgtacggttcgttatatttttggaacgtagtattacgaaggcgtgttcgtagttggtgtcgtttcggcggttattaggtagtattatttcgcgtggcgatataggtgcgcgtttcggtgtagtagagcggcgtgtcggtaaatagcgtattgcgttcggggagagcgtgtcggtttgcgggttaaacgtttgtaatacgatggtgttgtcgggttgttgtggtggcgcggtttttacgggcggtagatatagtatttgggttatcgtcgtcgtggaatagggacgggttaaattcgtcgttgtttatgggattggttcgttttatggtttttcgatggagggcgcggtgacgaggagttgcggtcgtttttttacggcgagtcgataatttttacgtcggtgtaggtagttagaatttatcgtcggcgtagtttaggtacggcgtttagatgtttcggagttcgggttgttttttatgtttagtatcgatacgcggtttaacgggtgttgattagcgattagttttttaggttacgggagtggtagatgcgtcgttcgggaattattcgaaggtcgaggtggcgatgtagtagttttcgtttggcggtatagggacgggttcgggttgaagtcggtgagtatcgggttaggatttttatattgttttcggttaatgggatgcggttgtcgcggcgtcggaacggtttcgttttgcgtcgcgcggtgtttaattagttgtcggttgatgtttttacgcgggtatcggtgagtttgtagagcgatagtatgatgaatatttcgcgtagagtattatcggtattacgtagaatagaattttgatggtgggagtattttaatcggttgtacgttgttgttggcggaatagt

SEQ ID NO: 5816 - DNA, 1360 bp, Artificial Sequence
  chemically treated genomic DNA (Homo sapiens) CpG-island No: 5816
actattccgccaacaacaacgtacaaccgattaaaatactcccaccatcaaaattctattctacgtaataccgataatactctacgcgaaatattcatcatactatcgctctacaaactcaccgatacccgcgtaaaaacatcaaccgacaactaattaaacaccgcgcgacgcaaaacgaaaccgttccgacgccgcgacaaccgcatcccattaaccgaaaacaatataaaaatcctaacccgatactcaccgacttcaacccgaacccgtccctataccgccaaacgaaaactactacatcgccacctcgaccttcgaataattcccgaacgacgcatctaccactcccgtaacctaaaaaactaatcgctaatcaacacccgttaaaccgcgtatcgatactaaacataaaaaacaacccgaactccgaaacatctaaacgccgtacctaaactacgccgacgataaattctaactacctacaccgacgtaaaaattatcgactcgccgtaaaaaaacgaccgcaactcctcgtcaccgcgccctccatcgaaaaaccataaaacgaaccaatcccataaacaacgacgaatttaacccgtccctattccacgacgacgataacccaaatactatatctaccgcccgtaaaaaccgcgccaccacaacaacccgacaacaccatcgtattacaaacgtttaacccgcaaaccgacacgctctccccgaacgcaatacgctatttaccgacacgccgctctactacaccgaaacgcgcacctatatcgccacgcgaaataatactacctaataaccgccgaaacgacaccaactacgaacacgccttcgtaatactacgttccaaaaatataacgaaccgtacgaactacacccgaacgtaacgataataaccaactaaccctaccgaaaaacccgctacaaaaaaacgaccacgactcgctactacaacgcatacgaataaataatacataacctacctcaccaaccgcccgctacgctacccgacgtaccgctactaacctccgacgaacgcgactactacccgcgaaacgcgaaaccgacatcgcccgcattaaataacgcgacgactaaccgacgtaaaaaacgacaaacacgcgcaactaaccgtaaaaaacccgcaaataccgaacaacctacaaccgttccgaacaactaacgaaacgatttcgacgcaattcgcttaacccgaaactacaaaccctacgcattccgttcgacgacccctcgactcgctcaccgcgcgcccgaacttcttacgaaccgaaatctctaaaatcatatataaaaataatatatcatcatattctaaattttt

SEQ ID NO: 5817 - DNA, 687 bp, Artificial Sequence
  chemically treated genomic DNA (Homo sapiens) CpG-island No: 5817
  misc_feature (10)..(10): n is either a, c, g or t
  misc_feature (22)..(23): n is either a, c, g or t
  misc_feature (27)..(27): n is either a, c, g or t
  misc_feature (58)..(58): n is either a, c, g or t
  misc_feature (70)..(70): n is either a, c, g or t
  misc_feature (124)..(124): n is either a, c, g or t
  misc_feature (126)..(126): n is either a, c, g or t
  misc_feature (148)..(148): n is either a, c, g or t
  misc_feature (185)..(185): n is either a, c, g or t
  misc_feature (190)..(190): n is either a, c, g or t
  misc_feature (301)..(301): n is either a, c, g or t
  misc_feature (321)..(321): n is either a, c, g or t
  misc_feature (399)..(400): n is either a, c, g or t
  misc_feature (439)..(440): n is either a, c, g or t
  misc_feature (457)..(457): n is either a, c, g or t
  misc_feature (594)..(594): n is either a, c, g or t
gggcgggggnggcggggggggnngggngggggggtcgggggggcgggaaggggggggncggcgggggggnggggtcggggcgtttcggtcggggggggtcgggcgcgtcgcgggggcggggcgntncgcgggggtcggcgcggggcgnttcggggcgggcgggggcgggcgtcgggtcggggggngggtnggtcgtttcgggggcggcgcggggggcggggcgggggcgggggggggtcgttcgggtcgggcgcggggggcgggggggcgttcgcgcggggggtcggggcgcgcgtcgcgnggcggcggcgggggcgggtngcgggggcgcggcggggcggggcgcgcgcgggggggggcgcgggcgggcgggggggcgggcgcgggggggggcgcggnntcggttttcgggcggggcgggcgggcgttcgggggtcgnnggggttcggggggcgtntcgggcgtcggggcgggttcgcgttcgggcggggcgggggcgtcggggcgcggggggggggcggggggttcggggttcgcggcggcgggcggggggcggggtcggcgcggggggggggggtcgcgcggtcggtcgtnggcggggcgtttcggtcgggcgcgggcggggggggtagtttttatgtttgtaggtcgtgttgttttaagttggagtgtgtggtgtgattatag

SEQ ID NO: 5818 - DNA, 687 bp, Artificial Sequence
  chemically treated genomic DNA (Homo sapiens) CpG-island No: 5818
  misc_feature (94)..(94): n is either a, c, g or t
  misc_feature (231)..(231): n is either a, c, g or t
  misc_feature (248)..(249): n is either a, c, g or t
  misc_feature (288)..(289): n is either a, c, g or t
  misc_feature (367)..(367): n is either a, c, g or t
  misc_feature (387)..(387): n is either a, c, g or t
  misc_feature (498)..(498): n is either a, c, g or t
  misc_feature (503)..(503): n is either a, c, g or t
  misc_feature (540)..(540): n is either a, c, g or t
  misc_feature (562)..(562): n is either a, c, g or t
  misc_feature (564)..(564): n is either a, c, g or t
  misc_feature (618)..(618): n is either a, c, g or t
  misc_feature (630)..(630): n is either a, c, g or t
  misc_feature (661)..(661): n is either a, c, g or t
  misc_feature (665)..(666): n is either a, c, g or t
  misc_feature (678)..(678): n is either a, c, g or t
ctataatcacaccacacactccaacttaaaacaacacgacctacaaacataaaaactaccccccccgcccgcgcccgaccgaaacgccccgccnacgaccgaccgcgcgaccccccccccccgcgccgaccccgccccccgcccgccgccgcgaaccccgaaccccccgccccccccccgcgccccgacgcccccgccccgcccgaacgcgaacccgccccgacgcccganacgccccccgaaccccnncgacccccgaacgcccgcccgccccgcccgaaaaccgannccgcgcccccccccgcgcccgcccccccgcccgcccgcgcccccccccgcgcgcgccccgccccgccgcgcccccgcnacccgcccccgccgccgccncgcgacgcgcgccccgaccccccgcgcgaacgcccccccgccccccgcgcccgacccgaacgacccccccccgcccccgccccgccccccgcgccgcccccgaaacgaccnacccnccccccgacccgacgcccgcccccgcccgccccgaancgccccgcgccgacccccgcgnancgccccgcccccgcgacgcgcccgaccccccccgaccgaaacgccccgaccccncccccccgccgnccccccccttcccgcccccccgacccccccncccnnccccccccgccncccccgccc

SEQ ID NO: 5819 - DNA, 687 bp, Artificial Sequence
  chemically treated genomic DNA (Homo sapiens) CpG-island No: 5819
  misc_feature (94)..(94): n is either a, c, g or t
  misc_feature (231)..(231): n is either a, c, g or t
  misc_feature (248)..(249): n is either a, c, g or t
  misc_feature (288)..(289): n is either a, c, g or t
  misc_feature (367)..(367): n is either a, c, g or t
  misc_feature (387)..(387): n is either a, c, g or t
  misc_feature (498)..(498): n is either a, c, g or t
  misc_feature (503)..(503): n is either a, c, g or t
  misc_feature (540)..(540): n is either a, c, g or t
  misc_feature (562)..(562): n is either a, c, g or t
  misc_feature (564)..(564): n is either a, c, g or t
  misc_feature (618)..(618): n is either a, c, g or t
  misc_feature (630)..(630): n is either a, c, g or t
  misc_feature (661)..(661): n is either a, c, g or t
  misc_feature (665)..(666): n is either a, c, g or t
  misc_feature (678)..(678): n is either a, c, g or t
ttgtgattatattatatattttagtttgaggtaatacgatttgtaggtatgaaagttgtttttttcgttcgcgttcggtcggggcgtttcgttngcggtcggtcgcgcggtttttttttttcgcgtcggtttcgtttttcgttcgtcgtcgcgggtttcgggtttttcgtttttttttcgcgtttcggcgttttcgtttcgttcgggcgcgggttcgtttcggcgttcggngcgtttttcgggttttnncggttttcgggcgttcgttcgtttcgttcgggggtcggnntcgcgttttttttcgcgttcgttttttcgttcgttcgcgttttttttcgcgcgcgtttcgtttcgtcgcgttttcgtngttcgttttcgtcgtcgttncgcggcgcgcgtttcggtttttcgcgcgggcgttttttcgtttttcgcgttcggttcgggcggttttttttcgttttcgtttcgtttttcgcgtcgttttcggggcggttngtttntttttcggttcggcgttcgttttcgttcgtttcgggncgtttcgcgtcggttttcgcgngncgtttcgttttcgcggcgcgttcggtttttttcggtcggggcgtttcggttttnttttttcgtcgnttttttttttttcgttttttcggtttttttntttnntttttttcgttnttttcgttt

SEQ ID NO: 5820 - DNA, 687 bp, Artificial Sequence
  chemically treated genomic DNA (Homo sapiens) CpG-island No: 5820
  misc_feature (10)..(10): n is either a, c, g or t
  misc_feature (22)..(23): n is either a, c, g or t
  misc_feature (27)..(27): n is either a, c, g or t
  misc_feature (58)..(58): n is either a, c, g or t
  misc_feature (70)..(70): n is either a, c, g or t
  misc_feature (124)..(124): n is either a, c, g or t
  misc_feature (126)..(126): n is either a, c, g or t
  misc_feature (148)..(148): n is either a, c, g or t
  misc_feature (185)..(185): n is either a, c, g or t
  misc_feature (190)..(190): n is either a, c, g or t
  misc_feature (301)..(301): n is either a, c, g or t
  misc_feature (321)..(321): n is either a, c, g or t
  misc_feature (399)..(400): n is either a, c, g or t
  misc_feature (439)..(440): n is either a, c, g or t
  misc_feature (457)..(457): n is either a, c, g or t
  misc_feature (594)..(594): n is either a, c, g or t
aaacgaaaanaacgaaaaaaannaaanaaaaaaaccgaaaaaacgaaaaaaaaaaaancgacgaaaaaanaaaaccgaaacgccccgaccgaaaaaaaccgaacgcgccgcgaaaacgaaacgncncgcgaaaaccgacgcgaaacgncccgaaacgaacgaaaacgaacgccgaaccgaaaaanaaacnaaccgccccgaaaacgacgcgaaaaacgaaacgaaaacgaaaaaaaaccgcccgaaccgaacgcgaaaaacgaaaaaacgcccgcgcgaaaaaccgaaacgcgcgccgcgnaacgacgacgaaaacgaacnacgaaaacgcgacgaaacgaaacgcgcgcgaaaaaaaacgcgaacgaacgaaaaaacgaacgcgaaaaaaaacgcgannccgacccccgaacgaaacgaacgaacgcccgaaaaccgnnaaaacccgaaaaacgcnccgaacgccgaaacgaacccgcgcccgaacgaaacgaaaacgccgaaacgcgaaaaaaaaacgaaaaacccgaaacccgcgacgacgaacgaaaaacgaaaccgacgcgaaaaaaaaaaaccgcgcgaccgaccgcnaacgaaacgccccgaccgaacgcgaacgaaaaaaacaactttcatacctacaaatcgtattacctcaaactaaaatatataatataatcacaa

SEQ ID NO: 5821 - DNA, 505 bp, Artificial Sequence
  chemically treated genomic DNA (Homo sapiens) CpG-island No: 5821
ggcgaagttcgggcggtgtagagagtcggggtatagagtaggtaggtgttaatggtatgggaaggaagagtaagaagtggggtaagaaggtgtcgcggtacgaggggaaggtgagatttaagaaggtgtcggttaagaagttggtgtcggcgtggaaggagaaggtgtggggcgaggaaataacgaagggcgaggaaagatttcgaggcgaagagatagtttttatcgagaaggggtagggcgaggaggaggggcgttattagagggcgggacggggcgacgggttcgcgcgggaagaattaatcgtcgagaattcggggaaggaacgggtttataaagattaagtggaggagtaggggcgcggttaggagcggaagtagagtgaggagtaagtttcgggcgagaaacgggggttcggtcgggagtaagagtaggggcggggtcgggagtaagagtagggcggggttcggagacgggcgagattaggtatagtatttagtttttg

SEQ ID NO: 5822 - DNA, 505 bp, Artificial Sequence
  chemically treated genomic DNA (Homo sapiens) CpG-island No: 5822
caaaaactaaatactatacctaatctcgcccgtctccgaaccccgccctactcttactcccgaccccgcccctactcttactcccgaccgaacccccgtttctcgcccgaaacttactcctcactctacttccgctcctaaccgcgcccctactcctccacttaatctttataaacccgttccttccccgaattctcgacgattaattcttcccgcgcgaacccgtcgccccgtcccgccctctaataacgcccctcctcctcgccctaccccttctcgataaaaactatctcttcgcctcgaaatctttcctcgcccttcgttatttcctcgccccacaccttctccttccacgccgacaccaacttcttaaccgacaccttcttaaatctcaccttcccctcgtaccgcgacaccttcttaccccacttcttactcttccttcccataccattaacacctacctactctataccccgactctctacaccgcccgaacttcgcc

SEQ ID NO: 5823 - DNA, 505 bp, Artificial Sequence
  chemically treated genomic DNA (Homo sapiens) CpG-island No: 5823
taggggttgggtattgtatttggtttcgttcgttttcgggtttcgttttgtttttgttttcggtttcgtttttgtttttgttttcggtcgggttttcgtttttcgttcggggtttgttttttattttgttttcgtttttgatcgcgtttttatttttttatttggtttttatggattcgtttttttttcgggttttcggcgattggtttttttcgcgcgggttcgtcgtttcgtttcgttttttggtaacgtttttttttttcgttttgttttttttcgatgaaaattgttttttcgtttcgggattttttttcgtttttcgttgttttttcgttttatattttttttttttacgtcggtattagttttttagtcggtatttttttgagttttatttttttttcgtatcgcgatatttttttgttttattttttattttttttttttatgttattaatatttgtttgttttatatttcgattttttgtatcgttcggatttcgtt

SEQ ID NO: 5824 - DNA, 505 bp, Artificial Sequence
  chemically treated genomic DNA (Homo sapiens) CpG-island No: 5824
aacgaaatccgaacgatacaaaaaatcgaaatataaaacaaacaaatattaataacataaaaaaaaaaaataaaaaataaaacaaaaaaatatcgcgatacgaaaaaaaaataaaactcaaaaaaataccgactaaaaaactaataccgacgtaaaaaaaaaaaatataaaacgaaaaaacaacgaaaaacgaaaaaaaatcccgaaacgaaaaaacaattttcatcgaaaaaaaacaaaacgaaaaaaaaaaacgttaccaaaaaacgaaacgaaacgacgaacccgcgcgaaaaaaaccaatcgccgaaaacccgaaaaaaaaacgaatccataaaaaccaaataaaaaaataaaaacgcgatcaaaaacgaaaacaaaataaaaaacaaaccccgaacgaaaaacgaaaacccgaccgaaaacaaaaacaaaaacgaaaccgaaaacaaaaacaaaacgaaacccgaaaacgaacgaaaccaaatacaatacccaaccccta

SEQ ID NO: 5825 - DNA, 757 bp, Artificial Sequence
  chemically treated genomic DNA (Homo sapiens) CpG-island No: 5825
cggcggggcggaatagtcgaggaataggggttggtagaatattttaaggttgggggcggataattataaggtgcgattatacgaggggggggcgggttagatataatagggcgaacggattatttaaagcgatttagataaaaaaggcgggtaaatttttcgggtagtcggataaaaaggcggataaataagggtcggtggaagtttgtatgtttgtaggtttaggcgcggacgatagttattgtcgaaaattattttttcgtcgttggcgcggtattcgcgtagtagggaaagtagtttttcgcggttggtcgggtttaagatcgttaggttaatttcgtttaggtagagataatcgaaattcgttagtttttcgtaaatcgtcgtagattgtttattttttagttagaatttggcggcggtttcgtttcgttagtagtagaacgtacgttcgtcggtgttgtcggttttaatgtagtaaaggttcggtagacggttttttattcgttgggttagggaagtattaacgttttcgtcgtgttaggcgtttagtatttgttggttaaaattgttcgtttttagcgtcgttacgtaatgaacggttaatgtcgtaggatcgatttgacgggcgatatagacggaagtgtttagggtatcgtcgtcgaaatcgcgtttaacgttcgcgtttttttcggaaagtttaattatgtattcgttaattacggtaatttttttggatatagtcgtgaatttgatt

SEQ ID NO: 5826 - DNA, 757 bp, Artificial Sequence
  chemically treated genomic DNA (Homo sapiens) CpG-island No: 5826
aatcaaattcacgactatatccaaaaaaattaccgtaattaacgaatacataattaaactttccgaaaaaaacgcgaacgttaaacgcgatttcgacgacgataccctaaacacttccgtctatatcgcccgtcaaatcgatcctacgacattaaccgttcattacgtaacgacgctaaaaacgaacaattttaaccaacaaatactaaacgcctaacacgacgaaaacgttaatacttccctaacccaacgaataaaaaaccgtctaccgaacctttactacattaaaaccgacaacaccgacgaacgtacgttctactactaacgaaacgaaaccgccgccaaattctaactaaaaaataaacaatctacgacgatttacgaaaaactaacgaatttcgattatctctacctaaacgaaattaacctaacgatcttaaacccgaccaaccgcgaaaaactactttccctactacgcgaataccgcgccaacgacgaaaaaataattttcgacaataactatcgtccgcgcctaaacctacaaacatacaaacttccaccgacccttatttatccgcctttttatccgactacccgaaaaatttacccgccttttttatctaaatcgctttaaataatccgttcgccctattatatctaacccgcccccccctcgtataatcgcaccttataattatccgcccccaaccttaaaatattctaccaacccctattcctcgactattccgccccgccg

SEQ ID NO: 5827 - DNA, 757 bp, Artificial Sequence
  chemically treated genomic DNA (Homo sapiens) CpG-island No: 5827
gattaggtttacgattatgtttaaaaagattgtcgtgattggcgaatgtatgattgagtttttcgagaaaggcgcggacgttaagcgcggtttcggcggcgatattttgaatattttcgtttatatcgttcgttaggtcgattttgcggtattaatcgtttattacgtaacggcgttgggaacggatagttttagttagtagatgttggacgtttggtacggcgagaacgttgatatttttttgatttaacggatggaaaatcgtttgtcgggtttttattatattgaaatcgatagtatcggcgagcgtacgttttattattggcggaacgaagtcgtcgttaaattttggttggagagtgagtagtttgcggcgatttgcgaagagttggcgaatttcgattatttttatttgagcgggattagtttggcgattttaagttcgattagtcgcgaaaagttgttttttttgttgcgcgaatgtcgcgttaacggcggaaaagtgattttcgataataattatcgttcgcgtttggatttgtaggtatgtaaatttttatcgatttttgtttgttcgtttttttgttcggttgttcgaagaatttattcgttttttttgtttgggtcgttttgaatggttcgttcgttttgttatgtttggttcgtttttttttcgtgtaatcgtattttgtaattgttcgtttttagttttaaaatgttttgttaatttttgtttttcggttgtttcgtttcgtcg

SEQ ID NO: 5828 - DNA, 757 bp, Artificial Sequence
  chemically treated genomic DNA (Homo sapiens) CpG-island No: 5828
cgacgaaacgaaacaaccgaaaaacaaaaattaacaaaacattttaaaactaaaaacgaacaattacaaaatacgattacacgaaaaaaaaacgaaccaaacataacaaaacgaacgaaccattcaaaacgacccaaacaaaaaaaacgaataaattcttcgaacaaccgaacaaaaaaacgaacaaacaaaaatcgataaaaatttacatacctacaaatccaaacgcgaacgataattattatcgaaaatcacttttccgccgttaacgcgacattcgcgcaacaaaaaaaacaacttttcgcgactaatcgaacttaaaatcgccaaactaatcccgctcaaataaaaataatcgaaattcgccaactcttcgcaaatcgccgcaaactactcactctccaaccaaaatttaacgacgacttcgttccgccaataataaaacgtacgctcgccgatactatcgatttcaatataataaaaacccgacaaacgattttccatccgttaaatcaaaaaaatatcaacgttctcgccgtaccaaacgtccaacatctactaactaaaactatccgttcccaacgccgttacgtaataaacgattaataccgcaaaatcgacctaacgaacgatataaacgaaaatattcaaaatatcgccgccgaaaccgcgcttaacgtccgcgcctttctcgaaaaactcaatcatacattcgccaatcacgacaatctttttaaacataatcgtaaacctaatc

SEQ ID NO: 5829 - DNA, 584 bp, Artificial Sequence
  chemically treated genomic DNA (Homo sapiens) CpG-island No: 5829
ggacggggatggggttgtagagtgttatggttcgcgttttttgcgttattgattgtttgtatattttttgcgtttcgggttgttcgttttgtcggttgttttcggtttttcgttcgttttcgttgtttacgattatttcggcggttgtttcggagttttttttttcgtagcgggtcggtatttcgttttcgaagcgggttattttgtaaagagtaaagggtttcgggttacgttgcggcgaacgatgcggaagacgtcgtcgtcgtcgtcgtcgtcgttgatgttgaggttgtcggggttgggagcgcggcggttggagttacgattgcggagacgttttacggtttagtttatcgggcggcggcggttcggcgtttcgggtcgggggtttagaaggcggttgttcgggtcgagtcggggatagtagttcgggatatttttttggttgatttcggagaaggaggggcgggaggagggtgcgggggcggggcgcgggggttcggggaggaggggggaggggagagagaagcgaggtaaaaaataatcgaggaaggaatttaggtaatttttagtttatttatttt

SEQ ID NO: 5830 - DNA, 584 bp, Artificial Sequence
  chemically treated genomic DNA (Homo sapiens) CpG-island No: 5830
aaaataaataaactaaaaattacctaaattccttcctcgattattttttacctcgcttctctctcccctcccccctcctccccgaacccccgcgccccgcccccgcaccctcctcccgcccctccttctccgaaatcaaccaaaaaaatatcccgaactactatccccgactcgacccgaacaaccgccttctaaacccccgacccgaaacgccgaaccgccgccgcccgataaactaaaccgtaaaacgtctccgcaatcgtaactccaaccgccgcgctcccaaccccgacaacctcaacatcaacgacgacgacgacgacgacgacgtcttccgcatcgttcgccgcaacgtaacccgaaaccctttactctttacaaaataacccgcttcgaaaacgaaataccgacccgctacgaaaaaaaaaactccgaaacaaccgccgaaataatcgtaaacaacgaaaacgaacgaaaaaccgaaaacaaccgacaaaacgaacaacccgaaacgcaaaaaatatacaaacaatcaataacgcaaaaaacgcgaaccataacactctacaaccccatccccgtcc

SEQ ID NO: 5831 - DNA, 584 bp, Artificial Sequence
  chemically treated genomic DNA (Homo sapiens) CpG-island No: 5831
ggagtgggtggattggggattgtttggatttttttttcggttattttttgtttcgtttttttttttttttttttttttttttcgggttttcgcgtttcgttttcgtatttttttttcgttttttttttttcggggttagttaggaagatgtttcgagttgttattttcggttcggttcgggtagtcgttttttgagttttcgattcgaggcgtcgagtcgtcgtcgttcgatgggttgggtcgtggagcgttttcgtagtcgtagttttagtcgtcgcgtttttagtttcggtagttttagtattagcggcggcggcggcggcggcggcgtttttcgtatcgttcgtcgtagcgtaattcggagttttttgttttttgtagaatggttcgtttcggagacgagatgtcggttcgttacgggggaggaggtttcggggtagtcgtcggggtggtcgtgggtagcggaggcgggcgaggagtcgggggtagtcggtagggcgggtagttcggggcgtaaaggatgtataagtagttaatggcgtagagagcgcggattatggtattttataattttattttcgttt

SEQ ID NO: 5832 - DNA, 584 bp, Artificial Sequence
  chemically treated genomic DNA (Homo sapiens) CpG-island No: 5832
aaacgaaaataaaattataaaataccataatccgcgctctctacgccattaactacttatacatcctttacgccccgaactacccgccctaccgactacccccgactcctcgcccgcctccgctacccacgaccaccccgacgactaccccgaaacctcctcccccgtaacgaaccgacatctcgtctccgaaacgaaccattctacaaaaaacaaaaaactccgaattacgctacgacgaacgatacgaaaaacgccgccgccgccgccgccgccgctaatactaaaactaccgaaactaaaaacgcgacgactaaaactacgactacgaaaacgctccacgacccaacccatcgaacgacgacgactcgacgcctcgaatcgaaaactcaaaaaacgactacccgaaccgaaccgaaaataacaactcgaaacatcttcctaactaaccccgaaaaaaaaaaaacgaaaaaaaaatacgaaaacgaaacgcgaaaacccgaaaaaaaaaaaaaaaaaaaaaaaaaaacgaaacaaaaaataaccgaaaaaaaaatccaaacaatccccaatccacccactcc

SEQ ID NO: 5833 - DNA, 562 bp, Artificial Sequence
  chemically treated genomic DNA (Homo sapiens) CpG-island No: 5833
  misc_feature (529)..(529): n is either a, c, g or t
  misc_feature (540)..(540): n is either a, c, g or t
  misc_feature (548)..(548): n is either a, c, g or t
  misc_feature (559)..(561): n is either a, c, g or t
cgtcgtcgcgttaatggtaaacgttagtttagtaggtttcgtatcgattatcgttagattttttttttgtacggcgggaaggattggtattttggtttcgtggtaggcgcgaggatttattaggtacgaggtgattttgttaacgaagatttgatcgagataggtttgattgtagttaatataagtgttgattttatcggttcgtttcgattgcgtttttgatagtagtttcgtattagtaagaaacggtcgcgttatcgatattatatcggtatcgtcgcgcgagagaatatcgtcggtaatttgcggatcgttaattcggttggtggttattagcggtagcgagacgtggttttttagtttgcgcgtgatttatttaaatgcgtcgcgcggtacgggcgtggtaatggtcggaatacgtgttttatgttagttaatgtcggtgttgataatggtcgcgttcgtcgttttaatggtttgcgttagttttatcgtttcggtaaaagtttcgtcgttttcgattaagttncggggaggaantttgattnattttagaaannnt

SEQ ID NO: 5834 - DNA, 562 bp, Artificial Sequence
  chemically treated genomic DNA (Homo sapiens) CpG-island No: 5834
  misc_feature (2)..(4): n is either a, c, g or t
  misc_feature (15)..(15): n is either a, c, g or t
  misc_feature (23)..(23): n is either a, c, g or t
  misc_feature (34)..(34): n is either a, c, g or t
annntttctaaaatnaatcaaanttcctccccgnaacttaatcgaaaacgacgaaacttttaccgaaacgataaaactaacgcaaaccattaaaacgacgaacgcgaccattatcaacaccgacattaactaacataaaacacgtattccgaccattaccacgcccgtaccgcgcgacgcatttaaataaatcacgcgcaaactaaaaaaccacgtctcgctaccgctaataaccaccaaccgaattaacgatccgcaaattaccgacgatattctctcgcgcgacgataccgatataatatcgataacgcgaccgtttcttactaatacgaaactactatcaaaaacgcaatcgaaacgaaccgataaaatcaacacttatattaactacaatcaaacctatctcgatcaaatcttcgttaacaaaatcacctcgtacctaataaatcctcgcgcctaccacgaaaccaaaataccaatccttcccgccgtacaaaaaaaaaatctaacgataatcgatacgaaacctactaaactaacgtttaccattaacgcgacgacg

SEQ ID NO: 5835 - DNA, 562 bp, Artificial Sequence
  chemically treated genomic DNA (Homo sapiens) CpG-island No: 5835
  misc_feature (2)..(4): n is either a, c, g or t
  misc_feature (15)..(15): n is either a, c, g or t
  misc_feature (23)..(23): n is either a, c, g or t
  misc_feature (34)..(34): n is either a, c, g or t
annntttttagggtnaattaaanttttttttcgngatttggtcgaagacggcgggatttttgtcgaaacggtagagttggcgtaggttattgaagcggcgggcgcgattattattaatatcggtattggttggtatgaagtacgtatttcgattattgttacgttcgtgtcgcgcggcgtatttagatgggttacgcgtaaattgaaaggttacgtttcgttgtcgttggtaattattaatcggattaacgattcgtaggttgtcgacgatattttttcgcgcggcgatgtcgatatggtatcgatggcgcgatcgttttttgttgatgcggagttgttgttaaaagcgtaatcgggacgagtcgatgagattaatatttgtattggttgtaattaggtttgtttcgattaaattttcgttggtaaagttatttcgtgtttggtgaattttcgcgtttgttacgaaattaaaatgttaatttttttcgtcgtgtagaaaaaaaatttggcggtggtcggtgcgggatttgttgggttggcgtttgttattaacgcggcggcg

SEQ ID NO: 5836 - DNA, 562 bp, Artificial Sequence
  chemically treated genomic DNA (Homo sapiens) CpG-island No: 5836
  misc_feature (529)..(529): n is either a, c, g or t
  misc_feature (540)..(540): n is either a, c, g or t
  misc_feature (548)..(548): n is either a, c, g or t
  misc_feature (559)..(561): n is either a, c, g or t
cgccgccgcgttaataacaaacgccaacccaacaaatcccgcaccgaccaccgccaaattttttttctacacgacgaaaaaaattaacattttaatttcgtaacaaacgcgaaaattcaccaaacacgaaataactttaccaacgaaaatttaatcgaaacaaacctaattacaaccaatacaaatattaatctcatcgactcgtcccgattacgcttttaacaacaactccgcatcaacaaaaaacgatcgcgccatcgataccatatcgacatcgccgcgcgaaaaaatatcgtcgacaacctacgaatcgttaatccgattaataattaccaacgacaacgaaacgtaacctttcaatttacgcgtaacccatctaaatacgccgcgcgacacgaacgtaacaataatcgaaatacgtacttcataccaaccaataccgatattaataataatcgcgcccgccgcttcaataacctacgccaactctaccgtttcgacaaaaatcccgccgtcttcgaccaaatcncgaaaaaaaantttaattnaccctaaaaannnt

SEQ ID NO: 5837 - DNA, 568 bp, Artificial Sequence
  chemically treated genomic DNA (Homo sapiens) CpG-island No: 5837
gcgcgcgggaaatatagtttttgagggtgtgagagttagtattttttatacgagcgttgcgaattggagttagtatgtgagacgagaatcgaacggtgggaaaagcggtttgtaaaagggtatcggcgttagtgtgaaattcgtttttatatttgcgtatagtagtgatcgattgtcgatcgaaacgcgatacgcgtatcgtgtaattttgagagtagttttcgatacgatatgttacgtaaatttgatcgatttttgttacgtatttaagtttttatttttcgcggtatgattattgatcgttttggtcgttcgttagcggtgagcgtgtcggtaaaagcgatttgggttgattcgaaagaagtgtatgacgttggcggtattagcgacggtgatcgttggaaggcgttggttaacgcgtttaatatttcgttggattagtttttagttcgtattaacgttaattcgaaagggcgttttatttatttggcgcgttaggtgaattttgatatggcggattatattaaaaaattgaaattgtcggggatttatttgcgtgaagaatttt

SEQ ID NO: 5838 - DNA, 568 bp, Artificial Sequence
  chemically treated genomic DNA (Homo sapiens) CpG-island No: 5838
aaaattcttcacgcaaataaatccccgacaatttcaattttttaatataatccgccatatcaaaattcacctaacgcgccaaataaataaaacgccctttcgaattaacgttaatacgaactaaaaactaatccaacgaaatattaaacgcgttaaccaacgccttccaacgatcaccgtcgctaataccgccaacgtcatacacttctttcgaatcaacccaaatcgcttttaccgacacgctcaccgctaacgaacgaccaaaacgatcaataatcataccgcgaaaaataaaaacttaaatacgtaacaaaaatcgatcaaatttacgtaacatatcgtatcgaaaactactctcaaaattacacgatacgcgtatcgcgtttcgatcgacaatcgatcactactatacgcaaatataaaaacgaatttcacactaacgccgatacccttttacaaaccgcttttcccaccgttcgattctcgtctcacatactaactccaattcgcaacgctcgtataaaaaatactaactctcacaccctcaaaaactatatttcccgcgcgc

SEQ ID NO: 5839 - DNA, 568 bp, Artificial Sequence
  chemically treated genomic DNA (Homo sapiens) CpG-island No: 5839
gagattttttacgtagatgaattttcggtagttttagttttttgatgtagttcgttatgttagggtttatttgacgcgttagataaataaagcgttttttcgggttggcgttaatgcgggttgaaagttgatttagcggaatattgagcgcgttagttagcgttttttagcggttatcgtcgttgatatcgttagcgttatgtatttttttcgggttagtttaaatcgtttttatcggtacgtttatcgttaacgggcgattagaacggttagtaattatgtcgcgggaggtggaaatttgggtacgtagtaagggtcgattaaatttgcgtgatatgtcgtgtcgaggattatttttaggattatacggtgcgcgtatcgcgtttcggtcggtagtcgattattgttgtgcgtaaatgtgagggcgggttttatattgacgtcgatgtttttttatagatcgttttttttatcgttcggttttcgttttatatgttggttttagttcgtagcgttcgtgtgaagagtgttggtttttatatttttaaaaattgtgtttttcgcgcgt

SEQ ID NO: 5840 - DNA, 568 bp, Artificial Sequence
  chemically treated genomic DNA (Homo sapiens) CpG-island No: 5840
acgcgcgaaaaacacaatttttaaaaatataaaaaccaacactcttcacacgaacgctacgaactaaaaccaacatataaaacgaaaaccgaacgataaaaaaaacgatctataaaaaaacatcgacgtcaatataaaacccgccctcacatttacgcacaacaataatcgactaccgaccgaaacgcgatacgcgcaccgtataatcctaaaaataatcctcgacacgacatatcacgcaaatttaatcgacccttactacgtacccaaatttccacctcccgcgacataattactaaccgttctaatcgcccgttaacgataaacgtaccgataaaaacgatttaaactaacccgaaaaaaatacataacgctaacgatatcaacgacgataaccgctaaaaaacgctaactaacgcgctcaatattccgctaaatcaactttcaacccgcattaacgccaacccgaaaaaacgctttatttatctaacgcgtcaaataaaccctaacataacgaactacatcaaaaaactaaaactaccgaaaattcatctacgtaaaaaatctc

SEQ ID NO: 5841 - DNA, 572 bp, Artificial Sequence
  chemically treated genomic DNA (Homo sapiens) CpG-island No: 5841
gtagtttttgtcgtttcgtttatttgtatatggtaggtttcgtttttagcgtttagtttcgttatatcgtttattattagtacgcggtagttcggtattttagttagtatttggattgttgtagttattgaatcgatattggcgttgtaggagtcgtcgagtagtaattggttttttgttagttggatggggaatagacggtttggaatagtttttagatttgttagtttcgttttgatagtattaagcgttgcgtttacggatatggagagcgtagcggttgttagcgtattcgtaatattgtgacgtttcggtaacggtagtagaatatcgacgttatcggttggggtttgtagggtaaatttcgtatcgtgcgaggttatatggatattggtggcggtgaaatcgttgttggcggtattgggtgagaaacgttatattttgcgtgagttaattacgttttgttagtttagttagtcgttgttgttcgcgtttataatggcgatatcgttttttgtacgtttattttaaggatttttttgttgtttgttgaaattttaataatatgtaga

SEQ ID NO: 5842 - DNA, 572 bp, Artificial Sequence
  chemically treated genomic DNA (Homo sapiens) CpG-island No: 5842
tctacatattattaaaatttcaacaaacaacaaaaaaatccttaaaataaacgtacaaaaaacgatatcgccattataaacgcgaacaacaacgactaactaaactaacaaaacgtaattaactcacgcaaaatataacgtttctcacccaataccgccaacaacgatttcaccgccaccaatatccatataacctcgcacgatacgaaatttaccctacaaaccccaaccgataacgtcgatattctactaccgttaccgaaacgtcacaatattacgaatacgctaacaaccgctacgctctccatatccgtaaacgcaacgcttaatactatcaaaacgaaactaacaaatctaaaaactattccaaaccgtctattccccatccaactaacaaaaaaccaattactactcgacgactcctacaacgccaatatcgattcaataactacaacaatccaaatactaactaaaataccgaactaccgcgtactaataataaacgatataacgaaactaaacgctaaaaacgaaacctaccatatacaaataaacgaaacgacaaaaactac

SEQ ID NO: 5843 - DNA, 572 bp, Artificial Sequence
  chemically treated genomic DNA (Homo sapiens) CpG-island No: 5843
tttgtatattgttggagttttagtaggtaataaggggatttttagagtaagcgtgtaggaggcggtatcgttattatgaacgcggataataacgattggttgaattggtagagcgtaattggtttacgtaaagtgtggcgttttttatttaatgtcgttaatagcgattttatcgttattaatatttatgtgatttcgtacggtacggaatttattttataaattttaatcggtagcgtcgatgttttgttgtcgttgtcggggcgttataatattgcgaatgcgttggtagtcgttgcgttttttatgttcgtgggcgtaacgtttgatgttattaaagcggggttggtaaatttgaaagttgttttaggtcgtttgttttttatttaattggtagaaaattagttgttgttcgacgatttttataacgttaatgtcggtttaatgattgtagtagtttaggtattggttgaaatgtcgggttatcgcgtgttggtggtgggcgatatggcggaattgggcgttgaaagcgaagtttgttatgtataggtgggcgaggcggtaaaagttgt

SEQ ID NO: 5844 - DNA, 572 bp, Artificial Sequence
  chemically treated genomic DNA (Homo sapiens) CpG-island No: 5844
acaacttttaccgcctcgcccacctatacataacaaacttcgctttcaacgcccaattccgccatatcgcccaccaccaacacgcgataacccgacatttcaaccaatacctaaactactacaatcattaaaccgacattaacgttataaaaatcgtcgaacaacaactaattttctaccaattaaataaaaaacaaacgacctaaaacaactttcaaatttaccaaccccgctttaataacatcaaacgttacgcccacgaacataaaaaacgcaacgactaccaacgcattcgcaatattataacgccccgacaacgacaacaaaacatcgacgctaccgattaaaatttataaaataaattccgtaccgtacgaaatcacataaatattaataacgataaaatcgctattaacgacattaaataaaaaacgccacactttacgtaaaccaattacgctctaccaattcaaccaatcgttattatccgcgttcataataacgataccgcctcctacacgcttactctaaaaatccccttattacctactaaaactccaacaatatacaaa

SEQ ID NO: 5845 - DNA, 1951 bp, Artificial Sequence
  chemically treated genomic DNA (Homo sapiens) CpG-island No: 5845
  misc_feature (1)..(1): n is either a, c, g or t
  misc_feature (4)..(4): n is either a, c, g or t
  misc_feature (8)..(9): n is either a, c, g or t
  misc_feature (12)..(12): n is either a, c, g or t
  misc_feature (14)..(14): n is either a, c, g or t
  misc_feature (16)..(16): n is either a, c, g or t
  misc_feature (18)..(19): n is either a, c, g or t
  misc_feature (21)..(22): n is either a, c, g or t
  misc_feature (31)..(32): n is either a, c, g or t
  misc_feature (39)..(39): n is either a, c, g or t
  misc_feature (42)..(42): n is either a, c, g or t
  misc_feature (45)..(45): n is either a, c, g or t
  misc_feature (48)..(49): n is either a, c, g or t
  misc_feature (54)..(54): n is either a, c, g or t
  misc_feature (57)..(58): n is either a, c, g or t
  misc_feature (66)..(67): n is either a, c, g or t
  misc_feature (92)..(92): n is either a, c, g or t
  misc_feature (94)..(94): n is either a, c, g or t
  misc_feature (99)..(99): n is either a, c, g or t
  misc_feature (104)..(105): n is either a, c, g or t
  misc_feature (111)..(112): n is either a, c, g or t
  misc_feature (121)..(121): n is either a, c, g or t
  misc_feature (128)..(128): n is either a, c, g or t
  misc_feature (131)..(132): n is either a, c, g or t
  misc_feature (147)..(148): n is either a, c, g or t
  misc_feature (163)..(163): n is either a, c, g or t
  misc_feature (166)..(166): n is either a, c, g or t
  misc_feature (168)..(169): n is either a, c, g or t
  misc_feature (172)..(172): n is either a, c, g or t
  misc_feature (176)..(176): n is either a, c, g or t
  misc_feature (181)..(181): n is either a, c, g or t
  misc_feature (186)..(186): n is either a, c, g or t
  misc_feature (195)..(195): n is either a, c, g or t
  misc_feature (202)..(202): n is either a, c, g or t
  misc_feature (205)..(205): n is either a, c, g or t
  misc_feature (217)..(218): n is either a, c, g or t
  misc_feature (220)..(220): n is either a, c, g or t
  misc_feature (223)..(224): n is either a, c, g or t
  misc_feature (226)..(226): n is either a, c, g or t
  misc_feature (228)..(229): n is either a, c, g or t
  misc_feature (231)..(234): n is either a, c, g or t
  misc_feature (239)..(239): n is either a, c, g or t
  misc_feature (243)..(245): n is either a, c, g or t
  misc_feature (247)..(247): n is either a, c, g or t
  misc_feature (254)..(254): n is either a, c, g or t
  misc_feature (256)..(257): n is either a, c, g or t
  misc_feature (266)..(266): n is either a, c, g or t
  misc_feature (281)..(281): n is either a, c, g or t
  misc_feature (285)..(285): n is either a, c, g or t
  misc_feature (319)..(319): n is either a, c, g or t
  misc_feature (322)..(322): n is either a, c, g or t
  misc_feature (324)..(324): n is either a, c, g or t
  misc_feature (329)..(329): n is either a, c, g or t
  misc_feature (343)..(344): n is either a, c, g or t
  misc_feature (348)..(348): n is either a, c, g or t
  misc_feature (355)..(356): n is either a, c, g or t
  misc_feature (391)..(391): n is either a, c, g or t
  misc_feature (396)..(396): n is either a, c, g or t
  misc_feature (429)..(429): n is either a, c, g or t
  misc_feature (447)..(447): n is either a, c, g or t
  misc_feature (449)..(449): n is either a, c, g or t
  misc_feature (456)..(456): n is either a, c, g or t
  misc_feature (475)..(475): n is either a, c, g or t
  misc_feature (485)..(485): n is either a, c, g or t
  misc_feature (536)..(536): n is either a, c, g or t
  misc_feature (546)..(546): n is either a, c, g or t
  misc_feature (570)..(570): n is either a, c, g or t
  misc_feature (572)..(572): n is either a, c, g or t
  misc_feature (715)..(715): n is either a, c, g or t
  misc_feature (739)..(739): n is either a, c, g or t
  misc_feature (1036)..(1036): n is either a, c, g or t
  misc_feature (1062)..(1062): n is either a, c, g or t
  misc_feature (1243)..(1243): n is either a, c, g or t
  misc_feature (1265)..(1265): n is either a, c, g or t
  misc_feature (1271)..(1271): n is either a, c, g or t
  misc_feature (1282)..(1282): n is either a, c, g or t
  misc_feature (1293)..(1293): n is either a, c, g or t
  misc_feature (1304)..(1304): n is either a, c, g or t
  misc_feature (1309)..(1309): n is either a, c, g or t
  misc_feature (1363)..(1363): n is either a, c, g or t
  misc_feature (1368)..(1368): n is either a, c, g or t
  misc_feature (1382)..(1382): n is either a, c, g or t
  misc_feature (1384)..(1384): n is either a, c, g or t
  misc_feature (1388)..(1388): n is either a, c, g or t
  misc_feature (1391)..(1391): n is either a, c, g or t
  misc_feature (1437)..(1437): n is either a, c, g or t
  misc_feature (1440)..(1440): n is either a, c, g or t
  misc_feature (1454)..(1454): n is either a, c, g or t
  misc_feature (1467)..(1467): n is either a, c, g or t
  misc_feature (1555)..(1555): n is either a, c, g or t
ncgncgtnngtngngntnntnncgcgtcgtnngcgtcgncgnttnganngcgtncgnncgcgtcgnngcgtcggcgcgtcgttcgcgcggtngntcgtngcgtnntcgttnngtttttcgntcgcgtnttnncggcgtcgggcgatnncgcgcggcgcgggtngtngnnttngttncgcgncggtngcgggcgtncgggcgngtncgcgcgcggcgnntnttnntntnntnnnngcgtncgtnnntntttcgtntnncgtcgcgtngtcgcgcggcgtcgntagntattagcgatagcgagtttcgcgcgacgacggtncgngngacgngtagtacgcgcgtnncgantacgcgnncgcgaatacgacgcgacgagcgacggcgtagcgangcggntagcgtacggcgacgtaagtaacgacgcgcgtnacgcgtagcgcgcgcgangngcgacgngagcgcgcgcgtagagtangcgcgtcgancgcgcgtcgattcgttcgcgcgcgcgcgcggcgagtacgtcgtacgcgtangcgcgcgcgntttcgttcgcgtagattcgcgcgngngtacgcgcgcgcgcgcgcgcgcgcgcgtacgcgcgcgtacgcgcgcgcgcgacgcgcgcgcgtagacgcgcgcgtacgagttcgcgcgcgcgcgcgcgcgcgcgcgcgcgcgcgcgcgcgcgcgcgcgtacgcgcgcgcgcgngcgcgcgcgcgcgcgcgcgcgcgngcgcgcgcgcgcgcgcgcgcgcgcgcgcgtatacgcgcgcgcgggcgcgcgcgcgcgtcgaggcgcgggcgcgcgcgcgcgcgcgcgcggacgcgcgcgcgtacgcgcgcgcgcgcgcgcgcgcgcgcgcgcgcgcgtacgtagcgcgcgcgagacgcgcgtagcgcgcgcgcgcgcgcgcgcgggcgcgtacgcgcgcgtacgcgcgggcgcgcgcgggcgcgcgcgcgcgcgcgcgcgcgtacgcgcgtacgcgcgcgcgcgcgcgcgcgcgcgcgcgcgcgcgcgcggacgcgngcgcgcgcgcgcgggcgcgcgcgagngcggcgcgcgcgtaggcgcgcgagcgcgcgcgcgcgcgcgcgcgcgtacgagcgcgcgcgcgcgcgcgcgcgcgcgcgcgcgcgcgcgtagcgagtacgaagtacgtagcgcgcgcgcgcgcgcgcgcgtacgcgcgcgcgcgtacgcgcgcgtacgcgcgatcgaagagcgcgcgcggangcgcgcgtagacgcgagcgcgnacgggngcgcgcgacgncgggagcggtngcgggcgcgtngcgangcgcgaagatacgcggatagcggagatagtcgacgcgtagatcgcgcgggcggngcgtngacgacgcgcgcgnangcgngtncgcggagcgtaggcgcgcgcgcggcgcgacggcggggcgcgggganggngcgcgcgcgtcgtnggcgtcgacgggngcgcgtagcgcgcgcgcgtagacgtatacgtatagggtatacggggcgcgggggggcgcggggacgcggacgcgtaagcgcgtcgatngcgcgggcgtttatgtttgtaggttcggcggtattagttattatggcggggattttcgaatcggcgttatatggcgtggcgattcgtttgaaacgttcgtttatcgttagttttattagcggttttatttgcggcgcggttgtcggtatggcggggtttgttagttatttaatggtagcgtcggggttatttattagcgtgtagtttttcgattcggcgaatttaatgagtatcgtttgggtgttcgcggttatggcgttggcggtggtgttgtcgtttatttttatattgttgttcggttttgaggatatttttgttgaggaagcggttgtttaggcgcgaaagtattagagcgtataatcgatcgtcgttaaagaagtaagttttaattgagga

SEQ ID NO: 5846 - DNA, 1951 bp, Artificial Sequence
  chemically treated genomic DNA (Homo sapiens) CpG-island No: 5846
  misc_feature (397)..(397): n is either a, c, g or t
  misc_feature (485)..(485): n is either a, c, g or t
  misc_feature (498)..(498): n is either a, c, g or t
  misc_feature (512)..(512): n is either a, c, g or t
  misc_feature (515)..(515): n is either a, c, g or t
  misc_feature (561)..(561): n is either a, c, g or t
  misc_feature (564)..(564): n is either a, c, g or t
  misc_feature (568)..(568): n is either a, c, g or t
  misc_feature (570)..(570): n is either a, c, g or t
  misc_feature (584)..(584): n is either a, c, g or t
  misc_feature (589)..(589): n is either a, c, g or t
  misc_feature (643)..(643): n is either a, c, g or t
  misc_feature (648)..(648): n is either a, c, g or t
  misc_feature (659)..(659): n is either a, c, g or t
  misc_feature (670)..(670): n is either a, c, g or t
  misc_feature (681)..(681): n is either a, c, g or t
  misc_feature (687)..(687): n is either a, c, g or t
  misc_feature (709)..(709): n is either a, c, g or t
  misc_feature (890)..(890): n is either a, c, g or t
  misc_feature (916)..(916): n is either a, c, g or t
  misc_feature (1213)..(1213): n is either a, c, g or t
  misc_feature (1237)..(1237): n is either a, c, g or t
  misc_feature (1380)..(1380): n is either a, c, g or t
  misc_feature (1382)..(1382): n is either a, c, g or t
  misc_feature (1406)..(1406): n is either a, c, g or t
  misc_feature (1416)..(1416): n is either a, c, g or t
  misc_feature (1467)..(1467): n is either a, c, g or t
  misc_feature (1477)..(1477): n is either a, c, g or t
  misc_feature (1496)..(1496): n is either a, c, g or t
  misc_feature (1503)..(1503): n is either a, c, g or t
  misc_feature (1505)..(1505): n is either a, c, g or t
  misc_feature (1523)..(1523): n is either a, c, g or t
  misc_feature (1556)..(1556): n is either a, c, g or t
  misc_feature (1561)..(1561): n is either a, c, g or t
  misc_feature (1596)..(1597): n is either a, c, g or t
  misc_feature (1604)..(1604): n is either a, c, g or t
  misc_feature (1608)..(1609): n is either a, c, g or t
  misc_feature (1623)..(1623): n is either a, c, g or t
  misc_feature (1628)..(1628): n is either a, c, g or t
  misc_feature (1630)..(1630): n is either a, c, g or t
  misc_feature (1633)..(1633): n is either a, c, g or t
  misc_feature (1667)..(1667): n is either a, c, g or t
  misc_feature (1671)..(1671): n is either a, c, g or t
  misc_feature (1686)..(1686): n is either a, c, g or t
  misc_feature (1695)..(1696): n is either a, c, g or t
  misc_feature (1698)..(1698): n is either a, c, g or t
  misc_feature (1705)..(1705): n is either a, c, g or t
  misc_feature (1707)..(1709): n is either a, c, g or t
  misc_feature (1713)..(1713): n is either a, c, g or t
  misc_feature (1718)..(1721): n is either a, c, g or t
  misc_feature (1723)..(1724): n is either a, c, g or t
  misc_feature (1726)..(1726): n is either a, c, g or t
  misc_feature (1728)..(1729): n is either a, c, g or t
  misc_feature (1732)..(1732): n is either a, c, g or t
  misc_feature (1734)..(1735): n is either a, c, g or t
  misc_feature (1747)..(1747): n is either a, c, g or t
  misc_feature (1750)..(1750): n is either a, c, g or t
  misc_feature (1757)..(1757): n is either a, c, g or t
  misc_feature (1766)..(1766): n is either a, c, g or t
  misc_feature (1771)..(1771): n is either a, c, g or t
  misc_feature (1776)..(1776): n is either a, c, g or t
  misc_feature (1780)..(1780): n is either a, c, g or t
  misc_feature (1783)..(1784): n is either a, c, g or t
  misc_feature (1786)..(1786): n is either a, c, g or t
  misc_feature (1789)..(1789): n is either a, c, g or t
  misc_feature (1804)..(1805): n is either a, c, g or t
  misc_feature (1820)..(1821): n is either a, c, g or t
  misc_feature (1824)..(1824): n is either a, c, g or t
  misc_feature (1831)..(1831): n is either a, c, g or t
  misc_feature (1840)..(1841): n is either a, c, g or t
  misc_feature (1847)..(1848): n is either a, c, g or t
  misc_feature (1853)..(1853): n is either a, c, g or t
  misc_feature (1858)..(1858): n is either a, c, g or t
  misc_feature (1860)..(1860): n is either a, c, g or t
  misc_feature (1885)..(1886): n is either a, c, g or t
  misc_feature (1894)..(1895): n is either a, c, g or t
  misc_feature (1898)..(1898): n is either a, c, g or t
  misc_feature (1903)..(1904): n is either a, c, g or t
  misc_feature (1907)..(1907): n is either a, c, g or t
  misc_feature (1910)..(1910): n is either a, c, g or t
  misc_feature (1913)..(1913): n is either a, c, g or t
  misc_feature (1920)..(1921): n is either a, c, g or t
  misc_feature (1930)..(1931): n is either a, c, g or t
  misc_feature (1933)..(1934): n is either a, c, g or t
  misc_feature (1936)..(1936): n is either a, c, g or t
  misc_feature (1938)..(1938): n is either a, c, g or t
  misc_feature (1940)..(1940): n is either a, c, g or t
  misc_feature (1943)..(1944): n is either a, c, g or t
  misc_feature (1948)..(1948): n is either a, c, g or t
  misc_feature (1951)..(1951): n is either a, c, g or t
tcctcaattaaaacttacttctttaacgacgatcgattatacgctctaatactttcgcgcctaaacaaccgcttcctcaacaaaaatatcctcaaaaccgaacaacaatataaaaataaacgacaacaccaccgccaacgccataaccgcgaacacccaaacgatactcattaaattcgccgaatcgaaaaactacacgctaataaataaccccgacgctaccattaaataactaacaaaccccgccataccgacaaccgcgccgcaaataaaaccgctaataaaactaacgataaacgaacgtttcaaacgaatcgccacgccatataacgccgattcgaaaatccccgccataataactaataccgccgaacctacaaacataaacgcccgcgcnatcgacgcgcttacgcgtccgcgtccccgcgcccccccgcgccccgtataccctatacgtatacgtctacgcgcgcgcgctacgcgcncccgtcgacgccnacgacgcgcgcgcnccntccccgcgccccgccgtcgcgccgcgcgcgcgcctacgctccgcgnacncgcntncgcgcgcgtcgtcnacgcnccgcccgcgcgatctacgcgtcgactatctccgctatccgcgtatcttcgcgcntcgcnacgcgcccgcnaccgctcccgncgtcgcgcgcncccgtncgcgctcgcgtctacgcgcgcntccgcgcgcgctcttcgatcgcgcgtacgcgcgcgtacgcgcgcgcgcgtacgcgcgcgcgcgcgcgcgcgctacgtacttcgtactcgctacgcgcgcgcgcgcgcgcgcgcgcgcgcgcgcgcgcgctcgtacgcgcgcgcgcgcgcgcgcgcgctcgcgcgcctacgcgcgcgccgcnctcgcgcgcgcccgcgcgcgcgcgcncgcgtccgcgcgcgcgcgcgcgcgcgcgcgcgcgcgcgcgcgcgtacgcgcgtacgcgcgcgcgcgcgcgcgcgcgcccgcgcgcgcccgcgcgtacgcgcgcgtacgcgcccgcgcgcgcgcgcgcgcgcgctacgcgcgtctcgcgcgcgctacgtacgcgcgcgcgcgcgcgcgcgcgcgcgcgcgcgcgtacgcgcgcgcgtccgcgcgcgcgcgcgcgcgcgcccgcgcctcgacgcgcgcgcgcgcccgcgcgcgcgtatacgcgcgcgcgcgcgcgcgcgcgcgcgcgcncgcgcgcgcgcgcgcgcgcgcgcncgcgcgcgcgcgtacgcgcgcgcgcgcgcgcgcgcgcgcgcgcgcgcgcgcgcgcgcgcgaactcgtacgcgcgcgtctacgcgcgcgcgtcgcgcgcgcgcgtacgcgcgcgtacgcgcgcgcgcgcgcgcgcgcgcgtacncncgcgcgaatctacgcgaacgaaancgcgcgcgcntacgcgtacgacgtactcgccgcgcgcgcgcgcgaacgaatcgacgcgcgntcgacgcgcntactctacgcgcgcgctcncgtcgcncntcgcgcgcgctacgcgtnacgcgcgtcgttacttacgtcgccgtacgctanccgcntcgctacgccgtcgctcgtcgcgtcgtattcgcgnncgcgtantcgnnacgcgcgtactacncgtcncncgnaccgtcgtcgcgcgaaactcgctatcgctaatanctancgacgccgcgcgacnacgcgacgnnanacgaaanannnacgnacgcnnnnannanannaananncgccgcgcgcgnacncgcccgnacgcccgcnaccgncgcgnaacnaanncnacnacccgcgccgcgcgnnatcgcccgacgccgnnaanacgcgancgaaaaacnnaacgannacgcnacgancnaccgcgcgaacgacgcgccgacgcnncgacgcgnncgnacgcnntcnaancgncgacgcnnacgacgcgnnannancncnacnnacgncgn

SEQ ID NO: 5847 - DNA, 1951 bp, Artificial Sequence
  chemically treated genomic DNA (Homo sapiens) CpG-island No: 5847
  misc_feature (397)..(397): n is either a, c, g or t
  misc_feature (485)..(485): n is either a, c, g or t
  misc_feature (498)..(498): n is either a, c, g or t
  misc_feature (512)..(512): n is either a, c, g or t
  misc_feature (515)..(515): n is either a, c, g or t
  misc_feature (561)..(561): n is either a, c, g or t
  misc_feature (564)..(564): n is either a, c, g or t
  misc_feature (568)..(568): n is either a, c, g or t
  misc_feature (570)..(570): n is either a, c, g or t
  misc_feature (584)..(584): n is either a, c, g or t
  misc_feature (589)..(589): n is either a, c, g or t
  misc_feature (643)..(643): n is either a, c, g or t
  misc_feature (648)..(648): n is either a, c, g or t
  misc_feature (659)..(659): n is either a, c, g or t
  misc_feature (670)..(670): n is either a, c, g or t
  misc_feature (681)..(681): n is either a, c, g or t
  misc_feature (687)..(687): n is either a, c, g or t
  misc_feature (709)..(709): n is either a, c, g or t
  misc_feature (890)..(890): n is either a, c, g or t
  misc_feature (916)..(916): n is either a, c, g or t
  misc_feature (1213)..(1213): n is either a, c, g or t
  misc_feature (1237)..(1237): n is either a, c, g or t
  misc_feature (1380)..(1380): n is either a, c, g or t
  misc_feature (1382)..(1382): n is either a, c, g or t
  misc_feature (1406)..(1406): n is either a, c, g or t
  misc_feature (1416)..(1416): n is either a, c, g or t
  misc_feature (1467)..(1467): n is either a, c, g or t
  misc_feature (1477)..(1477): n is either a, c, g or t
  misc_feature (1496)..(1496): n is either a, c, g or t
  misc_feature (1503)..(1503): n is either a, c, g or t
  misc_feature (1505)..(1505): n is either a, c, g or t
  misc_feature (1523)..(1523): n is either a, c, g or t
  misc_feature (1556)..(1556): n is either a, c, g or t
  misc_feature (1561)..(1561): n is either a, c, g or t
  misc_feature (1596)..(1597): n is either a, c, g or t
  misc_feature (1604)..(1604): n is either a, c, g or t
  misc_feature (1608)..(1609): n is either a, c, g or t
  misc_feature (1623)..(1623): n is either a, c, g or t
  misc_feature (1628)..(1628): n is either a, c, g or t
  misc_feature (1630)..(1630): n is either a, c, g or t
  misc_feature (1633)..(1633): n is either a, c, g or t
  misc_feature (1667)..(1667): n is either a, c, g or t
  misc_feature (1671)..(1671): n is either a, c, g or t
  misc_feature (1686)..(1686): n is either a, c, g or t
  misc_feature (1695)..(1696): n is either a, c, g or t
  misc_feature (1698)..(1698): n is either a, c, g or t
  misc_feature (1705)..(1705): n is either a, c, g or t
  misc_feature (1707)..(1709): n is either a, c, g or t
  misc_feature (1713)..(1713): n is either a, c, g or t
  misc_feature (1718)..(1721): n is either a, c, g or t
  misc_feature (1723)..(1724): n is either a, c, g or t
  misc_feature (1726)..(1726): n is either a, c, g or t
  misc_feature (1728)..(1729): n is either a, c, g or t
  misc_feature (1732)..(1732): n is either a, c, g or t
  misc_feature (1734)..(1735): n is either a, c, g or t
  misc_feature (1747)..(1747): n is either a, c, g or t
  misc_feature (1750)..(1750): n is either a, c, g or t
  misc_feature (1757)..(1757): n is either a, c, g or t
  misc_feature (1766)..(1766): n is either a, c, g or t
  misc_feature (1771)..(1771): n is either a, c, g or t
  misc_feature (1776)..(1776): n is either a, c, g or t
  misc_feature (1780)..(1780): n is either a, c, g or t
  misc_feature (1783)..(1784): n is either a, c, g or t
  misc_feature (1786)..(1786): n is either a, c, g or t
  misc_feature (1789)..(1789): n is either a, c, g or t
  misc_feature (1804)..(1805): n is either a, c, g or t
  misc_feature (1820)..(1821): n is either a, c, g or t
  misc_feature (1824)..(1824): n is either a, c, g or t
  misc_feature (1831)..(1831): n is either a, c, g or t
  misc_feature (1840)..(1841): n is either a, c, g or t
  misc_feature (1847)..(1848): n is either a, c, g or t
  misc_feature (1853)..(1853): n is either a, c, g or t
  misc_feature (1858)..(1858): n is either a, c, g or t
  misc_feature (1860)..(1860): n is either a, c, g or t
  misc_feature (1885)..(1886): n is either a, c, g or t
  misc_feature (1894)..(1895): n is either a, c, g or t
  misc_feature (1898)..(1898): n is either a, c, g or t
  misc_feature (1903)..(1904): n is either a, c, g or t
  misc_feature (1907)..(1907): n is either a, c, g or t
  misc_feature (1910)..(1910): n is either a, c, g or t
  misc_feature (1913)..(1913): n is either a, c, g or t
  misc_feature (1920)..(1921): n is either a, c, g or t
  misc_feature (1930)..(1931): n is either a, c, g or t
  misc_feature (1933)..(1934): n is either a, c, g or t
  misc_feature (1936)..(1936): n is either a, c, g or t
  misc_feature (1938)..(1938): n is either a, c, g or t
  misc_feature (1940)..(1940): n is either a, c, g or t
  misc_feature (1943)..(1944): n is either a, c, g or t
  misc_feature (1948)..(1948): n is either a, c, g or t
  misc_feature (1951)..(1951): n is either a, c, g or t
tttttaattaagatttatttttttggcgacggtcggttgtacgttttgatattttcgcgtttgggtagtcgtttttttaataggaatatttttaaagtcgagtaatagtgtgaggataaacgatagtattatcgttagcgttatgatcgcgaatatttagacgatgtttattggattcgtcggatcgaagaattgtacgttggtaaatagtttcggcgttgttattgagtggttggtaagtttcgttatatcggtaatcgcgtcgtaaataaaatcgttgataagattggcgataagcggacgttttaggcggatcgttacgttatataacgtcggttcggaaattttcgttataatggttgatgtcgtcggatttgtaggtatgggcgttcgcgtngtcggcgcgtttgcgcgttcgcgttttcgcgttttttcgcgtttcgtgtgttttgtgcgtgtgcgtttgcgcgcgcgcgttgcgcgtnttcgtcggcgttngcggcgcgcgcgtnttnttttcgcgtttcgtcgtcgcgtcgcgcgcgcgtttgcgtttcgcgngtncgtntncgcgcgcgtcgttngcgtntcgttcgcgcggtttgcgcgtcggttgttttcgttgttcgcgtgttttcgcgtntcgtngcgcgttcgtngtcgttttcgncgtcgcgcgtnttcgtncgcgttcgcgtttgcgcgcgtnttcgcgcgcgtttttcggtcgcgcgtgcgcgcgcgtgcgcgcgcgcgcgtgcgcgcgcgcgcgcgcgcgcgttgcgtgtttcgtgttcgttgcgcgcgcgcgcgcgcgcgcgcgcgcgcgcgcgcgcgttcgtgcgcgcgcgcgcgcgcgcgcgcgttcgcgcgtttgcgcgcgcgtcgtnttcgcgcgcgttcgcgcgcgcgcgtncgcgttcgcgcgcgcgcgcgcgcgcgcgcgcgcgcgcgcgcgcgtgcgcgcgtgcgcgcgcgcgcgcgcgcgcgcgttcgcgcgcgttcgcgcgtgcgcgcgcgtgcgcgttcgcgcgcgcgcgcgcgcgcgttgcgcgcgtttcgcgcgcgttgcgtgcgcgcgcgcgcgcgcgcgcgcgcgcgcgcgcgcgtgcgcgcgcgcgttcgcgcgcgcgcgcgcgcgcgttcgcgtttcggcgcgcgcgcgcgttcgcgcgcgcgtgtgcgcgcgcgcgcgcgcgcgcgcgcgcgcgtncgcgcgcgcgcgcgcgcgcgcgtncgcgcgcgcgcgtgcgcgcgcgcgcgcgcgcgcgcgcgcgcgcgcgcgcgcgcgcgcgcgggttcgtgcgcgcgcgtttgcgcgcgcgcgtcgcgcgcgcgcgtgcgcgcgcgtgcgcgcgcgcgcgcgcgcgcgcgcgtgtntncgcgcgggtttgcgcgggcggggncgcgcgcgtntgcgcgtgcggcgtgttcgtcgcgcgcgcgcgcgggcgggtcggcgcgcgntcggcgcgtntgttttgcgcgcgcgtttncgtcgtntntcgcgcgcgttgcgcgtngcgcgcgtcgttgtttgcgtcgtcgtgcgttgntcgtntcgttgcgtcgtcgttcgtcgcgtcgtgttcgcgnncgcgtgntcgnngcgcgcgtgttgtncgttntncgngtcgtcgtcgcgcggggttcgttgtcgttggtgnttgncggcgtcgcgcggtngcgcggcgnngngcggggngnnngcgngcgtnnnngnngngnnggngnncgtcgcgcgcgngtncgttcgngcgttcgtngtcgncgcgnggtnggnntngtngttcgcgtcgcgcgnngtcgttcggcgtcgnnggngcgcggncggggggtnnggcggnngcgtngcggntngtcgcgcgggcggcgcgtcggcgtnncggcgcgnncgngcgtnnttnggncgncggcgtnngcggcgcgnngnngntntngtnngcgncgn

SEQ ID NO: 5848 - DNA, 1951 bp, Artificial Sequence
  chemically treated genomic DNA (Homo sapiens) CpG-island No: 5848
  misc_feature (1)..(1): n is either a, c, g or t
  misc_feature (4)..(4): n is either a, c, g or t
  misc_feature (8)..(9): n is either a, c, g or t
  misc_feature (12)..(12): n is either a, c, g or t
  misc_feature (14)..(14): n is either a, c, g or t
  misc_feature (16)..(16): n is either a, c, g or t
  misc_feature (18)..(19): n is either a, c, g or t
  misc_feature (21)..(22): n is either a, c, g or t
  misc_feature (31)..(32): n is either a, c, g or t
  misc_feature (39)..(39): n is either a, c, g or t
  misc_feature (42)..(42): n is either a, c, g or t
  misc_feature (45)..(45): n is either a, c, g or t
  misc_feature (48)..(49): n is either a, c, g or t
  misc_feature (54)..(54): n is either a, c, g or t
  misc_feature (57)..(58): n is either a, c, g or t
  misc_feature (66)..(67): n is either a, c, g or t
  misc_feature (92)..(92): n is either a, c, g or t
  misc_feature (94)..(94): n is either a, c, g or t
  misc_feature (99)..(99): n is either a, c, g or t
  misc_feature (104)..(105): n is either a, c, g or t
  misc_feature (111)..(112): n is either a, c, g or t
  misc_feature (121)..(121): n is either a, c, g or t
  misc_feature (128)..(128): n is either a, c, g or t
  misc_feature (131)..(132): n is either a, c, g or t
  misc_feature (147)..(148): n is either a, c, g or t
  misc_feature (163)..(163): n is either a, c, g or t
  misc_feature (166)..(166): n is either a, c, g or t
  misc_feature (168)..(169): n is either a, c, g or t
  misc_feature (172)..(172): n is either a, c, g or t
  misc_feature (176)..(176): n is either a, c, g or t
  misc_feature (181)..(181): n is either a, c, g or t
  misc_feature (186)..(186): n is either a, c, g or t
  misc_feature (195)..(195): n is either a, c, g or t
  misc_feature (202)..(202): n is either a, c, g or t
  misc_feature (205)..(205): n is either a, c, g or t
  misc_feature (217)..(218): n is either a, c, g or t
  misc_feature (220)..(220): n is either a, c, g or t
  misc_feature (223)..(224): n is either a, c, g or t
  misc_feature (226)..(226): n is either a, c, g or t
  misc_feature (228)..(229): n is either a, c, g or t
  misc_feature (231)..(234): n is either a, c, g or t
  misc_feature (239)..(239): n is either a, c, g or t
  misc_feature (243)..(245): n is either a, c, g or t
  misc_feature (247)..(247): n is either a, c, g or t
  misc_feature (254)..(254): n is either a, c, g or t
  misc_feature (256)..(257): n is either a, c, g or t
  misc_feature (266)..(266): n is either a, c, g or t
  misc_feature (281)..(281): n is either a, c, g or t
  misc_feature (285)..(285): n is either a, c, g or t
  misc_feature (319)..(319): n is either a, c, g or t
  misc_feature (322)..(322): n is either a, c, g or t
  misc_feature (324)..(324): n is either a, c, g or t
  misc_feature (329)..(329): n is either a, c, g or t
  misc_feature (343)..(344): n is either a, c, g or t
  misc_feature (348)..(348): n is either a, c, g or t
  misc_feature (355)..(356): n is either a, c, g or t
  misc_feature (391)..(391): n is either a, c, g or t
  misc_feature (396)..(396): n is either a, c, g or t
  misc_feature (429)..(429): n is either a, c, g or t
  misc_feature (447)..(447): n is either a, c, g or t
  misc_feature (449)..(449): n is either a, c, g or t
  misc_feature (456)..(456): n is either a, c, g or t
  misc_feature (475)..(475): n is either a, c, g or t
  misc_feature (485)..(485): n is either a, c, g or t
  misc_feature (536)..(536): n is either a, c, g or t
  misc_feature (546)..(546): n is either a, c, g or t
  misc_feature (570)..(570): n is either a, c, g or t
  misc_feature (572)..(572): n is either a, c, g or t
  misc_feature (715)..(715): n is either a, c, g or t
  misc_feature (739)..(739): n is either a, c, g or t
  misc_feature (1036)..(1036): n is either a, c, g or t
  misc_feature (1062)..(1062): n is either a, c, g or t
  misc_feature (1243)..(1243): n is either a, c, g or t
  misc_feature (1265)..(1265): n is either a, c, g or t
  misc_feature (1271)..(1271): n is either a, c, g or t
  misc_feature (1282)..(1282): n is either a, c, g or t
  misc_feature (1293)..(1293): n is either a, c, g or t
  misc_feature (1304)..(1304): n is either a, c, g or t
  misc_feature (1309)..(1309): n is either a, c, g or t
  misc_feature (1363)..(1363): n is either a, c, g or t
  misc_feature (1368)..(1368): n is either a, c, g or t
  misc_feature (1382)..(1382): n is either a, c, g or t
  misc_feature (1384)..(1384): n is either a, c, g or t
  misc_feature (1388)..(1388): n is either a, c, g or t
  misc_feature (1391)..(1391): n is either a, c, g or t
  misc_feature (1437)..(1437): n is either a, c, g or t
  misc_feature (1440)..(1440): n is either a, c, g or t
  misc_feature (1454)..(1454): n is either a, c, g or t
  misc_feature (1467)..(1467): n is either a, c, g or t
  misc_feature (1555)..(1555): n is either a, c, g or t
ncgncgcnnacnanancnncnncgcgccgcnnacgccgncgnccnaannacgcncgnncgcgccgnnacgccgacgcgccgcccgcgcgacnanccgcnacgcnnccgccnnaccccccgnccgcgcnccnncgacgccgaacgacnncgcgcgacgcgaacnacnannccnaccncgcgncgacnacgaacgcncgaacgnacncgcgcgcgacgnncnccnncncnncnnnnacgcncgcnnncnccccgcncnncgccgcgcnaccgcgcgacgccgncaancaccaacgacaacgaaccccgcgcgacgacgacncgnanaacgnacaacacgcgcgcnncgancacgcgnncgcgaacacgacgcgacgaacgacgacgcaacganacgancaacgcacgacgacgcaaacaacgacgcgcgcnacgcgcaacgcgcgcgananacgacgnaaacgcgcgcgcaaaacanacgcgccgancgcgcgccgacccgcccgcgcgcgcgcgcgacgaacacgccgcacgcgcanacgcgcgcgnccccgcccgcgcaaacccgcgcgnanacacgcgcgcgcgcgcgcgcgcgcgcgcacgcgcgcgcacgcgcgcgcgcgacgcgcgcgcgcaaacgcgcgcgcacgaacccgcgcgcgcgcgcgcgcgcgcgcgcgcgcgcgcgcgcgcgcgcgcgcacgcgcgcgcgcgnacgcgcgcgcgcgcgcgcgcgcgnacgcgcgcgcgcgcgcgcgcgcgcgcgcgcacacgcgcgcgcgaacgcgcgcgcgcgccgaaacgcgaacgcgcgcgcgcgcgcgcgcgaacgcgcgcgcgcacgcgcgcgcgcgcgcgcgcgcgcgcgcgcgcgcgcacgcaacgcgcgcgaaacgcgcgcaacgcgcgcgcgcgcgcgcgcgaacgcgcacgcgcgcgcacgcgcgaacgcgcgcgaacgcgcgcgcgcgcgcgcgcgcgcacgcgcgcacgcgcgcgcgcgcgcgcgcgcgcgcgcgcgcgcgcgcgaacgcgnacgcgcgcgcgcgaacgcgcgcgaanacgacgcgcgcgcaaacgcgcgaacgcgcgcgcgcgcgcgcgcgcgcacgaacgcgcgcgcgcgcgcgcgcgcgcgcgcgcgcgcgcgcaacgaacacgaaacacgcaacgcgcgcgcgcgcgcgcgcgcacgcgcgcgcgcgcacgcgcgcgcacgcgcgaccgaaaaacgcgcgcgaanacgcgcgcaaacgcgaacgcgnacgaanacgcgcgacgncgaaaacgacnacgaacgcgcnacganacgcgaaaacacgcgaacaacgaaaacaaccgacgcgcaaaccgcgcgaacganacgcnaacgacgcgcgcgnanacgnacncgcgaaacgcaaacgcgcgcgcgacgcgacgacgaaacgcgaaaanaanacgcgcgcgccgcnaacgccgacgaanacgcgcaacgcgcgcgcgcaaacgcacacgcacaaaacacacgaaacgcgaaaaaacgcgaaaacgcgaacgcgcaaacgcgccgacnacgcgaacgcccatacctacaaatccgacgacatcaaccattataacgaaaatttccgaaccgacgttatataacgtaacgatccgcctaaaacgtccgcttatcgccaatcttatcaacgattttatttacgacgcgattaccgatataacgaaacttaccaaccactcaataacaacgccgaaactatttaccaacgtacaattcttcgatccgacgaatccaataaacatcgtctaaatattcgcgatcataacgctaacgataatactatcgtttatcctcacactattactcgactttaaaaatattcctattaaaaaaacgactacccaaacgcgaaaatatcaaaacgtacaaccgaccgtcgccaaaaaaataaatcttaattaaaaa

SEQ ID NO: 5849 - DNA, 594 bp, Artificial Sequence
  chemically treated genomic DNA (Homo sapiens) CpG-island No: 5849
gatgtcgtattatcgatgtggaacgtacgtatggttagttgtgtattcggtttatcgatggattgtgtcgcgataatatcgattgttttatttttgttgatgatgtggttacgcgttaggttacgatcgtagtagtgcgtatatatattaaagtcggtgttataagatataatagaacgtattttaatcgcgtcgatagagtttttttttagtaggttatattattgttcgtgtagtagcgtgttgcgcggaacgaggatattagtagtattcggttttagaacgtttttagtagttatacgatttagtacgcgatcgcgtagcggttttttaacgttattattttcgataatcggagttattatgatatttttatgggtattataatcgttttcggtaattattaggttttgcgttacgttaattagacgacgagttaggtaatcggagttcgtagtttttagtgcggtattcgttagatttttacgagtatcgtgggtggagatgaagtattggagtacgtttagatttttacggaagttcgcggtgattgggttaattttgtatgttttgtaggtttattaattaggtatg

SEQ ID NO: 5850 - DNA, 594 bp, Artificial Sequence
  chemically treated genomic DNA (Homo sapiens) CpG-island No: 5850
catacctaattaataaacctacaaaacatacaaaattaacccaatcaccgcgaacttccgtaaaaatctaaacgtactccaatacttcatctccacccacgatactcgtaaaaatctaacgaataccgcactaaaaactacgaactccgattacctaactcgtcgtctaattaacgtaacgcaaaacctaataattaccgaaaacgattataatacccataaaaatatcataataactccgattatcgaaaataataacgttaaaaaaccgctacgcgatcgcgtactaaatcgtataactactaaaaacgttctaaaaccgaatactactaatatcctcgttccgcgcaacacgctactacacgaacaataatataacctactaaaaaaaaactctatcgacgcgattaaaatacgttctattatatcttataacaccgactttaatatatatacgcactactacgatcgtaacctaacgcgtaaccacatcatcaacaaaaataaaacaatcgatattatcgcgacacaatccatcgataaaccgaatacacaactaaccatacgtacgttccacatcgataatacgacatc

SEQ ID NO: 5851 - DNA, 594 bp, Artificial Sequence
  chemically treated genomic DNA (Homo sapiens) CpG-island No: 5851
tatatttggttaatagatttgtagagtatgtaaggttgatttaattatcgcgaattttcgtgaaggtttgaacgtattttagtattttatttttatttacggtgttcgtaaaggtttggcggatatcgtattgaaaattgcgaatttcggttatttgattcgtcgtttggttgacgtggcgtaggatttggtggttatcgaagacgattgtggtatttatgaaggtattatgatgatttcggttatcgagggtggtgacgttaaagagtcgttgcgcgatcgcgtattgggtcgtgtaattgttgaagacgttttgaagtcgggtattgttgatattttcgtttcgcgtaatacgttgttgtacgaatagtggtgtgatttgttggaagagaattttgtcgacgcggttaaagtacgttttgttgtattttgtgatatcgattttggtgtatgtgcgtattgttacggtcgtgatttggcgcgtggttatattattaataagggtgaagtaatcggtgttatcgcggtatagtttatcggtgaatcgggtatatagttgattatgcgtacgttttatatcggtggtgcggtatt

SEQ ID NO: 5852 - DNA, 594 bp, Artificial Sequence
  chemically treated genomic DNA (Homo sapiens) CpG-island No: 5852
aataccgcaccaccgatataaaacgtacgcataatcaactatatacccgattcaccgataaactataccgcgataacaccgattacttcacccttattaataatataaccacgcgccaaatcacgaccgtaacaatacgcacatacaccaaaatcgatatcacaaaatacaacaaaacgtactttaaccgcgtcgacaaaattctcttccaacaaatcacaccactattcgtacaacaacgtattacgcgaaacgaaaatatcaacaatacccgacttcaaaacgtcttcaacaattacacgacccaatacgcgatcgcgcaacgactctttaacgtcaccaccctcgataaccgaaatcatcataataccttcataaataccacaatcgtcttcgataaccaccaaatcctacgccacgtcaaccaaacgacgaatcaaataaccgaaattcgcaattttcaatacgatatccgccaaacctttacgaacaccgtaaataaaaataaaatactaaaatacgttcaaaccttcacgaaaattcgcgataattaaatcaaccttacatactctacaaatctattaaccaaatata

SEQ ID NO: 5853 - DNA, 611 bp, Artificial Sequence
  chemically treated genomic DNA (Homo sapiens) CpG-island No: 5853
gttatagaggaggtttcggttaggtcggttacgttttcgacgtagagatagttttcgagtaggggttttacgcgggtggtgtttttttcgttttgttattttatagtggtttcgggcgttacgaggcgggcgttgggtcgtagtcgtaggtgtaggtttcggttaaagatcgtgatattgtagaagaggtgattgttaggttttttttcgttgttttcggggaagttcggggttcggatcggggcggttttgcgggttcgtatttttgttttggacgtagttgtcgatattacgtgggatattaagcggttttgggcgttagtgcgtacgggtatcgttaggatgcgtttcgtttcgtgttttaggggttcgtttgtaacgggaaggggcgttagatcggcggagattacggagttttagtgttttagagattcgtcggcgagttacgtttttttagatttcgttttattggcgaaggtaaggtgtattcggtaggcgaattttagagttaggttgtagttttttgcgtattgtatatagacgatatttttgcgagttcgtgatttgtttttttatttacgattatatattatttatatttttagacgtat

SEQ ID NO: 5854 - DNA, 611 bp, Artificial Sequence
  chemically treated genomic DNA (Homo sapiens) CpG-island No: 5854
atacgtctaaaaatataaataatatataatcgtaaataaaaaaacaaatcacgaactcgcaaaaatatcgtctatatacaatacgcaaaaaactacaacctaactctaaaattcgcctaccgaatacaccttaccttcgccaataaaacgaaatctaaaaaaacgtaactcgccgacgaatctctaaaacactaaaactccgtaatctccgccgatctaacgccccttcccgttacaaacgaacccctaaaacacgaaacgaaacgcatcctaacgatacccgtacgcactaacgcccaaaaccgcttaatatcccacgtaatatcgacaactacgtccaaaacaaaaatacgaacccgcaaaaccgccccgatccgaaccccgaacttccccgaaaacaacgaaaaaaaacctaacaatcacctcttctacaatatcacgatctttaaccgaaacctacacctacgactacgacccaacgcccgcctcgtaacgcccgaaaccactataaaataacaaaacgaaaaaaacaccacccgcgtaaaacccctactcgaaaactatctctacgtcgaaaacgtaaccgacctaaccgaaacctcctctataac

SEQ ID NO: 5855 - DNA, 611 bp, Artificial Sequence
  chemically treated genomic DNA (Homo sapiens) CpG-island No: 5855
gtgcgtttaaagatgtaggtggtgtgtagtcgtaagtgagaaggtagattacggattcgtaagagtatcgtttgtatgtagtgcgtaaagagttgtagtttggttttggggttcgtttgtcgaatgtattttgttttcgttagtggggcggggtttgggggggcgtggttcgtcggcgggtttttgaggtattggggtttcgtggttttcgtcgatttaacgttttttttcgttgtaggcgggtttttggggtacggagcggagcgtattttggcggtgttcgtgcgtattgacgtttagggtcgtttggtgttttacgtggtgtcggtagttacgtttagagtaggggtacgagttcgtagggtcgtttcggttcggatttcgagttttttcggaggtaacgaggaggagtttggtagttattttttttataatgttacggtttttggtcgagatttgtatttgcggttgcggtttaacgttcgtttcgtggcgttcggggttattatggagtggtagggcgagaagggtattattcgcgtggagtttttgttcgggagttgtttttacgtcggagacgtggtcggtttagtcgaagttttttttgtggt

SEQ ID NO: 5856 - DNA, 611 bp, Artificial Sequence
  chemically treated genomic DNA (Homo sapiens) CpG-island No: 5856
accacaaaaaaaacttcgactaaaccgaccacgtctccgacgtaaaaacaactcccgaacaaaaactccacgcgaataatacccttctcgccctaccactccataataaccccgaacgccacgaaacgaacgttaaaccgcaaccgcaaatacaaatctcgaccaaaaaccgtaacattataaaaaaaataactaccaaactcctcctcgttacctccgaaaaaactcgaaatccgaaccgaaacgaccctacgaactcgtacccctactctaaacgtaactaccgacaccacgtaaaacaccaaacgaccctaaacgtcaatacgcacgaacaccgccaaaatacgctccgctccgtaccccaaaaacccgcctacaacgaaaaaaaacgttaaatcgacgaaaaccacgaaaccccaatacctcaaaaacccgccgacgaaccacgcccccccaaaccccgccccactaacgaaaacaaaatacattcgacaaacgaaccccaaaaccaaactacaactctttacgcactacatacaaacgatactcttacgaatccgtaatctaccttctcacttacgactacacaccacctacatctttaaacgcac

SEQ ID NO: 5857 - DNA, 624 bp, Artificial Sequence
  chemically treated genomic DNA (Homo sapiens) CpG-island No: 5857
  misc_feature (543)..(545): n is either a, c, g or t
  misc_feature (583)..(583): n is either a, c, g or t
  misc_feature (587)..(587): n is either a, c, g or t
  misc_feature (600)..(600): n is either a, c, g or t
  misc_feature (602)..(603): n is either a, c, g or t
  misc_feature (623)..(623): n is either a, c, g or t
tgtagttcggttgttatggattcgtcggcgggagtcgttcgtcgtttgttttgtttcgcgttgttgttgttgttgttgttgttgacgtcggcgtttttgtcgtcgtcggcgtcgttcgcgaacgttaggttcgtcgtcgtcgtcgattttttaggtaggtgcggttcggtttttatttttcgggattttcgtcggtttggttttgtttcgcgtgtttcgtcgttttttttttaggcgtcgtttagtttgatttgggtaaatttcgcgcgtttcgttcggggttaagttggttaatttcggggtcgggttggtcgcgtagggggcgtttcgtatcgttttcgagcgttttgggtcgggggagtttcggagtattggcggtttatgagtcgcggagggtggggacggagggtcgggaaaagtttcgcggttaagagcgtagagttagttttagcgggttcgaggggggagttagggcgaggcggcgtcggggttagcgttcggtaatttttcgttgggaagcgtacggtagtcgtattgatttgnnntacgagggttatacgtattcggaagttgcgcgattttnaatnttttcgcgttgananngatcgttttttttttttttnt

SEQ ID NO: 5858 - DNA, 624 bp, Artificial Sequence
  chemically treated genomic DNA (Homo sapiens) CpG-island No: 5858
  misc_feature (2)..(2): n is either a, c, g or t
  misc_feature (22)..(23): n is either a, c, g or t
  misc_feature (25)..(25): n is either a, c, g or t
  misc_feature (38)..(38): n is either a, c, g or t
  misc_feature (42)..(42): n is either a, c, g or t
  misc_feature (80)..(82): n is either a, c, g or t
anaaaaaaaaaaaaaacgatcnntntcaacgcgaaaanattnaaaatcgcgcaacttccgaatacgtataaccctcgtannncaaatcaatacgactaccgtacgcttcccaacgaaaaattaccgaacgctaaccccgacgccgcctcgccctaactcccccctcgaacccgctaaaactaactctacgctcttaaccgcgaaacttttcccgaccctccgtccccaccctccgcgactcataaaccgccaatactccgaaactcccccgacccaaaacgctcgaaaacgatacgaaacgccccctacgcgaccaacccgaccccgaaattaaccaacttaaccccgaacgaaacgcgcgaaatttacccaaatcaaactaaacgacgcctaaaaaaaaaacgacgaaacacgcgaaacaaaaccaaaccgacgaaaatcccgaaaaataaaaaccgaaccgcacctacctaaaaaatcgacgacgacgacgaacctaacgttcgcgaacgacgccgacgacgacaaaaacgccgacgtcaacaacaacaacaacaacaacaacgcgaaacaaaacaaacgacgaacgactcccgccgacgaatccataacaaccgaactaca

SEQ ID NO: 5859 - DNA, 624 bp, Artificial Sequence
  chemically treated genomic DNA (Homo sapiens) CpG-island No: 5859
  misc_feature (2)..(2): n is either a, c, g or t
  misc_feature (22)..(23): n is either a, c, g or t
  misc_feature (25)..(25): n is either a, c, g or t
  misc_feature (38)..(38): n is either a, c, g or t
  misc_feature (42)..(42): n is either a, c, g or t
  misc_feature (80)..(82): n is either a, c, g or t
anggggaggaggggagcgattnntnttagcgcggaganattnagagtcgcgtagttttcgggtacgtatgattttcgtgnnntagattagtacgattgtcgtacgttttttagcggagggttgtcggacgttagtttcggcgtcgtttcgttttggtttttttttcggattcgttggggttgattttgcgtttttggtcgcggggtttttttcggtttttcgtttttatttttcgcgatttatgagtcgttagtgtttcgaggttttttcggtttaaggcgttcgggggcggtgcggggcgttttttgcgcgattaattcggtttcgaagttggttaatttggtttcgggcggggcgcgcggagtttgtttaagttaggttggacgacgtttggggagggggcggcggggtacgcgggatagggttaggtcggcgggggtttcggggagtaggggtcgggtcgtatttatttggggggtcgacggcggcggcgagtttggcgttcgcgggcggcgtcggcggcggtaggagcgtcggcgttagtagtagtagtagtagtagtagcgcggggtagagtaggcggcgagcggttttcgtcggcggatttatggtagtcggattgta

SEQ ID NO: 5860 - DNA, 624 bp, Artificial Sequence
  chemically treated genomic DNA (Homo sapiens) CpG-island No: 5860
  misc_feature (543)..(545): n is either a, c, g or t
  misc_feature (583)..(583): n is either a, c, g or t
  misc_feature (587)..(587): n is either a, c, g or t
  misc_feature (600)..(600): n is either a, c, g or t
  misc_feature (602)..(603): n is either a, c, g or t
  misc_feature (623)..(623): n is either a, c, g or t
tacaatccgactaccataaatccgccgacgaaaaccgctcgccgcctactctaccccgcgctactactactactactactactaacgccgacgctcctaccgccgccgacgccgcccgcgaacgccaaactcgccgccgccgtcgaccccccaaataaatacgacccgacccctactccccgaaacccccgccgacctaaccctatcccgcgtaccccgccgccccctccccaaacgtcgtccaacctaacttaaacaaactccgcgcgccccgcccgaaaccaaattaaccaacttcgaaaccgaattaatcgcgcaaaaaacgccccgcaccgcccccgaacgccttaaaccgaaaaaacctcgaaacactaacgactcataaatcgcgaaaaataaaaacgaaaaaccgaaaaaaaccccgcgaccaaaaacgcaaaatcaaccccaacgaatccgaaaaaaaaaccaaaacgaaacgacgccgaaactaacgtccgacaaccctccgctaaaaaacgtacgacaatcgtactaatctannncacgaaaatcatacgtacccgaaaactacgcgactctnaatntctccgcgctaanannaatcgctcccctcctccccnt

SEQ ID NO: 5861 - DNA, 748 bp, Artificial Sequence
  chemically treated genomic DNA (Homo sapiens) CpG-island No: 5861
  misc_feature (94)..(94): n is either a, c, g or t
gcgcggagggggtgggcgtaagtcgttttcgtttagcggttttcgtcgagtatggtgataatgagggtggggttagcgttggcggtagagcgtntggtggtttcggggttttttttcgtttttcgcgtttttttgcggcgcgtagtatagagagtttagtcgttttcgtagttgtcgttaaagtcggtagtcgttcgtttggaagaagaggtagacgaagggattgagaacgttgttggttatcgttattacgcgtagtacgtcgatagggttttttttttttattttttcgtaggttcggacgattacgttgtttttagtcggtcggtaaattagggtagttcgtagtttacgaatagtagttttagtagttggtttatttttaggttttgtattttggcgcggggtatcgcgttgggcgtacgggttttatttgggttcgtcgattaggtcgttgtattcgttggggtttttagtcggtgtcgttattagacggagagtaggtggttataagcgatatttatgattttaataggcgcgacgaagttcgcgacggttttatagaacgcgtatatttgtacgtgttagcgttgtaggagcgcgaagatttagtggtagcgacgtattttcggttaggttcgggcggagagtggcgcgtttggttgtagagacgttggtggaggaggaggaggaagaggagagggagagtattagcgtattataaatttcgattttcgcgttagtagta

SEQ ID NO: 5862 - DNA, 748 bp, Artificial Sequence
  chemically treated genomic DNA (Homo sapiens) CpG-island No: 5862
  misc_feature (655)..(655): n is either a, c, g or t
tactactaacgcgaaaatcgaaatttataatacgctaatactctccctctcctcttcctcctcctcctccaccaacgtctctacaaccaaacgcgccactctccgcccgaacctaaccgaaaatacgtcgctaccactaaatcttcgcgctcctacaacgctaacacgtacaaatatacgcgttctataaaaccgtcgcgaacttcgtcgcgcctattaaaatcataaatatcgcttataaccacctactctccgtctaataacgacaccgactaaaaaccccaacgaatacaacgacctaatcgacgaacccaaataaaacccgtacgcccaacgcgataccccgcgccaaaatacaaaacctaaaaataaaccaactactaaaactactattcgtaaactacgaactaccctaatttaccgaccgactaaaaacaacgtaatcgtccgaacctacgaaaaaataaaaaaaaaaaaccctatcgacgtactacgcgtaataacgataaccaacaacgttctcaatcccttcgtctacctcttcttccaaacgaacgactaccgactttaacgacaactacgaaaacgactaaactctctatactacgcgccgcaaaaaaacgcgaaaaacgaaaaaaaaccccgaaaccaccanacgctctaccgccaacgctaaccccaccctcattatcaccatactcgacgaaaaccgctaaacgaaaacgacttacgcccaccccctccgcgc

SEQ ID NO: 5863 - DNA, 748 bp, Artificial Sequence
  chemically treated genomic DNA (Homo sapiens) CpG-island No: 5863
  misc_feature (655)..(655): n is either a, c, g or t
tgttgttggcgcgggggtcggggtttgtggtgcgttagtattttttttttttttttttttttttttttttattaacgtttttgtagttaggcgcgttatttttcgttcgagtttggtcggggatgcgtcgttgttattggattttcgcgtttttgtagcgttggtacgtgtaggtgtacgcgttttatgaggtcgtcgcgggtttcgtcgcgtttgttaagattatgggtgtcgtttgtggttatttatttttcgtttggtggcggtatcggttgaaggttttagcgggtgtagcggtttggtcggcgagtttaggtggagttcgtgcgtttagcgcgatgtttcgcgttaaggtgtagagtttgaagatgagttagttgttggggttgttgttcgtgggttgcgagttgttttagtttgtcgatcggttggaggtagcgtggtcgttcgggtttgcgggagaatgggagggagaggttttgtcggcgtgttgcgcgtggtggcgatggttaatagcgtttttaattttttcgtttatttttttttttaggcgggcgattgtcggttttggcgatagttgcggaagcggttgggttttttgtgttgcgcgtcgtagggaggcgcggaggacgaggaggggtttcggggttattangcgttttatcgttaacgttggttttatttttattattattatgttcggcgggaatcgttggacgagggcggtttgcgtttatttttttcgcgt

SEQ ID NO: 5864 - DNA, 748 bp, Artificial Sequence
  chemically treated genomic DNA (Homo sapiens) CpG-island No: 5864
  misc_feature (94)..(94): n is either a, c, g or t
acgcgaaaaaaataaacgcaaaccgccctcgtccaacgattcccgccgaacataataataataaaaataaaaccaacgttaacgataaaacgcntaataaccccgaaacccctcctcgtcctccgcgcctccctacgacgcgcaacacaaaaaacccaaccgcttccgcaactatcgccaaaaccgacaatcgcccgcctaaaaaaaaaaataaacgaaaaaattaaaaacgctattaaccatcgccaccacgcgcaacacgccgacaaaacctctccctcccattctcccgcaaacccgaacgaccacgctacctccaaccgatcgacaaactaaaacaactcgcaacccacgaacaacaaccccaacaactaactcatcttcaaactctacaccttaacgcgaaacatcgcgctaaacgcacgaactccacctaaactcgccgaccaaaccgctacacccgctaaaaccttcaaccgataccgccaccaaacgaaaaataaataaccacaaacgacacccataatcttaacaaacgcgacgaaacccgcgacgacctcataaaacgcgtacacctacacgtaccaacgctacaaaaacgcgaaaatccaataacaacgacgcatccccgaccaaactcgaacgaaaaataacgcgcctaactacaaaaacgttaataaaaaaaaaaaaaaaaaaaaaaaaaaaaaatactaacgcaccacaaaccccgacccccgcgccaacaaca

SEQ ID NO: 5865 - DNA, 856 bp, Artificial Sequence
  chemically treated genomic DNA (Homo sapiens) CpG-island No: 5865
tttagttcgaggcgtcggatatgttgaagttcggagatttcggcggttcggttttttttaaagtggatttagtttatttgtagtattggtagtaattttttttttacggaggcgtaggttcgtttaagggtagcggcgtcgcgggttttttgagcgcgtcgtagtttttttagtcgtcgtcgtcgttttcgttttcggagcgcgttgagttttcgtcggatagtttgcgttcgcggttcgtttttttttttttcgtttcgtttacgtcggtttttttttttattttcgtttttttcgtttttttttgcgttgttgcggtcgttgtcgtcgcgttggttggtttttcggttttgtcggtgtcgtagttgtcggtgttcgcgtttttagtcgtcgttgtcgtcgtcgtcgagtcgttgttttttaaggaattgtgtttcggcgttattttcggtttcgggttcgttaagtgcggtggtggtggcggcggcggcggggagggtcgcggcgtttcgcgttttcgttgtagcgtagaggagttggattattatttgtatggttagtagcgtatggagattatttcgtttaattagtatattagcgattttaataatcgtacgtagtcgtagttcgcgcgttttttttcggggcgtcggcgtcggcgtcggcgggcgcgggtgtttgttagggaggcgggtcggataggagtgatacggggtcgggtgggtggggagtatttggttttggtcgttggttcgcgttttttcgatttttgtgataaaagttttttggcgttggagaaggaaagagaacggatgggacggtcggtggtattttggggtttttttttttttttttt

SEQ ID NO: 5866 - DNA, 856 bp, Artificial Sequence
  chemically treated genomic DNA (Homo sapiens) CpG-island No: 5866
aaaaaaaaaaaaaaaaaaccccaaaataccaccgaccgtcccatccgttctctttccttctccaacgccaaaaaacttttatcacaaaaatcgaaaaaacgcgaaccaacgaccaaaaccaaatactccccacccacccgaccccgtatcactcctatccgacccgcctccctaacaaacacccgcgcccgccgacgccgacgccgacgccccgaaaaaaaacgcgcgaactacgactacgtacgattattaaaatcgctaatatactaattaaacgaaataatctccatacgctactaaccatacaaataataatccaactcctctacgctacaacgaaaacgcgaaacgccgcgaccctccccgccgccgccgccaccaccaccgcacttaacgaacccgaaaccgaaaataacgccgaaacacaattccttaaaaaacaacgactcgacgacgacgacaacgacgactaaaaacgcgaacaccgacaactacgacaccgacaaaaccgaaaaaccaaccaacgcgacgacaacgaccgcaacaacgcaaaaaaaaacgaaaaaaacgaaaataaaaaaaaaaaccgacgtaaacgaaacgaaaaaaaaaaaaacgaaccgcgaacgcaaactatccgacgaaaactcaacgcgctccgaaaacgaaaacgacgacgacgactaaaaaaactacgacgcgctcaaaaaacccgcgacgccgctacccttaaacgaacctacgcctccgtaaaaaaaaaattactaccaatactacaaataaactaaatccactttaaaaaaaaccgaaccgccgaaatctccgaacttcaacatatccgacgcctcgaactaaa

SEQ ID NO: 5867 - DNA, 856 bp, Artificial Sequence
  chemically treated genomic DNA (Homo sapiens) CpG-island No: 5867
agagggagggagagggaattttaaagtgttatcggtcgttttattcgttttttttttttttttaacgttagaaaatttttgttatagagatcggggaggcgcgggttagcggttaggattaggtgttttttatttattcggtttcgtgttatttttattcgattcgtttttttgataggtattcgcgttcgtcggcgtcggcgtcggcgtttcgggagagagcgcgcgggttgcggttacgtacggttgttggggtcgttggtgtgttggttgagcgggatgatttttatgcgttgttggttatataggtaatagtttagtttttttgcgttgtagcggaagcgcggggcgtcgcgatttttttcgtcgtcgtcgttattattatcgtatttgacgggttcggggtcggaggtggcgtcgaggtatagttttttggggggtagcggttcggcggcgacggtagcggcggttagaggcgcgaatatcggtagttgcgatatcggtagggtcgagagattagttagcgcggcggtagcggtcgtagtagcgtaggaggaggcggaggaggcggaggtggaagaggaagtcggcgtggacgaggcggaggagagagaggcgggtcgcgggcgtaggttgttcggcggaggtttagcgcgtttcgggggcgggggcggcggcggcggttgaagaggttgcggcgcgtttaggagattcgcggcgtcgttgtttttgagcgggtttgcgttttcgtgagggaagagttgttgttagtgttgtaggtaggttgggtttattttgaggaaggtcgaatcgtcggggttttcgggttttagtatgttcggcgtttcgaattggg

SEQ ID NO: 5868 - DNA, 856 bp, Artificial Sequence
  chemically treated genomic DNA (Homo sapiens) CpG-island No: 5868
cccaattcgaaacgccgaacatactaaaacccgaaaaccccgacgattcgaccttcctcaaaataaacccaacctacctacaacactaacaacaactcttccctcacgaaaacgcaaacccgctcaaaaacaacgacgccgcgaatctcctaaacgcgccgcaacctcttcaaccgccgccgccgcccccgcccccgaaacgcgctaaacctccgccgaacaacctacgcccgcgacccgcctctctctcctccgcctcgtccacgccgacttcctcttccacctccgcctcctccgcctcctcctacgctactacgaccgctaccgccgcgctaactaatctctcgaccctaccgatatcgcaactaccgatattcgcgcctctaaccgccgctaccgtcgccgccgaaccgctaccccccaaaaaactatacctcgacgccacctccgaccccgaacccgtcaaatacgataataataacgacgacgacgaaaaaaatcgcgacgccccgcgcttccgctacaacgcaaaaaaactaaactattacctatataaccaacaacgcataaaaatcatcccgctcaaccaacacaccaacgaccccaacaaccgtacgtaaccgcaacccgcgcgctctctcccgaaacgccgacgccgacgccgacgaacgcgaatacctatcaaaaaaacgaatcgaataaaaataacacgaaaccgaataaataaaaaacacctaatcctaaccgctaacccgcgcctccccgatctctataacaaaaattttctaacgttaaaaaaaaaaaaaaaacgaataaaacgaccgataacactttaaaattccctctccctccctct

SEQ ID NO: 5869 - DNA, 884 bp, Artificial Sequence
  chemically treated genomic DNA (Homo sapiens) CpG-island No: 5869
gagaggagcggtgggtaacgtgtttgtgttcggcgaatgcgtatattttagttaggtcgttggttcggatttagaaatgtttcgttttttttagtgtttgttttcgtttaggtttcggttttttgtggttcggtcgacggttcgggagttgcgcgcggtcgcgtgcgggagggggcgggtgggaaggatttgtagtgcgacgatatacgaaggttgagtgtttcgttgcgtatcgaattaacgaaattgagatatttaggtgtcgtatcgcgagtacgaatcgagtatagagtatagattaaaggacgattttaatttttaataattcgggaagtcgcggttttttaagttttattagttttacgtgagtatttagcgtcgttgattcgggcgagggggagtcgttggcgacgggtagcgtttaggcggtttttttagagcgatttttttcggcgcgttgcggtttttgtttcgttcggtcgtttggcgttcgttagttgttagttttttggtgggtgtggacgggtgtttatttttttgtcgcgcggttagttatcgacgtggttttgttcggcggttttttcgttcgtcggtgggttgtatgtttttttggttgcgcggcgaggttttggagatttttcggggttcggttttcgtcgatcgggtagtttagtttagtcgcgtcgcggagttttgcgtttagtttttaagagtttattcgcgcggttgtttttttgtcgttcgcggttgtagttagttcgggaggagaagacggcgtggaattcgtttttttcgttttttttcgtcgatttttatttttttaggtggatttttttttgttttttggatagatgggttatcgtttttattgtggtttttttata

SEQ ID NO: 5870 - DNA, 884 bp, Artificial Sequence
  chemically treated genomic DNA (Homo sapiens) CpG-island No: 5870
tataaaaaaaccacaataaaaacgataacccatctatccaaaaaacaaaaaaaaatccacctaaaaaaataaaaatcgacgaaaaaaaacgaaaaaaacgaattccacgccgtcttctcctcccgaactaactacaaccgcgaacgacaaaaaaacaaccgcgcgaataaactcttaaaaactaaacgcaaaactccgcgacgcgactaaactaaactacccgatcgacgaaaaccgaaccccgaaaaatctccaaaacctcgccgcgcaaccaaaaaaacatacaacccaccgacgaacgaaaaaaccgccgaacaaaaccacgtcgataactaaccgcgcgacaaaaaaataaacacccgtccacacccaccaaaaaactaacaactaacgaacgccaaacgaccgaacgaaacaaaaaccgcaacgcgccgaaaaaaatcgctctaaaaaaaccgcctaaacgctacccgtcgccaacgactccccctcgcccgaatcaacgacgctaaatactcacgtaaaactaataaaacttaaaaaaccgcgacttcccgaattattaaaaattaaaatcgtcctttaatctatactctatactcgattcgtactcgcgatacgacacctaaatatctcaatttcgttaattcgatacgcaacgaaacactcaaccttcgtatatcgtcgcactacaaatccttcccacccgccccctcccgcacgcgaccgcgcgcaactcccgaaccgtcgaccgaaccacaaaaaaccgaaacctaaacgaaaacaaacactaaaaaaaacgaaacatttctaaatccgaaccaacgacctaactaaaatatacgcattcgccgaacacaaacacgttacccaccgctcctctc

SEQ ID NO: 5871 - DNA, 884 bp, Artificial Sequence
  chemically treated genomic DNA (Homo sapiens) CpG-island No: 5871
tatgagaggattatagtgaaaacggtagtttatttgtttaaagaatagaaagaagtttatttggaaagatgggagtcggcggaggggggcgagaagaacgagttttacgtcgtttttttttttcgggttaattgtagtcgcgggcggtaggaaggtagtcgcgcgggtgggtttttggggattgggcgtagggtttcgcggcgcggttgggttgggttgttcgatcggcgagggtcgggtttcgggaagtttttagggtttcgtcgcgtagttaggaaagtatgtagtttatcgacgggcggaggaatcgtcgggtaaagttacgtcggtggttgatcgcgcggtagggaggtgggtattcgtttatatttattaggaggttgatagttggcgagcgttaggcggtcgggcgggataagggtcgtagcgcgtcggagggggtcgttttgagaaagtcgtttgggcgttgttcgtcgttaacgattttttttcgttcggattagcggcgttggatatttacgtagggttggtagaatttggagagtcgcggtttttcgggttgttgaagattaggatcgttttttgatttatgttttgtgttcggttcgtattcgcggtgcggtatttgggtgttttagtttcgttggttcggtgcgtagcgaagtatttagttttcgtatatcgtcgtattgtagattttttttattcgttttttttcgtacgcgatcgcgcgtagttttcgagtcgtcggtcgggttataaggggtcggggtttgggcgggggtaggtattaaggaaagcgaaatatttttaggttcgagttagcggtttaattggagtgtgcgtattcgtcgagtatagatacgttgtttatcgtttttttt

SEQ ID NO: 5872 - DNA, 884 bp, Artificial Sequence
  chemically treated genomic DNA (Homo sapiens) CpG-island No: 5872
aaaaaaaacgataaacaacgtatctatactcgacgaatacgcacactccaattaaaccgctaactcgaacctaaaaatatttcgctttccttaatacctacccccgcccaaaccccgaccccttataacccgaccgacgactcgaaaactacgcgcgatcgcgtacgaaaaaaaacgaataaaaaaaatctacaatacgacgatatacgaaaactaaatacttcgctacgcaccgaaccaacgaaactaaaacacccaaataccgcaccgcgaatacgaaccgaacacaaaacataaatcaaaaaacgatcctaatcttcaacaacccgaaaaaccgcgactctccaaattctaccaaccctacgtaaatatccaacgccgctaatccgaacgaaaaaaaatcgttaacgacgaacaacgcccaaacgactttctcaaaacgaccccctccgacgcgctacgacccttatcccgcccgaccgcctaacgctcgccaactatcaacctcctaataaatataaacgaatacccacctccctaccgcgcgatcaaccaccgacgtaactttacccgacgattcctccgcccgtcgataaactacatactttcctaactacgcgacgaaaccctaaaaacttcccgaaacccgaccctcgccgatcgaacaacccaacccaaccgcgccgcgaaaccctacgcccaatccccaaaaacccacccgcgcgactaccttcctaccgcccgcgactacaattaacccgaaaaaaaaaaacgacgtaaaactcgttcttctcgcccccctccgccgactcccatctttccaaataaacttctttctattctttaaacaaataaactaccgttttcactataatcctctcata

SEQ ID NO: 5873 - DNA, 554 bp, Artificial Sequence
  chemically treated genomic DNA (Homo sapiens) CpG-island No: 5873
ggtttttacgttttattggagatacgtattttagtcgttacgacgtagcggtaaattttcgcgtagcgtcggttcgttaatttggatgatgttaattttagcggtttttagatcggttattttattacgtagcgttagcgtaatttgtttggcgatggttttacggttgatatttttacgcgggaacgattagtagagtatggtgatcggtttcgttagtattttttttatcggtttgtcggttagcgattgcgtatatttcgtttattttacggtaatcggtgtcgggcggttaatgttattaatgataatcggtggttttacgtagcgggaatcgtagttttgtatttaatcgttttgcgtaaagataaattcgtcgaagtgttcgttaaagtattttattatgttattacgttcgggttcgttatgtattagtatatttagttttaaacgtttttgtttaataatggtttgtttgatatgtttcgtaatgttcgtgcggtagttggttggcgtttagattgttttttttgaaatttagacgtagggtacga

SEQ ID NO: 5874 - DNA, 554 bp, Artificial Sequence
  chemically treated genomic DNA (Homo sapiens) CpG-island No: 5874
tcgtaccctacgtctaaatttcaaaaaaaacaatctaaacgccaaccaactaccgcacgaacattacgaaacatatcaaacaaaccattattaaacaaaaacgtttaaaactaaatatactaatacataacgaacccgaacgtaataacataataaaatactttaacgaacacttcgacgaatttatctttacgcaaaacgattaaatacaaaactacgattcccgctacgtaaaaccaccgattatcattaataacattaaccgcccgacaccgattaccgtaaaataaacgaaatatacgcaatcgctaaccgacaaaccgataaaaaaaatactaacgaaaccgatcaccatactctactaatcgttcccgcgtaaaaatatcaaccgtaaaaccatcgccaaacaaattacgctaacgctacgtaataaaataaccgatctaaaaaccgctaaaattaacatcatccaaattaacgaaccgacgctacgcgaaaatttaccgctacgtcgtaacgactaaaatacgtatctccaataaaacgtaaaaacc

SEQ ID NO: 5875 - DNA, 554 bp, Artificial Sequence
  chemically treated genomic DNA (Homo sapiens) CpG-island No: 5875
tcgtattttgcgtttggattttaaaaagggtaatttagacgttaattaattatcgtacgggtattgcggaatatattaagtaggttattgttgagtaggaacgtttgggattggatgtgttggtatatggcgagttcgagcgtaatgatatggtggaatattttggcgagtatttcgacggatttgtttttacgtaaaacggttgggtatagagttacggttttcgttgcgtgaagttatcgattgttattggtgatattagtcgttcggtatcgattatcgtggagtgggcgaagtatgcgtaatcgttgatcgataaatcggtgaaagggatgttgacggggtcggttattatattttgttggtcgttttcgcgtgaagatgttagtcgtgaaattatcgttaaatagattgcgttggcgttgcgtgatgaagtggtcgatttggaagtcgttggaattggtattatttagattgacgaatcggcgttgcgcgaaggtttatcgttgcgtcgtagcgattgggatgcgtatttttagtggggcgtagaggtt

SEQ ID NO: 5876 - DNA, 554 bp, Artificial Sequence
  chemically treated genomic DNA (Homo sapiens) CpG-island No: 5876
aacctctacgccccactaaaaatacgcatcccaatcgctacgacgcaacgataaaccttcgcgcaacgccgattcgtcaatctaaataataccaattccaacgacttccaaatcgaccacttcatcacgcaacgccaacgcaatctatttaacgataatttcacgactaacatcttcacgcgaaaacgaccaacaaaatataataaccgaccccgtcaacatccctttcaccgatttatcgatcaacgattacgcatacttcgcccactccacgataatcgataccgaacgactaatatcaccaataacaatcgataacttcacgcaacgaaaaccgtaactctatacccaaccgttttacgtaaaaacaaatccgtcgaaatactcgccaaaatattccaccatatcattacgctcgaactcgccatataccaacacatccaatcccaaacgttcctactcaacaataacctacttaatatattccgcaatacccgtacgataattaattaacgtctaaattaccctttttaaaatccaaacgcaaaatacga

SEQ ID NO: 5877 - DNA, 531 bp, Artificial Sequence
  chemically treated genomic DNA (Homo sapiens) CpG-island No: 5877
ggagcgcgtttcgatagttttgaatattttttatttaacggttgagagtcgttgggagtttaacgtttgtaatcgagtgagttcgagttcggttggggtcggatcgttggattttttcgttggttttttgttgtattttttcgcgttttgggttcgcgtaagttttttttgttacgcgttttaacggtcgtttatcggtatcgggttgaatacggtgcgttttatttcggagtttttattttattttaaggatttaatagcgtataagttgttttttacgggtaattatttttgtaagttttattttcggtttcgttacgtttcgtagggttttttgtttggtttggattatttcgttttttttgcgtttttttttttggtttagttagataagtgttttttacgatttagcgcgtttatcgttcggtttcgtcgtcgttaaggggtgggggtgtttgattcgttaggttttgcgtttttttttcggatttatttttaatgtttaggtaagatttttatatgaagtcggtg

SEQ ID NO: 5878 - DNA, 531 bp, Artificial Sequence
  chemically treated genomic DNA (Homo sapiens) CpG-island No: 5878
caccgacttcatataaaaatcttacctaaacattaaaaataaatccgaaaaaaaaacgcaaaacctaacgaatcaaacacccccaccccttaacgacgacgaaaccgaacgataaacgcgctaaatcgtaaaaaacacttatctaactaaaccaaaaaaaaaaacgcaaaaaaaacgaaataatccaaaccaaacaaaaaaccctacgaaacgtaacgaaaccgaaaataaaacttacaaaaataattacccgtaaaaaacaacttatacgctattaaatccttaaaataaaataaaaactccgaaataaaacgcaccgtattcaacccgataccgataaacgaccgttaaaacgcgtaacaaaaaaaacttacgcgaacccaaaacgcgaaaaaatacaacaaaaaaccaacgaaaaaatccaacgatccgaccccaaccgaactcgaactcactcgattacaaacgttaaactcccaacgactctcaaccgttaaataaaaaatattcaaaactatcgaaacgcgctcc

SEQ ID NO: 5879 - DNA, 531 bp, Artificial Sequence
  chemically treated genomic DNA (Homo sapiens) CpG-island No: 5879
tatcggttttatgtaagagttttgtttggatattgaggatggattcgagagagaagcgtagagtttgacggattagatatttttattttttagcggcgacgaaatcgagcggtaaacgcgttggatcgtgagaagtatttgtttagttaggttaaggagagaggcgtagggagagcgaggtgatttagattagatagggaattttgcggggcgtggcggggtcgggggtgaagtttgtagaggtagttgttcgtgaagagtagtttgtgcgttgttggatttttggagtggagtgggaatttcgaggtgaagcgtatcgtgtttagttcgatgtcggtgagcggtcgttggaacgcgtggtagagaaagtttgcgcgagtttagggcgcgaagaagtataataaagggttaacggggaggtttaacggttcgattttagtcggattcgagtttattcggttgtaggcgttaggtttttagcggtttttagtcgttaagtggagaatgtttaggattgtcgaggcgcgtttt

SEQ ID NO: 5880 - DNA, 531 bp, Artificial Sequence
  chemically treated genomic DNA (Homo sapiens) CpG-island No: 5880
aaaacgcgcctcgacaatcctaaacattctccacttaacgactaaaaaccgctaaaaacctaacgcctacaaccgaataaactcgaatccgactaaaatcgaaccgttaaacctccccgttaaccctttattatacttcttcgcgccctaaactcgcgcaaactttctctaccacgcgttccaacgaccgctcaccgacatcgaactaaacacgatacgcttcacctcgaaattcccactccactccaaaaatccaacaacgcacaaactactcttcacgaacaactacctctacaaacttcacccccgaccccgccacgccccgcaaaattccctatctaatctaaatcacctcgctctccctacgcctctctccttaacctaactaaacaaatacttctcacgatccaacgcgtttaccgctcgatttcgtcgccgctaaaaaataaaaatatctaatccgtcaaactctacgcttctctctcgaatccatcctcaatatccaaacaaaactcttacataaaaccgata

SEQ ID NO: 5881 - DNA, 673 bp, Artificial Sequence
  chemically treated genomic DNA (Homo sapiens) CpG-island No: 5881
tttcgttcggggcgttattattcgcgcggttaagagaatttttttcggagtttttgcggtttggcgcgtttagggcgtatttttcgttcgttcgttcgtcgcgtttttagttggggcgtcgttttttcgttcgtaggttttcgttttttcgttttgttgaatgttttgaagaagtcgtatttcgtcgtcgcggtaggtattttcggagggagagtttgaatttggttatatacggttattcgtaatgagttcgggagttttcggacgggagttatatttcgcgacgagttgattttttttcgttggtttgggtaaggagtttgttgtttttttcgtttttttttcggtttttcggcgtttgcggttgggggacggggtagcggacggagcgacgattttcgtttttgtttttgcgtttatggtcggggcgtcgtgggtgttttttatataaaagaaaagtcgagcgttttatattcggcggatttgattcggggttgcggggcggggtcgcggttggaagtgcgcgttcgcgggggatttcgtaggtcgatcggacgttaggacgtcggggtcgcgtttaaattcgtgcggtaggagggaggtgtagcgtttttagggttttttaaggtcggggagagtttcgaatttttattatttttttttttggtttttt

SEQ ID NO: 5882 - DNA, 673 bp, Artificial Sequence
  chemically treated genomic DNA (Homo sapiens) CpG-island No: 5882
aaaaaaccaaaaaaaaaaataataaaaattcgaaactctccccgaccttaaaaaaccctaaaaacgctacacctccctcctaccgcacgaatttaaacgcgaccccgacgtcctaacgtccgatcgacctacgaaatcccccgcgaacgcgcacttccaaccgcgaccccgccccgcaaccccgaatcaaatccgccgaatataaaacgctcgacttttcttttatataaaaaacacccacgacgccccgaccataaacgcaaaaacaaaaacgaaaatcgtcgctccgtccgctaccccgtcccccaaccgcaaacgccgaaaaaccgaaaaaaaaacgaaaaaaacaacaaactccttacccaaaccaacgaaaaaaaatcaactcgtcgcgaaatataactcccgtccgaaaactcccgaactcattacgaataaccgtatataaccaaattcaaactctccctccgaaaatacctaccgcgacgacgaaatacgacttcttcaaaacattcaacaaaacgaaaaaacgaaaacctacgaacgaaaaaacgacgccccaactaaaaacgcgacgaacgaacgaacgaaaaatacgccctaaacgcgccaaaccgcaaaaactccgaaaaaaattctcttaaccgcgcgaataataacgccccgaacgaaa

SEQ ID NO: 5883 - DNA, 673 bp, Artificial Sequence
  chemically treated genomic DNA (Homo sapiens) CpG-island No: 5883
aagagattagaaaaaggagtgatgggaattcgaggtttttttcggttttggaaaattttggaagcgttgtattttttttttgtcgtacggatttgagcgcggtttcgacgttttggcgttcgatcggtttgcggagtttttcgcgggcgcgtatttttagtcgcgatttcgtttcgtagtttcgggttagattcgtcgagtatgaagcgttcggttttttttttgtgtgaggagtatttacgacgtttcgattatgggcgtaggggtagaggcgaaggtcgtcgtttcgttcgttatttcgttttttagtcgtaagcgtcgaggagtcggaagagaggcggaaagggtagtaggttttttatttagattagcgaggggaggttagttcgtcgcggggtgtggttttcgttcggggattttcgagtttattacgggtggtcgtgtgtagttaagtttaagtttttttttcgggaatgtttgtcgcggcggcggaatacggtttttttaggatatttagtaaagcggggaggcggggatttgcgggcggaggagcgacgttttagttgggaacgcggcggacgggcgagcggggggtgcgttttgggcgcgttaggtcgtagaggtttcggggaaagtttttttggtcgcgcgagtggtggcgtttcgggcggga

SEQ ID NO: 5884 - DNA, 673 bp, Artificial Sequence
  chemically treated genomic DNA (Homo sapiens) CpG-island No: 5884
tcccgcccgaaacgccaccactcgcgcgaccaaaaaaactttccccgaaacctctacgacctaacgcgcccaaaacgcaccccccgctcgcccgtccgccgcgttcccaactaaaacgtcgctcctccgcccgcaaatccccgcctccccgctttactaaatatcctaaaaaaaccgtattccgccgccgcgacaaacattcccgaaaaaaaaacttaaacttaactacacacgaccacccgtaataaactcgaaaatccccgaacgaaaaccacaccccgcgacgaactaacctcccctcgctaatctaaataaaaaacctactaccctttccgcctctcttccgactcctcgacgcttacgactaaaaaacgaaataacgaacgaaacgacgaccttcgcctctacccctacgcccataatcgaaacgtcgtaaatactcctcacacaaaaaaaaaaccgaacgcttcatactcgacgaatctaacccgaaactacgaaacgaaatcgcgactaaaaatacgcgcccgcgaaaaactccgcaaaccgatcgaacgccaaaacgtcgaaaccgcgctcaaatccgtacgacaaaaaaaaaatacaacgcttccaaaattttccaaaaccgaaaaaaacctcgaattcccatcactcctttttctaatctctt

SEQ ID NO: 5885 - DNA, 579 bp, Artificial Sequence
  chemically treated genomic DNA (Homo sapiens) CpG-island No: 5885
gtcgtattcgatatgtttttttttaaattagaataatagcgttagttcgtcgataattatattagatattgttattatcgtttttgttagttataaggttttcgtcgggaacgttttgcgtagtataattagtgacggtaaatttattgtcgggagcgttattaataatgttagcgtcggagcggtttttatatttgttagtattatcgtttgtataatcggaatttttgttgtcgtgggaatgataaataagtattttgttatcgttatcgttattatttatattaggttgttatcgatagtattatcggtatgggggaataattagacgcgagcggtatttaatattagtattgtaaggatgtaaatcgggatcgtattttagaaaagcgtttatagcgttttgttttagcggttaaaaaattcgttttgtgttttcggtatgttaatttcgatcggtgtttgcgtttgcggtgttttacgtatttatttttgtattagcgtcgtaattagtaatattattattagttcggttattagacgaatcgtcgtaaaattttagtcgaggataaagtttat

SEQ ID NO: 5886 - DNA, 579 bp, Artificial Sequence
  chemically treated genomic DNA (Homo sapiens) CpG-island No: 5886
ataaactttatcctcgactaaaattttacgacgattcgtctaataaccgaactaataataatattactaattacgacgctaatacaaaaataaatacgtaaaacaccgcaaacgcaaacaccgatcgaaattaacataccgaaaacacaaaacgaattttttaaccgctaaaacaaaacgctataaacgcttttctaaaatacgatcccgatttacatccttacaatactaatattaaataccgctcgcgtctaattattcccccataccgataatactatcgataacaacctaatataaataataacgataacgataacaaaatacttatttatcattcccacgacaacaaaaattccgattatacaaacgataatactaacaaatataaaaaccgctccgacgctaacattattaataacgctcccgacaataaatttaccgtcactaattatactacgcaaaacgttcccgacgaaaaccttataactaacaaaaacgataataacaatatctaatataattatcgacgaactaacgctattattctaatttaaaaaaaaacatatcgaatacgac

SEQ ID NO: 5887 - DNA, 579 bp, Artificial Sequence
  chemically treated genomic DNA (Homo sapiens) CpG-island No: 5887
atgggttttgttttcggttggggttttgcggcgattcgtttggtggtcgggttggtgatggtgttgttgattgcgacgttggtgtaaaaatgggtgcgtgaaatatcgtaaacgtaggtatcggtcgaaattgatatatcggaagtatagggcgggttttttagtcgttggggtagggcgttatggacgtttttttggagtacgatttcggtttatatttttgtagtattggtgttgggtgtcgttcgcgtttggttatttttttatgtcgatggtgttgtcgataatagtttgatgtgggtggtggcgatggcggtagtaggatgtttgtttgttatttttacggtagtagaaatttcgattgtataaacgatgatgttggtaggtatgggaatcgtttcggcgttggtattgttgatgacgttttcggtagtgagtttgtcgttattgattatgttgcgtaaagcgttttcggcgaaagttttatggttgataggggcgatggtggtagtgtttggtgtgattgtcggcgggttggcgttgttgttttgatttgagggaaaatatgtcggatgcggt

SEQ ID NO: 5888 - DNA, 579 bp, Artificial Sequence
  chemically treated genomic DNA (Homo sapiens) CpG-island No: 5888
accgcatccgacatattttccctcaaatcaaaacaacaacgccaacccgccgacaatcacaccaaacactaccaccatcgcccctatcaaccataaaactttcgccgaaaacgctttacgcaacataatcaataacgacaaactcactaccgaaaacgtcatcaacaataccaacgccgaaacgattcccatacctaccaacatcatcgtttatacaatcgaaatttctactaccgtaaaaataacaaacaaacatcctactaccgccatcgccaccacccacatcaaactattatcgacaacaccatcgacataaaaaaataaccaaacgcgaacgacacccaacaccaatactacaaaaatataaaccgaaatcgtactccaaaaaaacgtccataacgccctaccccaacgactaaaaaacccgccctatacttccgatatatcaatttcgaccgatacctacgtttacgatatttcacgcacccatttttacaccaacgtcgcaatcaacaacaccatcaccaacccgaccaccaaacgaatcgccgcaaaaccccaaccgaaaacaaaacccat

SEQ ID NO: 5889 - DNA, 637 bp, Artificial Sequence
  chemically treated genomic DNA (Homo sapiens) CpG-island No: 5889
ttatcgatatcggtattcgttttcgtagatacgtgtacgaattggtttttatcgttttattttttcggtaggatgtcgtattgggagagttcgtttttaacgcgattcggattagtttttggtttatcgattttgtttattgtaattattatcggtatttgcgtcgttttcgcgtgttggattgtttcgatggtttgcggtattatatcgtcgtcggtagtaataattaggattacgatgttcgttgtttgcgtattacgagtacgtattgaagtaaacgcggcgtgtttcggggtgtttaggaaggtgattatgtcgtttttagttttaacgtggtatgtattaatgtgttgggtaatgtcgttcgtttcgttagaggttattttcgttgaacgaatgtagtttagtagagaggttttatcgtggttaacgtgatttatgatggttataatcggcgcgcgcggtttagtcgtagtattcgtgttacggtcgtttattatcgttttttttagttcgtttttacgacgtaggataattttatggtttatttttttagtaattagttgtgcggttttttgatcgataatttggttgatggttggtattgcgtttagtttttattattcgtttttggatg

SEQ ID NO: 5890 - DNA, 637 bp, Artificial Sequence
  chemically treated genomic DNA (Homo sapiens) CpG-island No: 5890
catccaaaaacgaataataaaaactaaacgcaataccaaccatcaaccaaattatcgatcaaaaaaccgcacaactaattactaaaaaaataaaccataaaattatcctacgtcgtaaaaacgaactaaaaaaaacgataataaacgaccgtaacacgaatactacgactaaaccgcgcgcgccgattataaccatcataaatcacgttaaccacgataaaacctctctactaaactacattcgttcaacgaaaataacctctaacgaaacgaacgacattacccaacacattaatacataccacgttaaaactaaaaacgacataatcaccttcctaaacaccccgaaacacgccgcgtttacttcaatacgtactcgtaatacgcaaacaacgaacatcgtaatcctaattattactaccgacgacgatataataccgcaaaccatcgaaacaatccaacacgcgaaaacgacgcaaataccgataataattacaataaacaaaatcgataaaccaaaaactaatccgaatcgcgttaaaaacgaactctcccaatacgacatcctaccgaaaaaataaaacgataaaaaccaattcgtacacgtatctacgaaaacgaataccgatatcgataa

SEQ ID NO: 5891 - DNA, 637 bp, Artificial Sequence
  chemically treated genomic DNA (Homo sapiens) CpG-island No: 5891
tatttaaaagcggatgatggaaattgggcgtaatgttaattattaattaggttatcgattaggaaatcgtatagttggttgttgaagagatgggttataaagttattttgcgtcgtgaaaacgagttggaagaggcggtaatgagcgatcgtgatacgggtgttgcggttgaatcgcgcgcgtcggttgtgattattatgggttacgttgattacggtaaaatttttttgttggattatattcgtttaacgaaagtggtttttggcgaagcgggcggtattatttagtatattggtgtatattacgttgaaattgaaaacggtatgattatttttttggatatttcggggtacgtcgcgtttattttaatgcgtgttcgtggtgcgtaggtaacggatatcgtagttttggttgttgttgtcgacgacggtgtgatgtcgtagattatcgaagtaatttagtacgcgaaagcggcgtaggtatcggtggtggttgtagtgaataagatcgataaattagaagttgattcggatcgcgttaagaacgaatttttttagtacggtattttgtcggaagagtggggcggtgaaagttagttcgtatacgtatttgcgaaagcgggtatcggtatcgatga

SEQ ID NO: 5892 - DNA, 637 bp, Artificial Sequence
  chemically treated genomic DNA (Homo sapiens) CpG-island No: 5892
tcatcgataccgatacccgctttcgcaaatacgtatacgaactaactttcaccgccccactcttccgacaaaataccgtactaaaaaaattcgttcttaacgcgatccgaatcaacttctaatttatcgatcttattcactacaaccaccaccgatacctacgccgctttcgcgtactaaattacttcgataatctacgacatcacaccgtcgtcgacaacaacaaccaaaactacgatatccgttacctacgcaccacgaacacgcattaaaataaacgcgacgtaccccgaaatatccaaaaaaataatcataccgttttcaatttcaacgtaatatacaccaatatactaaataataccgcccgcttcgccaaaaaccactttcgttaaacgaatataatccaacaaaaaaattttaccgtaatcaacgtaacccataataatcacaaccgacgcgcgcgattcaaccgcaacacccgtatcacgatcgctcattaccgcctcttccaactcgttttcacgacgcaaaataactttataacccatctcttcaacaaccaactatacgatttcctaatcgataacctaattaataattaacattacgcccaatttccatcatccgcttttaaata

SEQ ID NO: 5893 - DNA, 782 bp, Artificial Sequence
  chemically treated genomic DNA (Homo sapiens) CpG-island No: 5893
  misc_feature (753)..(753): n is either a, c, g or t
gttggattttagttttttcggttgaaaattttcgcggtaatattattcgtgataacggtatcgatattagacgcgtgttgaattcgttcgcgtttttgaaatcggtggtcgatacgttgatattaagtgtaagcgggcgttggattagacgggttttagcgattggttatggcgggcggcgtgagtgttaatcgtacgttacgggcgaagttggttgaaatgatgaaaaaacgtcgcggcgaagtgttttacgcgcgttcggaattttgtattgatacggcgcgatgatcgtttatgtcggaatggtgcggtttaaagtaggcgcgacggcggatttcggcgttagcgtgcgtcgcgttggtcgttggcggagttatcggttgcgtaaaattattgggtgtcggagagtaattttcggtatcgtttttatttaaagtaatattacgggtatttatagtaagtcggtaattattagtaatacgaggaatattagtttaaaaatcgtttttagtcgttagtaattcgtcgttggtagataattattgtcgtagtaaatcggattggggtcggtggcgtatggtgtaagaatgttttttagattaattgtcgtattaattattaggtagaatatcggtagcgggattttcggtatcgttagcgtagtagtaattattatcggtgcgagagcggaggtatacgtcgtggcgttggcgaaaaagtagcgtagtagataaaatattataattaacgttnatattattatcgttggcgaataaacgttt

SEQ ID NO: 5894 - DNA, 782 bp, Artificial Sequence
  chemically treated genomic DNA (Homo sapiens) CpG-island No: 5894
  misc_feature (30)..(30): n is either a, c, g or t
aaacgtttattcgccaacgataataatatnaacgttaattataatattttatctactacgctactttttcgccaacgccacgacgtatacctccgctctcgcaccgataataattactactacgctaacgataccgaaaatcccgctaccgatattctacctaataattaatacgacaattaatctaaaaaacattcttacaccatacgccaccgaccccaatccgatttactacgacaataattatctaccaacgacgaattactaacgactaaaaacgatttttaaactaatattcctcgtattactaataattaccgacttactataaatacccgtaatattactttaaataaaaacgataccgaaaattactctccgacacccaataattttacgcaaccgataactccgccaacgaccaacgcgacgcacgctaacgccgaaatccgccgtcgcgcctactttaaaccgcaccattccgacataaacgatcatcgcgccgtatcaatacaaaattccgaacgcgcgtaaaacacttcgccgcgacgttttttcatcatttcaaccaacttcgcccgtaacgtacgattaacactcacgccgcccgccataaccaatcgctaaaacccgtctaatccaacgcccgcttacacttaatatcaacgtatcgaccaccgatttcaaaaacgcgaacgaattcaacacgcgtctaatatcgataccgttatcacgaataatattaccgcgaaaattttcaaccgaaaaaactaaaatccaac

SEQ ID NO: 5895 - DNA, 782 bp, Artificial Sequence
  chemically treated genomic DNA (Homo sapiens) CpG-island No: 5895
  misc_feature (30)..(30): n is either a, c, g or t
aagcgtttattcgttaacgatggtgatgtnggcgttgattgtggtgttttatttattgcgttattttttcgttagcgttacggcgtatattttcgttttcgtatcgatgatgattgttgttgcgttggcgatgtcggaaatttcgttgtcggtgttttgtttgatggttggtgcggtaattggtttggggagtatttttatattatacgttatcggttttagttcgatttattacggtagtggttatttgttaacggcggattattggcgattgggggcgatttttgggttgatatttttcgtattgttggtgattatcggtttattgtggatgttcgtggtgttgttttaagtgaggacggtgtcggaaattgtttttcggtatttaatagttttacgtagtcggtaatttcgttagcggttagcgcgacgtacgttaacgtcgagattcgtcgtcgcgtttgttttaaatcgtattatttcggtataggcgattatcgcgtcgtattagtataaaatttcggacgcgcgtagaatatttcgtcgcggcgtttttttattattttagttagtttcgttcgtaacgtacggttagtatttacgtcgttcgttatgattagtcgttaaagttcgtttgatttagcgttcgtttgtatttaatattagcgtatcgattatcgattttaaaggcgcgggcgaatttagtacgcgtttggtgtcggtgtcgttgttacgaatggtattgtcgcgaaggtttttagtcggagaagttggaatttagt

SEQ ID NO: 5896 - DNA, 782 bp, Artificial Sequence
  chemically treated genomic DNA (Homo sapiens) CpG-island No: 5896
  misc_feature (753)..(753): n is either a, c, g or t
actaaattccaacttctccgactaaaaaccttcgcgacaataccattcgtaacaacgacaccgacaccaaacgcgtactaaattcgcccgcgcctttaaaatcgataatcgatacgctaatattaaatacaaacgaacgctaaatcaaacgaactttaacgactaatcataacgaacgacgtaaatactaaccgtacgttacgaacgaaactaactaaaataataaaaaaacgccgcgacgaaatattctacgcgcgtccgaaattttatactaatacgacgcgataatcgcctataccgaaataatacgatttaaaacaaacgcgacgacgaatctcgacgttaacgtacgtcgcgctaaccgctaacgaaattaccgactacgtaaaactattaaataccgaaaaacaatttccgacaccgtcctcacttaaaacaacaccacgaacatccacaataaaccgataatcaccaacaatacgaaaaatatcaacccaaaaatcgcccccaatcgccaataatccgccgttaacaaataaccactaccgtaataaatcgaactaaaaccgataacgtataatataaaaatactccccaaaccaattaccgcaccaaccatcaaacaaaacaccgacaacgaaatttccgacatcgccaacgcaacaacaatcatcatcgatacgaaaacgaaaatatacgccgtaacgctaacgaaaaaataacgcaataaataaaacaccacaatcaacgccnacatcaccatcgttaacgaataaacgctt

SEQ ID NO: 5897 - DNA, 572 bp, Artificial Sequence
  chemically treated genomic DNA (Homo sapiens) CpG-island No: 5897
ttattcgaaattggtaaaatagtcgatggtagaaagcgagttgttgtagggtacgttggagtcgattaacgagttttatgttattgttaaaatcgtcgggattaaattgtgcgaattatataatcgttagtacggacgcgattatcgtttagttatgtcgattaatttgtacgggttatacgataatttttattcgagtaattcgtatgtgattttagtattgttgcgtcgtttttacgaggcgacggtatagaatgcgtcggacgtggtggtatggggtagcggtatatcgatgcgcgaatttttgtacgtcgatgatatggcggcggcgagtatttatgttatggagttggcgtatgaagtttggttggagaatatttagtcgatgttgtagaatattaacgtcggtacgggcgttgattgtattattcgcgagttggcgtaaattatcgttaaagtggtgggttataaaggtcgggtggtttttgatgttagtaaatcggatggtacgtcgcgtaaattgttggatgtgattcgttaattatttatatgtttgtaggtcgatgttattt

SEQ ID NO: 5898 - DNA, 572 bp, Artificial Sequence
  chemically treated genomic DNA (Homo sapiens) CpG-island No: 5898
aaataacatcgacctacaaacatataaataattaacgaatcacatccaacaatttacgcgacgtaccatccgatttactaacatcaaaaaccacccgacctttataacccaccactttaacgataatttacgccaactcgcgaataatacaatcaacgcccgtaccgacgttaatattctacaacatcgactaaatattctccaaccaaacttcatacgccaactccataacataaatactcgccgccgccatatcatcgacgtacaaaaattcgcgcatcgatataccgctaccccataccaccacgtccgacgcattctataccgtcgcctcgtaaaaacgacgcaacaatactaaaatcacatacgaattactcgaataaaaattatcgtataacccgtacaaattaatcgacataactaaacgataatcgcgtccgtactaacgattatataattcgcacaatttaatcccgacgattttaacaataacataaaactcgttaatcgactccaacgtaccctacaacaactcgctttctaccatcgactattttaccaatttcgaataa

SEQ ID NO: 5899 - DNA, 572 bp, Artificial Sequence
  chemically treated genomic DNA (Homo sapiens) CpG-island No: 5899
agataatatcgatttgtaggtatgtaggtgattaacgagttatatttagtagtttgcgcggcgtgttattcggtttgttggtattaaaaattattcggtttttgtaatttattattttgacgatggtttgcgttagttcgcggatagtgtagttaacgttcgtgtcgacgttaatgttttataatatcggttgggtgttttttagttagattttatgcgttagttttatgatatgaatgttcgtcgtcgttatattatcgacgtgtagaaattcgcgtatcggtgtatcgttgttttatattattacgttcggcgtattttgtgtcgtcgtttcgtggaagcgacgtagtaatgttgggattatatgcgaattattcgggtggaagttgtcgtgtggttcgtataggttggtcggtatgattgagcggtaatcgcgttcgtattggcggttgtatgattcgtatagtttgatttcggcgattttggtaatagtataaggttcgttagtcggttttagcgtgttttgtaataattcgttttttgttatcggttgttttgttagtttcgggtag

SEQ ID NO: 5900 - DNA, 572 bp, Artificial Sequence
  chemically treated genomic DNA (Homo sapiens) CpG-island No: 5900
ctacccgaaactaacaaaacaaccgataacaaaaaacgaattattacaaaacacgctaaaaccgactaacgaaccttatactattaccaaaatcgccgaaatcaaactatacgaatcatacaaccgccaatacgaacgcgattaccgctcaatcataccgaccaacctatacgaaccacacgacaacttccacccgaataattcgcatataatcccaacattactacgtcgcttccacgaaacgacgacacaaaatacgccgaacgtaataatataaaacaacgatacaccgatacgcgaatttctacacgtcgataatataacgacgacgaacattcatatcataaaactaacgcataaaatctaactaaaaaacacccaaccgatattataaaacattaacgtcgacacgaacgttaactacactatccgcgaactaacgcaaaccatcgtcaaaataataaattacaaaaaccgaataatttttaataccaacaaaccgaataacacgccgcgcaaactactaaatataactcgttaatcacctacatacctacaaatcgatattatct

SEQ ID NO: 5901 - DNA, 786 bp, Artificial Sequence
  chemically treated genomic DNA (Homo sapiens) CpG-island No: 5901
tacgttaaaacgtaattattcggtttttagttattagtattaaatatggcggtttttatcgagtattatatttagattacgagatcgcgcgttgtcggagttagtttgtcggtttattggggcgcgtttatttttagattgattaataaacgcgaggcgtaaggtacgtttttttttttttcgttttcgttaataatttttcggttttttttataggatttaattatcgtttcggttttttttgaatgaaaaggtagcggtttagttagtagagtagtagttcgacgtaagaggtaggaagcgtagtaattcgtgtttgagcgttcggcggaaaaacgaagttggaagtgttttttagtagcgcgcggagaagaacggggagttaggtgagtagcggatttcgggcgcggggtcgcggtgtggggacgtttgaattgagagcgagaggacgaggggagacgttgggatttaaggggagggggagaaagggtcgcgagacggtgggggcggggcggttggtgtgttagagcgttgtgtgttggtcgttgggtatcggggcgtatgcgttaggggtgggttagtcgttggcgcgcggtgttcggggttcggggttcgtttttcggaggggttgttatggtttacggcgtttcgagttttatttggagtttgttagttcgttcgaatagatttcgcggcggtttggggttatttggagagggacgagggggtgacgtcggggtttggggtttgggtgggagaagttggagtttttagttgttaggggtt

SEQ ID NO: 5902 - DNA, 786 bp, Artificial Sequence
  chemically treated genomic DNA (Homo sapiens) CpG-island No: 5902
aacccctaacaactaaaaactccaacttctcccacccaaaccccaaaccccgacgtcaccccctcgtccctctccaaataaccccaaaccgccgcgaaatctattcgaacgaactaacaaactccaaataaaactcgaaacgccgtaaaccataacaacccctccgaaaaacgaaccccgaaccccgaacaccgcgcgccaacgactaacccacccctaacgcatacgccccgatacccaacgaccaacacacaacgctctaacacaccaaccgccccgcccccaccgtctcgcgaccctttctccccctccccttaaatcccaacgtctcccctcgtcctctcgctctcaattcaaacgtccccacaccgcgaccccgcgcccgaaatccgctactcacctaactccccgttcttctccgcgcgctactaaaaaacacttccaacttcgtttttccgccgaacgctcaaacacgaattactacgcttcctacctcttacgtcgaactactactctactaactaaaccgctaccttttcattcaaaaaaaaccgaaacgataattaaatcctataaaaaaaaccgaaaaattattaacgaaaacgaaaaaaaaaaaaacgtaccttacgcctcgcgtttattaatcaatctaaaaataaacgcgccccaataaaccgacaaactaactccgacaacgcgcgatctcgtaatctaaatataatactcgataaaaaccgccatatttaatactaataactaaaaaccgaataattacgttttaacgta

SEQ ID NO: 5903 - DNA, 786 bp, Artificial Sequence
  chemically treated genomic DNA (Homo sapiens) CpG-island No: 5903
aatttttgataattgaaagttttaattttttttatttaggttttagatttcggcgttattttttcgtttttttttaaatggttttaggtcgtcgcggggtttattcggacgaattgatagattttaagtggggttcggagcgtcgtaggttatgatagttttttcgagaagcgggtttcgagtttcgagtatcgcgcgttaacggttggtttatttttagcgtatgcgtttcggtgtttaacggttaatatatagcgttttgatatattaatcgtttcgtttttatcgtttcgcgattttttttttttttttttttagattttaacgttttttttcgttttttcgtttttagtttagacgtttttatatcgcggtttcgcgttcgggattcgttgtttatttggtttttcgttttttttcgcgcgttgttaagagatatttttaatttcgttttttcgtcgggcgtttagatacgagttgttgcgttttttgttttttgcgtcgggttgttgttttgttgattgggtcgttgtttttttatttaagagaggtcgaagcggtgattgggttttgtggaagggatcgggagattattggcggagacgggaagaaagagggcgtgttttacgtttcgcgtttattggttaatttaaaagtaggcgcgttttagtgagtcgatagattggtttcgatagcgcgcggtttcgtgatttgggtgtggtgttcggtgggagtcgttatgtttagtattgataattgaagatcggatgattgcgttttggcgtg

SEQ ID NO: 5904 - DNA, 786 bp, Artificial Sequence
  chemically treated genomic DNA (Homo sapiens) CpG-island No: 5904
cacgccaaaacgcaatcatccgatcttcaattatcaatactaaacataacgactcccaccgaacaccacacccaaatcacgaaaccgcgcgctatcgaaaccaatctatcgactcactaaaacgcgcctacttttaaattaaccaataaacgcgaaacgtaaaacacgccctctttcttcccgtctccgccaataatctcccgatcccttccacaaaacccaatcaccgcttcgacctctcttaaataaaaaaacaacgacccaatcaacaaaacaacaacccgacgcaaaaaacaaaaaacgcaacaactcgtatctaaacgcccgacgaaaaaacgaaattaaaaatatctcttaacaacgcgcgaaaaaaaacgaaaaaccaaataaacaacgaatcccgaacgcgaaaccgcgatataaaaacgtctaaactaaaaacgaaaaaacgaaaaaaaacgttaaaatctaaaaaaaaaaaaaaaaaaaatcgcgaaacgataaaaacgaaacgattaatatatcaaaacgctatatattaaccgttaaacaccgaaacgcatacgctaaaaataaaccaaccgttaacgcgcgatactcgaaactcgaaacccgcttctcgaaaaaactatcataacctacgacgctccgaaccccacttaaaatctatcaattcgtccgaataaaccccgcgacgacctaaaaccatttaaaaaaaaacgaaaaaataacgccgaaatctaaaacctaaataaaaaaaattaaaactttcaattatcaaaaatt

SEQ ID NO: 5905 - DNA, 943 bp, Artificial Sequence
  chemically treated genomic DNA (Homo sapiens) CpG-island No: 5905
cgcggcgttttgggtttttaatacgtcggtcgtgtcgtcgtcgggcgtttcgttcgcgttgtttattttttttatgacgttgggcgtcgtgtttaatttgttggcgttggcgttgttggcgtaggtcgcgggtcgtttgagacgtcgtcgtcggtcgttatatttttgttgttcgtggttagtttgttggttatcgatttggcgggttacgtgatttcgggcgcgttggtgttgcgtttgtatattgcggggcgcgtttcggtcggcggggtttgttattttttgggcggttgtatggtttttttcggtttgtgttcgttgttgttgggttgtggtatggtcgtggagcgttgcgtgggcgttacgcggtcgttgttttacgtcgcgcgggtttcggtcgttcgcgcgcgtttggcgttggtcgcggtggtcgcggtggttttggtcgtggcgttgttgtcgttggcgcgcgtgggtcgttatgagttgtagtattcgggtacgtggtgttttatcggtttgggtttttcgggcggttggcgttaggtattgtttgttggttttttcgttagtatcggtttggtcgcgtttttcgtcgcgttggtgtgtaatacgtttagcggtttggttttgttacgcgttcgttggcgacgtcgttttcgacggtttttttcggttttaggtttcgatagtcggcgtcgttggggggcgtacggatttcgttcggttttcgtatcgttcgtttcgtttatcgtttcggtttttattttttttggcggttttcggagtagcggttcggtacgtagagttcgcgtttacgacgtggagatggtgggttagtttgtcggtattatggtggagtcgtgtatttgttggagtttaatgttggtgaggggcgtatcggtttttcgagttacgttttttttcgttttttttgggtatt

SEQ ID NO: 5906 - DNA, 943 bp, Artificial Sequence
  chemically treated genomic DNA (Homo sapiens) CpG-island No: 5906
aatacccaaaaaaaacgaaaaaaaacgtaactcgaaaaaccgatacgcccctcaccaacattaaactccaacaaatacacgactccaccataataccgacaaactaacccaccatctccacgtcgtaaacgcgaactctacgtaccgaaccgctactccgaaaaccgccaaaaaaaataaaaaccgaaacgataaacgaaacgaacgatacgaaaaccgaacgaaatccgtacgccccccaacgacgccgactatcgaaacctaaaaccgaaaaaaaccgtcgaaaacgacgtcgccaacgaacgcgtaacaaaaccaaaccgctaaacgtattacacaccaacgcgacgaaaaacgcgaccaaaccgatactaacgaaaaaaccaacaaacaatacctaacgccaaccgcccgaaaaacccaaaccgataaaacaccacgtacccgaatactacaactcataacgacccacgcgcgccaacgacaacaacgccacgaccaaaaccaccgcgaccaccgcgaccaacgccaaacgcgcgcgaacgaccgaaacccgcgcgacgtaaaacaacgaccgcgtaacgcccacgcaacgctccacgaccataccacaacccaacaacaacgaacacaaaccgaaaaaaaccatacaaccgcccaaaaaataacaaaccccgccgaccgaaacgcgccccgcaatatacaaacgcaacaccaacgcgcccgaaatcacgtaacccgccaaatcgataaccaacaaactaaccacgaacaacaaaaatataacgaccgacgacgacgtctcaaacgacccgcgacctacgccaacaacgccaacgccaacaaattaaacacgacgcccaacgtcataaaaaaaataaacaacgcgaacgaaacgcccgacgacgacacgaccgacgtattaaaaacccaaaacgccgcg

SEQ ID NO: 5907 - DNA, 943 bp, Artificial Sequence
  chemically treated genomic DNA (Homo sapiens) CpG-island No: 5907
ggtgtttaaagggagcgggaaggagcgtggttcgaggggtcggtgcgttttttattagtattgggttttagtagatgtacgattttattatgatatcgataagttggtttattatttttacgtcgtgggcgcgagttttgcgtgtcgagtcgttgtttcgagagtcgttaaagaaggtggaggtcgaagcgatggacgaggcggacgatgcggaggtcgagcggggttcgtgcgttttttagcgacgtcggttgtcggggtttgaggtcgggggaggtcgtcgggagcggcgtcgttagcgggcgcgtagtagggttaggtcgttgagcgtgttgtatattagcgcggcgaggagcgcgattaggtcgatgttggcgaagaggttagtaagtagtgtttggcgttagtcgttcgggggatttaggtcgatgaagtattacgtgttcgggtattgtagtttatagcggtttacgcgcgttagcggtagtagcgttacggttaaggttatcgcggttatcgcggttagcgttaggcgcgcgcgggcgatcgagattcgcgcggcgtggagtagcggtcgcgtgacgtttacgtagcgttttacggttatgttatagtttagtagtagcgggtataggtcgaagaagattatgtagtcgtttaggaagtggtaggtttcgtcggtcggagcgcgtttcgtagtgtatagacgtagtattagcgcgttcgggattacgtggttcgttaggtcggtggttagtaggttggttacgaatagtaggaatgtggcggtcgacggcggcgttttaggcggttcgcggtttgcgttagtagcgttagcgttagtaggttggatacggcgtttagcgttatggagaagatgggtagcgcgggcgaagcgttcgacggcggtacggtcgacgtgttggggatttagggcgtcgcg

SEQ ID NO: 5908 - DNA, 943 bp, Artificial Sequence
  chemically treated genomic DNA (Homo sapiens) CpG-island No: 5908
cgcgacgccctaaatccccaacacgtcgaccgtaccgccgtcgaacgcttcgcccgcgctacccatcttctccataacgctaaacgccgtatccaacctactaacgctaacgctactaacgcaaaccgcgaaccgcctaaaacgccgccgtcgaccgccacattcctactattcgtaaccaacctactaaccaccgacctaacgaaccacgtaatcccgaacgcgctaatactacgtctatacactacgaaacgcgctccgaccgacgaaacctaccacttcctaaacgactacataatcttcttcgacctatacccgctactactaaactataacataaccgtaaaacgctacgtaaacgtcacgcgaccgctactccacgccgcgcgaatctcgatcgcccgcgcgcgcctaacgctaaccgcgataaccgcgataaccttaaccgtaacgctactaccgctaacgcgcgtaaaccgctataaactacaatacccgaacacgtaatacttcatcgacctaaatcccccgaacgactaacgccaaacactacttactaacctcttcgccaacatcgacctaatcgcgctcctcgccgcgctaatatacaacacgctcaacgacctaaccctactacgcgcccgctaacgacgccgctcccgacgacctcccccgacctcaaaccccgacaaccgacgtcgctaaaaaacgcacgaaccccgctcgacctccgcatcgtccgcctcgtccatcgcttcgacctccaccttctttaacgactctcgaaacaacgactcgacacgcaaaactcgcgcccacgacgtaaaaataataaaccaacttatcgatatcataataaaatcgtacatctactaaaacccaatactaataaaaaacgcaccgacccctcgaaccacgctccttcccgctccctttaaacacc

SEQ ID NO: 5909 - DNA, 719 bp, Artificial Sequence
  chemically treated genomic DNA (Homo sapiens) CpG-island No: 5909
gtcgttagggcgtcggcgtgttggtgttgatgcgttcgttcgattattcgtttaacgtttaggcgcgttttagttagaatttgttggattagggtagttattttattagcgaaaaattgttttcggtattgcgtttcgcgttcggttacgtcgttgacgtattggggattatcgagggggagaacgttatttatttgcgtattttgcgtcgtgttaacggcgtcgcgttttgtttaatcgattattatttcgcggattttattttttggtcgacgttgtaacgtttcgatagcggttcgttgtacgattttttgcgcgagtaaatcggaattgcgttgcgtcgtagttagacgcggattagcgttcgtcgcgtttaggttaaagagtgttagcgttttgaaatttcgaatatgtcgtcgttgttgtgcgtgcgtatttttaattatcgtgacggtgaaagtagttcggcggagtatttcgttagtttgacgcgcgtcgatatgattgaatttattatggagtattgaatgtacgtagatatcgcgatacggtagtattggatgttttaagatttaggaaagggttagggggataatcgagcggaggtagacgttacggacggaagcgtaggtagataaggagggagcgttacgtaggtcgagttcgggtataatatataggtaagaaattattattataagtaaaacggggtatagtag

SEQ ID NO: 5910 - DNA, 719 bp, Artificial Sequence
  chemically treated genomic DNA (Homo sapiens) CpG-island No: 5910
ctactataccccgttttacttataataataatttcttacctatatattatacccgaactcgacctacgtaacgctccctccttatctacctacgcttccgtccgtaacgtctacctccgctcgattatccccctaaccctttcctaaatcttaaaacatccaatactaccgtatcgcgatatctacgtacattcaatactccataataaattcaatcatatcgacgcgcgtcaaactaacgaaatactccgccgaactactttcaccgtcacgataattaaaaatacgcacgcacaacaacgacgacatattcgaaatttcaaaacgctaacactctttaacctaaacgcgacgaacgctaatccgcgtctaactacgacgcaacgcaattccgatttactcgcgcaaaaaatcgtacaacgaaccgctatcgaaacgttacaacgtcgaccaaaaaataaaatccgcgaaataataatcgattaaacaaaacgcgacgccgttaacacgacgcaaaatacgcaaataaataacgttctccccctcgataatccccaatacgtcaacgacgtaaccgaacgcgaaacgcaataccgaaaacaatttttcgctaataaaataactaccctaatccaacaaattctaactaaaacgcgcctaaacgttaaacgaataatcgaacgaacgcatcaacaccaacacgccgacgccctaacgac

SEQ ID NO: 5911 - DNA, 719 bp, Artificial Sequence
  chemically treated genomic DNA (Homo sapiens) CpG-island No: 5911
ttgttgtgtttcgttttgtttgtggtggtggttttttgtttgtgtgttgtgttcgggttcggtttgcgtggcgttttttttttgtttgtttgcgttttcgttcgtggcgtttgttttcgttcggttgtttttttggtttttttttgggttttgggatatttagtgttgtcgtgtcgcggtatttgcgtgtatttagtgttttatagtgaatttaattatgtcggcgcgcgttaggttgacggagtatttcgtcgggttgtttttatcgttacggtggttaagggtgcgtacgtatagtagcggcgatatattcgggattttaagacgttggtattttttggtttgggcgcggcgggcgttgattcgcgtttggttgcggcgtagcgtaatttcggtttgttcgcgtagaaaatcgtgtagcgagtcgttgtcgaagcgttgtagcgtcggttagagggtgaggttcgcgaagtagtggtcgattaaatagagcgcgacgtcgttgatacgacgtagggtgcgtaggtggatgacgttttttttttcggtaatttttagtgcgttagcgacgtggtcggacgcggggcgtaatatcgaaagtagtttttcgttggtgggatggttgttttgatttagtagattttggttaaaacgcgtttgggcgttgagcgggtaatcgaacgggcgtattagtattagtacgtcgacgttttgacggt

SEQ ID NO: 5912 - DNA, 719 bp, Artificial Sequence
  chemically treated genomic DNA (Homo sapiens) CpG-island No: 5912
accgtcaaaacgtcgacgtactaatactaatacgcccgttcgattacccgctcaacgcccaaacgcgttttaaccaaaatctactaaatcaaaacaaccatcccaccaacgaaaaactactttcgatattacgccccgcgtccgaccacgtcgctaacgcactaaaaattaccgaaaaaaaaaacgtcatccacctacgcaccctacgtcgtatcaacgacgtcgcgctctatttaatcgaccactacttcgcgaacctcaccctctaaccgacgctacaacgcttcgacaacgactcgctacacgattttctacgcgaacaaaccgaaattacgctacgccgcaaccaaacgcgaatcaacgcccgccgcgcccaaaccaaaaaataccaacgtcttaaaatcccgaatatatcgccgctactatacgtacgcacccttaaccaccgtaacgataaaaacaacccgacgaaatactccgtcaacctaacgcgcgccgacataattaaattcactataaaacactaaatacacgcaaataccgcgacacgacaacactaaatatcccaaaacccaaaaaaaaaccaaaaaaacaaccgaacgaaaacaaacgccacgaacgaaaacgcaaacaaacaaaaaaaaaacgccacgcaaaccgaacccgaacacaacacacaaacaaaaaaccaccaccacaaacaaaacgaaacacaacaa

SEQ ID NO: 5913 - DNA, 660 bp, Artificial Sequence
  chemically treated genomic DNA (Homo sapiens) CpG-island No: 5913
gcggtgttttacgatttcggtaatatttgttttatttttatggttggtaagtcggagtacgataaaattatttttacgtcgattgtgtttaatgcgttgaacgcgttcggcgttagcgtcgaagcgttcggacgtaacgatttggtggtgaaaatcgtcgaaggcgatcgtaaagttttaggttcggtttatcgcgaaattaaagatcgcggtttttattacggtattttgttatttaatgtcgattttagtcgtttggtaaattattttaattcggataaaaagaaattggcggcgaaaggtattacgtcggtacgttttcgcgtgattaattttatcgagttgttgtcggggattatttatgagtaggtttgcgaggttataatcgatgtttttttcgtttattatggcgagcgcgtgggaagcggaaattattttttcgaataaaacgttagatttgttaaatttcgtcgaaatttttgttcgttagagtagttgggaatggaatttcgggtagggttcggtattttcgtatttgttggatgaacgttttatttgggggcggcgtggaattgtatttcgacgttgaataaagggtatattacggggggaaatgtgggtggaggtaatattatgttgtagtcgatttagacgattttt

SEQ ID NO: 5914 - DNA, 660 bp, Artificial Sequence
  chemically treated genomic DNA (Homo sapiens) CpG-island No: 5914
aaaaatcgtctaaatcgactacaacataatattacctccacccacatttccccccgtaatataccctttattcaacgtcgaaatacaattccacgccgcccccaaataaaacgttcatccaacaaatacgaaaataccgaaccctacccgaaattccattcccaactactctaacgaacaaaaatttcgacgaaatttaacaaatctaacgttttattcgaaaaaataatttccgcttcccacgcgctcgccataataaacgaaaaaaacatcgattataacctcgcaaacctactcataaataatccccgacaacaactcgataaaattaatcacgcgaaaacgtaccgacgtaatacctttcgccgccaatttctttttatccgaattaaaataatttaccaaacgactaaaatcgacattaaataacaaaataccgtaataaaaaccgcgatctttaatttcgcgataaaccgaacctaaaactttacgatcgccttcgacgattttcaccaccaaatcgttacgtccgaacgcttcgacgctaacgccgaacgcgttcaacgcattaaacacaatcgacgtaaaaataattttatcgtactccgacttaccaaccataaaaataaaacaaatattaccgaaatcgtaaaacaccgc

SEQ ID NO: 5915 - DNA, 660 bp, Artificial Sequence
  chemically treated genomic DNA (Homo sapiens) CpG-island No: 5915
agggatcgtttagatcgattgtagtataatattgtttttatttatattttttttcgtgatatgttttttatttaacgtcgaaatgtagttttacgtcgtttttaggtaaagcgtttatttagtagatgcgagaatgtcgagttttgttcgaagttttatttttagttattttggcgggtaaaggtttcggcgaagtttggtaagtttggcgttttgttcggggagatgattttcgttttttacgcgttcgttataatgggcgaaaaaggtatcggttatggtttcgtaaatttgtttatgggtgattttcggtaatagttcggtgaggttggttacgcgggaacgtatcgacgtaatgtttttcgtcgttagtttttttttattcggattgagatagtttgttaggcggttgaggtcggtattgagtagtaaggtgtcgtggtggaagtcgcgatttttggtttcgcgataggtcgagtttgagattttgcggtcgttttcgacggtttttattattagatcgttacgttcggacgtttcggcgttgacgtcgagcgcgtttagcgtattgagtataatcgacgtggagatagttttatcgtatttcggtttgttagttataaaggtaaagtaggtattgtcgagatcgtggaatatcgt

SEQ ID NO: 5916 - DNA, 660 bp, Artificial Sequence
  chemically treated genomic DNA (Homo sapiens) CpG-island No: 5916
acgatattccacgatctcgacaatacctactttacctttataactaacaaaccgaaatacgataaaactatctccacgtcgattatactcaatacgctaaacgcgctcgacgtcaacgccgaaacgtccgaacgtaacgatctaataataaaaaccgtcgaaaacgaccgcaaaatctcaaactcgacctatcgcgaaaccaaaaatcgcgacttccaccacgacaccttactactcaataccgacctcaaccgcctaacaaactatctcaatccgaataaaaaaaaactaacgacgaaaaacattacgtcgatacgttcccgcgtaaccaacctcaccgaactattaccgaaaatcacccataaacaaatttacgaaaccataaccgatacctttttcgcccattataacgaacgcgtaaaaaacgaaaatcatctccccgaacaaaacgccaaacttaccaaacttcgccgaaacctttacccgccaaaataactaaaaataaaacttcgaacaaaactcgacattctcgcatctactaaataaacgctttacctaaaaacgacgtaaaactacatttcgacgttaaataaaaaacatatcacgaaaaaaaatataaataaaaacaatattatactacaatcgatctaaacgatccct

SEQ ID NO: 5917 - DNA, 676 bp, Artificial Sequence
  chemically treated genomic DNA (Homo sapiens) CpG-island No: 5917
cgttaacgtttaagttttcgtttttgttttagtaaagttatgaattggttattttaaatcgggttgagcggatgtagcgttttttgatttttaataaattttttagcggcgttaattattcgttgttgacgtaattcgcgtttattggcgggtaaatttttttcgttttttaatagacggtcgcgtatatgggtatcggttttcgttagttcgggtatcggcggttgatgggaaagtttatcggaatttaggaatagtacgcgtttattgagagtgttggtgaaacgtttaatggttttatttaatatgcgggtacgttggaaatcgggtagcggcgtggcgatatcgttgatgaatataggtagaattggtattttatttagtttatcgagtaggaattttagcggttgggcgaattcgtggtttatttgtatatagtaagaaacggtaagatcgatttcgttttttatgacggtatgcgtataggttttcgttagttttatatgtacgggtagtttttttgtcgtattgtcgaaattattaattgtcgtcgttgtaacgtttaaatagaaggtggtattacgttatagaaaaagtcgttgtagtgatttggcgtatatagtatattagtttatgggagaatgtcgtaatacgtttttcggtgttgtatcgtatt

SEQ ID NO: 5918 - DNA, 676 bp, Artificial Sequence
  chemically treated genomic DNA (Homo sapiens) CpG-island No: 5918
aatacgatacaacaccgaaaaacgtattacgacattctcccataaactaatatactatatacgccaaatcactacaacgactttttctataacgtaataccaccttctatttaaacgttacaacgacgacaattaataatttcgacaatacgacaaaaaaactacccgtacatataaaactaacgaaaacctatacgcataccgtcataaaaaacgaaatcgatcttaccgtttcttactatatacaaataaaccacgaattcgcccaaccgctaaaattcctactcgataaactaaataaaataccaattctacctatattcatcaacgatatcgccacgccgctacccgatttccaacgtacccgcatattaaataaaaccattaaacgtttcaccaacactctcaataaacgcgtactattcctaaattccgataaactttcccatcaaccgccgatacccgaactaacgaaaaccgatacccatatacgcgaccgtctattaaaaaacgaaaaaaatttacccgccaataaacgcgaattacgtcaacaacgaataattaacgccgctaaaaaatttattaaaaatcaaaaaacgctacatccgctcaacccgatttaaaataaccaattcataactttactaaaacaaaaacgaaaacttaaacgttaacg

SEQ ID NO: 5919 - DNA, 676 bp, Artificial Sequence
  chemically treated genomic DNA (Homo sapiens) CpG-island No: 5919
aatacggtatagtatcggagggcgtattgcggtatttttttatgaattggtgtgttgtatgcgttagattattataacggttttttttatgacgtgatgttattttttgtttaggcgttgtagcgacggtaattggtgatttcggtagtgcggtaggagagttgttcgtgtatgtggagttggcggaggtttgtgcgtatgtcgttatgaagagcgggatcgattttgtcgttttttattgtatgtaggtggattacgggttcgtttagtcgttggagtttttgttcggtgggttggataaggtgttagttttgtttgtgtttattaacggtgtcgttacgtcgttgttcggtttttagcgtattcgtatgttgggtgaagttattggacgttttattagtatttttaataaacgcgtgttgtttttgggtttcggtgggtttttttattagtcgtcggtgttcgaattggcgaaagtcgatgtttatatgcgcgatcgtttgttggggagcgggaaagatttattcgttagtgagcgcgaattgcgttagtaacgggtgattagcgtcgttgagaagtttgttgaggattagagaacgttgtattcgtttaattcgatttgggataattagtttatgattttgttggagtagggacggggatttggacgttaacg

SEQ ID NO: 5920 - DNA, 676 bp, Artificial Sequence
  chemically treated genomic DNA (Homo sapiens) CpG-island No: 5920
cgttaacgtccaaatccccgtccctactccaacaaaatcataaactaattatcccaaatcgaattaaacgaatacaacgttctctaatcctcaacaaacttctcaacgacgctaatcacccgttactaacgcaattcgcgctcactaacgaataaatctttcccgctccccaacaaacgatcgcgcatataaacatcgactttcgccaattcgaacaccgacgactaataaaaaaacccaccgaaacccaaaaacaacacgcgtttattaaaaatactaataaaacgtccaataacttcacccaacatacgaatacgctaaaaaccgaacaacgacgtaacgacaccgttaataaacacaaacaaaactaacaccttatccaacccaccgaacaaaaactccaacgactaaacgaacccgtaatccacctacatacaataaaaaacgacaaaatcgatcccgctcttcataacgacatacgcacaaacctccgccaactccacatacacgaacaactctcctaccgcactaccgaaatcaccaattaccgtcgctacaacgcctaaacaaaaaataacatcacgtcataaaaaaaaccgttataataatctaacgcatacaacacaccaattcataaaaaaataccgcaatacgccctccgatactataccgtatt

SEQ ID NO: 5921 - DNA, 558 bp, Artificial Sequence
  chemically treated genomic DNA (Homo sapiens) CpG-island No: 5921
  misc_feature (447)..(447): n is either a, c, g or t
  misc_feature (465)..(465): n is either a, c, g or t
tttgtgtacgtttgagttttaggataatcgtcgtttgtacgattgggtattggataatattacgatttttgtttattcgcgttagtatgagttttcgcgtttgaatttggaatatatcgtgatgtttaagcgtaagttgaatttgttggtgatcgataagtacgttgaaggttgggatgattcgcgtatgtcgattattttcggtttgcgtcgtcgtggttatattgcggtttttattcgtgagttttgtaaacgtatcggcgtgattaagtaggataatattattgagatggcgtcgttggaattttgtattcgtgaagattttaacgaaaatgcgtcgcgcgtaatggcggttatcgattcggtgaaattggttatcgaaaattattagggcgaaggcgaaatggttattatgtcgaattattcgaataaatcggaaatgggtantcgttaggtgtcgtttancggtgagatttggattgatcgcgtcgattttcgttaagaagttagggttttcgcggcgagattattggtgtaggtttattttagaagattttt

SEQ ID NO: 5922 - DNA, 558 bp, Artificial Sequence
  chemically treated genomic DNA (Homo sapiens) CpG-island No: 5922
  misc_feature (94)..(94): n is either a, c, g or t
  misc_feature (112)..(112): n is either a, c, g or t
aaaaatcttctaaaataaacctacaccaataatctcgccgcgaaaaccctaacttcttaacgaaaatcgacgcgatcaatccaaatctcaccgntaaacgacacctaacgantacccatttccgatttattcgaataattcgacataataaccatttcgccttcgccctaataattttcgataaccaatttcaccgaatcgataaccgccattacgcgcgacgcattttcgttaaaatcttcacgaatacaaaattccaacgacgccatctcaataatattatcctacttaatcacgccgatacgtttacaaaactcacgaataaaaaccgcaatataaccacgacgacgcaaaccgaaaataatcgacatacgcgaatcatcccaaccttcaacgtacttatcgatcaccaacaaattcaacttacgcttaaacatcacgatatattccaaattcaaacgcgaaaactcatactaacgcgaataaacaaaaatcgtaatattatccaatacccaatcgtacaaacgacgattatcctaaaactcaaacgtacacaaa

SEQ ID NO: 5923 - DNA, 558 bp, Artificial Sequence
  chemically treated genomic DNA (Homo sapiens) CpG-island No: 5923
  misc_feature (94)..(94): n is either a, c, g or t
  misc_feature (112)..(112): n is either a, c, g or t
ggggattttttagagtagatttgtattagtaatttcgtcgcgaaaattttagttttttggcgaaaatcggcgcgattaatttaaattttatcgntaaacggtatttgacggntgtttattttcggtttgttcggatggttcggtatggtaattatttcgttttcgttttgatagttttcgataattagttttatcggatcgataatcgttattgcgcgcggcgtattttcgttgagatttttacggatgtaggattttagcgacgttattttaatggtgttgttttgtttggttacgtcgatgcgtttgtagaatttacgaatagaagtcgtagtgtaattacgacgacgtagatcggaaatggtcggtatacgcgggttattttagtttttaacgtgtttgtcggttattagtaggtttaatttacgtttggatattacggtgtattttagatttaggcgcgagaatttatattggcgcgggtgaataggaatcgtgatgttgtttagtatttagtcgtatagacgacggttgttttggaatttaagcgtatataga

SEQ ID NO: 5924 - DNA, 558 bp, Artificial Sequence
  chemically treated genomic DNA (Homo sapiens) CpG-island No: 5924
  misc_feature (447)..(447): n is either a, c, g or t
  misc_feature (465)..(465): n is either a, c, g or t
tctatatacgcttaaattccaaaacaaccgtcgtctatacgactaaatactaaacaacatcacgattcctattcacccgcgccaatataaattctcgcgcctaaatctaaaatacaccgtaatatccaaacgtaaattaaacctactaataaccgacaaacacgttaaaaactaaaataacccgcgtataccgaccatttccgatctacgtcgtcgtaattacactacgacttctattcgtaaattctacaaacgcatcgacgtaaccaaacaaaacaacaccattaaaataacgtcgctaaaatcctacatccgtaaaaatctcaacgaaaatacgccgcgcgcaataacgattatcgatccgataaaactaattatcgaaaactatcaaaacgaaaacgaaataattaccataccgaaccatccgaacaaaccgaaaataaacanccgtcaaataccgtttancgataaaatttaaattaatcgcgccgattttcgccaaaaaactaaaattttcgcgacgaaattactaatacaaatctactctaaaaaatcccc

SEQ ID NO: 5925 - DNA, 696 bp, Artificial Sequence
  chemically treated genomic DNA (Homo sapiens) CpG-island No: 5925
atttatcgtttatttgatacgcgttaatcggtaatttagtacgtttacgtagtttacgtacgatgtcgaggtacgttttagtaggtttaattattaggtagtttgcgttttgggttttatttagtagtgatttacgaatcgttttacgacggtttattgggtttatttgatagtttttgcggtcgttttttaatgcgttttcggtagttttacggaacgggttataaaaggaggaggcgaatttggtcgaatacgatataatcgtcgtatttttaaatttcgtagcgtttagcgtttgacgaatcgtttgtatttggtcgtttatcgcggcggaaggggcgatgaagtttgtatttgtagtagttgtaattacggtttgtttgtttaaattttttagagtcgcggcgttgtcgacgttatgttcgtatagtaaaacgtagtgatcgtgagaagggtattatagaagtaggggttgatataacgattatttttggtacggtttgtttgtagatgcgcgatataaggcgtaatagtttattttttcgttaggtatcgttgtcggttttatcggtgttggtttttgattattgtcggtgtaaatttgattggtggttatgttgcgggtatgatggttgtgtcggataacgttatcgattcgttgatgttattggaagtttatggtcgcgtatttttgta

SEQ ID NO: 5926 - DNA, 696 bp, Artificial Sequence
  chemically treated genomic DNA (Homo sapiens) CpG-island No: 5926
tacaaaaatacgcgaccataaacttccaataacatcaacgaatcgataacgttatccgacacaaccatcatacccgcaacataaccaccaatcaaatttacaccgacaataatcaaaaaccaacaccgataaaaccgacaacgatacctaacgaaaaaataaactattacgccttatatcgcgcatctacaaacaaaccgtaccaaaaataatcgttatatcaacccctacttctataatacccttctcacgatcactacgttttactatacgaacataacgtcgacaacgccgcgactctaaaaaatttaaacaaacaaaccgtaattacaactactacaaatacaaacttcatcgccccttccgccgcgataaacgaccaaatacaaacgattcgtcaaacgctaaacgctacgaaatttaaaaatacgacgattatatcgtattcgaccaaattcgcctcctccttttataacccgttccgtaaaactaccgaaaacgcattaaaaaacgaccgcaaaaactatcaaataaacccaataaaccgtcgtaaaacgattcgtaaatcactactaaataaaacccaaaacgcaaactacctaataattaaacctactaaaacgtacctcgacatcgtacgtaaactacgtaaacgtactaaattaccgattaacgcgtatcaaataaacgataaat

SEQ ID NO: 5927 - DNA, 696 bp, Artificial Sequence
  chemically treated genomic DNA (Homo sapiens) CpG-island No: 5927
tgtaagaatacgcgattatagatttttagtgatattagcggatcggtaacgttattcggtatagttattatattcgtaatataattattaattaggtttgtatcggtagtggttaggaattagtatcgatgaaatcggtagcgatgtttggcgggaagatggattgttgcgttttatgtcgcgtatttgtaagtagatcgtgttagaaatgatcgttatgttagtttttgtttttgtgatattttttttacggttattgcgttttgttgtgcgagtatggcgtcgataacgtcgcgattttggaaaatttaggtaagtaagtcgtggttgtagttgttgtaggtgtagattttatcgtttttttcgtcgcgatggacggttaggtataggcgattcgttaggcgttggacgttgcgggatttaaagatacggcgattatgtcgtattcgattaagttcgttttttttttttatggttcgtttcgtgaagttgtcggaagcgtattaaaaggcgatcgtaaaagttattagatgaatttaatgaatcgtcgtgaggcgattcgtgaattattgttggatgaagtttagggcgtagattgtttgatggttaaatttgttggagcgtatttcgatatcgtgcgtgagttgcgtgaacgtattgaattgtcgattggcgcgtattaggtgagcggtgagt

SEQ ID NO: 5928 - DNA, 696 bp, Artificial Sequence
  chemically treated genomic DNA (Homo sapiens) CpG-island No: 5928
actcaccgctcacctaatacgcgccaatcgacaattcaatacgttcacgcaactcacgcacgatatcgaaatacgctccaacaaatttaaccatcaaacaatctacgccctaaacttcatccaacaataattcacgaatcgcctcacgacgattcattaaattcatctaataacttttacgatcgccttttaatacgcttccgacaacttcacgaaacgaaccataaaaaaaaaaaacgaacttaatcgaatacgacataatcgccgtatctttaaatcccgcaacgtccaacgcctaacgaatcgcctatacctaaccgtccatcgcgacgaaaaaaacgataaaatctacacctacaacaactacaaccacgacttacttacctaaattttccaaaatcgcgacgttatcgacgccatactcgcacaacaaaacgcaataaccgtaaaaaaaatatcacaaaaacaaaaactaacataacgatcatttctaacacgatctacttacaaatacgcgacataaaacgcaacaatccatcttcccgccaaacatcgctaccgatttcatcgatactaattcctaaccactaccgatacaaacctaattaataattatattacgaatataataactataccgaataacgttaccgatccgctaatatcactaaaaatctataatcgcgtattcttaca

SEQ ID NO: 5929 - DNA, 828 bp, Artificial Sequence
  chemically treated genomic DNA (Homo sapiens) CpG-island No: 5929
cgtcgtttggagtagatacgtcgtcgtcgcgtttttgggaacggttagggaagtaagtagaagtcgggaagtcgcgaaagatgcgagaaagtgcgattttttttttagattttcggtttttcgtcgaaatttttgtcggtcggttaaattttagataatggaagttttacgtttttatttttatttttttttataagttcggtcgcgggtttttttcggttcgggatttcggcgttagtttcggagtcggagtttgtacgatacgttttttttcgtcggggtaggatgataaacggatatcggtgattcgttgttgtttatataaatatgtgatatttgggcgggtatacggtatttcgatgtcggtgtatcgttaaggttggaggatcgagtaagaagaaagagtgtattatttcgcgatgaaatgcggggaggtaataatattggtgcggtattggggaagtaaggacggaagcgggcgggtttagtattgttgttgtgcggggaaagttagtgagcgagtggaaatgggagggtatgtggggcgatgtagtggagtacggtttcgtaggaggggaacgtacggtggtttcgtgcgtggttggagttttgagagtagtcgtgatagagacgggtaggtcgtgttatcgttttaaagagcgtggatgtagtgggtagtggagggtcgagttttgaattttcgagggagtttggacggtttaggggtgggagagtcgttaatatcgttgtgcggacgcgatttgtatgagaatatttttatttgggggcgaatatgtagaaggtatggggcggtaatgttattgagat

SEQ ID NO: 5930 - DNA, 828 bp, Artificial Sequence
  chemically treated genomic DNA (Homo sapiens) CpG-island No: 5930
atctcaataacattaccgccccataccttctacatattcgcccccaaataaaaatattctcatacaaatcgcgtccgcacaacgatattaacgactctcccacccctaaaccgtccaaactccctcgaaaattcaaaactcgaccctccactacccactacatccacgctctttaaaacgataacacgacctacccgtctctatcacgactactctcaaaactccaaccacgcacgaaaccaccgtacgttcccctcctacgaaaccgtactccactacatcgccccacataccctcccatttccactcgctcactaactttccccgcacaacaacaatactaaacccgcccgcttccgtccttacttccccaataccgcaccaatattattacctccccgcatttcatcgcgaaataatacactctttcttcttactcgatcctccaaccttaacgatacaccgacatcgaaataccgtatacccgcccaaatatcacatatttatataaacaacaacgaatcaccgatatccgtttatcatcctaccccgacgaaaaaaaacgtatcgtacaaactccgactccgaaactaacgccgaaatcccgaaccgaaaaaaacccgcgaccgaacttataaaaaaaaataaaaataaaaacgtaaaacttccattatctaaaatttaaccgaccgacaaaaatttcgacgaaaaaccgaaaatctaaaaaaaaaatcgcactttctcgcatctttcgcgacttcccgacttctacttacttccctaaccgttcccaaaaacgcgacgacgacgtatctactccaaacgacg

SEQ ID NO: 5931 - DNA, 828 bp, Artificial Sequence
  chemically treated genomic DNA (Homo sapiens) CpG-island No: 5931
gttttaatgatattgtcgttttatgttttttatatattcgtttttaaatagagatatttttatgtaaatcgcgttcgtataacggtattaacggtttttttatttttgggtcgtttagattttttcggaaatttaaaattcggttttttattgtttattatatttacgttttttgaggcgatggtacggtttgttcgtttttgttacggttgtttttaaaattttagttacgtacggggttatcgtgcgttttttttttacggggtcgtgttttattgtatcgttttatatgtttttttatttttattcgtttattggtttttttcgtataataataatattaggttcgttcgttttcgtttttatttttttaatatcgtattaatgttgttgttttttcgtattttatcgcggaatagtatattttttttttttattcggttttttagttttgacgatgtatcggtatcggggtgtcgtgtgttcgtttaagtgttatatgtttgtatgggtaatagcgggttatcgatattcgtttgttattttgtttcggcgggagggggcgtatcgtgtaggtttcgatttcggggttggcgtcggggtttcgggtcgaggggaattcgcgatcggatttgtgggggagaatgaggatgaaaacgtggagtttttattgtttagggtttgatcggtcgatagggatttcgacgggggatcggggatttggggagggggtcgtattttttcgtatttttcgcggtttttcggtttttgtttgtttttttgatcgtttttaggggcgcggcggcgacgtgtttgttttaggcggcg

SEQ ID NO: 5932 - DNA, 828 bp, Artificial Sequence
  chemically treated genomic DNA (Homo sapiens) CpG-island No: 5932
cgccgcctaaaacaaacacgtcgccgccgcgcccctaaaaacgatcaaaaaaacaaacaaaaaccgaaaaaccgcgaaaaatacgaaaaaatacgaccccctccccaaatccccgatcccccgtcgaaatccctatcgaccgatcaaaccctaaacaataaaaactccacgttttcatcctcattctcccccacaaatccgatcgcgaattcccctcgacccgaaaccccgacgccaaccccgaaatcgaaacctacacgatacgccccctcccgccgaaacaaaataacaaacgaatatcgataacccgctattacccatacaaacatataacacttaaacgaacacacgacaccccgataccgatacatcgtcaaaactaaaaaaccgaataaaaaaaaaaaatatactattccgcgataaaatacgaaaaaacaacaacattaatacgatattaaaaaaataaaaacgaaaacgaacgaacctaatattattattatacgaaaaaaaccaataaacgaataaaaataaaaaaacatataaaacgatacaataaaacacgaccccgtaaaaaaaaaacgcacgataaccccgtacgtaactaaaattttaaaaacaaccgtaacaaaaacgaacaaaccgtaccatcgcctcaaaaaacgtaaatataataaacaataaaaaaccgaattttaaatttccgaaaaaatctaaacgacccaaaaataaaaaaaccgttaataccgttatacgaacgcgatttacataaaaatatctctatttaaaaacgaatatataaaaaacataaaacgacaatatcattaaaac

SEQ ID NO: 5933 - DNA, 503 bp, Artificial Sequence
  chemically treated genomic DNA (Homo sapiens) CpG-island No: 5933
cgtgcgcgtttaatttggaggtagtcgttttcgtcgttgataggtgttgtttagagggcgtcgggtgcggtttttggcgtagttggacgcgtacgtttcggtgcgtgtagtttttcgagttcggttagagagaagagggagttagggcgcggtttgggggacgttagtggattggagtcgcggagtttcgagggaaaaattttgtaggcgtcgcggtcgggattcggttacggttttagtttattttagtaggtgcgggaggaagaggtagcgtcggagtttcgaggttagagagtttcggcggcggcggtcgtttttttttttcgagttggtttgaagtcgttgggtattttcggtttttgttgatgcgttcgttcgtcgtcgtcgtcgttatcgttagcgtcgcggggattcgggaggaggtgtagtcgaagagggaggagaagtaggaggaggaggacgattaggagcggagaggaggagtagggggtggaggatggagt

SEQ ID NO: 5934 - DNA, 503 bp, Artificial Sequence
  chemically treated genomic DNA (Homo sapiens) CpG-island No: 5934
actccatcctccaccccctactcctcctctccgctcctaatcgtcctcctcctcctacttctcctccctcttcgactacacctcctcccgaatccccgcgacgctaacgataacgacgacgacgacgaacgaacgcatcaacaaaaaccgaaaatacccaacgacttcaaaccaactcgaaaaaaaaaaacgaccgccgccgccgaaactctctaacctcgaaactccgacgctacctcttcctcccgcacctactaaaataaactaaaaccgtaaccgaatcccgaccgcgacgcctacaaaatttttccctcgaaactccgcgactccaatccactaacgtcccccaaaccgcgccctaactccctcttctctctaaccgaactcgaaaaactacacgcaccgaaacgtacgcgtccaactacgccaaaaaccgcacccgacgccctctaaacaacacctatcaacgacgaaaacgactacctccaaattaaacgcgcacg

SEQ ID NO: 5935 - DNA, 503 bp, Artificial Sequence
  chemically treated genomic DNA (Homo sapiens) CpG-island No: 5935
gttttattttttattttttgtttttttttttcgtttttggtcgtttttttttttttgtttttttttttttttcggttgtattttttttcgggttttcgcggcgttggcggtggcggcggcggcggcgggcgggcgtattagtagaaatcgggagtgtttagcgattttaggttagttcgggggaaagaagcggtcgtcgtcgtcgaggttttttggtttcgggatttcggcgttgtttttttttttcgtatttgttggggtgggttggagtcgtaatcgaatttcggtcgcggcgtttgtaaagtttttttttcgaagtttcgcggttttagtttattggcgttttttaggtcgcgttttggtttttttttttttttgatcgagttcgggaagttgtacgtatcggggcgtgcgcgtttagttgcgttagggatcgtattcggcgttttttgggtagtatttgttagcggcgggggcggttgtttttaaattgggcgcgtacg

SEQ ID NO: 5936 - DNA, 503 bp, Artificial Sequence
  chemically treated genomic DNA (Homo sapiens) CpG-island No: 5936
cgtacgcgcccaatttaaaaacaaccgcccccgccgctaacaaatactacccaaaaaacgccgaatacgatccctaacgcaactaaacgcgcacgccccgatacgtacaacttcccgaactcgatcaaaaaaaaaaaaaaaccaaaacgcgacctaaaaaacgccaataaactaaaaccgcgaaacttcgaaaaaaaaactttacaaacgccgcgaccgaaattcgattacgactccaacccaccccaacaaatacgaaaaaaaaaaacaacgccgaaatcccgaaaccaaaaaacctcgacgacgacgaccgcttctttcccccgaactaacctaaaatcgctaaacactcccgatttctactaatacgcccgcccgccgccgccgccgccaccgccaacgccgcgaaaacccgaaaaaaaatacaaccgaaaaaaaaaaaaaaacaaaaaaaaaaaaacgaccaaaaacgaaaaaaaaaaacaaaaaataaaaaataaaac

SEQ ID NO: 5937 - DNA, 600 bp, Artificial Sequence
  chemically treated genomic DNA (Homo sapiens) CpG-island No: 5937
ggggtataggtgcgcgtatgtaattagtgatggcgtttggtttaattgagttatgttcgttaacgcgtatattttaagtattacgttgtatttattagcgtaggtttattatgtcggtataggtggtatagtagtatgtatcgcgttaacgcgggtatatgtttaggggcgtggtgcgtatgtgatttacgggttgatgcgtttaattttggtaggaatttatgggcgttagtttcgcggttttttgttggtgatagtttttggtttgtatgagttttttttcgtttttgcgttggttatacgtttttcggaggtttggtattgtttcgtattggtcgtgtttttttgcgcggtcgtcgtggtttttattgggttttcgcgggtgtatcgatttatatgtttcggggttcgcgtcgtttcggttagtttttttgtatcgattttcgtttgttcggggtttcgttcggcggttatagttgtttatcggtattgtatttttgtcgcggtcgtttttgggttttttgatttgttttgttcgtttagtgtgtttgtttcgtttgtttacgttttgtgtgttgcgtgtgcgtgttgttttttttt

SEQ ID NO: 5938 - DNA, 600 bp, Artificial Sequence
  chemically treated genomic DNA (Homo sapiens) CpG-island No: 5938
aaaaaaaaacaacacgcacacgcaacacacaaaacgtaaacaaacgaaacaaacacactaaacgaacaaaacaaatcaaaaaacccaaaaacgaccgcgacaaaaatacaataccgataaacaactataaccgccgaacgaaaccccgaacaaacgaaaatcgatacaaaaaaactaaccgaaacgacgcgaaccccgaaacatataaatcgatacacccgcgaaaacccaataaaaaccacgacgaccgcgcaaaaaaacacgaccaatacgaaacaataccaaacctccgaaaaacgtataaccaacgcaaaaacgaaaaaaaactcatacaaaccaaaaactatcaccaacaaaaaaccgcgaaactaacgcccataaattcctaccaaaattaaacgcatcaacccgtaaatcacatacgcaccacgcccctaaacatatacccgcgttaacgcgatacatactactataccacctataccgacataataaacctacgctaataaatacaacgtaatacttaaaatatacgcgttaacgaacataactcaattaaaccaaacgccatcactaattacatacgcgcacctatacccc

SEQ ID NO: 5939 - DNA, 600 bp, Artificial Sequence
  chemically treated genomic DNA (Homo sapiens) CpG-island No: 5939
ggaaaggagtagtacgtatacgtaatatataaagcgtgaataaacgaggtaagtatattgagcgaataaaataaattagagggtttaggggcgatcgcgataggagtgtaatatcggtgagtagttgtagtcgtcgggcgaggtttcgagtaggcgggaatcgatatagggagattgatcgaaacgacgcgagtttcgggatatgtaaatcggtatattcgcgagaatttaatgagggttacggcgatcgcgtagaggagtacgattagtgcgaagtagtgttagattttcgaggagcgtgtgattagcgtaaaaacgggagaaagtttatataggttagagattattattagtagagaatcgcggagttgacgtttatgagtttttgttagggttaaacgtattagttcgtgggttatatacgtattacgtttttagatatgtgttcgcgttgacgcgatgtatgttgttgtgttatttgtgtcgatatggtaaatttgcgttggtaagtgtagcgtgatatttagaatatgcgcgttgacggatatggtttagttgagttaagcgttattattagttatatacgcgtatttatgtttt

SEQ ID NO: 5940 - DNA, 600 bp, Artificial Sequence
  chemically treated genomic DNA (Homo sapiens) CpG-island No: 5940
aaaacataaatacgcgtatataactaataataacgcttaactcaactaaaccatatccgtcaacgcgcatattctaaatatcacgctacacttaccaacgcaaatttaccatatcgacacaaataacacaacaacatacatcgcgtcaacgcgaacacatatctaaaaacgtaatacgtatataacccacgaactaatacgtttaaccctaacaaaaactcataaacgtcaactccgcgattctctactaataataatctctaacctatataaactttctcccgtttttacgctaatcacacgctcctcgaaaatctaacactacttcgcactaatcgtactcctctacgcgatcgccgtaaccctcattaaattctcgcgaatataccgatttacatatcccgaaactcgcgtcgtttcgatcaatctccctatatcgattcccgcctactcgaaacctcgcccgacgactacaactactcaccgatattacactcctatcgcgatcgcccctaaaccctctaatttattttattcgctcaatatacttacctcgtttattcacgctttatatattacgtatacgtactactcctttcc

SEQ ID NO: 5941 - DNA, 682 bp, Artificial Sequence
  chemically treated genomic DNA (Homo sapiens) CpG-island No: 5941
cgtaaagcggtattgaataaattcgtcgatttaatggaagtttacgtcgaatagttggtattgttggaaattttcgatatcggtaaatcgattcgttatagtttgcgtgatgatattttcggcgcggcgcgcgttattcgttggtacgtcgaagcgatcgataaagtgtatggcgaagtggcgattattagtagttatgagttggcgatgatcgtgcgtgaatcggtcggcgtgattgtcgttatcgtgtcgtggaatttttcgttgttgttgatttgttggaaattcggttcggcgttggcggcgggaaatagcgtgattttaaaatcggttgaaaaattatcgtttagtgcgattcgtttcgcggggttggcgatagaagtaggtttgtcggatggtgtgttgaacgtggtgacgggttttggttatgaagtcgggtaagcgttgacgggttataacgaaattaatattaatggttttatcgagtaatttttttcgggaaatagtggttgataaattcggcgaatagaatatgaatcgcgtttggttggaagtcgcgcgtaaaagggttaatatttgttttcggtgtttggttcgttttgttattagtcggtaagcgggtttttattatgatcggattatttttgtagatatttatagtagtagaattaaaaaaaattaa

SEQ ID NO: 5942 - DNA, 682 bp, Artificial Sequence
  chemically treated genomic DNA (Homo sapiens) CpG-island No: 5942
ttaattttttttaattctactactataaatatctacaaaaataatccgatcataataaaaacccgcttaccgactaataacaaaacgaaccaaacaccgaaaacaaatattaacccttttacgcgcgacttccaaccaaacgcgattcatattctattcgccgaatttatcaaccactatttcccgaaaaaaattactcgataaaaccattaatattaatttcgttataacccgtcaacgcttacccgacttcataaccaaaacccgtcaccacgttcaacacaccatccgacaaacctacttctatcgccaaccccgcgaaacgaatcgcactaaacgataatttttcaaccgattttaaaatcacgctatttcccgccgccaacgccgaaccgaatttccaacaaatcaacaacaacgaaaaattccacgacacgataacgacaatcacgccgaccgattcacgcacgatcatcgccaactcataactactaataatcgccacttcgccatacactttatcgatcgcttcgacgtaccaacgaataacgcgcgccgcgccgaaaatatcatcacgcaaactataacgaatcgatttaccgatatcgaaaatttccaacaataccaactattcgacgtaaacttccattaaatcgacgaatttattcaataccgctttacg

SEQ ID NO: 5943 - DNA, 682 bp, Artificial Sequence
  chemically treated genomic DNA (Homo sapiens) CpG-island No: 5943
ttgattttttttagttttgttattatgggtatttgtaggggtgattcgattataatgggggttcgtttgtcggttagtgataaaacggattaggtatcgaaaataaatgttggtttttttgcgcgcggtttttagttagacgcggtttatgttttgttcgtcggatttgttagttattgtttttcggaaggggttattcggtaaagttattggtgttgatttcgttatgattcgttagcgtttgttcggttttatgattaaaattcgttattacgtttaatatattattcggtaagtttgtttttatcgttagtttcgcgagacgaatcgtattgagcggtgattttttagtcggttttagaattacgttgtttttcgtcgttagcgtcgggtcgagtttttagtaagttagtaatagcgggaagttttacggtacgatggcggtaattacgtcgatcggtttacgtacgattatcgttagtttatggttattggtggtcgttatttcgttatatattttgtcgatcgtttcggcgtattagcgaatggcgcgcgtcgcgtcgggaatattattacgtagattgtgacgaatcggtttgtcggtgtcgagagtttttagtagtgttagttgttcggcgtgggtttttattaaatcggcgagtttatttagtatcgttttacg

SEQ ID NO: 5944 - DNA, 682 bp, Artificial Sequence
  chemically treated genomic DNA (Homo sapiens) CpG-island No: 5944
cgtaaaacgatactaaataaactcgccgatttaataaaaacccacgccgaacaactaacactactaaaaactctcgacaccgacaaaccgattcgtcacaatctacgtaataatattcccgacgcgacgcgcgccattcgctaatacgccgaaacgatcgacaaaatatataacgaaataacgaccaccaataaccataaactaacgataatcgtacgtaaaccgatcgacgtaattaccgccatcgtaccgtaaaacttcccgctattactaacttactaaaaactcgacccgacgctaacgacgaaaaacaacgtaattctaaaaccgactaaaaaatcaccgctcaatacgattcgtctcgcgaaactaacgataaaaacaaacttaccgaataatatattaaacgtaataacgaattttaatcataaaaccgaacaaacgctaacgaatcataacgaaatcaacaccaataactttaccgaataaccccttccgaaaaacaataactaacaaatccgacgaacaaaacataaaccgcgtctaactaaaaaccgcgcgcaaaaaaaccaacatttattttcgatacctaatccgttttatcactaaccgacaaacgaacccccattataatcgaatcacccctacaaatacccataataacaaaactaaaaaaaatcaa

SEQ ID NO: 5945 - DNA, 934 bp, Artificial Sequence
  chemically treated genomic DNA (Homo sapiens) CpG-island No: 5945
cgaaatcgattggttggtagttagaaatgggcgaagtcgaattggtgattatgttgacgttgggttatatcgttggagtcgatattgaagaaatcgattttatcgtagaagtggtcgatgatgtagtatatcgacggaatttttattatgattttaagcgtaatcgtttttgtatgacgtaggttatcgcgtttaagtttaacgatcgttttttggatttcgttttttatttataagatttgatcgaggttgtgaattatcgggattattaattgggcgttgtcgaaattggcggcgcgtaaaatggttcgtagttgagtgcggaataggttagtaaatttcgggtaaatacgtatcgcgcgatagtcgaggaacgggttttttttttggggaatatttagataaggaatgtttttatcgtcggcgatgtttatcgtgcggaagataatcggtttgtcgttcgtcgttagtagtatatgttggtaggttttaaattgtttttgttcgttcggcgcgttgtcgcgatttatatagagtatttcggtacggaatagttcgatatttttcgcgtcgttggtaaacgcgtttggcgtttttagagcggtgtcgatattcgtcgtaatattaatacgtttgttattacgggaataggttagttgcgcggtagtttgcgtttgttgtttttggcgtttattcgttagcgtttgcgcgatttgataataatcgtttatcgcgttattcgggttaatcgttagtacgtcgtattgggcgttaagtattgtaggttgttcggtataacgggtaatcgtatttagcggtaagttatttagtatcgggatcgtcgaggtacgggttagaattagtgtatgcgaggtgcgttcggttttttttagaattatgttcgtaagattttttaaattaaggtttaaaaata

SEQ ID NO: 5946 - DNA, 934 bp, Artificial Sequence
  chemically treated genomic DNA (Homo sapiens) CpG-island No: 5946
tatttttaaaccttaatttaaaaaatcttacgaacataattctaaaaaaaaccgaacgcacctcgcatacactaattctaacccgtacctcgacgatcccgatactaaataacttaccgctaaatacgattacccgttataccgaacaacctacaatacttaacgcccaatacgacgtactaacgattaacccgaataacgcgataaacgattattatcaaatcgcgcaaacgctaacgaataaacgccaaaaacaacaaacgcaaactaccgcgcaactaacctattcccgtaataacaaacgtattaatattacgacgaatatcgacaccgctctaaaaacgccaaacgcgtttaccaacgacgcgaaaaatatcgaactattccgtaccgaaatactctatataaatcgcgacaacgcgccgaacgaacaaaaacaatttaaaacctaccaacatatactactaacgacgaacgacaaaccgattatcttccgcacgataaacatcgccgacgataaaaacattccttatctaaatattccccaaaaaaaaaacccgttcctcgactatcgcgcgatacgtatttacccgaaatttactaacctattccgcactcaactacgaaccattttacgcgccgccaatttcgacaacgcccaattaataatcccgataattcacaacctcgatcaaatcttataaataaaaaacgaaatccaaaaaacgatcgttaaacttaaacgcgataacctacgtcatacaaaaacgattacgcttaaaatcataataaaaattccgtcgatatactacatcatcgaccacttctacgataaaatcgatttcttcaatatcgactccaacgatataacccaacgtcaacataatcaccaattcgacttcgcccatttctaactaccaaccaatcgatttcg

SEQ ID NO: 5947 - DNA, 934 bp, Artificial Sequence
  chemically treated genomic DNA (Homo sapiens) CpG-island No: 5947
tgtttttgagttttgatttgaaaaattttgcgggtatgattttggagaaaatcgggcgtatttcgtatatattgattttggttcgtgtttcggcgatttcggtattgagtggtttgtcgttggatgcgattgttcgttatgtcgggtaatttgtagtgtttgacgtttagtgcggcgtgttggcgattaattcgaatgacgcggtgagcggttattattaggtcgcgtagacgttggcggataaacgttaaaaataataggcgtaggttgtcgcgtagttggtttattttcgtgataataagcgtattgatattgcggcgaatatcggtatcgttttggaagcgttaggcgcgtttgttaacggcgcggaaggtgtcgggttgtttcgtatcgaaatgttttatatggatcgcgatagcgcgtcggacgagtaggagtaatttgaagtttattagtatgtgttattggcggcgggcgataagtcgattatttttcgtacgatggatatcgtcggcgataaaagtattttttatttgaatattttttaggaagagaattcgtttttcggttatcgcgcggtacgtatttattcggaatttgttggtttgtttcgtatttaattgcgggttattttgcgcgtcgttagtttcggtaacgtttagttgatgatttcgatggtttatagtttcgattagattttatgggtgaaaggcgagatttaaaaagcgatcgttgagtttaagcgcgatggtttgcgttatgtagagacgattacgtttgggattatggtggaagtttcgtcggtgtgttatattatcgattatttttgcgatgaggtcgatttttttagtatcggttttaacgatatgatttagcgttagtatgattattagttcgatttcgtttatttttgattgttagttaatcggtttcg

SEQ ID NO: 5948 - DNA, 934 bp, Artificial Sequence
  chemically treated genomic DNA (Homo sapiens) CpG-island No: 5948
cgaaaccgattaactaacaatcaaaaataaacgaaatcgaactaataatcatactaacgctaaatcatatcgttaaaaccgatactaaaaaaatcgacctcatcgcaaaaataatcgataatataacacaccgacgaaacttccaccataatcccaaacgtaatcgtctctacataacgcaaaccatcgcgcttaaactcaacgatcgctttttaaatctcgcctttcacccataaaatctaatcgaaactataaaccatcgaaatcatcaactaaacgttaccgaaactaacgacgcgcaaaataacccgcaattaaatacgaaacaaaccaacaaattccgaataaatacgtaccgcgcgataaccgaaaaacgaattctcttcctaaaaaatattcaaataaaaaatacttttatcgccgacgatatccatcgtacgaaaaataatcgacttatcgcccgccgccaataacacatactaataaacttcaaattactcctactcgtccgacgcgctatcgcgatccatataaaacatttcgatacgaaacaacccgacaccttccgcgccgttaacaaacgcgcctaacgcttccaaaacgataccgatattcgccgcaatatcaatacgcttattatcacgaaaataaaccaactacgcgacaacctacgcctattatttttaacgtttatccgccaacgtctacgcgacctaataataaccgctcaccgcgtcattcgaattaatcgccaacacgccgcactaaacgtcaaacactacaaattacccgacataacgaacaatcgcatccaacgacaaaccactcaataccgaaatcgccgaaacacgaaccaaaatcaatatatacgaaatacgcccgattttctccaaaatcatacccgcaaaatttttcaaatcaaaactcaaaaaca

SEQ ID NO: 5949 - DNA, 619 bp, Artificial Sequence
  chemically treated genomic DNA (Homo sapiens) CpG-island No: 5949
cgcgtttcgggttttaggattcgttttcgaggcgttgcgcgcggggaggggattcgggaatttaggcgttcggcgtttcgtttttcgttttcggggtagcgcggttatttgtatcgttcgagtcgtatttggcggaggtagaagttataaattcggcgagtttagagcggtggagcggagaggagggacggtattcggttgtagggaggagggaggcggtagcggtagcggcggcgtggagggcgtagcgcgtcgcgcggcggaggagggtagacggcggcggcggcggcgttcggttcgttttgttcggtcggttgggcgcgtattcgggttcgtatcgcgtcgttgcggacgtatatggtagcgtgagaggtcggcggcgggaggagcgggcggcgtcgggtcggggttgtagggtcgtatggatagcggcgttatttcggtcggtttttattagggttttttatttgcgggcgttatttttcggattatggtgtttcggcgtcgttcgggttaagagcggtcggttggagtcgttgagttttcgttgcggtcgggagttgtatgggggagcgtcggtagcgtttgggaagatgtttcggtcggagttgtttttgtt

SEQ ID NO: 5950 - DNA, 619 bp, Artificial Sequence
  chemically treated genomic DNA (Homo sapiens) CpG-island No: 5950
aacaaaaacaactccgaccgaaacatcttcccaaacgctaccgacgctcccccatacaactcccgaccgcaacgaaaactcaacgactccaaccgaccgctcttaacccgaacgacgccgaaacaccataatccgaaaaataacgcccgcaaataaaaaaccctaataaaaaccgaccgaaataacgccgctatccatacgaccctacaaccccgacccgacgccgcccgctcctcccgccgccgacctctcacgctaccatatacgtccgcaacgacgcgatacgaacccgaatacgcgcccaaccgaccgaacaaaacgaaccgaacgccgccgccgccgccgtctaccctcctccgccgcgcgacgcgctacgccctccacgccgccgctaccgctaccgcctccctcctccctacaaccgaataccgtccctcctctccgctccaccgctctaaactcgccgaatttataacttctacctccgccaaatacgactcgaacgatacaaataaccgcgctaccccgaaaacgaaaaacgaaacgccgaacgcctaaattcccgaatcccctccccgcgcgcaacgcctcgaaaacgaatcctaaaacccgaaacgcg

SEQ ID NO: 5951 - DNA, 619 bp, Artificial Sequence
  chemically treated genomic DNA (Homo sapiens) CpG-island No: 5951
gataggggtagtttcggtcggggtatttttttaagcgttgtcggcgtttttttatgtagttttcggtcgtagcgggggtttagcggttttagtcggtcgtttttagttcgggcggcgtcgaggtattatgattcggggggtggcgttcgtagatggggggttttagtaggggtcggtcggggtggcgtcgttgtttatgcggttttgtagtttcgattcggcgtcgttcgtttttttcgtcgtcggttttttacgttgttatgtgcgttcgtagcggcgcggtgcgagttcgggtgcgcgtttagtcggtcgggtagagcgagtcgagcgtcgtcgtcgtcgtcgtttgttttttttcgtcgcgcggcgcgttgcgttttttacgtcgtcgttgtcgttgtcgttttttttttttttgtagtcgggtgtcgtttttttttttcgttttatcgttttgagttcgtcgggtttgtgatttttgttttcgttaggtgcggttcgggcggtgtaggtaatcgcgttgtttcggaaacgggaggcggagcgtcgggcgtttgggttttcgggtttttttttcgcgcgtagcgtttcgagggcgggttttagggttcgagacgcg

SEQ ID NO: 5952 - DNA, 619 bp, Artificial Sequence
  chemically treated genomic DNA (Homo sapiens) CpG-island No: 5952
cgcgtctcgaaccctaaaacccgccctcgaaacgctacgcgcgaaaaaaaaacccgaaaacccaaacgcccgacgctccgcctcccgtttccgaaacaacgcgattacctacaccgcccgaaccgcacctaacgaaaacaaaaatcacaaacccgacgaactcaaaacgataaaacgaaaaaaaaaaacgacacccgactacaaaaaaaaaaaaaacgacaacgacaacgacgacgtaaaaaacgcaacgcgccgcgcgacgaaaaaaaacaaacgacgacgacgacgacgctcgactcgctctacccgaccgactaaacgcgcacccgaactcgcaccgcgccgctacgaacgcacataacaacgtaaaaaaccgacgacgaaaaaaacgaacgacgccgaatcgaaactacaaaaccgcataaacaacgacgccaccccgaccgacccctactaaaaccccccatctacgaacgccaccccccgaatcataatacctcgacgccgcccgaactaaaaacgaccgactaaaaccgctaaacccccgctacgaccgaaaactacataaaaaaacgccgacaacgcttaaaaaaataccccgaccgaaactacccctatc

SEQ ID NO: 5953 - DNA, 578 bp, Artificial Sequence
  chemically treated genomic DNA (Homo sapiens) CpG-island No: 5953
gcgtatttgtaggtcggataaggcgtttacgtcgtattcgatattaacgtttgatgcgacgtttgtcgcgttttattaggtttacgttagatagcgtaatagtttgatttagcgtgattttgtaggtcggataaggcgtttatgtcgtattcgatattaacgtttgatgcgacgtttaacgcgttttattaggtttacgttagatagcgtaatagtttgatttagcgtgattttgtaggtcggataaggcgtttacgtcgtattcgatattaatgtttgatgcgacgtttgtcgcgttttattaggtttataaatgtttttcgtaggtcggataaggcgtttacgtcgtattcggtaatcgtgtcgattagatagtgattattattttatcgttatcgataaaaattttgtcgtttgggtaaaattattattttttttttgttacgttacgttgtcgcgtagggatattcgttgattgatattgttcgtgatttttatttttattttatttcgttgttttatcgtatcgttattgatagtgttgttattttttttaattttcgtcgaatggggatcgt

SEQ ID NO: 5954 - DNA, 578 bp, Artificial Sequence
  chemically treated genomic DNA (Homo sapiens) CpG-island No: 5954
acgatccccattcgacgaaaattaaaaaaaataacaacactatcaataacgatacgataaaacaacgaaataaaataaaaataaaaatcacgaacaatatcaatcaacgaatatccctacgcgacaacgtaacgtaacaaaaaaaaaataataattttacccaaacgacaaaatttttatcgataacgataaaataataatcactatctaatcgacacgattaccgaatacgacgtaaacgccttatccgacctacgaaaaacatttataaacctaataaaacgcgacaaacgtcgcatcaaacattaatatcgaatacgacgtaaacgccttatccgacctacaaaatcacgctaaatcaaactattacgctatctaacgtaaacctaataaaacgcgttaaacgtcgcatcaaacgttaatatcgaatacgacataaacgccttatccgacctacaaaatcacgctaaatcaaactattacgctatctaacgtaaacctaataaaacgcgacaaacgtcgcatcaaacgttaatatcgaatacgacgtaaacgccttatccgacctacaaatacgc

SEQ ID NO: 5955 - DNA, 578 bp, Artificial Sequence
  chemically treated genomic DNA (Homo sapiens) CpG-island No: 5955
acgatttttattcgacggaaattgaagaggatggtagtattattagtgacgatgcggtgaagtaacggggtgaaataaaagtgggagttacgggtaatattagttagcgagtgtttttgcgcggtagcgtggcgtggtagaaagggagtgatgattttgtttagacggtagggtttttgtcgatgacggtgaaatggtaattattgtttagtcggtacggttgtcggatgcggcgtaaacgttttattcggtttacggggagtatttgtaggtttgataagacgcggtaagcgtcgtattaggtattgatgtcggatgcggcgtaaacgttttattcgatttataaaattacgttaaattaggttattgcgttgtttggcgtaggtttgataagacgcgttaagcgtcgtattaggcgttgatgtcggatgcggtataaacgttttattcgatttataaaattacgttaaattaggttattgcgttgtttggcgtaggtttgataagacgcggtaagcgtcgtattaggcgttgatgtcggatgcggcgtaaacgttttattcggtttataaatgcgt

SEQ ID NO: 5956 - DNA, 578 bp, Artificial Sequence
  chemically treated genomic DNA (Homo sapiens) CpG-island No: 5956
acgcatttataaaccgaataaaacgtttacgccgcatccgacatcaacgcctaatacgacgcttaccgcgtcttatcaaacctacgccaaacaacgcaataacctaatttaacgtaattttataaatcgaataaaacgtttataccgcatccgacatcaacgcctaatacgacgcttaacgcgtcttatcaaacctacgccaaacaacgcaataacctaatttaacgtaattttataaatcgaataaaacgtttacgccgcatccgacatcaatacctaatacgacgcttaccgcgtcttatcaaacctacaaatactccccgtaaaccgaataaaacgtttacgccgcatccgacaaccgtaccgactaaacaataattaccatttcaccgtcatcgacaaaaaccctaccgtctaaacaaaatcatcactccctttctaccacgccacgctaccgcgcaaaaacactcgctaactaatattacccgtaactcccacttttatttcaccccgttacttcaccgcatcgtcactaataatactaccatcctcttcaatttccgtcgaataaaaatcgt

SEQ ID NO: 5957 - DNA, 774 bp, Artificial Sequence
  chemically treated genomic DNA (Homo sapiens) CpG-island No: 5957
gaaagtcgttagtcgggagtgcgtgcgtttatagaattttttgtcggtggtgaagtgaaaacgtcggagtaattgatattagaataacgttagttttttgaataaatgtaggttgatatgcgttagtagttaacgtagttggttgaagtttcgtggaatgaatagacgtcggaatagcgttagtaaacgttatagcgttaacgttaggcgtagtaattagcggaatagtaacgtttggtttagtagtcgcgtacgattgaataaagttggtagtagtagacgcgtacgtcgtaagtcgtatcggtataggcgtaatcgcgttagtttaaatcggtttttttttagtagtcgtattaggatttgttgtaaatttttgcgtatacgattgcgtagtcgaagtcgtagtaagttgcgttagttgttcgtgtcgttgacgcgttaaaatcgacggcggagaaaaaagacgaacgtcgttggatggtgtagtgcggttcgtttagaggcgcggaataggtagagacggtacgtgtttagttggcgttcgaaggttttgattcgaaaattattattaataatggttggaatcgtgtggttattggttcggtgaaaggtaaagagaacgtagatagtatttttaatcggttgaagatggcgggttatataaattgtattcggttcgtcgtcgggggttgaaatttttaaaattttttttatttataattgtattatgtttcgtatttttgtacggggtttgtattttgtattcgtaattaa

SEQ ID NO: 5958 - DNA, 774 bp, Artificial Sequence
  chemically treated genomic DNA (Homo sapiens) CpG-island No: 5958
ttaattacgaatacaaaatacaaaccccgtacaaaaatacgaaacataatacaattataaataaaaaaaattttaaaaatttcaacccccgacgacgaaccgaatacaatttatataacccgccatcttcaaccgattaaaaatactatctacgttctctttacctttcaccgaaccaataaccacacgattccaaccattattaataataattttcgaatcaaaaccttcgaacgccaactaaacacgtaccgtctctacctattccgcgcctctaaacgaaccgcactacaccatccaacgacgttcgtcttttttctccgccgtcgattttaacgcgtcaacgacacgaacaactaacgcaacttactacgacttcgactacgcaatcgtatacgcaaaaatttacaacaaatcctaatacgactactaaaaaaaaaccgatttaaactaacgcgattacgcctataccgatacgacttacgacgtacgcgtctactactaccaactttattcaatcgtacgcgactactaaaccaaacgttactattccgctaattactacgcctaacgttaacgctataacgtttactaacgctattccgacgtctattcattccacgaaacttcaaccaactacgttaactactaacgcatatcaacctacatttattcaaaaaactaacgttattctaatatcaattactccgacgttttcacttcaccaccgacaaaaaattctataaacgcacgcactcccgactaacgactttc

SEQ ID NO: 5959 - DNA, 774 bp, Artificial Sequence
  chemically treated genomic DNA (Homo sapiens) CpG-island No: 5959
ttggttacgaatatagagtataaatttcgtataaaagtacggggtataatgtaattatagatgggggggattttgagggttttaattttcggcggcgagtcgaatgtagtttgtatgattcgttatttttaatcgattgagggtgttgtttgcgttttttttgttttttatcgggttaatgattatacgattttagttattgttggtggtgattttcgagttaaagttttcgaacgttagttgagtacgtatcgtttttgtttgtttcgcgtttttgaacgaatcgtattgtattatttagcggcgttcgtttttttttttcgtcgtcggttttggcgcgttagcggtacgagtaattggcgtagtttgttgcggtttcgattgcgtagtcgtgtgcgtaggagtttgtagtagattttggtacggttgttgagaagaagtcggtttagattggcgcggttgcgtttgtatcggtgcggtttgcgacgtacgcgtttgttgttgttagttttgtttagtcgtacgcgattgttgagttaggcgttgttgtttcgttaattgttgcgtttgacgttggcgttgtagcgtttgttgacgttgtttcggcgtttgtttattttacggaattttaattagttgcgttggttgttggcgtatattagtttgtatttgtttaagaagttgacgttgttttggtgttagttgtttcggcgtttttattttattatcggtagaaggttttgtgggcgtacgtattttcggttggcgattttt

SEQ ID NO: 5960 - DNA, 774 bp, Artificial Sequence
  chemically treated genomic DNA (Homo sapiens) CpG-island No: 5960
aaaaatcgccaaccgaaaatacgtacgcccacaaaaccttctaccgataataaaataaaaacgccgaaacaactaacaccaaaacaacgtcaacttcttaaacaaatacaaactaatatacgccaacaaccaacgcaactaattaaaattccgtaaaataaacaaacgccgaaacaacgtcaacaaacgctacaacgccaacgtcaaacgcaacaattaacgaaacaacaacgcctaactcaacaatcgcgtacgactaaacaaaactaacaacaacaaacgcgtacgtcgcaaaccgcaccgatacaaacgcaaccgcgccaatctaaaccgacttcttctcaacaaccgtaccaaaatctactacaaactcctacgcacacgactacgcaatcgaaaccgcaacaaactacgccaattactcgtaccgctaacgcgccaaaaccgacgacgaaaaaaaaaaacgaacgccgctaaataatacaatacgattcgttcaaaaacgcgaaacaaacaaaaacgatacgtactcaactaacgttcgaaaactttaactcgaaaatcaccaccaacaataactaaaatcgtataatcattaacccgataaaaaacaaaaaaaacgcaaacaacaccctcaatcgattaaaaataacgaatcatacaaactacattcgactcgccgccgaaaattaaaaccctcaaaatcccccccatctataattacattataccccgtacttttatacgaaatttatactctatattcgtaaccaa

SEQ ID NO: 5961 - DNA, 564 bp, Artificial Sequence
  chemically treated genomic DNA (Homo sapiens) CpG-island No: 5961
tcggattacgcgggtattatttaggggatgcgttttaataaagtggatatcgtttggtacggtaatttgtcggcgatggaagcggtggatcgcgttaatggttaggttttcgtttagacggtcgcggcggatggatcgtcgggttattggagcgtgttgatcgttaataaagatagttcgattaataatttgaacgatttgttggcgaagcggaaagattttatttttggtaatggcgattttaattttatttttggttttttcgttttcggttattacgttttcgttaaaaataatattttcgttagcgattttaagcgtatcgttaacgtcgggtatgaaattaacgcgttggtcgtcgttaataagtaggtggatgttgttattaataatatcgaaaatttcgataagttgaaaattttcgcgttagagaagttgaaagaattgaaggtgatttggaagtcgtcgttgattttaggcgattcgatcgtttggcgtaagaattttttcgaaattattaaagataagatttacgatttttttatgaattacggtaaaacgtcg

SEQ ID NO: 5962 - DNA, 564 bp, Artificial Sequence
  chemically treated genomic DNA (Homo sapiens) CpG-island No: 5962
cgacgttttaccgtaattcataaaaaaatcgtaaatcttatctttaataatttcgaaaaaattcttacgccaaacgatcgaatcgcctaaaatcaacgacgacttccaaatcaccttcaattctttcaacttctctaacgcgaaaattttcaacttatcgaaattttcgatattattaataacaacatccacctacttattaacgacgaccaacgcgttaatttcatacccgacgttaacgatacgcttaaaatcgctaacgaaaatattatttttaacgaaaacgtaataaccgaaaacgaaaaaaccaaaaataaaattaaaatcgccattaccaaaaataaaatctttccgcttcgccaacaaatcgttcaaattattaatcgaactatctttattaacgatcaacacgctccaataacccgacgatccatccgccgcgaccgtctaaacgaaaacctaaccattaacgcgatccaccgcttccatcgccgacaaattaccgtaccaaacgatatccactttattaaaacgcatcccctaaataatacccgcgtaatccga

SEQ ID NO: 5963 - DNA, 564 bp, Artificial Sequence
  chemically treated genomic DNA (Homo sapiens) CpG-island No: 5963
cggcgttttgtcgtagtttataaagaagtcgtagattttgtttttggtggtttcggaaagatttttgcgttagacgatcggatcgtttgggattagcggcgatttttagattatttttagtttttttagtttttttggcgcggaggtttttagtttgtcgaggttttcggtgttgttggtggtaatatttatttgtttgttggcgacggttagcgcgttggttttatgttcggcgttgacggtgcgtttgaagtcgttggcggagatattgtttttggcgaagacgtagtagtcggggacgaggaagttagaggtggagttaggatcgttattgttaaaggtgagattttttcgtttcgttagtagatcgtttaggttgttgatcggattgtttttgttgacgattaatacgttttagtaattcggcgatttattcgtcgcgatcgtttgggcgaagatttggttattggcgcgatttatcgtttttatcgtcgatagattgtcgtattaggcgatatttattttattgaagcgtattttttggataatgttcgcgtagttcgg

SEQ ID NO: 5964 - DNA, 564 bp, Artificial Sequence
  chemically treated genomic DNA (Homo sapiens) CpG-island No: 5964
ccgaactacgcgaacattatccaaaaaatacgcttcaataaaataaatatcgcctaatacgacaatctatcgacgataaaaacgataaatcgcgccaataaccaaatcttcgcccaaacgatcgcgacgaataaatcgccgaattactaaaacgtattaatcgtcaacaaaaacaatccgatcaacaacctaaacgatctactaacgaaacgaaaaaatctcacctttaacaataacgatcctaactccacctctaacttcctcgtccccgactactacgtcttcgccaaaaacaatatctccgccaacgacttcaaacgcaccgtcaacgccgaacataaaaccaacgcgctaaccgtcgccaacaaacaaataaatattaccaccaacaacaccgaaaacctcgacaaactaaaaacctccgcgccaaaaaaactaaaaaaactaaaaataatctaaaaatcgccgctaatcccaaacgatccgatcgtctaacgcaaaaatctttccgaaaccaccaaaaacaaaatctacgacttctttataaactacgacaaaacgccg

SEQ ID NO: 5965 - DNA, 559 bp, Artificial Sequence
  chemically treated genomic DNA (Homo sapiens) CpG-island No: 5965
attttgtcgggttagggaatttgtttttcgggcggtttggagtgtcgttatcgggatttttggtagtcgcgcgggtgagggcgatttgattcgcgtaggttggatcgcggcgtttttagcgtttattaggtgcgtgatgagtgtcgttgagtgcgttttgtatatatcgttacgtggttttgagtagttagaagtttgtgtagtagttatatgtagtcgaatagtgagcgtttattggcgtgagattgtttagagttgggtcggtgtggcgcggtggttggtcgtgttatgtttggtgataacgttttgggtggtggattgaaacgagttgtagaagttagagaagtttaaagtcgcgatttgatcgtcgttgtcgaatcgggatcgtttatattacggtgttgaaaaacgttggtatttttttgttatatttgtatttatcggttgattgcgttttagtttggtttttgagtgaagtaatcggacgtatgtttgggttaggaattatttttttaacggttaatattttgtaatttttggtcgcgggtgatatgaaata

SEQ ID NO: 5966 - DNA, 559 bp, Artificial Sequence
  chemically treated genomic DNA (Homo sapiens) CpG-island No: 5966
tatttcatatcacccgcgaccaaaaattacaaaatattaaccgttaaaaaaataattcctaacccaaacatacgtccgattacttcactcaaaaaccaaactaaaacgcaatcaaccgataaatacaaatataacaaaaaaataccaacgtttttcaacaccgtaatataaacgatcccgattcgacaacgacgatcaaatcgcgactttaaacttctctaacttctacaactcgtttcaatccaccacccaaaacgttatcaccaaacataacacgaccaaccaccgcgccacaccgacccaactctaaacaatctcacgccaataaacgctcactattcgactacatataactactacacaaacttctaactactcaaaaccacgtaacgatatatacaaaacgcactcaacgacactcatcacgcacctaataaacgctaaaaacgccgcgatccaacctacgcgaatcaaatcgccctcacccgcgcgactaccaaaaatcccgataacgacactccaaaccgcccgaaaaacaaattccctaacccgacaaaat

SEQ ID NO: 5967 - DNA, 559 bp, Artificial Sequence
  chemically treated genomic DNA (Homo sapiens) CpG-island No: 5967
tattttatgttattcgcgattagaaattgtagaatattggtcgttggggaagtgatttttaatttaaatatgcgttcggttgttttatttaggggttaggttaaagcgtaattaatcgatgagtatagatgtgataaagggatgttagcgttttttaatatcgtaatatgagcgatttcggttcggtagcggcggttaggtcgcgattttgagtttttttggtttttataattcgttttaatttattatttagagcgttattattaagtataatacggttaattatcgcgttatatcgatttaattttaaatagttttacgttaatagacgtttattgttcgattatatgtagttgttgtataggtttttgattatttagagttacgtggcgatgtgtgtagaacgtatttagcgatatttattacgtatttagtaaacgttgaaagcgtcgcgatttagtttgcgcgagttaagtcgtttttattcgcgcgattattaggggtttcggtggcgatattttaggtcgttcgggaggtagattttttgattcgatagaat

SEQ ID NO: 5968 - DNA, 559 bp, Artificial Sequence
  chemically treated genomic DNA (Homo sapiens) CpG-island No: 5968
attctatcgaatcaaaaaatctacctcccgaacgacctaaaatatcgccaccgaaacccctaataatcgcgcgaataaaaacgacttaactcgcgcaaactaaatcgcgacgctttcaacgtttactaaatacgtaataaatatcgctaaatacgttctacacacatcgccacgtaactctaaataatcaaaaacctatacaacaactacatataatcgaacaataaacgtctattaacgtaaaactatttaaaattaaatcgatataacgcgataattaaccgtattatacttaataataacgctctaaataataaattaaaacgaattataaaaaccaaaaaaactcaaaatcgcgacctaaccgccgctaccgaaccgaaatcgctcatattacgatattaaaaaacgctaacatccctttatcacatctatactcatcgattaattacgctttaacctaacccctaaataaaacaaccgaacgcatatttaaattaaaaatcacttccccaacgaccaatattctacaatttctaatcgcgaataacataaaata

SEQ ID NO: 5969 - DNA, 932 bp, Artificial Sequence
  chemically treated genomic DNA (Homo sapiens) CpG-island No: 5969
ttgtcggttcggtatcgtcgttatcgttgatatattttttattacgtagtgttagtattagagaattgaatatcgttttgtcgaagaatttcggcgcgttgatgtcgtgtagtacggagagacgttgcgcgacggtgcggttttttttttttagcgtatcgcggttgatcgacgggttggtatttaataattagaaggtgatggtataacgttgtagcgtttcgcgcgcgtttgcggttagtagttgtagcgtgcgagaatgcgtcgggttgatatgtaatttattattttgtagggtaattagtttttgacgttgtattttatttgttagcgtattaataacgttcggtaattcgtcgcgattttagcgtaggaatagtttcgtttttagtattgggtaaagtatattgtacgtgttttattaatacgtcgcgggagatgtggcgatgtatgggtgatagattgtcgatattagcgaaggtagattaaaatatgcgtaatgtgtagcgatagtaggttattagtatcgtttgttcgcgcggagaatgatgatgtcgcgaatgtgttttttcggattttattatttgtttatttgtagcgcgtgatcgataagttcgttggcgttggttgaaggaacggtagagttcgtggagtagggtacgttgcgtattagatttaggtagtagttgagttgttcggtaattgttcgcgggtgagtgagcgttgacgtgatgttagtagcgtagtatagtataggtttatggcgtttgtcgcgtttgcgttgttaatgcgtattattagatcggtagtaatattattgatcgtcggcgttaattatgtcggacgtatcgtttcgatgggatcgatagatttacgttagttaggtatatgttggttaaggtaggttattaacggtattggtttatcgaagt

SEQ ID NO: 5970 - DNA, 932 bp, Artificial Sequence
  chemically treated genomic DNA (Homo sapiens) CpG-island No: 5970
acttcgataaaccaataccgttaataacctaccttaaccaacatatacctaactaacgtaaatctatcgatcccatcgaaacgatacgtccgacataattaacgccgacgatcaataatattactaccgatctaataatacgcattaacaacgcaaacgcgacaaacgccataaacctatactatactacgctactaacatcacgtcaacgctcactcacccgcgaacaattaccgaacaactcaactactacctaaatctaatacgcaacgtaccctactccacgaactctaccgttccttcaaccaacgccaacgaacttatcgatcacgcgctacaaataaacaaataataaaatccgaaaaaacacattcgcgacatcatcattctccgcgcgaacaaacgatactaataacctactatcgctacacattacgcatattttaatctaccttcgctaatatcgacaatctatcacccatacatcgccacatctcccgcgacgtattaataaaacacgtacaatatactttacccaatactaaaaacgaaactattcctacgctaaaatcgcgacgaattaccgaacgttattaatacgctaacaaataaaatacaacgtcaaaaactaattaccctacaaaataataaattacatatcaacccgacgcattctcgcacgctacaactactaaccgcaaacgcgcgcgaaacgctacaacgttataccatcaccttctaattattaaataccaacccgtcgatcaaccgcgatacgctaaaaaaaaaaaaccgcaccgtcgcgcaacgtctctccgtactacacgacatcaacgcgccgaaattcttcgacaaaacgatattcaattctctaatactaacactacgtaataaaaaatatatcaacgataacgacgataccgaaccgacaa

SEQ ID NO: 5971 - DNA, 932 bp, Artificial Sequence
  chemically treated genomic DNA (Homo sapiens) CpG-island No: 5971
atttcggtgaattaatgtcgttgatgatttattttaattagtatgtatttgattggcgtgaatttatcgattttatcgaagcggtgcgttcggtatggttaacgtcgacggttaataatattgttgtcgatttgatggtacgtattaataacgtaggcgcggtaaacgttatgaatttgtgttgtattgcgttattggtattacgttagcgtttatttattcgcgagtagttatcgagtaatttaattgttatttggatttgatgcgtaacgtgttttattttacggattttatcgtttttttagttagcgttagcgagtttatcgattacgcgttgtaaatgaataagtggtgaagttcgagaagatatattcgcgatattattatttttcgcgcgagtaagcggtgttgatgatttattatcgttatatattgcgtatattttggtttgttttcgttgatgtcggtaatttgttatttatgtatcgttatatttttcgcgacgtattgatggagtacgtgtaatgtgttttatttaatgttgaaagcggagttgtttttgcgttgggatcgcgacgagttgtcggacgttattgatgcgttggtaaatgagatgtaacgttaggggttgattattttgtaagatgatgagttgtatattaattcggcgtattttcgtacgttatagttgttggtcgtaggcgcgcgcgaaacgttgtaacgttatgttattattttttggttgttgagtgttaattcgtcgattaatcgcggtacgttggagaaagagagtcgtatcgtcgcgtaacgttttttcgtgttgtacggtattaacgcgtcggagtttttcgataaggcggtgtttagttttttggtgttgatattgcgtgatgaagggtatattagcgatagcggcgatgtcgaatcggtag

SEQ ID NO: 5972 - DNA, 932 bp, Artificial Sequence
  chemically treated genomic DNA (Homo sapiens) CpG-island No: 5972
ctaccgattcgacatcgccgctatcgctaatatacccttcatcacgcaatatcaacaccaaaaaactaaacaccgccttatcgaaaaactccgacgcgttaataccgtacaacacgaaaaaacgttacgcgacgatacgactctctttctccaacgtaccgcgattaatcgacgaattaacactcaacaaccaaaaaataataacataacgttacaacgtttcgcgcgcgcctacgaccaacaactataacgtacgaaaatacgccgaattaatatacaactcatcatcttacaaaataatcaacccctaacgttacatctcatttaccaacgcatcaataacgtccgacaactcgtcgcgatcccaacgcaaaaacaactccgctttcaacattaaataaaacacattacacgtactccatcaatacgtcgcgaaaaatataacgatacataaataacaaattaccgacatcaacgaaaacaaaccaaaatatacgcaatatataacgataataaatcatcaacaccgcttactcgcgcgaaaaataataatatcgcgaatatatcttctcgaacttcaccacttattcatttacaacgcgtaatcgataaactcgctaacgctaactaaaaaaacgataaaatccgtaaaataaaacacgttacgcatcaaatccaaataacaattaaattactcgataactactcgcgaataaataaacgctaacgtaataccaataacgcaatacaacacaaattcataacgtttaccgcgcctacgttattaatacgtaccatcaaatcgacaacaatattattaaccgtcgacgttaaccataccgaacgcaccgcttcgataaaatcgataaattcacgccaatcaaatacatactaattaaaataaatcatcaacgacattaattcaccgaaat

SEQ ID NO: 5973 - DNA, 874 bp, Artificial Sequence
  chemically treated genomic DNA (Homo sapiens) CpG-island No: 5973
gcgataattacgttcggttcgtttatggtttttaataggcgacgaaaattgtgttgggtattttgtacgggaagtataaaagcggtttttagggttatgcgttgttttcgcgaattatcgtaaagaagtcgattcggttggcgtttatttcggtttggcgtgcggtaatgcgtgttatacggttagcgtttagcggggtaataagggtttttgataagttttgaaagtggcgagattgttgtattagcgcgttaattagcgcgtagcgttcggcgtgttgtttattacgtttttgtatttagttgtagtcgagcgtgtcgttagttaggcgtacggcggcgcgggttagcgtggcgtcgtcggtaaaaaaacgttcgtcggtgtcgtttattcgcgtttgaatttgtattaggttagttttagcggcgcggattattttatagtcggcggtgatgtttagcgcgtttaggcgtgttgttagtttagtcggttggttgtgcgttagtacggatatttagtgttggcgggtcgcggtatttgcgtgtatttagtgttttatagtgaatttaattatgtcggcgcgcgttaggttgacggagtatttcgtcgggttgtttttatcgttacggtggttaagggtgcgtacgtatagtagcggcgatatattcgggattttaagacgttggtattttttggtttggtgcgcggcgggcgttgattcgcgtttggttgcggcgtagcgtaatttcggtttgttcgcgtagaaaatcgtgtagcgagtcgttgtcgaagcgttgtagcgtcggttagagggtgaggttcgcgaagtagtggtcgattaaatagagcgcgacgtcgttgatacgacgtaggg

SEQ ID NO: 5974 - DNA, 874 bp, Artificial Sequence
  chemically treated genomic DNA (Homo sapiens) CpG-island No: 5974
ccctacgtcgtatcaacgacgtcgcgctctatttaatcgaccactacttcgcgaacctcaccctctaaccgacgctacaacgcttcgacaacgactcgctacacgattttctacgcgaacaaaccgaaattacgctacgccgcaaccaaacgcgaatcaacgcccgccgcgcaccaaaccaaaaaataccaacgtcttaaaatcccgaatatatcgccgctactatacgtacgcacccttaaccaccgtaacgataaaaacaacccgacgaaatactccgtcaacctaacgcgcgccgacataattaaattcactataaaacactaaatacacgcaaataccgcgacccgccaacactaaatatccgtactaacgcacaaccaaccgactaaactaacaacacgcctaaacgcgctaaacatcaccgccgactataaaataatccgcgccgctaaaactaacctaatacaaattcaaacgcgaataaacgacaccgacgaacgtttttttaccgacgacgccacgctaacccgcgccgccgtacgcctaactaacgacacgctcgactacaactaaatacaaaaacgtaataaacaacacgccgaacgctacgcgctaattaacgcgctaatacaacaatctcgccactttcaaaacttatcaaaaacccttattaccccgctaaacgctaaccgtataacacgcattaccgcacgccaaaccgaaataaacgccaaccgaatcgacttctttacgataattcgcgaaaacaacgcataaccctaaaaaccgcttttatacttcccgtacaaaatacccaacacaattttcgtcgcctattaaaaaccataaacgaaccgaacgtaattatcgc

SEQ ID NO: 5975 - DNA, 874 bp, Artificial Sequence
  chemically treated genomic DNA (Homo sapiens) CpG-island No: 5975
ttttgcgtcgtgttaacggcgtcgcgttttgtttaatcgattattatttcgcgggttttattttttggtcgacgttgtaacgtttcgatagcggttcgttgtacgattttttgcgcgagtaaatcggaattgcgttgcgtcgtagttagacgcggattagcgttcgtcgcgtattaggttaaagagtgttagcgttttgaaatttcgaatatgtcgtcgttgttgtgcgtgcgtatttttaattatcgtgacggtgaaagtagttcggcggagtatttcgttagtttgacgcgcgtcgatatgattgaatttattatggagtattgaatgtacgtagatatcgcgattcgttagtattggatgttcgtgttggcgtatagttaatcggttgaattggtagtacgtttgaacgcgttaaatattatcgtcgattatgaggtgattcgcgtcgttgaaattggtttggtatagatttaggcgcggatgggcggtatcggcgaacgtttttttgtcggcgacgttacgttgattcgcgtcgtcgtgcgtttgattgacggtacgttcggttatagttgggtgtaggggcgtgataaatagtacgtcgaacgttgcgcgttgattgacgcgttgatgtagtaatttcgttatttttaaaatttattagaaatttttattgtttcgttggacgttgatcgtatggtacgtattgtcgtacgttaggtcgaagtgaacgttagtcgggtcgatttttttacgatggttcgcggagataacgtatgattttggaaatcgtttttatgtttttcgtgtaggatgtttagtatagttttcgtcgtttgttaaaggttatgagcgagtcgggcgtgattgtcgt

SEQ ID NO: 5976 - DNA, 874 bp, Artificial Sequence
  chemically treated genomic DNA (Homo sapiens) CpG-island No: 5976
acgacaatcacgcccgactcgctcataacctttaacaaacgacgaaaactatactaaacatcctacacgaaaaacataaaaacgatttccaaaatcatacgttatctccgcgaaccatcgtaaaaaaatcgacccgactaacgttcacttcgacctaacgtacgacaatacgtaccatacgatcaacgtccaacgaaacaataaaaatttctaataaattttaaaaataacgaaattactacatcaacgcgtcaatcaacgcgcaacgttcgacgtactatttatcacgcccctacacccaactataaccgaacgtaccgtcaatcaaacgcacgacgacgcgaatcaacgtaacgtcgccgacaaaaaaacgttcgccgataccgcccatccgcgcctaaatctataccaaaccaatttcaacgacgcgaatcacctcataatcgacgataatatttaacgcgttcaaacgtactaccaattcaaccgattaactatacgccaacacgaacatccaatactaacgaatcgcgatatctacgtacattcaatactccataataaattcaatcatatcgacgcgcgtcaaactaacgaaatactccgccgaactactttcaccgtcacgataattaaaaatacgcacgcacaacaacgacgacatattcgaaatttcaaaacgctaacactctttaacctaatacgcgacgaacgctaatccgcgtctaactacgacgcaacgcaattccgatttactcgcgcaaaaaatcgtacaacgaaccgctatcgaaacgttacaacgtcgaccaaaaaataaaacccgcgaaataataatcgattaaacaaaacgcgacgccgttaacacgacgcaaaa

SEQ ID NO: 5977 - DNA, 608 bp, Artificial Sequence
  chemically treated genomic DNA (Homo sapiens) CpG-island No: 5977
tagtaatcgtttggttaatcggtgttaaaatttataacggcgcgttgggcgtcgatatttacgaaaaagattatttaacgattttggaaatggtaaaagtcgtaggtttggcgatcggtaacgtttttatcgtagagttgtaggatgttacgttcgttgcgttggtggtatatgtgatttcgcgtaaatgttacggttcgagcgcgattagtgaaaaatgttcgggtaacgttttggaaaaaggcggaaaaggatcgattatcgaatagttgtttaacgttcgtgtcgacgttacgtttggcggcggcgtaaaaatttttgttgaaacggtaatcgttggtgaatggtagggaaaaacgttgcgtgaataggtataggcgcgtggttattagttggtgagcgatgttgttttattgaattcggtgacggaagcgaattagtaaaaatttttgtttggtttgtttgttgacggtaatatgttagtgcgttggttaggatcgaaagtaacgtattatggtaatatcgataagttcgtagttatttgtacgttaaattcgtaacgtaatgatagtgtattaattttggcgtagatgatcgataaagttatt

SEQ ID NO: 5978 - DNA, 608 bp, Artificial Sequence
  chemically treated genomic DNA (Homo sapiens) CpG-island No: 5978
aataactttatcgatcatctacgccaaaattaatacactatcattacgttacgaatttaacgtacaaataactacgaacttatcgatattaccataatacgttactttcgatcctaaccaacgcactaacatattaccgtcaacaaacaaaccaaacaaaaatttttactaattcgcttccgtcaccgaattcaataaaacaacatcgctcaccaactaataaccacgcgcctatacctattcacgcaacgtttttccctaccattcaccaacgattaccgtttcaacaaaaatttttacgccgccgccaaacgtaacgtcgacacgaacgttaaacaactattcgataatcgatccttttccgcctttttccaaaacgttacccgaacatttttcactaatcgcgctcgaaccgtaacatttacgcgaaatcacatataccaccaacgcaacgaacgtaacatcctacaactctacgataaaaacgttaccgatcgccaaacctacgacttttaccatttccaaaatcgttaaataatctttttcgtaaatatcgacgcccaacgcgccgttataaattttaacaccgattaaccaaacgattacta

SEQ ID NO: 5979 - DNA, 608 bp, Artificial Sequence
  chemically treated genomic DNA (Homo sapiens) CpG-island No: 5979
aatggttttgtcggttatttgcgttagggttggtatattgttattacgttgcggatttggcgtataggtgattgcgggtttatcgatattgttatggtacgttgttttcggttttagttagcgtattggtatattgtcgttagtaaataggttaagtaggggtttttgttgattcgttttcgttatcgaatttagtgaggtagtatcgtttattaattgataattacgcgtttgtgtttgtttacgtagcgtttttttttgttatttattagcggttgtcgttttagtaaaggtttttgcgtcgtcgttaagcgtaacgtcggtacgagcgttaagtagttgttcggtaatcgattttttttcgtttttttttagagcgttattcggatattttttattggtcgcgttcggatcgtagtatttgcgcgaggttatatgtgttattagcgtagcgggcgtggtattttgtaattttgcggtagaaacgttatcggtcgttagatttgcggtttttgttatttttagaatcgttgggtgatttttttcgtgaatatcgacgtttagcgcgtcgttataggttttgatatcggttgattaggcggttgttg

SEQ ID NO: 5980 - DNA, 608 bp, Artificial Sequence
  chemically treated genomic DNA (Homo sapiens) CpG-island No: 5980
caacaaccgcctaatcaaccgatatcaaaacctataacgacgcgctaaacgtcgatattcacgaaaaaaatcacccaacgattctaaaaataacaaaaaccgcaaatctaacgaccgataacgtttctaccgcaaaattacaaaataccacgcccgctacgctaataacacatataacctcgcgcaaatactacgatccgaacgcgaccaataaaaaatatccgaataacgctctaaaaaaaaacgaaaaaaaatcgattaccgaacaactacttaacgctcgtaccgacgttacgcttaacgacgacgcaaaaacctttactaaaacgacaaccgctaataaataacaaaaaaaaacgctacgtaaacaaacacaaacgcgtaattatcaattaataaacgatactacctcactaaattcgataacgaaaacgaatcaacaaaaacccctacttaacctatttactaacgacaatataccaatacgctaactaaaaccgaaaacaacgtaccataacaatatcgataaacccgcaatcacctatacgccaaatccgcaacgtaataacaatataccaaccctaacgcaaataaccgacaaaaccatt

SEQ ID NO: 5981 - DNA, 841 bp, Artificial Sequence
  chemically treated genomic DNA (Homo sapiens) CpG-island No: 5981
cggatgtagttttttcgtgtttttgtgtacgaatagtgatatcggttattttaggtgcgttgacgggagatatattagttaggacggttagtaatatcgattcgatacgcgtttggttttagttcgggatttattgtacgttttgattttttttagtgattgcgtacgtagatttttttgatttatgttgacgattattgcggcgtcgcgcggaagatgatcggcgttttgtgacgttagtatacggatagttgtgttgtatttttttaacgtgtagtagcgcgtttttttttgtagtagcgtaacgacgatgtcgttcgttttgaagacgtttacgttattagcgtcggataagtgttcggtagataagtgtcgttcgggttaatcggttagcggtttttaggtcgtatttttgatcgattatatagtcgttcgggcgtggttaggcgcggtgtgaacggtatcggtatcggtatttagggtaacggatcgtcgaggattgtcggaacgtcgaagtttataaacggatgggtaaacgtagtagtttaagtttcgtattttttatcgtgtcgagaatggtgtaatggttacgtcgatacgttgtattacgtttttaattagatttttcgttagattacggtttgatcgtcgatttgtattagcgtatagtcgaaatttggtgtatagagattgcgcggttggtaggtagagtttacggcgtggtggtttagatatttagcgagattggttcgttaacgttgtttacggtaaatttcgttttagtgtattttgatcgattgtttggaaagtaacgtcgatggacggagaagttcgtcgtaat

SEQ ID NO: 5982 - DNA, 841 bp, Artificial Sequence
  chemically treated genomic DNA (Homo sapiens) CpG-island No: 5982
attacgacgaacttctccgtccatcgacgttactttccaaacaatcgatcaaaatacactaaaacgaaatttaccgtaaacaacgttaacgaaccaatctcgctaaatatctaaaccaccacgccgtaaactctacctaccaaccgcgcaatctctatacaccaaatttcgactatacgctaatacaaatcgacgatcaaaccgtaatctaacgaaaaatctaattaaaaacgtaatacaacgtatcgacgtaaccattacaccattctcgacacgataaaaaatacgaaacttaaactactacgtttacccatccgtttataaacttcgacgttccgacaatcctcgacgatccgttaccctaaataccgataccgataccgttcacaccgcgcctaaccacgcccgaacgactatataatcgatcaaaaatacgacctaaaaaccgctaaccgattaacccgaacgacacttatctaccgaacacttatccgacgctaataacgtaaacgtcttcaaaacgaacgacatcgtcgttacgctactacaaaaaaaaacgcgctactacacgttaaaaaaatacaacacaactatccgtatactaacgtcacaaaacgccgatcatcttccgcgcgacgccgcaataatcgtcaacataaatcaaaaaaatctacgtacgcaatcactaaaaaaaatcaaaacgtacaataaatcccgaactaaaaccaaacgcgtatcgaatcgatattactaaccgtcctaactaatatatctcccgtcaacgcacctaaaataaccgatatcactattcgtacacaaaaacacgaaaaaactacatccg

SEQ ID NO: 5983 - DNA, 841 bp, Artificial Sequence
  chemically treated genomic DNA (Homo sapiens) CpG-island No: 5983
attacgacgaattttttcgtttatcgacgttgttttttaggtagtcgattaggatgtattaaagcgaaatttgtcgtaagtaacgttgacgggttaatttcgttgggtatttggattattacgtcgtggattttgtttgttaatcgcgtaatttttatgtattagatttcgattatgcgttggtgtagatcgacggttaggtcgtgatttggcgaaagatttggttgaaagcgtaatgtagcgtatcggcgtgattattatattattttcggtacggtaaaaggtgcggagtttgagttgttgcgtttatttattcgtttatgggtttcgacgtttcggtaattttcggcgattcgttattttggatgtcggtatcggtgtcgtttatatcgcgtttggttacgttcggacgattatgtgatcggttagaaatacggtttggaaatcgttaatcggttggttcggacggtatttatttgtcgggtatttattcgacgttggtggcgtgaacgtttttaaagcgaacgatatcgtcgttgcgttgttgtagaaaaaggcgcgttgttgtacgttgagaaaatgtagtatagttattcgtgtgttggcgttataaaacgtcgattatttttcgcgcgacgtcgtagtggtcgttagtatggattagaaaggtttgcgtgcgtagttattgaaagagattaaggcgtgtagtggatttcggattggggttaggcgcgtatcgagtcgatgttgttaatcgttttgattggtgtatttttcgttagcgtatttggggtgatcgatgttattgttcgtgtataaagatacggaagagttgtattcg

SEQ ID NO: 5984 - DNA, 841 bp, Artificial Sequence
  chemically treated genomic DNA (Homo sapiens) CpG-island No: 5984
cgaatacaactcttccgtatctttatacacgaacaataacatcgatcaccccaaatacgctaacgaaaaatacaccaatcaaaacgattaacaacatcgactcgatacgcgcctaaccccaatccgaaatccactacacgccttaatctctttcaataactacgcacgcaaacctttctaatccatactaacgaccactacgacgtcgcgcgaaaaataatcgacgttttataacgccaacacacgaataactatactacattttctcaacgtacaacaacgcgcctttttctacaacaacgcaacgacgatatcgttcgctttaaaaacgttcacgccaccaacgtcgaataaatacccgacaaataaataccgtccgaaccaaccgattaacgatttccaaaccgtatttctaaccgatcacataatcgtccgaacgtaaccaaacgcgatataaacgacaccgataccgacatccaaaataacgaatcgccgaaaattaccgaaacgtcgaaacccataaacgaataaataaacgcaacaactcaaactccgcaccttttaccgtaccgaaaataatataataatcacgccgatacgctacattacgctttcaaccaaatctttcgccaaatcacgacctaaccgtcgatctacaccaacgcataatcgaaatctaatacataaaaattacgcgattaacaaacaaaatccacgacgtaataatccaaatacccaacgaaattaacccgtcaacgttacttacgacaaatttcgctttaatacatcctaatcgactacctaaaaaacaacgtcgataaacgaaaaaattcgtcgtaat

SEQ ID NO: 5985 - DNA, 932 bp, Artificial Sequence
  chemically treated genomic DNA (Homo sapiens) CpG-island No: 5985
  misc_feature (801)..(801): n is either a, c, g or t
  misc_feature (851)..(851): n is either a, c, g or t
  misc_feature (862)..(862): n is either a, c, g or t
ggtcgcggggaaggcgtttagcgtattaaacggttcgtcgagtaataatagttggggatcgtcgttagcgtacgagtaatttttattcgttgacgttgattatcggaagttgttagatgtagcgtttttttgcgttttttagttttattttttttatatttggtgcgcgatttttagtcgttgtattttttttatatttgttaatgtaggtcgaacgttacgttgttttgtatattgcgttacggtagtagtttttattttgaaaaattacgttacgttttgttttcggttttttaatacgttattcgttagttgaatgttgttatgttgataaggtataaaatcggtaatcgatttagtagggtggttttatcgtagtcggacggttttagtattattagagttcgtcgttttttagcgttaggttgatattttttagtgtcggtttgcgttataatcggcgtaaagatgagagatttgtagtatttgcgttttttttattgtacgaagcgcgaggtaacgtattggttgtaattattcgttatagcgggattttgttttgtttttttaaaaattgcgcggtgtcgatgatcgtttgtttatcggttcggttagttttgtcgtttgttgttgcggcgttagatagtatttttttttattagtttcggaacgttatttttaggtacgtcgtttaacgcgttagtttgttgatgtttttcggttgttttagttatacgtttgggtagtaatgtacggttgttgagtatcgatggcgtttttagcgaacgtttttcgattttnaggatgttttcggtaaaatttttgcgtattaattagaagttagcgttggngcgttttatgntcgatttgtttagattcgttatatttgtttttttttagggggtaacgcggtgttcgattaagttttaata

SEQ ID NO: 5986 - DNA, 932 bp, Artificial Sequence
  chemically treated genomic DNA (Homo sapiens) CpG-island No: 5986
  misc_feature (71)..(71): n is either a, c, g or t
  misc_feature (82)..(82): n is either a, c, g or t
  misc_feature (132)..(132): n is either a, c, g or t
tattaaaacttaatcgaacaccgcgttaccccctaaaaaaaaacaaatataacgaatctaaacaaatcgancataaaacgcnccaacgctaacttctaattaatacgcaaaaattttaccgaaaacatcctnaaaatcgaaaaacgttcgctaaaaacgccatcgatactcaacaaccgtacattactacccaaacgtataactaaaacaaccgaaaaacatcaacaaactaacgcgttaaacgacgtacctaaaaataacgttccgaaactaataaaaaaaaatactatctaacgccgcaacaacaaacgacaaaactaaccgaaccgataaacaaacgatcatcgacaccgcgcaatttttaaaaaaacaaaacaaaatcccgctataacgaataattacaaccaatacgttacctcgcgcttcgtacaataaaaaaaacgcaaatactacaaatctctcatctttacgccgattataacgcaaaccgacactaaaaaatatcaacctaacgctaaaaaacgacgaactctaataatactaaaaccgtccgactacgataaaaccaccctactaaatcgattaccgattttataccttatcaacataacaacattcaactaacgaataacgtattaaaaaaccgaaaacaaaacgtaacgtaatttttcaaaataaaaactactaccgtaacgcaatatacaaaacaacgtaacgttcgacctacattaacaaatataaaaaaaatacaacgactaaaaatcgcgcaccaaatataaaaaaaataaaactaaaaaacgcaaaaaaacgctacatctaacaacttccgataatcaacgtcaacgaataaaaattactcgtacgctaacgacgatccccaactattattactcgacgaaccgtttaatacgctaaacgccttccccgcgacc

SEQ ID NO: 5987 - DNA, 932 bp, Artificial Sequence
  chemically treated genomic DNA (Homo sapiens) CpG-island No: 5987
  misc_feature (71)..(71): n is either a, c, g or t
  misc_feature (82)..(82): n is either a, c, g or t
  misc_feature (132)..(132): n is either a, c, g or t
tattagggtttagtcgggtatcgcgttattttttggaaagaggtaggtgtgacgaatttgaataggtcggntatggggcgtnttaacgttaatttttggttggtgcgtaaagattttgtcgagaatattttngaggtcggaaagcgttcgttaaaagcgttatcgatgtttagtaatcgtatattgttatttagacgtgtggttgaaatagtcggaaaatattagtaaattggcgcgttaagcggcgtgtttgaaggtgacgtttcggggttggtgaaggggaatattatttgacgtcgtagtaataaacggtagaattgatcggatcggtgaataagcgattatcgatatcgcgtagtttttgaaagagtagggtaaggtttcgttgtagcgaatgattatagttagtacgttatttcgcgtttcgtgtaataaaggaggcgtagatgttgtaaattttttatttttacgtcgattatggcgtaaatcggtattggaagatattaatttgacgttggaaagcggcgagttttggtggtgttggggtcgttcggttgcggtaaaattattttgttgaatcgattgtcggttttgtgttttattagtatggtagtatttaattggcgggtagcgtattgagggatcgggagtagagcgtggcgtagttttttagaatgagggttattatcgtggcgtaatgtataggataacgtggcgttcggtttgtattggtaggtatagagaaaatgtagcgattggaaatcgcgtattagatgtgaaaaaagtggggttggaaggcgtagaaaaacgttatatttggtagttttcggtggttaacgttagcgggtggggattgttcgtgcgttggcggcgatttttagttgttattattcgacgaatcgtttggtgcgttggacgtttttttcgcgatt

SEQ ID NO: 5988 - DNA, 932 bp, Artificial Sequence
  chemically treated genomic DNA (Homo sapiens) CpG-island No: 5988
  misc_feature (801)..(801): n is either a, c, g or t
  misc_feature (851)..(851): n is either a, c, g or t
  misc_feature (862)..(862): n is either a, c, g or t
aatcgcgaaaaaaacgtccaacgcaccaaacgattcgtcgaataataacaactaaaaatcgccgccaacgcacgaacaatccccacccgctaacgttaaccaccgaaaactaccaaatataacgtttttctacgccttccaaccccacttttttcacatctaatacgcgatttccaatcgctacattttctctatacctaccaatacaaaccgaacgccacgttatcctatacattacgccacgataataaccctcattctaaaaaactacgccacgctctactcccgatccctcaatacgctacccgccaattaaatactaccatactaataaaacacaaaaccgacaatcgattcaacaaaataattttaccgcaaccgaacgaccccaacaccaccaaaactcgccgctttccaacgtcaaattaatatcttccaataccgatttacgccataatcgacgtaaaaataaaaaatttacaacatctacgcctcctttattacacgaaacgcgaaataacgtactaactataatcattcgctacaacgaaaccttaccctactctttcaaaaactacgcgatatcgataatcgcttattcaccgatccgatcaattctaccgtttattactacgacgtcaaataatattccccttcaccaaccccgaaacgtcaccttcaaacacgccgcttaacgcgccaatttactaatattttccgactatttcaaccacacgtctaaataacaatatacgattactaaacatcgataacgcttttaacgaacgctttccgacctcnaaaatattctcgacaaaatctttacgcaccaaccaaaaattaacgttaanacgccccatanccgacctattcaaattcgtcacacctacctctttccaaaaaataacgcgatacccgactaaaccctaata

SEQ ID NO: 5989 - DNA, 520 bp, Artificial Sequence
  chemically treated genomic DNA (Homo sapiens) CpG-island No: 5989
  misc_feature (124)..(124): n is either a, c, g or t
  misc_feature (128)..(128): n is either a, c, g or t
  misc_feature (378)..(378): n is either a, c, g or t
tgattaaggggtgacgcggcgaaagattaatttcgtgggtttggtttttacgttaggttgtttttatatcgttaatcggtggttagagacgagcggtatgcggtgaggagtagtttggggttgntttnggttattggatttatggtttagcgtcgagcggttaagtaaagtattttttttttcgttagcgtgggtaattattttcgttcggttgtgttgtcgtattttcggcgattgatcgcggcgttttagttttcgatgttattcgattattttgttttaattggttatgatcgatcgttttgtcgtcgagtttttcgtgcgacgtatgattgggatcgttaattatggtttcgggtgaataaatacgtcggtttntggggttaatcgatcggtttattagagttaagttacgaattggtatttattagatcgtcgcggtaatgtattatttgaagttatgaagagttgtagcgagtttgcgattataatggtaaatcgggtgtggttttattattaa

SEQ ID NO: 5990 - DNA, 520 bp, Artificial Sequence
  chemically treated genomic DNA (Homo sapiens) CpG-island No: 5990
  misc_feature (143)..(143): n is either a, c, g or t
  misc_feature (393)..(393): n is either a, c, g or t
  misc_feature (397)..(397): n is either a, c, g or t
ttaataataaaaccacacccgatttaccattataatcgcaaactcgctacaactcttcataacttcaaataatacattaccgcgacgatctaataaataccaattcgtaacttaactctaataaaccgatcgattaaccccanaaaccgacgtatttattcacccgaaaccataattaacgatcccaatcatacgtcgcacgaaaaactcgacgacaaaacgatcgatcataaccaattaaaacaaaataatcgaataacatcgaaaactaaaacgccgcgatcaatcgccgaaaatacgacaacacaaccgaacgaaaataattacccacgctaacgaaaaaaaaaatactttacttaaccgctcgacgctaaaccataaatccaataaccnaaancaaccccaaactactcctcaccgcataccgctcgtctctaaccaccgattaacgatataaaaacaacctaacgtaaaaaccaaacccacgaaattaatctttcgccgcgtcaccccttaatca

SEQ ID NO: 5991 - DNA, 520 bp, Artificial Sequence
  chemically treated genomic DNA (Homo sapiens) CpG-island No: 5991
  misc_feature (143)..(143): n is either a, c, g or t
  misc_feature (393)..(393): n is either a, c, g or t
  misc_feature (397)..(397): n is either a, c, g or t
ttgatgatggaattatattcggtttattattgtggtcgtagattcgttgtaattttttatggttttagatgatatattgtcgcgacgatttggtggatattaattcgtagtttggttttagtagatcggtcgattgattttanggatcgacgtgtttgtttattcggaattatagttggcgattttagttatgcgtcgtacgagaagttcggcgataggacgatcgattatgattagttgaagtaggataatcgagtggtatcggaggttgaaacgtcgcgattaatcgtcggagatacggtaatatagtcgaacggaaatgattatttacgttagcgaaagagaaggtattttatttggtcgttcgacgttaggttatgaatttagtagttnggantagttttagattgttttttatcgtatatcgttcgtttttagttatcgattggcggtatggagataatttggcgtgagaattaagtttacggggttgatttttcgtcgcgttattttttggtta

SEQ ID NO: 5992 - DNA, 520 bp, Artificial Sequence
  chemically treated genomic DNA (Homo sapiens) CpG-island No: 5992
  misc_feature (124)..(124): n is either a, c, g or t
  misc_feature (128)..(128): n is either a, c, g or t
  misc_feature (378)..(378): n is either a, c, g or t
taaccaaaaaataacgcgacgaaaaatcaaccccgtaaacttaattctcacgccaaattatctccataccgccaatcgataactaaaaacgaacgatatacgataaaaaacaatctaaaactantccnaactactaaattcataacctaacgtcgaacgaccaaataaaataccttctctttcgctaacgtaaataatcatttccgttcgactatattaccgtatctccgacgattaatcgcgacgtttcaacctccgataccactcgattatcctacttcaactaatcataatcgatcgtcctatcgccgaacttctcgtacgacgcataactaaaatcgccaactataattccgaataaacaaacacgtcgatccntaaaatcaatcgaccgatctactaaaaccaaactacgaattaatatccaccaaatcgtcgcgacaatatatcatctaaaaccataaaaaattacaacgaatctacgaccacaataataaaccgaatataattccatcatcaa

SEQ ID NO: 5993 - DNA, 669 bp, Artificial Sequence
  chemically treated genomic DNA (Homo sapiens) CpG-island No: 5993
cgttagcgtcgatattgtttgtttgtaggaagtgatgggcgcgtacgaagtttattcgttgtatgtggaaaattggttcgatatttcgtattacgagtttttcgtcgatattatgtggagcgattttgtttacggtcgtaatgtcgtatattcggaagggtattacggtaacgtcgtattgtcgcgttattttattgaatattatgagaatcgcgatgtttcggtcgatggtgcggaaaagcgcggcgtgttttattgtcgtattgtgtcgtcgatgatcggaaaagcgatttatgtgatgtgcgtatatttgggtttgcgtgaggcgtatcgttaggcgtagtttgcgatgttcgtcgaatgggtgaatgagttatcggacggcgaatcggtattggtggcgggtgattttaatgattggcggtaaaaagttaattattcgttaaaagtgtaggtttggattggatgagatttttattcgcgtttacgcgacgttcgggcgcgttacgttttttttttatgtgtttaagagttatatatagaatttgtgaagagtttttaataagcgtttttgcgtggcgatttttttcgtttcgtgcgtttttcgttattaaaattattatatcgatttttgatttaaatgtatgatggtatttattgaatagaata

SEQ ID NO: 5994 - DNA, 669 bp, Artificial Sequence
  chemically treated genomic DNA (Homo sapiens) CpG-island No: 5994
tattctattcaataaataccatcatacatttaaatcaaaaatcgatataataattttaataacgaaaaacgcacgaaacgaaaaaaatcgccacgcaaaaacgcttattaaaaactcttcacaaattctatatataactcttaaacacataaaaaaaaaacgtaacgcgcccgaacgtcgcgtaaacgcgaataaaaatctcatccaatccaaacctacacttttaacgaataattaactttttaccgccaatcattaaaatcacccgccaccaataccgattcgccgtccgataactcattcacccattcgacgaacatcgcaaactacgcctaacgatacgcctcacgcaaacccaaatatacgcacatcacataaatcgcttttccgatcatcgacgacacaatacgacaataaaacacgccgcgcttttccgcaccatcgaccgaaacatcgcgattctcataatattcaataaaataacgcgacaatacgacgttaccgtaatacccttccgaatatacgacattacgaccgtaaacaaaatcgctccacataatatcgacgaaaaactcgtaatacgaaatatcgaaccaattttccacatacaacgaataaacttcgtacgcgcccatcacttcctacaaacaaacaatatcgacgctaacg

SEQ ID NO: 5995 - DNA, 669 bp, Artificial Sequence
  chemically treated genomic DNA (Homo sapiens) CpG-island No: 5995
tgttttgtttaatgaatattattatatatttgaattaggagtcggtatgatgattttggtgacggggggcgtacggagcgggaagagtcgttacgtagaggcgtttattggggattttttataggttttgtatatagtttttaagtatatgaaaagaaaacgtggcgcgttcgggcgtcgcgtgggcgcgggtaaaaattttatttagtttaggtttgtatttttaacggatgattagttttttgtcgttagttattgaaattattcgttattaatatcggttcgtcgttcggtagtttatttatttattcggcgagtatcgtaagttgcgtttgacggtgcgttttacgtaggtttagatgtacgtatattatatgaatcgttttttcggttatcggcggtataatgcggtagtagagtacgtcgcgttttttcgtattatcgatcgaaatatcgcgatttttataatgtttaatgggataacgcgatagtacggcgttgtcgtgatgttttttcgggtatacggtattgcgatcgtaggtaaaatcgttttatatagtgtcggcgagaaattcgtagtgcgaggtatcgggttagttttttatatgtagcggatgaatttcgtgcgcgtttattattttttgtaggtaaataatatcggcgttgacg

SEQ ID NO: 5996 - DNA, 669 bp, Artificial Sequence
  chemically treated genomic DNA (Homo sapiens) CpG-island No: 5996
cgtcaacgccgatattatttacctacaaaaaataataaacgcgcacgaaattcatccgctacatataaaaaactaacccgatacctcgcactacgaatttctcgccgacactatataaaacgattttacctacgatcgcaataccgtatacccgaaaaaacatcacgacaacgccgtactatcgcgttatcccattaaacattataaaaatcgcgatatttcgatcgataatacgaaaaaacgcgacgtactctactaccgcattataccgccgataaccgaaaaaacgattcatataatatacgtacatctaaacctacgtaaaacgcaccgtcaaacgcaacttacgatactcgccgaataaataaataaactaccgaacgacgaaccgatattaataacgaataatttcaataactaacgacaaaaaactaatcatccgttaaaaatacaaacctaaactaaataaaatttttacccgcgcccacgcgacgcccgaacgcgccacgttttcttttcatatacttaaaaactatatacaaaacctataaaaaatccccaataaacgcctctacgtaacgactcttcccgctccgtacgccccccgtcaccaaaatcatcataccgactcctaattcaaatatataataatattcattaaacaaaaca

SEQ ID NO: 5997 - DNA, 654 bp, Artificial Sequence
  chemically treated genomic DNA (Homo sapiens) CpG-island No: 5997
gttcgtggggaatatatatcgttgcgtttattatttcgttggcgttgtttatggggatttatttgcgttatttgcgttcggggcgtattggcgaagtgtcggttatcggtttggtatttttgattttcgttattatttttggcggttgggtggtagaaagttcgatttgggtatcgtattttgattttatcggcgtgtagttgatttggatgttggtgggttacggttttgtggcggcggtgttgtcggtgtggttattgttggtttcgcgtgattatttttttatttttttgaaaatcgggattatcgtcggtttggcggtaggtattttgattatgcgttcgacgttgattatgtttgcgttgattaaatttgtcgatggtattggttcggtatggatcggtaatttgttttcgtttttgtttattattatcgtttgtggcgcggtgtttggtttttatgcgttgattttttgtgggattacgtcgaagatgttggcgaacgaaggtaggcgtggttttattcgtttcggtgggatgttaatggaatttttcgtggcgattatggcgttggttttcgattgtattatcgattcgggtagtgtgttttttttatgaatatatcgatgcggtgttattattttatttattttaa

SEQ ID NO: 5998 - DNA, 654 bp, Artificial Sequence
  chemically treated genomic DNA (Homo sapiens) CpG-island No: 5998
ttaaaataaataaaataataacaccgcatcgatatattcataaaaaaaacacactacccgaatcgataatacaatcgaaaaccaacgccataatcgccacgaaaaattccattaacatcccaccgaaacgaataaaaccacgcctaccttcgttcgccaacatcttcgacgtaatcccacaaaaaatcaacgcataaaaaccaaacaccgcgccacaaacgataataataaacaaaaacgaaaacaaattaccgatccataccgaaccaataccatcgacaaatttaatcaacgcaaacataatcaacgtcgaacgcataatcaaaatacctaccgccaaaccgacgataatcccgattttcaaaaaaataaaaaaataatcacgcgaaaccaacaataaccacaccgacaacaccgccgccacaaaaccgtaacccaccaacatccaaatcaactacacgccgataaaatcaaaatacgatacccaaatcgaactttctaccacccaaccgccaaaaataataacgaaaatcaaaaataccaaaccgataaccgacacttcgccaatacgccccgaacgcaaataacgcaaataaatccccataaacaacgccaacgaaataataaacgcaacgatatatattccccacgaac

SEQ ID NO: 5999 - DNA, 654 bp, Artificial Sequence
  chemically treated genomic DNA (Homo sapiens) CpG-island No: 5999
ttggggtggataaggtgatagtatcgtatcggtgtgtttatgggaaaaatatattgttcggatcgatgatatagtcggaaattagcgttataatcgttacgaaggattttattaatattttatcgaagcggataaagttacgtttgttttcgttcgttagtattttcggcgtggttttataagagattagcgtatggaagttagatatcgcgttataggcgatggtgataaataggaacgggaataggttatcggtttatatcgggttagtgttatcgataaatttggttagcgtaggtatggttagcgtcgggcgtataattaaaatgtttatcgttagatcgacgatagtttcgatttttaggaaggtagagaggtagttacgcggggttagtagtaattatatcggtagtatcgtcgttataaaatcgtaatttattagtatttaggttaattgtacgtcggtaaagttaaagtacggtgtttaggtcggattttttgttatttagtcgttagagataatggcgaaaattaggaatattagatcgatgatcgatatttcgttaatacgtttcggacgtagatagcgtaggtagatttttataaatagcgttagcggaatggtgaacgtaacggtatatgttttttacgggt

SEQ ID NO: 6000 - DNA, 654 bp, Artificial Sequence
  chemically treated genomic DNA (Homo sapiens) CpG-island No: 6000
acccgtaaaaaacatataccgttacgttcaccattccgctaacgctatttataaaaatctacctacgctatctacgtccgaaacgtattaacgaaatatcgatcatcgatctaatattcctaattttcgccattatctctaacgactaaataacaaaaaatccgacctaaacaccgtactttaactttaccgacgtacaattaacctaaatactaataaattacgattttataacgacgatactaccgatataattactactaaccccgcgtaactacctctctaccttcctaaaaatcgaaactatcgtcgatctaacgataaacattttaattatacgcccgacgctaaccatacctacgctaaccaaatttatcgataacactaacccgatataaaccgataacctattcccgttcctatttatcaccatcgcctataacgcgatatctaacttccatacgctaatctcttataaaaccacgccgaaaatactaacgaacgaaaacaaacgtaactttatccgcttcgataaaatattaataaaatccttcgtaacgattataacgctaatttccgactatatcatcgatccgaacaatatatttttcccataaacacaccgatacgatactatcaccttatccaccccaa

SEQ ID NO: 6001 - DNA, 581 bp, Artificial Sequence
  chemically treated genomic DNA (Homo sapiens) CpG-island No: 6001
  misc_feature (486)..(486): n is either a, c, g or t
cgtttttattgttcggggatggggagtaagtttagttagtcgttgttttcgggtgtcgcgtgcgtagttgtacgttatttttagacgaatcgatgattggatggatggtcgtcgtagtcgttatattgatgatacggatgtgttttttcgtatatattatgttatcggagagttgttaacgtatggttatcgtcgggtatgggcgttgtttcgtagataggtagaatttgatggtatgtttgcgattaatgttaaacgtgtttatcggattatgcgttagaatgcgttggtgtttgagcgaaaatttgttgtatcgatatcgtaacgggtatatataggtagagtggtcgtgaaagaagtaattagcgatggtgttttgacgggttcgagtttttgttgtgataacggagagagattgcgtgttacgttcgcgttggattgttgtgatcggatgtattgtattgggcgggtattattgttggtttnattaggaaatagtttaggcgttttgtttggaatcgtggaatgttcgttcggtaacgatttttaggattatgacgttttattttacggcgttttaa

SEQ ID NO: 6002 - DNA, 581 bp, Artificial Sequence
  chemically treated genomic DNA (Homo sapiens) CpG-island No: 6002
  misc_feature (96)..(96): n is either a, c, g or t
ttaaaacgccgtaaaataaaacgtcataatcctaaaaatcgttaccgaacgaacattccacgattccaaacaaaacgcctaaactatttcctaatnaaaccaacaataatacccgcccaatacaatacatccgatcacaacaatccaacgcgaacgtaacacgcaatctctctccgttatcacaacaaaaactcgaacccgtcaaaacaccatcgctaattacttctttcacgaccactctacctatatatacccgttacgatatcgatacaacaaattttcgctcaaacaccaacgcattctaacgcataatccgataaacacgtttaacattaatcgcaaacataccatcaaattctacctatctacgaaacaacgcccatacccgacgataaccatacgttaacaactctccgataacataatatatacgaaaaaacacatccgtatcatcaatataacgactacgacgaccatccatccaatcatcgattcgtctaaaaataacgtacaactacgcacgcgacacccgaaaacaacgactaactaaacttactccccatccccgaacaataaaaacg

SEQ ID NO: 6003 - DNA, 581 bp, Artificial Sequence
  chemically treated genomic DNA (Homo sapiens) CpG-island No: 6003
  misc_feature (96)..(96): n is either a, c, g or t
ttagagcgtcgtagaataaggcgttataattttaagaatcgttgtcgagcgggtattttacggttttaagtaagacgtttagattgttttttggtnaagttagtagtagtgttcgtttagtatagtgtattcgattatagtagtttagcgcgaacgtgatacgtagttttttttcgttattataataagaattcgaattcgttagagtattatcgttgattgttttttttacggttattttgtttgtatgtgttcgttacgatgtcggtatagtaggttttcgtttaagtattagcgtattttggcgtatgattcggtaaatacgtttggtattgatcgtaggtatattattaagttttgtttgtttgcgaagtagcgtttatattcgacgataattatacgttggtagtttttcgataatatggtgtatacggagaagtatattcgtattattagtgtgacgattgcggcggttatttatttagttatcggttcgtttgagaatgacgtgtaattgcgtacgcgatattcggagataacggttgattaagtttattttttattttcgggtaataagggcg

SEQ ID NO: 6004 - DNA, 581 bp, Artificial Sequence
  chemically treated genomic DNA (Homo sapiens) CpG-island No: 6004
  misc_feature (486)..(486): n is either a, c, g or t
cgcccttattacccgaaaataaaaaataaacttaatcaaccgttatctccgaatatcgcgtacgcaattacacgtcattctcaaacgaaccgataactaaataaataaccgccgcaatcgtcacactaataatacgaatatacttctccgtatacaccatattatcgaaaaactaccaacgtataattatcgtcgaatataaacgctacttcgcaaacaaacaaaacttaataatatacctacgatcaataccaaacgtatttaccgaatcatacgccaaaatacgctaatacttaaacgaaaacctactataccgacatcgtaacgaacacatacaaacaaaataaccgtaaaaaaaacaatcaacgataatactctaacgaattcgaattcttattataataacgaaaaaaaactacgtatcacgttcgcgctaaactactataatcgaatacactatactaaacgaacactactactaacttnaccaaaaaacaatctaaacgtcttacttaaaaccgtaaaatacccgctcgacaacgattcttaaaattataacgccttattctacgacgctctaa

SEQ ID NO: 6005 - DNA, 529 bp, Artificial Sequence
  chemically treated genomic DNA (Homo sapiens) CpG-island No: 6005
cgtaggggttaggtagtagttaggcgttgacgtaggtgcgtcgttgggatagtgtttgttagaaattattcgatgttaatttggcgttgattttagtggttggcgagtatgcggcggagttggtaaattaggcgttggatcgtaattttaacgtgatgatgtttttcgataacgttacgttggaagatgaaatttaatttaaaattcgcgcgcgggaaaaaggtttgttggtgatggggtcggattgcggtacgtcgatgattgtcggtatatcgttggtttttgttaacgtgatgtcggaaggtaatattggcgttattggcgttttcggtatcgggatttaggagttgtgttcgtagattgcgttggtaggggagggaattatttacgcgattggttttggcgggcgcgattttagtcgtgaagtgggcggtattagtgcgttaatagcgttggaaatgtttagtgtagacgagaaaagcgaagtgttgtatttgttttaaaatatttgtcgaagttgtgcgtttga

SEQ ID NO: 6006 - DNA, 529 bp, Artificial Sequence
  chemically treated genomic DNA (Homo sapiens) CpG-island No: 6006
tcaaacgcacaacttcgacaaatattttaaaacaaatacaacacttcgcttttctcgtctacactaaacatttccaacgctattaacgcactaataccgcccacttcacgactaaaatcgcgcccgccaaaaccaatcgcgtaaataattccctcccctaccaacgcaatctacgaacacaactcctaaatcccgataccgaaaacgccaataacgccaatattaccttccgacatcacgttaacaaaaaccaacgatataccgacaatcatcgacgtaccgcaatccgaccccatcaccaacaaacctttttcccgcgcgcgaattttaaattaaatttcatcttccaacgtaacgttatcgaaaaacatcatcacgttaaaattacgatccaacgcctaatttaccaactccgccgcatactcgccaaccactaaaatcaacgccaaattaacatcgaataatttctaacaaacactatcccaacgacgcacctacgtcaacgcctaactactacctaacccctacg

SEQ ID NO: 6007 - DNA, 529 bp, Artificial Sequence
  chemically treated genomic DNA (Homo sapiens) CpG-island No: 6007
ttagacgtatagtttcggtaggtgttttgaaataaatgtagtatttcgtttttttcgtttgtattgagtatttttagcgttgttagcgtattgatgtcgtttattttacggttgaggtcgcgttcgttaaggttaatcgcgtgagtaatttttttttttgttagcgtaatttgcgaatatagtttttgaatttcggtatcggaagcgttaatgacgttaatattgtttttcggtattacgttagtaaaagttagcggtgtgtcggtaattatcgacgtatcgtagttcggttttattattagtaagtttttttttcgcgcgcgggttttaagttggattttattttttagcgtgacgttatcggagaatattattacgttgaggttgcgatttagcgtttggtttgttagtttcgtcgtatattcgttagttattgaaattagcgttagattggtatcgggtaatttttgataggtattgttttagcgacgtatttgcgttaacgtttggttgttgtttgatttttgcg

SEQ ID NO: 6008 - DNA, 529 bp, Artificial Sequence
  chemically treated genomic DNA (Homo sapiens) CpG-island No: 6008
cgcaaaaatcaaacaacaaccaaacgttaacgcaaatacgtcgctaaaacaatacctatcaaaaattacccgataccaatctaacgctaatttcaataactaacgaatatacgacgaaactaacaaaccaaacgctaaatcgcaacctcaacgtaataatattctccgataacgtcacgctaaaaaataaaatccaacttaaaacccgcgcgcgaaaaaaaaacttactaataataaaaccgaactacgatacgtcgataattaccgacacaccgctaacttttactaacgtaataccgaaaaacaatattaacgtcattaacgcttccgataccgaaattcaaaaactatattcgcaaattacgctaacaaaaaaaaaaattactcacgcgattaaccttaacgaacgcgacctcaaccgtaaaataaacgacatcaatacgctaacaacgctaaaaatactcaatacaaacgaaaaaaacgaaatactacatttatttcaaaacacctaccgaaactatacgtctaa

SEQ ID NO: 6009 - DNA, 609 bp, Artificial Sequence
  chemically treated genomic DNA (Homo sapiens) CpG-island No: 6009
aacgtttcgttcgagtttttttcgtcgcgtattagtgaaatggagtagattttgtggaattttatcgatcgttttagtagtttgaaatcgaagtttgtatcggtgatttatggcgcgaatttcggcgagcgcgatcgtacgtatagtattattaaaggtattaaagatcgtattggtttggaagcggtatcgtattttatttgtattgatgcgacgttcgacgagttgcgtattattgtacgcgattattggaataacggtattcgttatatcggggcgttgcgtggcgatttgtcgtcgggaagtggtaagttagaaatgtatgtttttgatttggggacgttgttaaaagaagtggtagatttcgatattttcgtggcggcgtattcggaagtttttcggaaggtaaaagcgtttagcggatttgtttaatttgaacgtaaagtggtgtcggagtttatcgcgcgattatttattttttttcgatgcgaaaagtttttgcgtttcgggattgttcgtgtatgcgtttagagatgcgttttaagattgcgtaggatatcgattaattcgtcgattttttttcgttttcggaagagatgttcgtaaatg

SEQ ID NO: 6010 - DNA, 609 bp, Artificial Sequence
  chemically treated genomic DNA (Homo sapiens) CpG-island No: 6010
catttacgaacatctcttccgaaaacgaaaaaaaatcgacgaattaatcgatatcctacgcaatcttaaaacgcatctctaaacgcatacacgaacaatcccgaaacgcaaaaacttttcgcatcgaaaaaaaataaataatcgcgcgataaactccgacaccactttacgttcaaattaaacaaatccgctaaacgcttttaccttccgaaaaacttccgaatacgccgccacgaaaatatcgaaatctaccacttcttttaacaacgtccccaaatcaaaaacatacatttctaacttaccacttcccgacgacaaatcgccacgcaacgccccgatataacgaataccgttattccaataatcgcgtacaataatacgcaactcgtcgaacgtcgcatcaatacaaataaaatacgataccgcttccaaaccaatacgatctttaatacctttaataatactatacgtacgatcgcgctcgccgaaattcgcgccataaatcaccgatacaaacttcgatttcaaactactaaaacgatcgataaaattccacaaaatctactccatttcactaatacgcgacgaaaaaaactcgaacgaaacgtt

SEQ ID NO: 6011 - DNA, 609 bp, Artificial Sequence
  chemically treated genomic DNA (Homo sapiens) CpG-island No: 6011
tatttgcgggtatttttttcgaaagcgagagaagatcgacggattgatcgatattttgcgtaattttagagcgtatttttaagcgtatgtacgaatagtttcgaaacgtaggagtttttcgtatcgaagaagagtgagtaatcgcgcggtgggtttcggtattattttgcgtttagattaagtaaattcgttgagcgtttttgtttttcggggaattttcggatacgtcgttacggagatatcgaaatttgttattttttttaatagcgtttttaggttagaagtatatatttttggtttattatttttcggcggtagatcgttacgtagcgtttcgatatgacgaatatcgttattttagtagtcgcgtgtaatggtgcgtagttcgtcgggcgtcgtattaatgtaagtaagatgcggtgtcgtttttagattagtgcgatttttaatgtttttaataatgttgtgcgtacggtcgcgttcgtcggagttcgcgttataggttatcgatataaatttcggttttaggttgttaaggcgatcgatggagttttatagggtttgttttattttattggtacgcggcgggaaaaattcgaacgaaacgtt

SEQ ID NO: 6012 - DNA, 609 bp, Artificial Sequence
  chemically treated genomic DNA (Homo sapiens) CpG-island No: 6012
aacgtttcgttcgaatttttcccgccgcgtaccaataaaataaaacaaaccctataaaactccatcgatcgccttaacaacctaaaaccgaaatttatatcgataacctataacgcgaactccgacgaacgcgaccgtacgcacaacattattaaaaacattaaaaatcgcactaatctaaaaacgacaccgcatcttacttacattaatacgacgcccgacgaactacgcaccattacacgcgactactaaaataacgatattcgtcatatcgaaacgctacgtaacgatctaccgccgaaaaataataaaccaaaaatatatacttctaacctaaaaacgctattaaaaaaaataacaaatttcgatatctccgtaacgacgtatccgaaaattccccgaaaaacaaaaacgctcaacgaatttacttaatctaaacgcaaaataataccgaaacccaccgcgcgattactcactcttcttcgatacgaaaaactcctacgtttcgaaactattcgtacatacgcttaaaaatacgctctaaaattacgcaaaatatcgatcaatccgtcgatcttctctcgctttcgaaaaaaatacccgcaaata

SEQ ID NO: 6013 - DNA, 653 bp, Artificial Sequence
  chemically treated genomic DNA (Homo sapiens) CpG-island No: 6013
cggtttttcggaagcgttattattttcggcgaacgttcgaattgtggtcgattggtgttcgacgaaagaacgtggtattgttttcgttatttttaattcggcgtaatatttttcgttggcgtttttttcgtcgttgtttgcgtagttggtttttgtttggggttggggatacgtttttatcgttatgggcgtggatgggtgttgggttatcgcggttgtgatttagttggttttattatttattttatcgtatgataaatcgtaataaatttaaaggtggcggttattatcggcgtcgcgttaaatttagatgtataatttattcgtttcggtttttttgtcgtggtttttatcgtatatatcgtatcgtttgattgcgggtatattagcgttttagtagaaaatacgtaatttacgtcgagtttatttttattgttttttattacgttaaaatcgttttttaggcgttcgcgtaatttcgtcgttagcgggttttgaatcgttttcgttagatcggtaatttgaatttgcgtcggattaatttgtttattcgcgttatcggttgtgattagtgggattttattgcgtcgataataagtaattagcgtcgttttgggtcggtatattatttatggtaattaattacgtacgaa

SEQ ID NO: 6014 - DNA, 653 bp, Artificial Sequence
  chemically treated genomic DNA (Homo sapiens) CpG-island No: 6014
ttcgtacgtaattaattaccataaataatataccgacccaaaacgacgctaattacttattatcgacgcaataaaatcccactaatcacaaccgataacgcgaataaacaaattaatccgacgcaaattcaaattaccgatctaacgaaaacgattcaaaacccgctaacgacgaaattacgcgaacgcctaaaaaacgattttaacgtaataaaaaacaataaaaataaactcgacgtaaattacgtattttctactaaaacgctaatatacccgcaatcaaacgatacgatatatacgataaaaaccacgacaaaaaaaccgaaacgaataaattatacatctaaatttaacgcgacgccgataataaccgccacctttaaatttattacgatttatcatacgataaaataaataataaaaccaactaaatcacaaccgcgataacccaacacccatccacgcccataacgataaaaacgtatccccaaccccaaacaaaaaccaactacgcaaacaacgacgaaaaaaacgccaacgaaaaatattacgccgaattaaaaataacgaaaacaataccacgttctttcgtcgaacaccaatcgaccacaattcgaacgttcgccgaaaataataacgcttccgaaaaaccg

SEQ ID NO: 6015 - DNA, 653 bp, Artificial Sequence
  chemically treated genomic DNA (Homo sapiens) CpG-island No: 6015
ttcgtacgtgattgattgttatagatagtgtatcggtttaaagcggcgttgattgtttattgtcggcgtaataaaattttattggttataatcggtggcgcgggtgggtagattgattcgacgtagatttaggttatcgatttggcgaaaacgatttaggattcgttggcggcgaagttgcgcgagcgtttgaaaagcgattttggcgtagtgaaaaatagtaaaggtaagttcggcgtggattgcgtgttttttattgaagcgttggtgtattcgtagttagacggtacggtgtgtgcgatgaaagttacggtagaagggtcgaagcggatggattgtgtatttggatttggcgcggcgtcgatggtgatcgttatttttgggtttgttgcggtttgttatgcggtgaagtagatgatggaattaattggattatagtcgcggtagtttaatatttatttacgtttataacggtaaagacgtgtttttagttttaggtaaaagttagttacgtaagtagcggcgaaagaggcgttagcgagaaatattgcgtcgagttaaaaatggcgaagatagtattacgttttttcgtcggatattagtcggttataattcgggcgttcgtcgggaatgatggcgttttcgagaagtcg

SEQ ID NO: 6016 - DNA, 653 bp, Artificial Sequence
  chemically treated genomic DNA (Homo sapiens) CpG-island No: 6016
cgacttctcgaaaacgccatcattcccgacgaacgcccgaattataaccgactaatatccgacgaaaaaacgtaatactatcttcgccatttttaactcgacgcaatatttctcgctaacgcctctttcgccgctacttacgtaactaacttttacctaaaactaaaaacacgtctttaccgttataaacgtaaataaatattaaactaccgcgactataatccaattaattccatcatctacttcaccgcataacaaaccgcaacaaacccaaaaataacgatcaccatcgacgccgcgccaaatccaaatacacaatccatccgcttcgacccttctaccgtaactttcatcgcacacaccgtaccgtctaactacgaatacaccaacgcttcaataaaaaacacgcaatccacgccgaacttacctttactatttttcactacgccaaaatcgcttttcaaacgctcgcgcaacttcgccgccaacgaatcctaaatcgttttcgccaaatcgataacctaaatctacgtcgaatcaatctacccacccgcgccaccgattataaccaataaaattttattacgccgacaataaacaatcaacgccgctttaaaccgatacactatctataacaatcaatcacgtacgaa

SEQ ID NO: 6017 - DNA, 726 bp, Artificial Sequence
  chemically treated genomic DNA (Homo sapiens) CpG-island No: 6017
atgtcgggtaagtagatggcgattgacgtcgattttaacgtcggattgattggtgaagatgaggcgaaaaaacgtcgtttcgaagtgatttaggaagtcgatttttacggtttaatggacggggtaagtaagtttgttcgcggcgatgttatcgtcgggatttttattatggttattaatattgtcggcgggttgttggtcggcgtgttgtaatatggtatgagtatgggatacgcggcggaaagttatacgttattgattattggcgacggtttggtggtataaatttcggcgttggtgatttttatcgtcgcgggggttatcgttacgcgtgttagtatcgattaagatgtgtggcgagtaaatggggaattagttttttaatgatttaagcgttatgttgggtaagcgtcgtcgtgttttggttattcggtttggtgttttgggatgtcgatatttggatttgtgttgggtattgtcggattgatttggtttggtttggggattttcggacgcgaaataaaagagattggtcgatattattatgacgtagaattagattatttacgatcgttttaacgtgacgttgattcgtgatgacgtgatgggcgaaagtttttataattcgatgttgttaggaattgtggcggattttaaagttaaaggtttggtagtagaaagcgaaggggcgatcgtcgtattttttgatgagtttaaaaataagga

SEQ ID NO: 6018 - DNA, 726 bp, Artificial Sequence
  chemically treated genomic DNA (Homo sapiens) CpG-island No: 6018
tccttatttttaaactcatcaaaaaatacgacgatcgccccttcgctttctactaccaaacctttaactttaaaatccgccacaattcctaacaacatcgaattataaaaactttcgcccatcacgtcatcacgaatcaacgtcacgttaaaacgatcgtaaataatctaattctacgtcataataatatcgaccaatctcttttatttcgcgtccgaaaatccccaaaccaaaccaaatcaatccgacaatacccaacacaaatccaaatatcgacatcccaaaacaccaaaccgaataaccaaaacacgacgacgcttacccaacataacgcttaaatcattaaaaaactaattccccatttactcgccacacatcttaatcgatactaacacgcgtaacgataacccccgcgacgataaaaatcaccaacgccgaaatttataccaccaaaccgtcgccaataatcaataacgtataactttccgccgcgtatcccatactcataccatattacaacacgccgaccaacaacccgccgacaatattaataaccataataaaaatcccgacgataacatcgccgcgaacaaacttacttaccccgtccattaaaccgtaaaaatcgacttcctaaatcacttcgaaacgacgttttttcgcctcatcttcaccaatcaatccgacgttaaaatcgacgtcaatcgccatctacttacccgacat

SEQ ID NO: 6019 - DNA, 726 bp, Artificial Sequence
  chemically treated genomic DNA (Homo sapiens) CpG-island No: 6019
tttttgtttttaaatttattaaggaatacgacggtcgttttttcgttttttattgttagatttttggttttgagattcgttataatttttggtagtatcgggttgtagaggttttcgtttattacgttattacgggttagcgttacgttgagacgatcgtaggtgatttggttttgcgttatggtgatgtcgattagttttttttgtttcgcgttcgagaatttttaagttaagttagattaattcggtagtatttagtataaatttaagtgtcggtattttagggtattagatcgagtaattagagtacggcggcgtttatttaatataacgtttgggttattgaaaagttgattttttatttgttcgttatatattttgatcggtgttgatacgcgtaacgatgattttcgcggcggtagaaattattagcgtcggaatttgtgttattagatcgtcgttaatggttaatagcgtataatttttcgtcgcgtgttttatgtttatgttatgttgtagtacgtcgattagtaattcgtcgataatgttaatgattatgatgaggatttcggcgatggtatcgtcgcgaataaatttatttgtttcgtttattgagtcgtaaaaatcggttttttgagttatttcggagcggcgttttttcgttttatttttattaattaattcggcgttaaggtcggcgttaatcgttatttgtttattcggtat

SEQ ID NO: 6020 - DNA, 726 bp, Artificial Sequence
  chemically treated genomic DNA (Homo sapiens) CpG-island No: 6020
ataccgaataaacaaataacgattaacgccgaccttaacgccgaattaattaataaaaataaaacgaaaaaacgccgctccgaaataactcaaaaaaccgatttttacgactcaataaacgaaacaaataaatttattcgcgacgataccatcgccgaaatcctcatcataatcattaacattatcgacgaattactaatcgacgtactacaacataacataaacataaaacacgcgacgaaaaattatacgctattaaccattaacgacgatctaataacacaaattccgacgctaataatttctaccgccgcgaaaatcatcgttacgcgtatcaacaccgatcaaaatatataacgaacaaataaaaaatcaacttttcaataacccaaacgttatattaaataaacgccgccgtactctaattactcgatctaataccctaaaataccgacacttaaatttatactaaatactaccgaattaatctaacttaacttaaaaattctcgaacgcgaaacaaaaaaaactaatcgacatcaccataacgcaaaaccaaatcacctacgatcgtctcaacgtaacgctaacccgtaataacgtaataaacgaaaacctctacaacccgatactaccaaaaattataacgaatctcaaaaccaaaaatctaacaataaaaaacgaaaaaacgaccgtcgtattccttaataaatttaaaaacaaaaa

SEQ ID NO: 6021 - DNA, 631 bp, Artificial Sequence
  chemically treated genomic DNA (Homo sapiens) CpG-island No: 6021
ggttggtacgttgggtatgttaagtaaagtaatgcggattttacgttagtaggaagttacggttttgcgtatttatttgtaaattcgtatcggtttgtatgcggcgtttaatgtttgtgaagagatgtgttaacgcgtggcgttggagcgttaattggatagcgaagaacgcgtattattgattgaacgttcgtaaacggttattcgttagggtcgcgattttttttacgtttgggatgttatttggaattcggcgtaggcgttggataacgtattatagtcggatagagtaggttagtttgtcgacgttttggagaaatacgttgtcggtttggtaatcgtatttagtcgttttttttaaataacgtttgaagagatattcgttttttaggttattttgtttattttattaaaataggagtaatacgtttgttagtttttcgttcgtttgttagattggatagtttcggtattaacgttcgttacggaataggtataaggagttacgtaatgattaatcgttatttttacgtttgttggtgtgtagtattttcggtagtacgacgttgattttcggttgtgtttttgttacgtaaggattttgtatttaataataagttaaaacgggaat

SEQ ID NO: 6022 - DNA, 631 bp, Artificial Sequence
  chemically treated genomic DNA (Homo sapiens) CpG-island No: 6022
attcccgttttaacttattattaaatacaaaatccttacgtaacaaaaacacaaccgaaaatcaacgtcgtactaccgaaaatactacacaccaacaaacgtaaaaataacgattaatcattacgtaactccttatacctattccgtaacgaacgttaataccgaaactatccaatctaacaaacgaacgaaaaactaacaaacgtattactcctattttaataaaataaacaaaataacctaaaaaacgaatatctcttcaaacgttatttaaaaaaaacgactaaatacgattaccaaaccgacaacgtatttctccaaaacgtcgacaaactaacctactctatccgactataatacgttatccaacgcctacgccgaattccaaataacatcccaaacgtaaaaaaaatcgcgaccctaacgaataaccgtttacgaacgttcaatcaataatacgcgttcttcgctatccaattaacgctccaacgccacgcgttaacacatctcttcacaaacattaaacgccgcatacaaaccgatacgaatttacaaataaatacgcaaaaccgtaacttcctactaacgtaaaatccgcattactttacttaacatacccaacgtaccaacc

SEQ ID NO: 6023 - DNA, 631 bp, Artificial Sequence
  chemically treated genomic DNA (Homo sapiens) CpG-island No: 6023
gttttcgttttaatttgttattaggtgtagaatttttacgtaataggggtatagtcggaaattagcgtcgtgttgtcgagaatgttgtatattagtagacgtgaaagtgacgattgattattgcgtggttttttgtgtttgtttcgtggcgggcgttaatgtcggggttgtttagtttggtaagcgggcgaaaagttggtagacgtgttgtttttgttttaataaggtgggtaggatggtttgagaggcgggtgtttttttaagcgttatttgaggagaacggttgagtgcggttgttagatcggtagcgtatttttttagggcgtcggtaaattgatttgttttgttcggttgtagtgcgttatttagcgtttgcgtcgagttttaggtggtattttaggcgtgaagaagatcgcggttttgacgaataatcgtttgcgaacgtttaattagtaatgcgcgtttttcgttgtttagttgacgttttagcgttacgcgttggtatatttttttataggtattaaacgtcgtatgtagatcgatacgaatttgtagataagtgcgtagagtcgtgattttttgttggcgtgggattcgtattattttatttaatatatttagcgtgttagtt

SEQ ID NO: 6024 - DNA, 631 bp, Artificial Sequence
  chemically treated genomic DNA (Homo sapiens) CpG-island No: 6024
aactaacacgctaaatatattaaataaaataatacgaatcccacgccaacaaaaaatcacgactctacgcacttatctacaaattcgtatcgatctacatacgacgtttaatacctataaaaaaatataccaacgcgtaacgctaaaacgtcaactaaacaacgaaaaacgcgcattactaattaaacgttcgcaaacgattattcgtcaaaaccgcgatcttcttcacgcctaaaataccacctaaaactcgacgcaaacgctaaataacgcactacaaccgaacaaaacaaatcaatttaccgacgccctaaaaaaatacgctaccgatctaacaaccgcactcaaccgttctcctcaaataacgcttaaaaaaacacccgcctctcaaaccatcctacccaccttattaaaacaaaaacaacacgtctaccaacttttcgcccgcttaccaaactaaacaaccccgacattaacgcccgccacgaaacaaacacaaaaaaccacgcaataatcaatcgtcactttcacgtctactaatatacaacattctcgacaacacgacgctaatttccgactatacccctattacgtaaaaattctacacctaataacaaattaaaacgaaaac

SEQ ID NO: 6025 - DNA, 670 bp, Artificial Sequence
  chemically treated genomic DNA (Homo sapiens) CpG-island No: 6025
gtggttagagcgtatcggaatcggtatcgtttgatcgtcgtatgttcggtaagaaaatgcgttacgtcggcgatcgtgttgttgcggtcgtcgtagaaagtgaagaaattgcggtttcgagtattggagttttatcgacgatggatatgaagtgttttagttcgggatggcgatcgacggagttattggcgggaagagcgttcgtcgtgtacgatgaatcggtggtggttgttgttgggcgttagatatcggatattgcggttgattacggtttaatgcgcgtggttttgaagttatattggtaatcggtttgttggttgtagtcgttgttgtatttgatgttaggcgtgtcggtgtcgtatttttaaacggtgatgtcggacgcgattttacgggtttgatatcgcgttttggttgtttttgtattttttttatcggtttcggttttggtttaggtttcggtttcggttttttaatgattatcggtgttttttttggcggttcggggatcggtttaagtttcggttttggttttattatcggtttcggtggcggttgaacggtttgtggcggttcgagattagtaagcgtaattatcgtgatagaaatcggttgcgtaagcgtaggtagtttaataatttgatgtatcggaaatgatcgtgcgatgtaa

SEQ ID NO: 6026 - DNA, 670 bp, Artificial Sequence
  chemically treated genomic DNA (Homo sapiens) CpG-island No: 6026
ttacatcgcacgatcatttccgatacatcaaattattaaactacctacgcttacgcaaccgatttctatcacgataattacgcttactaatctcgaaccgccacaaaccgttcaaccgccaccgaaaccgataataaaaccaaaaccgaaacttaaaccgatccccgaaccgccaaaaaaaacaccgataatcattaaaaaaccgaaaccgaaacctaaaccaaaaccgaaaccgataaaaaaaatacaaaaacaaccaaaacgcgatatcaaacccgtaaaatcgcgtccgacatcaccgtttaaaaatacgacaccgacacgcctaacatcaaatacaacaacgactacaaccaacaaaccgattaccaatataacttcaaaaccacgcgcattaaaccgtaatcaaccgcaatatccgatatctaacgcccaacaacaaccaccaccgattcatcgtacacgacgaacgctcttcccgccaataactccgtcgatcgccatcccgaactaaaacacttcatatccatcgtcgataaaactccaatactcgaaaccgcaatttcttcactttctacgacgaccgcaacaacacgatcgccgacgtaacgcattttcttaccgaacatacgacgatcaaacgataccgattccgatacgctctaaccac

SEQ ID NO: 6027 - DNA, 670 bp, Artificial Sequence
  chemically treated genomic DNA (Homo sapiens) CpG-island No: 6027
ttgtatcgtacggttattttcggtatattaggttattgaattatttgcgtttgcgtagtcgatttttgttacgatggttacgtttgttgatttcgaatcgttataagtcgtttagtcgttatcggagtcggtggtagagttagaatcggaatttgagtcgattttcgaatcgttaaaagaagtatcggtggttattgaaaagtcgaagtcgaaatttaagttaaaatcgaagtcggtgaaaaaggtataggagtagttaaaacgcgatgttaaattcgtagagtcgcgttcggtattatcgtttgaaaatacggtatcggtacgtttgatattaagtatagtaacggttgtaattagtaagtcggttattagtgtggttttaggattacgcgtattaagtcgtaattagtcgtagtattcggtatttggcgtttagtaataattattatcggtttatcgtgtacgacgggcgtttttttcgttagtggtttcgtcgatcgttatttcgggttaaagtattttatatttatcgtcgatgaggttttagtgttcggagtcgtaatttttttattttttgcgacgatcgtagtaatacgatcgtcgacgtgacgtatttttttgtcgaatatacggcggttaagcggtgtcggtttcggtgcgttttgattat

SEQ ID NO: 6028 - DNA, 670 bp, Artificial Sequence
  chemically treated genomic DNA (Homo sapiens) CpG-island No: 6028
ataatcaaaacgcaccgaaaccgacaccgcttaaccgccgtatattcgacaaaaaaatacgtcacgtcgacgatcgtattactacgatcgtcgcaaaaaataaaaaaattacgactccgaacactaaaacctcatcgacgataaatataaaatactttaacccgaaataacgatcgacgaaaccactaacgaaaaaaacgcccgtcgtacacgataaaccgataataattattactaaacgccaaataccgaatactacgactaattacgacttaatacgcgtaatcctaaaaccacactaataaccgacttactaattacaaccgttactatacttaatatcaaacgtaccgataccgtattttcaaacgataataccgaacgcgactctacgaatttaacatcgcgttttaactactcctatacctttttcaccgacttcgattttaacttaaatttcgacttcgacttttcaataaccaccgatacttcttttaacgattcgaaaatcgactcaaattccgattctaactctaccaccgactccgataacgactaaacgacttataacgattcgaaatcaacaaacgtaaccatcgtaacaaaaatcgactacgcaaacgcaaataattcaataacctaatataccgaaaataaccgtacgatacaa

SEQ ID NO: 6029 - DNA, 567 bp, Artificial Sequence
  chemically treated genomic DNA (Homo sapiens) CpG-island No: 6029
  misc_feature (349)..(349): n is either a, c, g or t
  misc_feature (430)..(430): n is either a, c, g or t
  misc_feature (479)..(479): n is either a, c, g or t
ttttcgggttgttgacgtggtaaacgtgtagacggtaattagtaattttcgttagatatagtacgcggcgaattgtttttatttcggtaaatatcggacgcgaagttatatagttatgagcggttacgcgatttttacgtttcgcgtttttcgtttagttcgttataaattagcgcgttttcgtagtgtattagtatcgggttgatttagttcgtttagtttttgcgtatttttgaagaattgttagtcgtttatattatcgaagtcggtggcgatatcgcgaatcgtataggtcgttacgaaatatgtgaagtcgataacgtttaattttatttatttgatgtagatngcgcgatgttgtaagatattaagtcgatcgagttgtggcgtattaaatattaacgttgttttttacggcgatcgaattttnattttattgaaacgcgggtatcggtgttagtagttggtgagcggtattncgattatttttagtcgtcgtatagagttgtgttggaaatgcgcgatttggggtaggaattaaagtatattgttatcgtaggcgtatta

SEQ ID NO: 6030 - DNA, 567 bp, Artificial Sequence
  chemically treated genomic DNA (Homo sapiens) CpG-island No: 6030
  misc_feature (89)..(89): n is either a, c, g or t
  misc_feature (138)..(138): n is either a, c, g or t
  misc_feature (219)..(219): n is either a, c, g or t
taatacgcctacgataacaatatactttaattcctaccccaaatcgcgcatttccaacacaactctatacgacgactaaaaataatcgnaataccgctcaccaactactaacaccgatacccgcgtttcaataaaatnaaaattcgatcgccgtaaaaaacaacgttaatatttaatacgccacaactcgatcgacttaatatcttacaacatcgcgcnatctacatcaaataaataaaattaaacgttatcgacttcacatatttcgtaacgacctatacgattcgcgatatcgccaccgacttcgataatataaacgactaacaattcttcaaaaatacgcaaaaactaaacgaactaaatcaacccgatactaatacactacgaaaacgcgctaatttataacgaactaaacgaaaaacgcgaaacgtaaaaatcgcgtaaccgctcataactatataacttcgcgtccgatatttaccgaaataaaaacaattcgccgcgtactatatctaacgaaaattactaattaccgtctacacgtttaccacgtcaacaacccgaaaa

SEQ ID NO: 6031 - DNA, 567 bp, Artificial Sequence
  chemically treated genomic DNA (Homo sapiens) CpG-island No: 6031
  misc_feature (89)..(89): n is either a, c, g or t
  misc_feature (138)..(138): n is either a, c, g or t
  misc_feature (219)..(219): n is either a, c, g or t
taatacgtttgcgataataatatgttttggtttttgttttagatcgcgtatttttagtataattttatacggcggttgaagatgatcgnaatgtcgtttattagttgttggtatcggtgttcgcgttttaatggaatngaagttcgatcgtcgtaaagggtaacgttgatatttgatgcgttataattcggtcggtttggtgttttatagtatcgcgtngtttgtattaagtagatgaagttgggcgttgtcggttttatatgtttcgtggcgatttgtgcgattcgcggtatcgttatcgatttcggtgatgtaaacgattggtagttttttaaaggtgcgtagaagttgggcgaattgggttagttcggtgttggtgtattgcgaaaacgcgttgatttgtgacgaattgggcgaagaacgcgaagcgtgaaggtcgcgtaatcgtttatgattatgtggtttcgcgttcggtatttatcgaagtgaaagtaattcgtcgcgtattgtatttggcgaaagttgttggttgtcgtttgtacgtttgttacgttagtagttcggaag

SEQ ID NO: 6032 - DNA, 567 bp, Artificial Sequence
  chemically treated genomic DNA (Homo sapiens) CpG-island No: 6032
  misc_feature (349)..(349): n is either a, c, g or t
  misc_feature (430)..(430): n is either a, c, g or t
  misc_feature (479)..(479): n is either a, c, g or t
cttccgaactactaacgtaacaaacgtacaaacgacaaccaacaactttcgccaaatacaatacgcgacgaattactttcacttcgataaataccgaacgcgaaaccacataatcataaacgattacgcgaccttcacgcttcgcgttcttcgcccaattcgtcacaaatcaacgcgttttcgcaatacaccaacaccgaactaacccaattcgcccaacttctacgcacctttaaaaaactaccaatcgtttacatcaccgaaatcgataacgataccgcgaatcgcacaaatcgccacgaaacatataaaaccgacaacgcccaacttcatctacttaatacaaacnacgcgatactataaaacaccaaaccgaccgaattataacgcatcaaatatcaacgttaccctttacgacgatcgaacttcnattccattaaaacgcgaacaccgataccaacaactaataaacgacattncgatcatcttcaaccgccgtataaaattatactaaaaatacgcgatctaaaacaaaaaccaaaacatattattatcgcaaacgtatta

SEQ ID NO: 6033 - DNA, 822 bp, Artificial Sequence
  chemically treated genomic DNA (Homo sapiens) CpG-island No: 6033
aagggattgttggcgtgtttggcgtgtcgtttgtggtgttgttggtaacgttgggtatcgtaggtattcgttggaagattggcgttattgttgggttgatcgtatttcgaatgcgcggttgtttgacgagggggtaatgcgttgtcggttgtgatgttaggggatataattgtttgtcgtatgcgttttaaggatgcgtgtacgtgcgttggatgcgtaaaattagttaatagaaatcgttaatgtcgggtagcgtatcgcgtttaatatcgcgggtgatgcggaaaaagagtagattaatcgtggcgattggttgtttgtcgatgtgtcgttagagtcgtttatacgggtgattgtcgagttttaaatttatatatcgttgatttagtggtagtcgttgtatatttattacgtcgttagttacgttacgggacgcgttttattgttggaagataattttgttgaattggttttcgatatttcgttatggttggtagataacgatcgtttggtattgcgcgatatttttgttcgtaatacgttggtcggagcgcgcgtcgcgatgtttaattcgtcgcgtcgcggtaaacgtaagtcggaatatttggtatggttggcgttttttgtacgggcgtagagcgagtcgatgcgttatttggttttcggaacgcggggcggtttatttcgcggatttcgtttgggcgcgttagtttaacggagaagggatgcgcgaattgttgtaatagttttgattatatttagtttggttatagtttgatggatgttttcgttgtcgttagttgttacggaatatttcgtttg

SEQ ID NO: 6034 - DNA, 822 bp, Artificial Sequence
  chemically treated genomic DNA (Homo sapiens) CpG-island No: 6034
caaacgaaatattccgtaacaactaacgacaacgaaaacatccatcaaactataaccaaactaaatataatcaaaactattacaacaattcgcgcatcccttctccgttaaactaacgcgcccaaacgaaatccgcgaaataaaccgccccgcgttccgaaaaccaaataacgcatcgactcgctctacgcccgtacaaaaaacgccaaccataccaaatattccgacttacgtttaccgcgacgcgacgaattaaacatcgcgacgcgcgctccgaccaacgtattacgaacaaaaatatcgcgcaataccaaacgatcgttatctaccaaccataacgaaatatcgaaaaccaattcaacaaaattatcttccaacaataaaacgcgtcccgtaacgtaactaacgacgtaataaatatacaacgactaccactaaatcaacgatatataaatttaaaactcgacaatcacccgtataaacgactctaacgacacatcgacaaacaaccaatcgccacgattaatctactctttttccgcatcacccgcgatattaaacgcgatacgctacccgacattaacgatttctattaactaattttacgcatccaacgcacgtacacgcatccttaaaacgcatacgacaaacaattatatcccctaacatcacaaccgacaacgcattaccccctcgtcaaacaaccgcgcattcgaaatacgatcaacccaacaataacgccaatcttccaacgaatacctacgatacccaacgttaccaacaacaccacaaacgacacgccaaacacgccaacaatccctt

SEQ ID NO: 6035 - DNA, 822 bp, Artificial Sequence
  chemically treated genomic DNA (Homo sapiens) CpG-island No: 6035
taaacgagatatttcgtggtaattggcggtaacgggggtatttattaagttataattaagttgaatataattaaggttgttgtagtaattcgcgtatttttttttcgttgagttggcgcgtttaggcgaaattcgcgaggtaaatcgtttcgcgtttcgaaggttagataacgtatcggttcgttttgcgttcgtgtaagagacgttagttatgttagatatttcggtttacgtttatcgcgacgcggcgggttaagtatcgcgacgcgcgtttcggttagcgtgttgcgggtagagatatcgcgtaatattaggcggtcgttatttgttagttataacggggtgtcgaagattagtttagtaaggttattttttagtagtgaaacgcgtttcgtgacgtggttggcggcgtggtgaatatgtagcggttgttattgggttagcggtgtatgggtttgaagttcgataattattcgtgtgaacggttttggcggtatatcggtaagtagttagtcgttacggttaatttgtttttttttcgtattattcgcgatgttaagcgcgatacgttgttcggtattggcggtttttgttggttggttttgcgtatttagcgtacgtatacgtatttttagagcgtatgcgataggtaattgtgttttttggtattatagtcggtagcgtattattttttcgttaggtagtcgcgtattcgagatacggttaatttagtaataacgttagttttttagcgaatatttacggtatttagcgttgttagtaatattataaacgatacgttaggtacgttagtaatttttt

SEQ ID NO: 6036 - DNA, 822 bp, Artificial Sequence
  chemically treated genomic DNA (Homo sapiens) CpG-island No: 6036
aaaaaattactaacgtacctaacgtatcgtttataatattactaacaacgctaaataccgtaaatattcgctaaaaaactaacgttattactaaattaaccgtatctcgaatacgcgactacctaacgaaaaaataatacgctaccgactataataccaaaaaacacaattacctatcgcatacgctctaaaaatacgtatacgtacgctaaatacgcaaaaccaaccaacaaaaaccgccaataccgaacaacgtatcgcgcttaacatcgcgaataatacgaaaaaaaaacaaattaaccgtaacgactaactacttaccgatataccgccaaaaccgttcacacgaataattatcgaacttcaaacccatacaccgctaacccaataacaaccgctacatattcaccacgccgccaaccacgtcacgaaacgcgtttcactactaaaaaataaccttactaaactaatcttcgacaccccgttataactaacaaataacgaccgcctaatattacgcgatatctctacccgcaacacgctaaccgaaacgcgcgtcgcgatacttaacccgccgcgtcgcgataaacgtaaaccgaaatatctaacataactaacgtctcttacacgaacgcaaaacgaaccgatacgttatctaaccttcgaaacgcgaaacgatttacctcgcgaatttcgcctaaacgcgccaactcaacgaaaaaaaaatacgcgaattactacaacaaccttaattatattcaacttaattataacttaataaatacccccgttaccgccaattaccacgaaatatctcgttta

SEQ ID NO: 6037 - DNA, 1022 bp, Artificial Sequence
  chemically treated genomic DNA (Homo sapiens) CpG-island No: 6037
tagttattaaacgtcgtatgtgtcgggtaagcgtgataatagttggtttatacgcgtttagtttgtatgtcgcgttttattttataggttagattatcgttgcggttttagacgttcgcgtttaggttatattgcgtatcgttcgttagttttagcgttttttttatcgttttgaaggtggttatcgttagtatcgggttaaaaatttttttttggaatattcgtatattgttttgattaaatagaatcgtcggttcgaggtagtagtcgttttttagtttattttttagtagtttgcgtcgttcgtttgtgagtacgttagcgtttttttttttatcgatattaatgtagttgaggatggtttttagttgttcgtgagaaatttgcgcgtttatttgcgttacgttgtcgagcgggttatcgttacgaatgttttcgatacggcggatggcgcgttttataaagcgttcgtagatagatttttgtattaaagtacgattcggataggtgttaatttcgttttgattaaagcgaatagtgtaaattttgagggaggtcgagacgattttataggttttaagtatcgtcggtcgggcggttgttggcgttaggtttgataacgatattgggttttgtgaaatgcgcgcgcggtagtggcgcgacggtagtaagagtgtcgtgtttttggcgtagttttttaattggatcgaatttaagtgtacgtagcgggtaggattcgatatatatgggttgttttttttcggcgacgcgcgaataataattatcgtatttcgttatgtgtttttttttagtattgtattgtggcgcgtcgtacggataagttatgtggtagtagcggtagtcgatataaatatttttattaattattataaagttatttttacgtttatgtattgcgtcgttggggtagatttttgtatatgcggggttatcgtaatggttataggagatggagagataataagcgaatacgttttggtgttagacgttattattttttt

SEQ ID NO: 6038 - DNA, 1022 bp, Artificial Sequence
  chemically treated genomic DNA (Homo sapiens) CpG-island No: 6038
aaaaaaataataacgtctaacaccaaaacgtattcgcttattatctctccatctcctataaccattacgataaccccgcatatacaaaaatctaccccaacgacgcaatacataaacgtaaaaataactttataataattaataaaaatatttatatcgactaccgctactaccacataacttatccgtacgacgcgccacaatacaatactaaaaaaaaacacataacgaaatacgataattattattcgcgcgtcgccgaaaaaaaacaacccatatatatcgaatcctacccgctacgtacacttaaattcgatccaattaaaaaactacgccaaaaacacgacactcttactaccgtcgcgccactaccgcgcgcgcatttcacaaaacccaatatcgttatcaaacctaacgccaacaaccgcccgaccgacgatacttaaaacctataaaatcgtctcgacctccctcaaaatttacactattcgctttaatcaaaacgaaattaacacctatccgaatcgtactttaatacaaaaatctatctacgaacgctttataaaacgcgccatccgccgtatcgaaaacattcgtaacgataacccgctcgacaacgtaacgcaaataaacgcgcaaatttctcacgaacaactaaaaaccatcctcaactacattaatatcgataaaaaaaaaaacgctaacgtactcacaaacgaacgacgcaaactactaaaaaataaactaaaaaacgactactacctcgaaccgacgattctatttaatcaaaacaatatacgaatattccaaaaaaaaatttttaacccgatactaacgataaccaccttcaaaacgataaaaaaaacgctaaaactaacgaacgatacgcaatataacctaaacgcgaacgtctaaaaccgcaacgataatctaacctataaaataaaacgcgacatacaaactaaacgcgtataaaccaactattatcacgcttacccgacacatacgacgtttaataacta

SEQ ID NO: 6039 - DNA, 1022 bp, Artificial Sequence
  chemically treated genomic DNA (Homo sapiens) CpG-island No: 6039
aggaagataatggcgtttggtattagaacgtgttcgtttattatttttttattttttgtaattattgcgatgatttcgtatgtataaaagtttgttttagcggcgtaatgtataagcgtgaagatggttttgtggtggttgatgaagatgtttgtatcggttgtcgttattgttatatggtttgttcgtacggcgcgttatagtataatgttgaaaaagggtatatgacgaagtgcgatggttgttattcgcgcgtcgtcgaggggaaataatttatatgtgtcgaattttgttcgttgcgtgtatttgagttcggtttaattgaagagttgcgttagaagtacggtatttttgttgtcgtcgcgttattgtcgcgcgcgtattttataaaatttaatatcgttattaaatttaacgttagtagtcgttcgatcggcgatatttagagtttataggatcgtttcgattttttttagggtttgtattgttcgttttaattagggcgaagttggtatttgttcgagtcgtgttttagtgtaggaatttatttacgaacgttttatggaacgcgttattcgtcgtgtcgaaagtattcgtagcggtaattcgttcgatagcgtgacgtaaatgggcgcgtaggttttttacgggtaattggaaattatttttaattatattgatatcggtaaaaaagagggcgttgacgtgtttataggcgggcggcgtaagttgttggaaggtgaattgaaagacggttattatttcgaatcgacgattttgtttggttagaataatatgcgggtgttttaggaggagatttttggttcggtgttggcggtgattatttttaaaacgatggaagaagcgttggagttggcgaacgatacgtaatatggtttgggcgcgggcgtttggagtcgtaacggtaatttggtttataagatggggcgcggtatataggttgggcgcgtgtggattaattgttattacgtttattcggtatatgcggcgtttggtggtta

SEQ ID NO: 6040 - DNA, 1022 bp, Artificial Sequence
  chemically treated genomic DNA (Homo sapiens) CpG-island No: 6040
taaccaccaaacgccgcatataccgaataaacgtaataacaattaatccacacgcgcccaacctatataccgcgccccatcttataaaccaaattaccgttacgactccaaacgcccgcgcccaaaccatattacgtatcgttcgccaactccaacgcttcttccatcgttttaaaaataatcaccgccaacaccgaaccaaaaatctcctcctaaaacacccgcatattattctaaccaaacaaaatcgtcgattcgaaataataaccgtctttcaattcaccttccaacaacttacgccgcccgcctataaacacgtcaacgccctcttttttaccgatatcaatataattaaaaataatttccaattacccgtaaaaaacctacgcgcccatttacgtcacgctatcgaacgaattaccgctacgaatactttcgacacgacgaataacgcgttccataaaacgttcgtaaataaattcctacactaaaacacgactcgaacaaataccaacttcgccctaattaaaacgaacaatacaaaccctaaaaaaaatcgaaacgatcctataaactctaaatatcgccgatcgaacgactactaacgttaaatttaataacgatattaaattttataaaatacgcgcgcgacaataacgcgacgacaacaaaaataccgtacttctaacgcaactcttcaattaaaccgaactcaaatacacgcaacgaacaaaattcgacacatataaattatttcccctcgacgacgcgcgaataacaaccatcgcacttcgtcatataccctttttcaacattatactataacgcgccgtacgaacaaaccatataacaataacgacaaccgatacaaacatcttcatcaaccaccacaaaaccatcttcacgcttatacattacgccgctaaaacaaacttttatacatacgaaatcatcgcaataattacaaaaaataaaaaaataataaacgaacacgttctaataccaaacgccattatcttcct

SEQ ID NO: 6041 - DNA, 686 bp, Artificial Sequence
  chemically treated genomic DNA (Homo sapiens) CpG-island No: 6041
gcgtttggcgtttcgattattatcgtagatgaaattcgtaaaaattcggttgttcgcgatgtgtcgaagattattcgtattatgttaggcgttaatttgatcggtaattttattagtggttagcgtgggaataatcgatagattgatattcgcggtatgggttcggaaaatacgttgattttgattgacggtaagtcggtaagtagtcgtaattcggtgcgttagggttggcgtggcgagcgcgatattcgtggtgatattttttgggtgttatttgaaatgattgaacgtattgaagttttgcgtggttcggtagttgcgcgttatggtaacggcgcggcgggcggcgtggttaatattattattaaaaaaggtagcggcgagtggtacggtttttgcgacgtatatttaatgcgttagaatataaagaggaaggtgttattaaacgtattaattttagtttgatcggttcgttgggcgacgaatttagttttcggtttgtatggtaatttcgataaaatttaagttgacgcgtgggatattaattaggttattaatcgcgcgtgtcgaacgttgttacgagttattagtcggcgcgaatgggtaattagtaagatattatggcgtgggcgttgtgattttcgttattgaatcgttggattgtttgatgacgtatcgttattgtg

SEQ ID NO: 6042 - DNA, 686 bp, Artificial Sequence
  chemically treated genomic DNA (Homo sapiens) CpG-island No: 6042
cacaataacgatacgtcatcaaacaatccaacgattcaataacgaaaatcacaacgcccacgccataatatcttactaattacccattcgcgccgactaataactcgtaacaacgttcgacacgcgcgattaataacctaattaatatcccacgcgtcaacttaaattttatcgaaattaccatacaaaccgaaaactaaattcgtcgcccaacgaaccgatcaaactaaaattaatacgtttaataacaccttcctctttatattctaacgcattaaatatacgtcgcaaaaaccgtaccactcgccgctaccttttttaataataatattaaccacgccgcccgccgcgccgttaccataacgcgcaactaccgaaccacgcaaaacttcaatacgttcaatcatttcaaataacacccaaaaaatatcaccacgaatatcgcgctcgccacgccaaccctaacgcaccgaattacgactacttaccgacttaccgtcaatcaaaatcaacgtattttccgaacccataccgcgaatatcaatctatcgattattcccacgctaaccactaataaaattaccgatcaaattaacgcctaacataatacgaataatcttcgacacatcgcgaacaaccgaatttttacgaatttcatctacgataataatcgaaacgccaaacgc

SEQ ID NO: 6043 - DNA, 686 bp, Artificial Sequence
  chemically treated genomic DNA (Homo sapiens) CpG-island No: 6043
tatagtagcgatacgttattaaatagtttagcgatttaatggcgaaaattatagcgtttacgttataatattttgttgattatttattcgcgtcggttggtaattcgtggtaacgttcggtacgcgcgattgatggtttggttgatattttacgcgttagtttgggttttgtcgaggttgttatataaatcgaaagttgaattcgtcgtttagcggatcggttaggttagagttagtgcgtttggtggtatttttttttttatgttttggcgtattaaatatgcgtcgtaggagtcgtgttattcgtcgttgttttttttggtaatgatgttaattacgtcgttcgtcgcgtcgttgttataacgcgtagttgtcggattacgtagaattttaatacgtttaattattttaggtggtatttaggaagtattattacgggtatcgcgttcgttacgttagttttgacgtatcgagttacggttgtttatcggtttgtcgttaattaaaattagcgtgtttttcggatttatatcgcgaatattaatttgtcggttatttttacgttgattattggtggagttatcggttaggttaacgtttggtatggtacggatgattttcgatatatcgcgggtaatcgggtttttgcggattttatttgcggtgatggtcgaaacgttaggcgt

SEQ ID NO: 6044 - DNA, 686 bp, Artificial Sequence
  chemically treated genomic DNA (Homo sapiens) CpG-island No: 6044
acgcctaacgtttcgaccatcaccgcaaataaaatccgcaaaaacccgattacccgcgatatatcgaaaatcatccgtaccataccaaacgttaacctaaccgataactccaccaataatcaacgtaaaaataaccgacaaattaatattcgcgatataaatccgaaaaacacgctaattttaattaacgacaaaccgataaacaaccgtaactcgatacgtcaaaactaacgtaacgaacgcgatacccgtaataatacttcctaaataccacctaaaataattaaacgtattaaaattctacgtaatccgacaactacgcgttataacaacgacgcgacgaacgacgtaattaacatcattaccaaaaaaaacaacgacgaataacacgactcctacgacgcatatttaatacgccaaaacataaaaaaaaaaataccaccaaacgcactaactctaacctaaccgatccgctaaacgacgaattcaactttcgatttatataacaacctcgacaaaacccaaactaacgcgtaaaatatcaaccaaaccatcaatcgcgcgtaccgaacgttaccacgaattaccaaccgacgcgaataaataatcaacaaaatattataacgtaaacgctataattttcgccattaaatcgctaaactatttaataacgtatcgctactata

SEQ ID NO: 6045 - DNA, 720 bp, Artificial Sequence
  chemically treated genomic DNA (Homo sapiens) CpG-island No: 6045
tgaatcgcgttatagaagttttttagttgcgcgatatcgcgtatatttgtcggtttgtcgttaagttgacgataaatttgcgttagcgtcgttgcgtttagcgcgttattgtttttgtttaaattaattagtagtagtgcgttattttcggtagaaagttgcggcgtgatggtgtgacgtatattttttacgcgggtaaatgtagaaattattagcgatagcggcgacgttatttcgcgtttttcgttatttttttgttagcgggtttttatcgatatggagtttttatttatcgggatcgttaggtttagcgtcggataaagtttttcgtttacggttttaacggtttttatataggttcgtatttttattagggtggtttgtcgtcgttatttagttggcgggaaagtgtgatgcgtttgatatcgttaatttgtgttgcggcgatgttgggtaacgttttatcgatcgttagacgggttagggtcgttgaaatttagtagcgttattagcgtacgttcgttaatcgttatcgttttatcgtagtagttgtcgagttggcggtatgatcgcgtaggtagcgattgtatttgttacgggttattatttgatgcgcgttttatgtcggtacgttgggacggtattggtataagatggttttttttttaacgggaaagttagtacgtttttacgaattattttaagtattcgttttatacg

SEQ ID NO: 6046 - DNA, 720 bp, Artificial Sequence
  chemically treated genomic DNA (Homo sapiens) CpG-island No: 6046
cgtataaaacgaatacttaaaataattcgtaaaaacgtactaactttcccgttaaaaaaaaaaccatcttataccaataccgtcccaacgtaccgacataaaacgcgcatcaaataataacccgtaacaaatacaatcgctacctacgcgatcataccgccaactcgacaactactacgataaaacgataacgattaacgaacgtacgctaataacgctactaaatttcaacgaccctaacccgtctaacgatcgataaaacgttacccaacatcgccgcaacacaaattaacgatatcaaacgcatcacactttcccgccaactaaataacgacgacaaaccaccctaataaaaatacgaacctatataaaaaccgttaaaaccgtaaacgaaaaactttatccgacgctaaacctaacgatcccgataaataaaaactccatatcgataaaaacccgctaacaaaaaaataacgaaaaacgcgaaataacgtcgccgctatcgctaataatttctacatttacccgcgtaaaaaatatacgtcacaccatcacgccgcaactttctaccgaaaataacgcactactactaattaatttaaacaaaaacaataacgcgctaaacgcaacgacgctaacgcaaatttatcgtcaacttaacgacaaaccgacaaatatacgcgatatcgcgcaactaaaaaacttctataacgcgattca

SEQ ID NO: 6047 - DNA, 720 bp, Artificial Sequence
  chemically treated genomic DNA (Homo sapiens) CpG-island No: 6047
cgtataaaacgaatgtttagagtgattcgtgagaacgtgttagttttttcgttgggggaaaaattattttgtgttaatgtcgttttagcgtatcggtatggagcgcgtattaaatggtggttcgtggtaggtgtagtcgttatttgcgcggttatatcgttagttcgatagttattacggtgaagcgatggcgattggcgagcgtgcgttggtagcgttgttggattttagcggttttagttcgtttggcggtcggtgaagcgttatttaatatcgtcgtaatatagattggcgatattaaacgtattatattttttcgttaattggatggcggcggtaggttattttggtgaagatgcgggtttgtatagaggtcgttaaagtcgtgggcgaagagttttgttcggcgttgggtttgacgatttcggtgggtaaagattttatgtcgatgaaaattcgttggtaggaaggtaacgaagagcgcgaaatgacgtcgtcgttgtcgttggtgatttttgtatttgttcgcgtggaagatgtacgttatattattacgtcgtagttttttatcgaagataacgtattgttgttgattgatttgggtaaaggtaataacgcgttgggcgtaacggcgttggcgtaggtttatcgttagtttggcgataaatcggtagatgtacgcgatgtcgcgtaattgaaaggtttttatgacgcgattta

SEQ ID NO: 6048 - DNA, 720 bp, Artificial Sequence
  chemically treated genomic DNA (Homo sapiens) CpG-island No: 6048
taaatcgcgtcataaaaacctttcaattacgcgacatcgcgtacatctaccgatttatcgccaaactaacgataaacctacgccaacgccgttacgcccaacgcgttattacctttacccaaatcaatcaacaacaatacgttatcttcgataaaaaactacgacgtaataatataacgtacatcttccacgcgaacaaatacaaaaatcaccaacgacaacgacgacgtcatttcgcgctcttcgttaccttcctaccaacgaattttcatcgacataaaatctttacccaccgaaatcgtcaaacccaacgccgaacaaaactcttcgcccacgactttaacgacctctatacaaacccgcatcttcaccaaaataacctaccgccgccatccaattaacgaaaaaatataatacgtttaatatcgccaatctatattacgacgatattaaataacgcttcaccgaccgccaaacgaactaaaaccgctaaaatccaacaacgctaccaacgcacgctcgccaatcgccatcgcttcaccgtaataactatcgaactaacgatataaccgcgcaaataacgactacacctaccacgaaccaccatttaatacgcgctccataccgatacgctaaaacgacattaacacaaaataatttttcccccaacgaaaaaactaacacgttctcacgaatcactctaaacattcgttttatacg

SEQ ID NO: 6049 - DNA, 504 bp, Artificial Sequence
  chemically treated genomic DNA (Homo sapiens) CpG-island No: 6049
atcgggtattggtagttaggcgcgaatggataggtcggtttcgttcgttggtgttaagttttagtatttcgttatggttattttcgatacgttgtataattgttagttttaatttcgtgtcgttaatggtgcgcgtattgtcgtcgcggataaacggttggaataggtgtttacgttgtttcggcgtaattttcggatcgttattttttatttggaattaggcgcgattcggtttcgtttcgttgttgattttgatttagttattgttataacgggcggcgttgattattatattcgttatcgcgcgtttgatcgatagcgggtgtatttttattttaatgttgtcggggtaaagcgcggttttaatttttcgtttatagttattttcggtagtaattattttatcgagtattgtattaagattcgttatttttatcggtattttttgttcggtgcgtaggtagtcgataaattgtttaatgatggcgttgtatttttcgatat

SEQ ID NO: 6050 - DNA, 504 bp, Artificial Sequence
  chemically treated genomic DNA (Homo sapiens) CpG-island No: 6050
atatcgaaaaatacaacgccatcattaaacaatttatcgactacctacgcaccgaacaaaaaataccgataaaaataacgaatcttaatacaatactcgataaaataattactaccgaaaataactataaacgaaaaattaaaaccgcgctttaccccgacaacattaaaataaaaatacacccgctatcgatcaaacgcgcgataacgaatataataatcaacgccgcccgttataacaataactaaatcaaaatcaacaacgaaacgaaaccgaatcgcgcctaattccaaataaaaaataacgatccgaaaattacgccgaaacaacgtaaacacctattccaaccgtttatccgcgacgacaatacgcgcaccattaacgacacgaaattaaaactaacaattatacaacgtatcgaaaataaccataacgaaatactaaaacttaacaccaacgaacgaaaccgacctatccattcgcgcctaactaccaatacccgat

SEQ ID NO: 6051 - DNA, 504 bp, Artificial Sequence
  chemically treated genomic DNA (Homo sapiens) CpG-island No: 6051
atatcgaagagtgtaacgttattattgagtagtttatcgattatttgcgtatcgggtaggagatgtcgatggaaatggcggattttaatgtagtattcggtgaggtgattgttgtcgaaagtggttatgagcgggaaattgaaatcgcgttttatttcggtagtattgaagtgaaaatgtattcgttgtcgattaaacgcgcggtggcgaatatggtggttaacgtcgttcgttatggtaatggttggattaaagttagtagcggaacggagtcgaatcgcgtttggttttaggtggaagatgacggttcgggaattgcgtcggaataacgtaagtatttgttttagtcgtttgttcgcggcgatagtgcgcgtattattagcggtacgggattagggttggtaattgtgtagcgtatcggggataattataacgggatgttggaatttggtattagcgagcggggtcggtttgtttattcgcgtttggttgttagtgttcggt

SEQ ID NO: 6052 - DNA, 504 bp, Artificial Sequence
  chemically treated genomic DNA (Homo sapiens) CpG-island No: 6052
accgaacactaacaaccaaacgcgaataaacaaaccgaccccgctcgctaataccaaattccaacatcccgttataattatccccgatacgctacacaattaccaaccctaatcccgtaccgctaataatacgcgcactatcgccgcgaacaaacgactaaaacaaatacttacgttattccgacgcaattcccgaaccgtcatcttccacctaaaaccaaacgcgattcgactccgttccgctactaactttaatccaaccattaccataacgaacgacgttaaccaccatattcgccaccgcgcgtttaatcgacaacgaatacattttcacttcaatactaccgaaataaaacgcgatttcaatttcccgctcataaccactttcgacaacaatcacctcaccgaatactacattaaaatccgccatttccatcgacatctcctacccgatacgcaaataatcgataaactactcaataataacgttacactcttcgatat

SEQ ID NO: 6053 - DNA, 1342 bp, Artificial Sequence
  chemically treated genomic DNA (Homo sapiens) CpG-island No: 6053
  misc_feature (848)..(848): n is either a, c, g or t
tttcggggttaagttttgattcgttagattcggaaagttgtataggattatcggtagggtgacgttacgggcgatttgttggtaatagcgttaagattcgtggggcgatttgttatagtagggttgatgggtacgatttattagcgtcgtagttgcgtattatgcgttattgatcgttcgttaggggaggggatcgagtttattaaatcgtattgttcgtgttaatggtttagtttgttatcgtttcggttaagatcgtttgtgtggttttttttttgaggattagacgtatcgattttttttgaattatgtcgtcgttgatttgcggtagttttaaggcgcgttgtaatagtttgcggttgttttcgtgtggattggttattagaaagttgcgttcggttatggtttgtgttagggtttttggttttttttgatatagtaattcgttttcgtttattagtaatacgttacggtattgttcggtttcgtcgagatacgaggtattttagaggattaatattttttcgttcgttagtttatgtattatttgttatagttcgcgtcgtgagatagggttaacgtcgacgtcgggtttatcgagtagtaatattttcggttcgtttattagggtataggttagatcgagtttttgttttattttatcggagagtttgttcgttaggcgtttcggtaaacggtttaagagacgtaaattttagtaggcgagtaaaagtttgtttacgtgtttcgtcggtgacgttgcgtaaattcgcgtatagattgagggtttttattatcgggagatttttatatagattaaatttgtgcggtatatatcgagtcggggngtagcgcgtcgtcgttttgatcggattttgagtggcgtttaaaggggattttttcgcggttggtagcgtgttattaatttgcgttggagtttcgattattttatttagggtgaaattattaatattacgatgttgttttattttggggtgatgattagtcgtacgcgttttcgtggtggtttgatgttaatttggggcgattcgtaacgttattttatcgattattttaatacggtttggggtttagatgtcgattttttcgttttttaggcgtagaacgtttggattcgtatattgtacgatcgttatcgttttgttatacgcggtacgttgggttggattgaaatcggtgatttcgataaagtatcgtcggatttgcgttttttcgtcgggggcgatcgtagtattcgtggttataaatataaatttatcgtttcgaaatacgttaacggtgatttgaaaggggtttcgaagttgataatcggatcgttgga

SEQ ID NO: 6054 - DNA, 1342 bp, Artificial Sequence
  chemically treated genomic DNA (Homo sapiens) CpG-island No: 6054
  misc_feature (495)..(495): n is either a, c, g or t
tccaacgatccgattatcaacttcgaaacccctttcaaatcaccgttaacgtatttcgaaacgataaatttatatttataaccacgaatactacgatcgcccccgacgaaaaaacgcaaatccgacgatactttatcgaaatcaccgatttcaatccaacccaacgtaccgcgtataacaaaacgataacgatcgtacaatatacgaatccaaacgttctacgcctaaaaaacgaaaaaatcgacatctaaaccccaaaccgtattaaaataatcgataaaataacgttacgaatcgccccaaattaacatcaaaccaccacgaaaacgcgtacgactaatcatcaccccaaaataaaacaacatcgtaatattaataatttcaccctaaataaaataatcgaaactccaacgcaaattaataacacgctaccaaccgcgaaaaaatcccctttaaacgccactcaaaatccgatcaaaacgacgacgcgctacnccccgactcgatatataccgcacaaatttaatctatataaaaatctcccgataataaaaaccctcaatctatacgcgaatttacgcaacgtcaccgacgaaacacgtaaacaaacttttactcgcctactaaaatttacgtctcttaaaccgtttaccgaaacgcctaacgaacaaactctccgataaaataaaacaaaaactcgatctaacctataccctaataaacgaaccgaaaatattactactcgataaacccgacgtcgacgttaaccctatctcacgacgcgaactataacaaataatacataaactaacgaacgaaaaaatattaatcctctaaaatacctcgtatctcgacgaaaccgaacaataccgtaacgtattactaataaacgaaaacgaattactatatcaaaaaaaaccaaaaaccctaacacaaaccataaccgaacgcaactttctaataaccaatccacacgaaaacaaccgcaaactattacaacgcgccttaaaactaccgcaaatcaacgacgacataattcaaaaaaaatcgatacgtctaatcctcaaaaaaaaaaccacacaaacgatcttaaccgaaacgataacaaactaaaccattaacacgaacaatacgatttaataaactcgatcccctcccctaacgaacgatcaataacgcataatacgcaactacgacgctaataaatcgtacccatcaaccctactataacaaatcgccccacgaatcttaacgctattaccaacaaatcgcccgtaacgtcaccctaccgataatcctatacaactttccgaatctaacgaatcaaaacttaaccccgaaa

SEQ ID NO: 6055 - DNA, 1342 bp, Artificial Sequence
  chemically treated genomic DNA (Homo sapiens) CpG-island No: 6055
  misc_feature (495)..(495): n is either a, c, g or t
tttagcgattcggttattaatttcgaggttttttttaggttatcgttggcgtatttcggagcgatagatttgtatttgtagttacgaatattgcggtcgttttcggcgaagaaacgtagattcggcggtattttgtcgaaattatcggttttaatttagtttagcgtgtcgcgtgtaataaaacgatggcgatcgtatagtgtgcggatttagacgttttgcgtttggaaaacggagaaatcgatatttgaattttaggtcgtgttggagtagtcgatagagtagcgttgcgagtcgttttaggttggtattaggttattacgagaacgcgtgcggttaattattattttaggataaaatagtatcgtggtattggtaattttattttgagtaaagtggtcgagattttagcgtaggttaatggtacgttgttagtcgcggagaggttttttttgagcgttatttaagattcgattaaaacgacggcgcgttgtntttcggttcggtatatgtcgtataaatttggtttgtatgaagatttttcggtgatggagatttttaatttgtacgcggatttgcgtagcgttatcggcgaggtacgtaagtaaatttttgttcgtttgttggagtttacgttttttgggtcgtttatcgggacgtttggcgggtaagtttttcggtgggatgaaataaaaattcggtttggtttgtattttggtgggcgaatcgaaagtgttgttgttcgatgaattcggcgtcggcgttgattttattttacggcgcgaattgtggtagatggtgtatgagttggcgggcgaagggatgttaattttttggagtatttcgtatttcgacgaagtcgagtagtgtcgtgacgtgttattgatgaacgaaggcgagttgttgtattagggagaattaaaagttttgatataaattatggtcggacgtagttttttgatgattagtttatacgagggtaatcgtaaattgttgtaacgcgttttgaaattgtcgtaggttagcgacggtatgatttaggggaaatcggtacgtttgatttttaaaaaagaggttatatagacgattttagtcgaggcgatgataaattgaattattggtacgggtagtgcggtttaataggttcggtttttttttttggcgagcggttaatggcgtatgatgcgtagttacggcgttgatggatcgtatttattaattttattatagtaagtcgttttacgaattttgacgttattattagtagatcgttcgtagcgttattttatcggtgattttgtataatttttcggatttgacgggttaggatttaatttcggaa

SEQ ID NO: 6056 - DNA, 1342 bp, Artificial Sequence
  chemically treated genomic DNA (Homo sapiens) CpG-island No: 6056
  misc_feature (848)..(848): n is either a, c, g or t
ttccgaaattaaatcctaacccgtcaaatccgaaaaattatacaaaatcaccgataaaataacgctacgaacgatctactaataataacgtcaaaattcgtaaaacgacttactataataaaattaataaatacgatccatcaacgccgtaactacgcatcatacgccattaaccgctcgccaaaaaaaaaaaccgaacctattaaaccgcactacccgtaccaataattcaatttatcatcgcctcgactaaaatcgtctatataacctcttttttaaaaatcaaacgtaccgatttcccctaaatcataccgtcgctaacctacgacaatttcaaaacgcgttacaacaatttacgattaccctcgtataaactaatcatcaaaaaactacgtccgaccataatttatatcaaaacttttaattctccctaatacaacaactcgccttcgttcatcaataacacgtcacgacactactcgacttcgtcgaaatacgaaatactccaaaaaattaacatcccttcgcccgccaactcatacaccatctaccacaattcgcgccgtaaaataaaatcaacgccgacgccgaattcatcgaacaacaacactttcgattcgcccaccaaaatacaaaccaaaccgaatttttatttcatcccaccgaaaaacttacccgccaaacgtcccgataaacgacccaaaaaacgtaaactccaacaaacgaacaaaaatttacttacgtacctcgccgataacgctacgcaaatccgcgtacaaattaaaaatctccatcaccgaaaaatcttcatacaaaccaaatttatacgacatataccgaaccgaaanacaacgcgccgtcgttttaatcgaatcttaaataacgctcaaaaaaaacctctccgcgactaacaacgtaccattaacctacgctaaaatctcgaccactttactcaaaataaaattaccaataccacgatactattttatcctaaaataataattaaccgcacgcgttctcgtaataacctaataccaacctaaaacgactcgcaacgctactctatcgactactccaacacgacctaaaattcaaatatcgatttctccgttttccaaacgcaaaacgtctaaatccgcacactatacgatcgccatcgttttattacacgcgacacgctaaactaaattaaaaccgataatttcgacaaaataccgccgaatctacgtttcttcgccgaaaacgaccgcaatattcgtaactacaaatacaaatctatcgctccgaaatacgccaacgataacctaaaaaaaacctcgaaattaataaccgaatcgctaaa

SEQ ID NO: 6057 - DNA, 671 bp, Artificial Sequence
  chemically treated genomic DNA (Homo sapiens) CpG-island No: 6057
ttcgtcgtcgttgttattaatttagtaatcggtaggtaggtttagaagtttaagtcgtaatagtgattgagtagcgtaaaagtgtaagcgtcgatggcgtaaaaatcgtcgtattttagtattagtagattagaaagattaataattacgtttagttcgagatcgaggataatgtagattatggttagggtggtaatatttatcgtttcgcgtgaaattataaacggttacgttatcgtaagtattaatagcgttacgaggaatagtttttgttttatcgtggagttattaatggcgggtagaataaatttcggttcggaaacgttttttaattttttttggaaagtcggtcgtaaaagttggaagaaaaagattatcgtcgtgtcgataaatatttattgttaacggatattcgaagtcgtgtcgattattagtttggtgttatttagttttagttgtacgtttataaagacgttcgttagtataaagaatatcgcggtagagagtagcgttattgtaatatgtatcggttttatattttttttatttgcgggcgatttagaatatcggtcggtattattagtagtattagaattagtagggcgaatgagatatatttttatattcgatttagatagtagaagaaacgtttcgtaaattttagattaggt

SEQ ID NO: 6058 - DNA, 671 bp, Artificial Sequence
  chemically treated genomic DNA (Homo sapiens) CpG-island No: 6058
acctaatctaaaatttacgaaacgtttcttctactatctaaatcgaatataaaaatatatctcattcgccctactaattctaatactactaataataccgaccgatattctaaatcgcccgcaaataaaaaaaatataaaaccgatacatattacaataacgctactctctaccgcgatattctttatactaacgaacgtctttataaacgtacaactaaaactaaataacaccaaactaataatcgacacgacttcgaatatccgttaacaataaatatttatcgacacgacgataatctttttcttccaacttttacgaccgactttccaaaaaaaattaaaaaacgtttccgaaccgaaatttattctacccgccattaataactccacgataaaacaaaaactattcctcgtaacgctattaatacttacgataacgtaaccgtttataatttcacgcgaaacgataaatattaccaccctaaccataatctacattatcctcgatctcgaactaaacgtaattattaatctttctaatctactaatactaaaatacgacgatttttacgccatcgacgcttacacttttacgctactcaatcactattacgacttaaacttctaaacctacctaccgattactaaattaataacaacgacgacgaa

SEQ ID NO: 6059 - DNA, 671 bp, Artificial Sequence
  chemically treated genomic DNA (Homo sapiens) CpG-island No: 6059
gtttgatttgggatttgcgaggcgttttttttgttatttgagtcgaatataaagatgtgttttattcgttttgttgattttggtgttgttggtgatgtcgatcggtattttgggtcgttcgtaggtagagaaagtatgaaatcgatgtatattgtaatggcgttgttttttgtcgcgatgttttttgtgttggcgggcgtttttatgggcgtgtaattggagttggatggtattaaattggtggtcgatacggtttcggatgttcgttggtagtgggtgtttatcggtacggcggtggttttttttttttagtttttgcgatcggttttttagaaagggttgaaaagcgttttcggatcgaagtttattttgttcgttattgatggttttacggtgaagtagaaattgtttttcgtggcgttgttggtgtttgcggtggcgtggtcgtttatggttttacgcgggacggtggatattgttattttgattatgatttatattattttcggtttcgggttgaacgtggttgttggtttttttggtttgttggtgttggggtacggcggtttttacgttatcggcgtttatatttttgcgttgtttaattattattacggtttgggtttttggatttgtttgtcgattgttggattaatggtagcggcggcggg

SEQ ID NO: 6060 - DNA, 671 bp, Artificial Sequence
  chemically treated genomic DNA (Homo sapiens) CpG-island No: 6060
cccgccgccgctaccattaatccaacaatcgacaaacaaatccaaaaacccaaaccgtaataataattaaacaacgcaaaaatataaacgccgataacgtaaaaaccgccgtaccccaacaccaacaaaccaaaaaaaccaacaaccacgttcaacccgaaaccgaaaataatataaatcataatcaaaataacaatatccaccgtcccgcgtaaaaccataaacgaccacgccaccgcaaacaccaacaacgccacgaaaaacaatttctacttcaccgtaaaaccatcaataacgaacaaaataaacttcgatccgaaaacgcttttcaaccctttctaaaaaaccgatcgcaaaaactaaaaaaaaaaaaccaccgccgtaccgataaacacccactaccaacgaacatccgaaaccgtatcgaccaccaatttaataccatccaactccaattacacgcccataaaaacgcccgccaacacaaaaaacatcgcgacaaaaaacaacgccattacaatatacatcgatttcatactttctctacctacgaacgacccaaaataccgatcgacatcaccaacaacaccaaaatcaacaaaacgaataaaacacatctttatattcgactcaaataacaaaaaaaacgcctcgcaaatcccaaatcaaac

SEQ ID NO: 6061 - DNA, 534 bp, Artificial Sequence
  chemically treated genomic DNA (Homo sapiens) CpG-island No: 6061
gtcgatcgtgagtttcgtagcgatttttattatcgtttgaacgtattttcgatttatttgtcgttattacgcgagcgttcggaagatatttcgttgttggcgaaagtttttatttttaaaattgttcgtcgtttggggcgtaatatcgatagtatttttgtcgagacgttgcgtattttgagtaatatggagtggtcgggtaacgtacgcgaattggaaaacgttattgagcgcgcggtattgttaatacgcggtaacgtgttgtagttgttattgttagatattgttttatcggaatttgaaacgtcgtttgtcgtaacggttgtcgttttggagggcgaagatgaatattaggtgattgtgcgcgtgttgaaagaaattaacggcgtggttgtcgggtttaaaggcgttgcgtaacgtttggggttgaaacgtacgattttgttgttacggatgaagcggttggaattgataaatcggtattgatttaattgtaaattggtcggatagatttgtttgttcggtagtatttat

SEQ ID NO: 6062 - DNA, 534 bp, Artificial Sequence
  chemically treated genomic DNA (Homo sapiens) CpG-island No: 6062
ataaatactaccgaacaaacaaatctatccgaccaatttacaattaaatcaataccgatttatcaattccaaccgcttcatccgtaacaacaaaatcgtacgtttcaaccccaaacgttacgcaacgcctttaaacccgacaaccacgccgttaatttctttcaacacgcgcacaatcacctaatattcatcttcgccctccaaaacgacaaccgttacgacaaacgacgtttcaaattccgataaaacaatatctaacaataacaactacaacacgttaccgcgtattaacaataccgcgcgctcaataacgttttccaattcgcgtacgttacccgaccactccatattactcaaaatacgcaacgtctcgacaaaaatactatcgatattacgccccaaacgacgaacaattttaaaaataaaaactttcgccaacaacgaaatatcttccgaacgctcgcgtaataacgacaaataaatcgaaaatacgttcaaacgataataaaaatcgctacgaaactcacgatcgac

SEQ ID NO: 6063 - DNA, 534 bp, Artificial Sequence
  chemically treated genomic DNA (Homo sapiens) CpG-island No: 6063
ataggtattgtcggataggtagatttgttcggttaatttgtagttaaattaatgtcgatttattaattttagtcgttttattcgtgatagtagggtcgtgcgttttagttttagacgttgcgtagcgtttttaggttcggtaattacgtcgttggttttttttagtacgcgtataattatttgatatttattttcgttttttagggcgataatcgttgcggtaggcggcgttttaggtttcggtaaaataatatttggtaatgatagttgtagtacgttatcgcgtgttagtaatatcgcgcgtttaatgacgttttttagttcgcgtacgttattcggttattttatgttgtttaaggtgcgtagcgtttcggtaggaatgttgtcgatattgcgttttagacgacgggtaattttgaaggtaaaggttttcgttagtagcggaatatttttcggacgttcgcgtagtggcggtaggtgaatcgggaatacgtttaggcggtaatagagatcgttacggaatttacggtcggt

SEQ ID NO: 6064 - DNA, 534 bp, Artificial Sequence
  chemically treated genomic DNA (Homo sapiens) CpG-island No: 6064
accgaccgtaaattccgtaacgatctctattaccgcctaaacgtattcccgattcacctaccgccactacgcgaacgtccgaaaaatattccgctactaacgaaaacctttaccttcaaaattacccgtcgtctaaaacgcaatatcgacaacattcctaccgaaacgctacgcaccttaaacaacataaaataaccgaataacgtacgcgaactaaaaaacgtcattaaacgcgcgatattactaacacgcgataacgtactacaactatcattaccaaatattattttaccgaaacctaaaacgccgcctaccgcaacgattatcgccctaaaaaacgaaaataaatatcaaataattatacgcgtactaaaaaaaaccaacgacgtaattaccgaacctaaaaacgctacgcaacgtctaaaactaaaacgcacgaccctactatcacgaataaaacgactaaaattaataaatcgacattaatttaactacaaattaaccgaacaaatctacctatccgacaatacctat

SEQ ID NO: 6065 - DNA, 673 bp, Artificial Sequence
  chemically treated genomic DNA (Homo sapiens) CpG-island No: 6065
ttagtatcgatcgtttggcggcgtataaagacgttgatgtgttttgttttgattacgataatagtaaagatatggatgcgttaatggtaacgtcgttgtggtaggttatgtcgtttgttcgcgtcggacgtttttagcgcgtatttgtagtttggttttatggtgcgacgttttcggtaatgtattttgtgcgcgttttggataacgttatcggaggtaaagcgtgagtaaacgaattgcgtttttttcggcgttattgttggcgttgttagtgattgtcgttacggcgtttatttggatgaatttttcgtaggcgttgtcgcgtagttagtgggcgtaggttgtttggtcgtcggatattgacgttatcgagtagatgattttttattatagtttgttgtcgcgtttggcgatttcgttgttggtgggcgcgggtttggggttggtgggcgtgttgttttagtaagtgttgggtaatttgttggcggagtcgacgacgtttggcgttgttataggcgcgtaattgggttgaagttgttttaaattttcgagtttagttgcgcgtttttacgtattataaagtgggtgaaaacgatcgttttttgattcgttttagggagtttataaaaataggttatcggtatatgtattttatagtttacgtcgtttattt

SEQ ID NO: 6066 - DNA, 673 bp, Artificial Sequence
  chemically treated genomic DNA (Homo sapiens) CpG-island No: 6066
aaataaacgacgtaaactataaaatacatataccgataacctatttttataaactccctaaaacgaatcaaaaaacgatcgttttcacccactttataatacgtaaaaacgcgcaactaaactcgaaaatttaaaacaacttcaacccaattacgcgcctataacaacgccaaacgtcgtcgactccgccaacaaattacccaacacttactaaaacaacacgcccaccaaccccaaacccgcgcccaccaacaacgaaatcgccaaacgcgacaacaaactataataaaaaatcatctactcgataacgtcaatatccgacgaccaaacaacctacgcccactaactacgcgacaacgcctacgaaaaattcatccaaataaacgccgtaacgacaatcactaacaacgccaacaataacgccgaaaaaaacgcaattcgtttactcacgctttacctccgataacgttatccaaaacgcgcacaaaatacattaccgaaaacgtcgcaccataaaaccaaactacaaatacgcgctaaaaacgtccgacgcgaacaaacgacataacctaccacaacgacgttaccattaacgcatccatatctttactattatcgtaatcaaaacaaaacacatcaacgtctttatacgccgccaaacgatcgatactaa

SEQ ID NO: 6067 - DNA, 673 bp, Artificial Sequence
  chemically treated genomic DNA (Homo sapiens) CpG-island No: 6067
aagtgggcggcgtaggttatgaagtgtatatgtcgatgatttgtttttatgaattttttgaagcgggttaggaagcgatcgtttttatttattttgtggtgcgtgaagacgcgtaattaagttcggaagtttgagatagttttaatttagttgcgcgtttgtagtaacgttaagcgtcgtcggtttcgttagtaggttatttagtatttgttgaaatagtacgtttattagttttagattcgcgtttattagtagcgaaatcgttagacgcggtaataagttgtagtgaaaaattatttgttcgatgacgttaatattcggcgattaggtagtttgcgtttattggttacgcggtagcgtttgcgagaagtttatttaggtgagcgtcgtagcgataattattaatagcgttagtaataacgtcgggaaaagcgtaattcgtttatttacgttttattttcgatggcgttatttagaacgcgtataaagtgtattgtcgagagcgtcgtattataaaattagattgtaggtacgcgttgaaagcgttcggcgcggataaacggtatggtttgttatagcggcgttgttattagcgtatttatgtttttgttgttgtcgtgattaaaatagagtatattaacgtttttatacgtcgttagacgatcgatattga

SEQ ID NO: 6068 - DNA, 673 bp, Artificial Sequence
  chemically treated genomic DNA (Homo sapiens) CpG-island No: 6068
tcaatatcgatcgtctaacgacgtataaaaacgttaatatactctattttaatcacgacaacaacaaaaacataaatacgctaataacaacgccgctataacaaaccataccgtttatccgcgccgaacgctttcaacgcgtacctacaatctaattttataatacgacgctctcgacaatacactttatacgcgttctaaataacgccatcgaaaataaaacgtaaataaacgaattacgcttttcccgacgttattactaacgctattaataattatcgctacgacgctcacctaaataaacttctcgcaaacgctaccgcgtaaccaataaacgcaaactacctaatcgccgaatattaacgtcatcgaacaaataatttttcactacaacttattaccgcgtctaacgatttcgctactaataaacgcgaatctaaaactaataaacgtactatttcaacaaatactaaataacctactaacgaaaccgacgacgcttaacgttactacaaacgcgcaactaaattaaaactatctcaaacttccgaacttaattacgcgtcttcacgcaccacaaaataaataaaaacgatcgcttcctaacccgcttcaaaaaattcataaaaacaaatcatcgacatatacacttcataacctacgccgcccactt

SEQ ID NO: 6069 - DNA, 696 bp, Artificial Sequence
  chemically treated genomic DNA (Homo sapiens) CpG-island No: 6069
cgacggttatcgtttggcggtttgtttaatgttaattggttaatttttgttaagttattcggtgatcgtatcgcgtaaaggcgtgattgaattgatgcgtatgttcgacggcggcgataattcgttgcgcgtatagattggtagtaataatattcgcgtttacgttggcgattttatttttatttttaaattggtggatggtcgtttttcggattatcgtcgcgttttgtcgaagaattcggataaatatttggaagttggttgcgatttgtttaagtaggcgtttgttcgcgcggcgattttttttaacgagaaatttcgcggcgtacgtttttatgttagcgaaaattagttgaaaattatcgttaataattcggaataggaagaagcggaagagattttcgacgttatttatagcggtgcggagatggaaatcggttttaacgttagttatgtgttggatgttttgaacgcgttgaaatgcgaaaacgttcgtatgatgttgatcggatcgggttttagcgtgttaaatggagatgcgggttgttagagcgcggtttatggtggtatgtttatgagattggaaggttttttatcgtttggtaatttcgaattttaaaagatattatcgttttgtgttttgtatatcgttttgtgttttaaagttaggtattatataggacgatatttcggatt

SEQ ID NO: 6070 - DNA, 696 bp, Artificial Sequence
  chemically treated genomic DNA (Homo sapiens) CpG-island No: 6070
aatccgaaatatcgtcctatataatacctaactttaaaacacaaaacgatatacaaaacacaaaacgataatatcttttaaaattcgaaattaccaaacgataaaaaaccttccaatctcataaacataccaccataaaccgcgctctaacaacccgcatctccatttaacacgctaaaacccgatccgatcaacatcatacgaacgttttcgcatttcaacgcgttcaaaacatccaacacataactaacgttaaaaccgatttccatctccgcaccgctataaataacgtcgaaaatctcttccgcttcttcctattccgaattattaacgataattttcaactaattttcgctaacataaaaacgtacgccgcgaaatttctcgttaaaaaaaatcgccgcgcgaacaaacgcctacttaaacaaatcgcaaccaacttccaaatatttatccgaattcttcgacaaaacgcgacgataatccgaaaaacgaccatccaccaatttaaaaataaaaataaaatcgccaacgtaaacgcgaatattattactaccaatctatacgcgcaacgaattatcgccgccgtcgaacatacgcatcaattcaatcacgcctttacgcgatacgatcaccgaataacttaacaaaaattaaccaattaacattaaacaaaccgccaaacgataaccgtcg

SEQ ID NO: 6071 - DNA, 696 bp, Artificial Sequence
  chemically treated genomic DNA (Homo sapiens) CpG-island No: 6071
agttcgagatatcgttttgtgtggtgtttggttttagagtatagggcgatatatagagtatagggcgatgatattttttggaattcgggattattaagcggtggagaattttttagttttatgggtatgttattataagtcgcgttttggtagttcgtatttttatttggtacgttggaattcgattcggttagtattatgcggacgttttcgtattttagcgcgtttagaatatttagtatataattgacgttgaagtcgatttttattttcgtatcgttataggtaacgtcgaggatttttttcgtttttttttgtttcgggttgttggcggtgatttttagttggttttcgttgatataaagacgtacgtcgcggaatttttcgttagagagaatcgtcgcgcgagtaaacgtttgtttgagtagatcgtagttagtttttagatgtttgttcgggtttttcggtagaacgcggcgataattcgggaagcgattatttattagtttggaggtgaagataaagtcgttaacgtgggcgcgaatgttgttgttgttaatttgtacgcgtagcggattgtcgtcgtcgtcgagtatacgtattagtttaattacgtttttacgcggtacgattatcgaatggtttggtaaagattgattaattggtattgaatagatcgttagacggtggtcgtcg

SEQ ID NO: 6072 - DNA, 696 bp, Artificial Sequence
  chemically treated genomic DNA (Homo sapiens) CpG-island No: 6072
cgacgaccaccgtctaacgatctattcaataccaattaatcaatctttaccaaaccattcgataatcgtaccgcgtaaaaacgtaattaaactaatacgtatactcgacgacgacgacaatccgctacgcgtacaaattaacaacaacaacattcgcgcccacgttaacgactttatcttcacctccaaactaataaataatcgcttcccgaattatcgccgcgttctaccgaaaaacccgaacaaacatctaaaaactaactacgatctactcaaacaaacgtttactcgcgcgacgattctctctaacgaaaaattccgcgacgtacgtctttatatcaacgaaaaccaactaaaaatcaccgccaacaacccgaaacaaaaaaaaacgaaaaaaatcctcgacgttacctataacgatacgaaaataaaaatcgacttcaacgtcaattatatactaaatattctaaacgcgctaaaatacgaaaacgtccgcataatactaaccgaatcgaattccaacgtaccaaataaaaatacgaactaccaaaacgcgacttataataacatacccataaaactaaaaaattctccaccgcttaataatcccgaattccaaaaaatatcatcgccctatactctatatatcgccctatactctaaaaccaaacaccacacaaaacgatatctcgaact

SEQ ID NO: 6073 - DNA, 578 bp, Artificial Sequence
  chemically treated genomic DNA (Homo sapiens) CpG-island No: 6073
aaacgtacggcgcggtttaacggcgtcgtttattagcgtggtgaataattggtcggtagtaatcgtatttttaacggtaacgcgtagtatacgacgatttttcgggtttatagtggttttttatagttgtttcgggtttatttcgtttagatttttataacgttggatggagaggtcgcgacgggatttttttattagttagtttagcgtttgttcgaagttggttatcggttgacgacgttcgttacgttcgataaacgtatttttttttagtaagttacgtagttttttatttagcgtgtagatacgacgatattcgttatcggtgataaattcgtgatttagcggatagttagtatttatatcgtgggtacgtacgcgaataatcggttcgaataggttttgtttagtattggtgtgaatattaaatttttattggttgtcgtgttgttttttgtcggttagttcgttgattagcgcgtttatttagcgggtaatcgtttgtttattagaaagttaattttcgttaattcggttgatagatagtttttttagtatgttttcggatacgacgtttt

SEQ ID NO: 6074 - DNA, 578 bp, Artificial Sequence
  chemically treated genomic DNA (Homo sapiens) CpG-island No: 6074
aaaacgtcgtatccgaaaacatactaaaaaaactatctatcaaccgaattaacgaaaattaactttctaataaacaaacgattacccgctaaataaacgcgctaatcaacgaactaaccgacaaaaaacaacacgacaaccaataaaaatttaatattcacaccaatactaaacaaaacctattcgaaccgattattcgcgtacgtacccacgatataaatactaactatccgctaaatcacgaatttatcaccgataacgaatatcgtcgtatctacacgctaaataaaaaactacgtaacttactaaaaaaaaatacgtttatcgaacgtaacgaacgtcgtcaaccgataaccaacttcgaacaaacgctaaactaactaataaaaaaatcccgtcgcgacctctccatccaacgttataaaaatctaaacgaaataaacccgaaacaactataaaaaaccactataaacccgaaaaatcgtcgtatactacgcgttaccgttaaaaatacgattactaccgaccaattattcaccacgctaataaacgacgccgttaaaccgcgccgtacgttt

SEQ ID NO: 6075 - DNA, 578 bp, Artificial Sequence
  chemically treated genomic DNA (Homo sapiens) CpG-island No: 6075
gaagcgtcgtattcgaaagtatgttgaaagagttatttattagtcgagttgacgaaagttgattttttgatgagtagacggttattcgttgggtggacgcgttggttagcgaattgatcgataaagaatagtacggtagttagtggaagtttgatgtttatattaatgttgagtaaaatttgttcgagtcgattgttcgcgtgcgtatttacggtgtggatattgattattcgttggattacgagtttattatcggtggcgaatatcgtcgtatttgtacgttgggtgagaaattgcgtggtttgttggaagaagatgcgtttatcgaacgtggcgagcgtcgttagtcggtagttagtttcgagtaggcgttggattggttggtgaaagagtttcgtcgcggtttttttatttagcgttataaaggtttgggcgagatgaattcggaatagttgtgggaaattattatggattcggaaagtcgtcgtatgttgcgcgttatcgttaaagatgcgattgttgtcgattagttgtttattacgttgatgggcgacgtcgttgaatcgcgtcgtgcgttt

SEQ ID NO: 6076 - DNA, 578 bp, Artificial Sequence
  chemically treated genomic DNA (Homo sapiens) CpG-island No: 6076
aaacgcacgacgcgattcaacgacgtcgcccatcaacgtaataaacaactaatcgacaacaatcgcatctttaacgataacgcgcaacatacgacgactttccgaatccataataatttcccacaactattccgaattcatctcgcccaaacctttataacgctaaataaaaaaaccgcgacgaaactctttcaccaaccaatccaacgcctactcgaaactaactaccgactaacgacgctcgccacgttcgataaacgcatcttcttccaacaaaccacgcaatttctcacccaacgtacaaatacgacgatattcgccaccgataataaactcgtaatccaacgaataatcaatatccacaccgtaaatacgcacgcgaacaatcgactcgaacaaattttactcaacattaatataaacatcaaacttccactaactaccgtactattctttatcgatcaattcgctaaccaacgcgtccacccaacgaataaccgtctactcatcaaaaaatcaactttcgtcaactcgactaataaataactctttcaacatactttcgaatacgacgcttc

SEQ ID NO: 6077 - DNA, 527 bp, Artificial Sequence
  chemically treated genomic DNA (Homo sapiens) CpG-island No: 6077
  misc_feature (5)..(5): n is either a, c, g or t
  misc_feature (11)..(11): n is either a, c, g or t
atcgncgtcgncgttcgtcgtttcggtttttttatcgttatcgtcgtcgattacgtgttggtcgtcggcgttgttatttttgagtcgtttatgggttcggtcgtttttattgtcgtcgtcgtagtagcggatagcggcgatttcgtcgatcgtcggcggtatttttacgatagttttcgatcgtttgcgttgttcgttcggttgttgtttttgttttagtcgtcgacgtcgttttttcgttcggggtagtagttttcgcgatatggcggtgtaaaattcgttttttttcgttttttattgggggagggatacgttcgttattcgtcgtttttattcgatagggggagttattggtttcgtcgcggggggagggtaagtcgttatatattttgcgcgtttattggatattgtttacgtcgttttgtaagagggttcgtttttggttgtttgagatattttttataggtggtcgttttttgttagttttttcgtcgatttcgttattttaaaataaaatttaatttgat

SEQ ID NO: 6078 - DNA, 527 bp, Artificial Sequence
  chemically treated genomic DNA (Homo sapiens) CpG-island No: 6078
  misc_feature (517)..(517): n is either a, c, g or t
  misc_feature (523)..(523): n is either a, c, g or t
atcaaattaaattttattttaaaataacgaaatcgacgaaaaaactaacaaaaaacgaccacctataaaaaatatctcaaacaaccaaaaacgaaccctcttacaaaacgacgtaaacaatatccaataaacgcgcaaaatatataacgacttaccctccccccgcgacgaaaccaataactccccctatcgaataaaaacgacgaataacgaacgtatccctcccccaataaaaaacgaaaaaaaacgaattttacaccgccatatcgcgaaaactactaccccgaacgaaaaaacgacgtcgacgactaaaacaaaaacaacaaccgaacgaacaacgcaaacgatcgaaaactatcgtaaaaataccgccgacgatcgacgaaatcgccgctatccgctactacgacgacgacaataaaaacgaccgaacccataaacgactcaaaaataacaacgccgacgaccaacacgtaatcgacgacgataacgataaaaaaaccgaaacgacgaacgncgacgncgat

SEQ ID NO: 6079 - DNA, 527 bp, Artificial Sequence
  chemically treated genomic DNA (Homo sapiens) CpG-island No: 6079
  misc_feature (517)..(517): n is either a, c, g or t
  misc_feature (523)..(523): n is either a, c, g or t
attaaattggattttattttaaggtggcggggtcgacggaaagattggtagaaagcgattatttataaggagtgttttagataattaagggcgggtttttttgtagaacggcgtgggtaatgtttaataagcgcgtaaggtgtgtggcggtttatttttttttcgcggcgggattagtggttttttttatcgggtgggggcggcgggtgacgggcgtgttttttttttaatgagagacggggggaggcgggttttgtatcgttatgtcgcggaggttgttgtttcgggcggagaagcggcgtcggcggttggagtagaggtagtagtcggacgagtagcgtaggcggtcgggagttatcgtgaagatgtcgtcggcggtcggcggagtcgtcgttgttcgttattacggcggcggtagtgagggcggtcgggtttataagcggtttaagaatgataacgtcggcgattagtacgtagtcggcgacggtggcggtgaagaagtcgggacggcgggcgncggcgncggt

SEQ ID NO: 6080 - DNA, 527 bp, Artificial Sequence
  chemically treated genomic DNA (Homo sapiens) CpG-island No: 6080
  misc_feature (5)..(5): n is either a, c, g or t
  misc_feature (11)..(11): n is either a, c, g or t
accgncgccgncgcccgccgtcccgacttcttcaccgccaccgtcgccgactacgtactaatcgccgacgttatcattcttaaaccgcttataaacccgaccgccctcactaccgccgccgtaataacgaacaacgacgactccgccgaccgccgacgacatcttcacgataactcccgaccgcctacgctactcgtccgactactacctctactccaaccgccgacgccgcttctccgcccgaaacaacaacctccgcgacataacgatacaaaacccgcctccccccgtctctcattaaaaaaaaaacacgcccgtcacccgccgcccccacccgataaaaaaaaccactaatcccgccgcgaaaaaaaaataaaccgccacacaccttacgcgcttattaaacattacccacgccgttctacaaaaaaacccgcccttaattatctaaaacactccttataaataatcgctttctaccaatctttccgtcgaccccgccaccttaaaataaaatccaatttaat

SEQ ID NO: 6081 - DNA, 1021 bp, Artificial Sequence
  chemically treated genomic DNA (Homo sapiens) CpG-island No: 6081
taagttggcgcgttatttagacgttagttttttatttttcggacgtttcgttttaggagtaaaattttagtgattttgggttcgttttcgtgagagtggagggcggtcgatgagggcggttttgaagggaataagattaatgagacgagttcggggcggggcgcggggtcggagggtggggcgggtggcggcggtggtagttcgaggtttggtttcgcgtagtatatgatagtacgttagtagcgggatggttttagtagtggcggcggttgtagaagtttaagtagtcgcggtcgtagtggaggttagagtcgaagcggcggcggcggcggtatttcggggagtttaagatggcggcgggggggatagggggtttgcgggaggagtagcgttatgggttgtcgtgcggacggttggggtaggataatattatcgtattgtatgtgaagtttatcgagacggcgattcgggcgttcgagatttattagagttataaggtgagcgggtcggtcggtaggttgggtttagagaggtagagcgtattttttacggtttggtcgcgttcgggtgcggggtcggcggagtcgtggttggtagttgttatcgttagcgttcgtagcggttaggtagggtagggtcgggtagggtggttgacgtcgcgttttcgggttagtttgggcgttggggaagcgggtagtcgggcggtttttggcggcggggtcgaggtagtcgtagttttgggtcggttgcgttgtcgttgcgggatttttcgatagttttcgaggaatttttggtttgttgggttttaagagggagagaggttcgataagagaagtgagatgattacgttattttcggcggggaaggagggtagcgagtagcgtatgggtaaggaattagggacgattcgcgggtattagttgttcgcgttttttagttatataggtacggtggatttttagagataggatataggcgtttcgcgtgtgggggtgggattttgtatttttagggatttggg

SEQ ID NO: 6082 - DNA, 1021 bp, Artificial Sequence
  chemically treated genomic DNA (Homo sapiens) CpG-island No: 6082
cccaaatccctaaaaatacaaaatcccacccccacacgcgaaacgcctatatcctatctctaaaaatccaccgtacctatataactaaaaaacgcgaacaactaatacccgcgaatcgtccctaattccttacccatacgctactcgctaccctccttccccgccgaaaataacgtaatcatctcacttctcttatcgaacctctctccctcttaaaacccaacaaaccaaaaattcctcgaaaactatcgaaaaatcccgcaacgacaacgcaaccgacccaaaactacgactacctcgaccccgccgccaaaaaccgcccgactacccgcttccccaacgcccaaactaacccgaaaacgcgacgtcaaccaccctacccgaccctaccctacctaaccgctacgaacgctaacgataacaactaccaaccacgactccgccgaccccgcacccgaacgcgaccaaaccgtaaaaaatacgctctacctctctaaacccaacctaccgaccgacccgctcaccttataactctaataaatctcgaacgcccgaatcgccgtctcgataaacttcacatacaatacgataatattatcctaccccaaccgtccgcacgacaacccataacgctactcctcccgcaaaccccctatcccccccgccgccatcttaaactccccgaaataccgccgccgccgccgcttcgactctaacctccactacgaccgcgactacttaaacttctacaaccgccgccactactaaaaccatcccgctactaacgtactatcatatactacgcgaaaccaaacctcgaactaccaccgccgccacccgccccaccctccgaccccgcgccccgccccgaactcgtctcattaatcttattcccttcaaaaccgccctcatcgaccgccctccactctcacgaaaacgaacccaaaatcactaaaattttactcctaaaacgaaacgtccgaaaaataaaaaactaacgtctaaataacgcgccaactta

SEQ ID NO: 6083 - DNA, 1021 bp, Artificial Sequence
  chemically treated genomic DNA (Homo sapiens) CpG-island No: 6083
tttaagtttttgggaatataaggttttatttttatacgcggagcgtttgtgttttgtttttgaggatttatcgtgtttatgtaattggaaaacgcgggtagttggtgttcgcgagtcgtttttggttttttgtttatacgttgttcgttatttttttttttcgtcgagggtagcgtggttattttattttttttatcgggttttttttttttttgggatttaataagttaggaatttttcgggggttgtcggaaagtttcgtagcggtagcgtagtcgatttagggttgcggttgtttcggtttcgtcgttaggggtcgttcgattgttcgtttttttaacgtttaggttagttcgggagcgcggcgttagttattttgttcggttttgttttgtttggtcgttgcgggcgttgacggtagtagttgttagttacggtttcgtcggtttcgtattcgggcgcggttaggtcgtgaggggtgcgttttgtttttttgagtttagtttgtcggtcggttcgtttattttgtggttttggtaagtttcgagcgttcggatcgtcgtttcggtgagttttatatgtagtacggtgatgttgttttgttttagtcgttcgtacgatagtttatagcgttgtttttttcgtaggttttttgtttttttcgtcgttattttaaatttttcggggtgtcgtcgtcgtcgtcgtttcggttttagtttttattgcggtcgcggttgtttgggtttttgtagtcgtcgttattgttagggttatttcgttgttgacgtattgttatatattgcgcggagttagatttcggattgttatcgtcgttattcgttttatttttcggtttcgcgtttcgtttcgggttcgttttattggttttgttttttttagaatcgtttttatcggtcgttttttatttttacgggggcgggtttaaagttattagagttttgtttttgggacgggacgttcgagaggtaagaggttgacgtttaggtgacgcgttaattta

SEQ ID NO: 6084 - DNA, 1021 bp, Artificial Sequence
  chemically treated genomic DNA (Homo sapiens) CpG-island No: 6084
taaattaacgcgtcacctaaacgtcaacctcttacctctcgaacgtcccgtcccaaaaacaaaactctaataactttaaacccgcccccgtaaaaataaaaaacgaccgataaaaacgattctaaaaaaaacaaaaccaataaaacgaacccgaaacgaaacgcgaaaccgaaaaataaaacgaataacgacgataacaatccgaaatctaactccgcgcaatatataacaatacgtcaacaacgaaataaccctaacaataacgacgactacaaaaacccaaacaaccgcgaccgcaataaaaactaaaaccgaaacgacgacgacgacgacaccccgaaaaatttaaaataacgacgaaaaaaacaaaaaacctacgaaaaaaacaacgctataaactatcgtacgaacgactaaaacaaaacaacatcaccgtactacatataaaactcaccgaaacgacgatccgaacgctcgaaacttaccaaaaccacaaaataaacgaaccgaccgacaaactaaactcaaaaaaacaaaacgcacccctcacgacctaaccgcgcccgaatacgaaaccgacgaaaccgtaactaacaactactaccgtcaacgcccgcaacgaccaaacaaaacaaaaccgaacaaaataactaacgccgcgctcccgaactaacctaaacgttaaaaaaacgaacaatcgaacgacccctaacgacgaaaccgaaacaaccgcaaccctaaatcgactacgctaccgctacgaaactttccgacaacccccgaaaaattcctaacttattaaatcccaaaaaaaaaaaaaacccgataaaaaaaataaaataaccacgctaccctcgacgaaaaaaaaaaataacgaacaacgtataaacaaaaaaccaaaaacgactcgcgaacaccaactacccgcgttttccaattacataaacacgataaatcctcaaaaacaaaacacaaacgctccgcgtataaaaataaaaccttatattcccaaaaacttaaa

SEQ ID NO: 6085 - DNA, 701 bp, Artificial Sequence
  chemically treated genomic DNA (Homo sapiens) CpG-island No: 6085
gagagcgcgtttttatgtgattaacgcgggcgaatatcgttcgcgaatgtggtttggcggttcgtattaatatcgttatgtagtggttttattttatttgacgtagattttgtttggcgattgcgttttcgcgaattgtcgggtgcgattgttaaaagttatagtagtaaaggttaggatcggtggaacgtaattggtaggttttggcgttggcgcgtgaattcgtagaaaagtttcgttgtaatcggtaaattcgtatagcgttaatcgatcgttagtgttttcgatgtcgtttttgatttcgtgaaaatcgtaatcgttgcgatgtcgtcgggtttggtgacgtttttttcgtttcggcgttgtcgttagacggttttggtcgatgggtattacgcgttgggaaaaacgtaatatcgtcgaagaatttttatttggaaagaggaattttgtatttaatgtaattattgcgttgcgtttgtttatatttagttattcgcgtaaaagtggtgtcgtttgaagcgtggaaaacgtttttgttagtttgtattcgttggatgtgaaatcgcgtgaatgcgcgggtagaaatatgttttgtaggtggtatcggaagattgtatcgttgtaatttgtgcgtcgaagtttgttcggcgaaagatcgttagaatttaagattaaagttattaatatgatgtttcgtt

SEQ ID NO: 6086 - DNA, 701 bp, Artificial Sequence
  chemically treated genomic DNA (Homo sapiens) CpG-island No: 6086
aacgaaacatcatattaataactttaatcttaaattctaacgatctttcgccgaacaaacttcgacgcacaaattacaacgatacaatcttccgataccacctacaaaacatatttctacccgcgcattcacgcgatttcacatccaacgaatacaaactaacaaaaacgttttccacgcttcaaacgacaccacttttacgcgaataactaaatataaacaaacgcaacgcaataattacattaaatacaaaattcctctttccaaataaaaattcttcgacgatattacgtttttcccaacgcgtaatacccatcgaccaaaaccgtctaacgacaacgccgaaacgaaaaaaacgtcaccaaacccgacgacatcgcaacgattacgattttcacgaaatcaaaaacgacatcgaaaacactaacgatcgattaacgctatacgaatttaccgattacaacgaaacttttctacgaattcacgcgccaacgccaaaacctaccaattacgttccaccgatcctaacctttactactataacttttaacaatcgcacccgacaattcgcgaaaacgcaatcgccaaacaaaatctacgtcaaataaaataaaaccactacataacgatattaatacgaaccgccaaaccacattcgcgaacgatattcgcccgcgttaatcacataaaaacgcgctctc

SEQ ID NO: 6087 - DNA, 701 bp, Artificial Sequence
  chemically treated genomic DNA (Homo sapiens) CpG-island No: 6087
ggcgagatattatattgatggttttaattttggattttgacggtttttcgtcgggtaaatttcgacgtataggttataacggtgtaatttttcggtgttatttgtaagatatatttttgttcgcgtatttacgcgattttatatttagcgaatgtaggttggtaggggcgttttttacgttttaggcggtattatttttgcgcgaatagttgagtgtgggtaagcgtaacgtagtggttatattgggtatagagtttttttttttagatggggatttttcggcgatattgcgttttttttagcgcgtagtgtttatcggttagggtcgtttggcggtagcgtcgaaacggggagggcgttattaagttcggcggtatcgtagcggttacggtttttacgaaattaggggcggtatcggaaatattggcggtcgattggcgttgtgcggatttatcggttgtaacggaatttttttacggatttacgcgttagcgttagagtttgttagttgcgttttatcgattttggtttttgttattgtaatttttggtaatcgtattcggtaattcgcgagggcgtaatcgttagatagaatttgcgttagatggaataaagttattgtatgacggtattaatacggatcgttaggttatattcgcggacgatattcgttcgcgttaattatatagaagcgcgttttt

SEQ ID NO: 6088 - DNA, 701 bp, Artificial Sequence
  chemically treated genomic DNA (Homo sapiens) CpG-island No: 6088
aaaaacgcgcttctatataattaacgcgaacgaatatcgtccgcgaatataacctaacgatccgtattaataccgtcatacaataactttattccatctaacgcaaattctatctaacgattacgccctcgcgaattaccgaatacgattaccaaaaattacaataacaaaaaccaaaatcgataaaacgcaactaacaaactctaacgctaacgcgtaaatccgtaaaaaaattccgttacaaccgataaatccgcacaacgccaatcgaccgccaatatttccgataccgcccctaatttcgtaaaaaccgtaaccgctacgataccgccgaacttaataacgccctccccgtttcgacgctaccgccaaacgaccctaaccgataaacactacgcgctaaaaaaaacgcaatatcgccgaaaaatccccatctaaaaaaaaaaactctatacccaatataaccactacgttacgcttacccacactcaactattcgcgcaaaaataataccgcctaaaacgtaaaaaacgcccctaccaacctacattcgctaaatataaaatcgcgtaaatacgcgaacaaaaatatatcttacaaataacaccgaaaaattacaccgttataacctatacgtcgaaatttacccgacgaaaaaccgtcaaaatccaaaattaaaaccatcaatataatatctcgcc

SEQ ID NO: 6089 - DNA, 512 bp, Artificial Sequence
  chemically treated genomic DNA (Homo sapiens) CpG-island No: 6089
tgtcggcgtgtgttagtcgtttgcgcgaggcgttataggagagggcgcgtttttgtcgttttgtcgtttttagaagtttttcgggaatcgattttattgattcgttttttcgcgttttacgcgtggtagtttaagtttagtttttagattggaggagatcgcggagggaattttgttggggtttgggttcggggttacgcggttcgagtagatcgagggtcgattttttcgagaattcgttttttggtttcggttttttttttgcgttcgtttttttacgtggggtttaggtttgggaattagcgttcgggggtggttggggataatcgagaacgagtttttttttcggtacgcgggcggaatggttgagtttagtttggaagttttcgttaggtttttgggggcgggcgggcgcgcgaagtatagggcggagatagtcgggagtttagtttttcgggttgggtcgtttttttttttttcgcgttcggtcggggatgggggtgtggttttaa

SEQ ID NO: 6090 - DNA, 512 bp, Artificial Sequence
  chemically treated genomic DNA (Homo sapiens) CpG-island No: 6090
ttaaaaccacacccccatccccgaccgaacgcgaaaaaaaaaaaaacgacccaacccgaaaaactaaactcccgactatctccgccctatacttcgcgcgcccgcccgcccccaaaaacctaacgaaaacttccaaactaaactcaaccattccgcccgcgtaccgaaaaaaaaactcgttctcgattatccccaaccacccccgaacgctaattcccaaacctaaaccccacgtaaaaaaacgaacgcaaaaaaaaaaccgaaaccaaaaaacgaattctcgaaaaaatcgaccctcgatctactcgaaccgcgtaaccccgaacccaaaccccaacaaaattccctccgcgatctcctccaatctaaaaactaaacttaaactaccacgcgtaaaacgcgaaaaaacgaatcaataaaatcgattcccgaaaaacttctaaaaacgacaaaacgacaaaaacgcgccctctcctataacgcctcgcgcaaacgactaacacacgccgaca

SEQ ID NO: 6091 - DNA, 512 bp, Artificial Sequence
  chemically treated genomic DNA (Homo sapiens) CpG-island No: 6091
ttgggattatatttttattttcggtcgggcgcggggaaggggagggcggtttagttcgggaggttgggttttcggttgttttcgttttgtgtttcgcgcgttcgttcgtttttaaggatttgacgggggtttttaggttgggtttagttatttcgttcgcgtgtcggggaagaagttcgttttcggttgtttttagttattttcgagcgttgatttttagatttgggttttacgtgggagggcgggcgtaagggaggagtcgaggttagagagcgagttttcggaggggtcggttttcgatttgttcgggtcgcgtggtttcgggtttagattttagtagggtttttttcgcggttttttttaatttggaggttgagtttaggttgttacgcgtggggcgcggaggggcgagttagtggagtcggttttcgggaaatttttgggggcggtagagcgataggagcgcgtttttttttgtggcgtttcgcgtaggcggttggtatacgtcgata

SEQ ID NO: 6092 - DNA, 512 bp, Artificial Sequence
  chemically treated genomic DNA (Homo sapiens) CpG-island No: 6092
tatcgacgtataccaaccgcctacgcgaaacgccacaaaaaaaaacgcgctcctatcgctctaccgcccccaaaaatttcccgaaaaccgactccactaactcgcccctccgcgccccacgcgtaacaacctaaactcaacctccaaattaaaaaaaaccgcgaaaaaaaccctactaaaatctaaacccgaaaccacgcgacccgaacaaatcgaaaaccgacccctccgaaaactcgctctctaacctcgactcctcccttacgcccgccctcccacgtaaaacccaaatctaaaaatcaacgctcgaaaataactaaaaacaaccgaaaacgaacttcttccccgacacgcgaacgaaataactaaacccaacctaaaaacccccgtcaaatccttaaaaacgaacgaacgcgcgaaacacaaaacgaaaacaaccgaaaacccaacctcccgaactaaaccgccctccccttccccgcgcccgaccgaaaataaaaatataatcccaa

SEQ ID NO: 6093 - DNA, 638 bp, Artificial Sequence
  chemically treated genomic DNA (Homo sapiens) CpG-island No: 6093
gataatcgtatattatagtagtacgatttagcgcgcgataagcgtagtagagtatacgtatgtacgatagagtatacgatagaagcgttataagcgtatgtattaaatacgttttcggcgcgtagcgtcgatataagatattatcgattatagtagtcgacgtaatagttagtatatagcgttattagcgatatagatgaataattatatacggacgtagtaatataggataatagagtataagattttttatgcgtataagacgtcgataattagagtagagttacgtattatagcgatgaatagcgattatttaagcgtcgggcgtagtatcgttcgacgcggcgcgtacgttaacgtaggacggatatagtagtagtagcgtcgtttgtagtgagtttacgtatagtatcgaatagacggtcgtatagaagtagtatgtaagtatataaagacgacgtatcgaaacgttatacgagaattagtgatcgattcgaagaagatgagagtacgataataagagcgttttttaagttacgattagttcgatagataatcgtaaaattacgaagcgataagttcgtaacgtaagatatagatacgtacggaatatttaagaataatagagataatagata

SEQ ID NO: 6094 - DNA, 638 bp, Artificial Sequence
  chemically treated genomic DNA (Homo sapiens) CpG-island No: 6094
tatctattatctctattattcttaaatattccgtacgtatctatatcttacgttacgaacttatcgcttcgtaattttacgattatctatcgaactaatcgtaacttaaaaaacgctcttattatcgtactctcatcttcttcgaatcgatcactaattctcgtataacgtttcgatacgtcgtctttatatacttacatactacttctatacgaccgtctattcgatactatacgtaaactcactacaaacgacgctactactactatatccgtcctacgttaacgtacgcgccgcgtcgaacgatactacgcccgacgcttaaataatcgctattcatcgctataatacgtaactctactctaattatcgacgtcttatacgcataaaaaatcttatactctattatcctatattactacgtccgtatataattattcatctatatcgctaataacgctatatactaactattacgtcgactactataatcgataatatcttatatcgacgctacgcgccgaaaacgtatttaatacatacgcttataacgcttctatcgtatactctatcgtacatacgtatactctactacgcttatcgcgcgctaaatcgtactactataatatacgattatc

SEQ ID NO: 6095 - DNA, 638 bp, Artificial Sequence
  chemically treated genomic DNA (Homo sapiens) CpG-island No: 6095
tgtttgttgtttttgttgtttttgggtgtttcgtgcgtatttgtgttttacgttgcgagtttgtcgtttcgtggttttgcggttgtttgtcgagttagtcgtggtttgggaagcgtttttgttgtcgtgtttttatttttttcgagtcggttattggttttcgtgtggcgtttcggtgcgtcgtttttgtatgtttgtatgttgtttttatgcggtcgtttgttcggtgttgtgcgtaggtttattgtaggcggcgttgttgttgttgtgttcgttttgcgttggcgtgcgcgtcgcgtcgggcggtgttgcgttcggcgtttgagtggtcgttgtttatcgttgtggtgcgtggttttgttttggttgtcggcgttttgtgcgtatgggggattttgtgttttgttgttttgtgttgttgcgttcgtgtgtggttgtttatttgtgtcgttggtggcgttgtgtgttggttgttgcgtcggttgttgtagtcggtggtgttttgtgtcggcgttgcgcgtcggaggcgtgtttggtgtatgcgtttgtggcgtttttgtcgtgtgttttgtcgtgtatgcgtgtgttttgttgcgtttgtcgcgcgttgggtcgtgttgttgtgatgtacgattgtt

SEQ ID NO: 6096 - DNA, 638 bp, Artificial Sequence
  chemically treated genomic DNA (Homo sapiens) CpG-island No: 6096
aacaatcgtacatcacaacaacacgacccaacgcgcgacaaacgcaacaaaacacacgcatacacgacaaaacacacgacaaaaacgccacaaacgcatacaccaaacacgcctccgacgcgcaacgccgacacaaaacaccaccgactacaacaaccgacgcaacaaccaacacacaacgccaccaacgacacaaataaacaaccacacacgaacgcaacaacacaaaacaacaaaacacaaaatcccccatacgcacaaaacgccgacaaccaaaacaaaaccacgcaccacaacgataaacaacgaccactcaaacgccgaacgcaacaccgcccgacgcgacgcgcacgccaacgcaaaacgaacacaacaacaacaacgccgcctacaataaacctacgcacaacaccgaacaaacgaccgcataaaaacaacatacaaacatacaaaaacgacgcaccgaaacgccacacgaaaaccaataaccgactcgaaaaaaataaaaacacgacaacaaaaacgcttcccaaaccacgactaactcgacaaacaaccgcaaaaccacgaaacgacaaactcgcaacgtaaaacacaaatacgcacgaaacacccaaaaacaacaaaaacaacaaaca

SEQ ID NO: 6097 - DNA, 637 bp, Artificial Sequence
  chemically treated genomic DNA (Homo sapiens) CpG-island No: 6097
gtgcgcggggtggtgataaatagaaaatcgttaattagtttgtcgttcggcgatatcgtttgcgttcgtatatcggcgggttagggttggagatcgtttaacgaaagtcggggataatatttttgtattagtcgtcgttgtcgtttttgtatagcgagttttttatttcgtttagttttgagcgtagatagttttgtagtattcggcgaattttcgacgagtttaaaatttttagcgtgtcgttaatgagaagtcgcgtttgcgatagttttcgcgtttgaaagttagtatcgcgtttggttcgacggttacgttgtcgtcgattatgcgggtgagatgaacgtttaaaaacggtattgtcgggtcgggaatggggtaaattaggtggttaataattttggttatgtttcggcgtaaggcggaaatattcgttacggaacgggtagatataaagttcggttcgagttcgagtatttttattagtcggttagttattagttcggaatagttaattagcgttgatgttttatattcgtcgttttgacgggtacgtattattacgtcgtttttatgtttattatagttcgttgatttcggcgttatagattattttatcgtttttggattggaagatttt

SEQ ID NO: 6098 - DNA, 637 bp, Artificial Sequence
  chemically treated genomic DNA (Homo sapiens) CpG-island No: 6098
aaaatcttccaatccaaaaacgataaaataatctataacgccgaaatcaacgaactataataaacataaaaacgacgtaataatacgtacccgtcaaaacgacgaatataaaacatcaacgctaattaactattccgaactaataactaaccgactaataaaaatactcgaactcgaaccgaactttatatctacccgttccgtaacgaatatttccgccttacgccgaaacataaccaaaattattaaccacctaatttaccccattcccgacccgacaataccgtttttaaacgttcatctcacccgcataatcgacgacaacgtaaccgtcgaaccaaacgcgatactaactttcaaacgcgaaaactatcgcaaacgcgacttctcattaacgacacgctaaaaattttaaactcgtcgaaaattcgccgaatactacaaaactatctacgctcaaaactaaacgaaataaaaaactcgctatacaaaaacgacaacgacgactaatacaaaaatattatccccgactttcgttaaacgatctccaaccctaacccgccgatatacgaacgcaaacgatatcgccgaacgacaaactaattaacgattttctatttatcaccaccccgcgcac

SEQ ID NO: 6099 - DNA, 637 bp, Artificial Sequence
  chemically treated genomic DNA (Homo sapiens) CpG-island No: 6099
aaaattttttagtttagaggcggtgaaatagtttataacgtcgaagttagcgggttgtaatgagtataaaaacggcgtggtgatacgtattcgttagggcggcgaatatgaagtattaacgttgattagttgtttcgggttgatggttgatcggttggtgaaaatgttcggattcgaatcgggttttatatttgttcgtttcgtggcgagtattttcgttttgcgtcggagtataattaagattgttaattatttgatttattttattttcgattcggtaatgtcgtttttgggcgtttattttattcgtatgatcgacggtagcgtgatcgtcgggttaaacgcggtgttggtttttaaacgcgaaggttatcgtaagcgcgattttttattagcgatacgttggagattttgggttcgtcggggattcgtcgggtgttgtaaaattatttacgtttaggattgggcgagatgaaaaattcgttgtgtaaaagcggtagcggcggttggtgtaaaagtattgttttcggttttcgttaagcgatttttagttttggttcgtcggtgtgcgggcgtaggcggtatcgtcggacggtaagttgattgacgattttttgtttgttattatttcgcgtat

SEQ ID NO: 6100 - DNA, 637 bp, Artificial Sequence
  chemically treated genomic DNA (Homo sapiens) CpG-island No: 6100
atacgcgaaataataacaaacaaaaaatcgtcaatcaacttaccgtccgacgataccgcctacgcccgcacaccgacgaaccaaaactaaaaatcgcttaacgaaaaccgaaaacaatacttttacaccaaccgccgctaccgcttttacacaacgaatttttcatctcgcccaatcctaaacgtaaataattttacaacacccgacgaatccccgacgaacccaaaatctccaacgtatcgctaataaaaaatcgcgcttacgataaccttcgcgtttaaaaaccaacaccgcgtttaacccgacgatcacgctaccgtcgatcatacgaataaaataaacgcccaaaaacgacattaccgaatcgaaaataaaataaatcaaataattaacaatcttaattatactccgacgcaaaacgaaaatactcgccacgaaacgaacaaatataaaacccgattcgaatccgaacattttcaccaaccgatcaaccatcaacccgaaacaactaatcaacgttaatacttcatattcgccgccctaacgaatacgtatcaccacgccgtttttatactcattacaacccgctaacttcgacgttataaactatttcaccgcctctaaactaaaaaatttt

SEQ ID NO: 6101 - DNA, 580 bp, Artificial Sequence
  chemically treated genomic DNA (Homo sapiens) CpG-island No: 6101
tattgattagtaaacgggttgtttatttgtcgtggtttatttttttagttaatttaaagaattattatgtttttcgttcgtgggaacggtcgaagaggtaaattattgatggtaatagtgacgcgtggtcggtgtcgtattgatattttttgttagatgttgtgtcgttttttcgagtaaattatttagtaataacgttatcgtttgcgggttttttatacggtaggtatcgttaaatgttttttatcgtaatttttttagaacgatataatagcgtttaggtaacgattaggcgttatacgttttattacgttagcgggtaataaattgttcgttttgattatttgtttgtattagtatgtttcgttgcgttaacgttttttttttttatcgataacgggttgaaaattatttatataaggcggttatttgttgggggaatttcgggaaagtatagtgttggcggtgatttatttttgtattatcgttaatgttggcgatttgcgtaagtgttagattatcggatttatttcgtcgttagttttttattatgttaaaattcgggttaatttgaattcga

SEQ ID NO: 6102 - DNA, 580 bp, Artificial Sequence
  chemically treated genomic DNA (Homo sapiens) CpG-island No: 6102
tcgaattcaaattaacccgaattttaacataataaaaaactaacgacgaaataaatccgataatctaacacttacgcaaatcgccaacattaacgataatacaaaaataaatcaccgccaacactatactttcccgaaattcccccaacaaataaccgccttatataaataattttcaacccgttatcgataaaaaaaaaaaacgttaacgcaacgaaacatactaatacaaacaaataatcaaaacgaacaatttattacccgctaacgtaataaaacgtataacgcctaatcgttacctaaacgctattatatcgttctaaaaaaattacgataaaaaacatttaacgatacctaccgtataaaaaacccgcaaacgataacgttattactaaataatttactcgaaaaaacgacacaacatctaacaaaaaatatcaatacgacaccgaccacgcgtcactattaccatcaataatttacctcttcgaccgttcccacgaacgaaaaacataataattctttaaattaactaaaaaaataaaccacgacaaataaacaacccgtttactaatcaata

SEQ ID NO: 6103 - DNA, 580 bp, Artificial Sequence
  chemically treated genomic DNA (Homo sapiens) CpG-island No: 6103
tcgaatttaagttagttcgggttttaatatggtgaaaaattggcggcgaagtggattcggtaatttggtatttacgtagatcgttagtattggcggtgatgtaaaaatggattatcgttagtattgtgttttttcgaggtttttttagtaaatagtcgttttgtatgagtggtttttagttcgttgtcgatggaaggaaaaggcgttaacgtaacgaggtatattggtgtaggtaggtgattagagcgagtaatttattattcgttggcgtgatggggcgtataacgtttggtcgttgtttgggcgttgttatatcgttttggaggagttgcgatggggggtatttggcgatgtttgtcgtgtgggaagttcgtaagcggtggcgttgttgttgggtgatttgttcgagaaagcgatataatatttggtagagagtattaatgcggtatcgattacgcgttattattattattagtggtttgttttttcgatcgtttttacgggcggggagtatgatgattttttaagttggttgggaaagtggattacggtagataaataattcgtttgttggttagtg

SEQ ID NO: 6104 - DNA, 580 bp, Artificial Sequence
  chemically treated genomic DNA (Homo sapiens) CpG-island No: 6104
cactaaccaacaaacgaattatttatctaccgtaatccactttcccaaccaacttaaaaaatcatcatactccccgcccgtaaaaacgatcgaaaaaacaaaccactaataataataataacgcgtaatcgataccgcattaatactctctaccaaatattatatcgctttctcgaacaaatcacccaacaacaacgccaccgcttacgaacttcccacacgacaaacatcgccaaataccccccatcgcaactcctccaaaacgatataacaacgcccaaacaacgaccaaacgttatacgccccatcacgccaacgaataataaattactcgctctaatcacctacctacaccaatatacctcgttacgttaacgccttttccttccatcgacaacgaactaaaaaccactcatacaaaacgactatttactaaaaaaacctcgaaaaaacacaatactaacgataatccatttttacatcaccgccaatactaacgatctacgtaaataccaaattaccgaatccacttcgccgccaatttttcaccatattaaaacccgaactaacttaaattcga

SEQ ID NO: 6105 - DNA, 742 bp, Artificial Sequence
  chemically treated genomic DNA (Homo sapiens) CpG-island No: 6105
agaatgtttatttgtttaacgatacggtttaatcggatattcggcggtagcgttttttatagtcgcgttagcgtatggtcgttcggttggaaagttcgcgttatttataggagcggttggcgtattacgttgtatagggggtaaattaatacgcgtttatgatcggcgtgtaggttttgcgcgaggcgattgtttagaaaacggaacgtttgtatggttattaattagatgtcgatagcgatattatcgtaacggtaggggcgacggaagcgttatacgcggcgattatcgtattggtgcgtaatggcgatgaagtgatttgttttgattttagttatgatagttacgttttcgttatcgcgttttttgggggaatagtgaagcgtatggtattgtaattatcgtattttcgcgttgattggtaggaatttgtcgtattattaagcgagcgtattagattggtgatttttaatatttcgtataattttagtgtaattgtttggtagtaggttgatttcgtcgttttgtggtaggcgatcgtcgggtacgagatttttgttattagcgatgaagtttacgagtatattaattttttataatagggttatgttagtgtgttggcgtattcgtaattgcgtgagcgggtagtggcggtttttttttttttatggtaattcgttgtttgtaggtttcgttatttgtatgttattgtatacgattcgtaatattttaatttgtagta

SEQ ID NO: 6106 - DNA, 742 bp, Artificial Sequence
  chemically treated genomic DNA (Homo sapiens) CpG-island No: 6106
tactacaaattaaaatattacgaatcgtatacaataacatacaaataacgaaacctacaaacaacgaattaccataaaaaaaaaaaaaccgccactacccgctcacgcaattacgaatacgccaacacactaacataaccctattataaaaaattaatatactcgtaaacttcatcgctaataacaaaaatctcgtacccgacgatcgcctaccacaaaacgacgaaatcaacctactaccaaacaattacactaaaattatacgaaatattaaaaatcaccaatctaatacgctcgcttaataatacgacaaattcctaccaatcaacgcgaaaatacgataattacaataccatacgcttcactattcccccaaaaaacgcgataacgaaaacgtaactatcataactaaaatcaaaacaaatcacttcatcgccattacgcaccaatacgataatcgccgcgtataacgcttccgtcgcccctaccgttacgataatatcgctatcgacatctaattaataaccatacaaacgttccgttttctaaacaatcgcctcgcgcaaaacctacacgccgatcataaacgcgtattaatttaccccctatacaacgtaatacgccaaccgctcctataaataacgcgaactttccaaccgaacgaccatacgctaacgcgactataaaaaacgctaccgccgaatatccgattaaaccgtatcgttaaacaaataaacattct

SEQ ID NO: 6107 - DNA, 742 bp, Artificial Sequence
  chemically treated genomic DNA (Homo sapiens) CpG-island No: 6107
tattataaattagagtattgcgaatcgtatgtaatggtatgtaaatgacgggatttgtaggtagcgagttgttatgggggagaagaaatcgttattgttcgtttacgtagttgcggatgcgttagtatattggtatggttttgttgtgaaaagttgatgtgttcgtagattttatcgttaatgataaaaatttcgtgttcggcgatcgtttgttataaagcggcgaaattagtttgttgttagatagttgtattggggttatgcggagtgttgaggattattagtttggtgcgttcgtttaataatgcggtaaatttttgttagttaacgcgaaaatgcggtggttgtagtgttatacgttttattatttttttagaaagcgcgatggcgggggcgtaattgttatagttgggattaaaataaattattttatcgttattgcgtattagtgcggtaatcgtcgcgtataacgttttcgtcgtttttgtcgttacggtgatatcgttatcggtatttggttgatagttatataaacgtttcgttttttgagtaatcgtttcgcgtaaggtttgtacgtcggttatgggcgcgtattggtttgttttttgtgtaacgtggtgcgttagtcgtttttgtaaatagcgcggattttttagtcggacggttatacgttggcgcggttgtggggggcgttgtcgtcggatattcggttaagtcgtatcgttaaatagatggatatttt

SEQ ID NO: 6108 - DNA, 742 bp, Artificial Sequence
  chemically treated genomic DNA (Homo sapiens) CpG-island No: 6108
aaaatatccatctatttaacgatacgacttaaccgaatatccgacgacaacgccccccacaaccgcgccaacgtataaccgtccgactaaaaaatccgcgctatttacaaaaacgactaacgcaccacgttacacaaaaaacaaaccaatacgcgcccataaccgacgtacaaaccttacgcgaaacgattactcaaaaaacgaaacgtttatataactatcaaccaaataccgataacgatatcaccgtaacgacaaaaacgacgaaaacgttatacgcgacgattaccgcactaatacgcaataacgataaaataatttattttaatcccaactataacaattacgcccccgccatcgcgctttctaaaaaaataataaaacgtataacactacaaccaccgcattttcgcgttaactaacaaaaatttaccgcattattaaacgaacgcaccaaactaataatcctcaacactccgcataaccccaatacaactatctaacaacaaactaatttcgccgctttataacaaacgatcgccgaacacgaaatttttatcattaacgataaaatctacgaacacatcaacttttcacaacaaaaccataccaatatactaacgcatccgcaactacgtaaacgaacaataacgatttcttctcccccataacaactcgctacctacaaatcccgtcatttacataccattacatacgattcgcaatactctaatttataata

SEQ ID NO: 6109 - DNA, 672 bp, Artificial Sequence
  chemically treated genomic DNA (Homo sapiens) CpG-island No: 6109
gcggttgtcgttggagaacgatattattaaagatgggcggattgttgatgcgtagtagttggttaaaacgttgttatcgtggagtcgcgaattgtcgtagcgttattatattatgttggcgtttttcgttagtcgtatattatagcggttattttcgcgttcgtcgatgttttttggtgagcgggagtaaacggtttggttgttagggacgatggttcgcgagttggatatggattcggattttttgcgtttcgattatagcgaagatttatttagtttcgtttataacgtgattgtcgcgtaaagtaaagagttggtaacgttgtttattttggtagaaaggttgcgtgtttatgtgagcgcgattatttcggatgttagtgtattatagcgatttttgttttttttatttttttattagtaatgtttggtttggcgtgataacgaatagtggttgtggcgacgcgttatagttgggggcgtaaattggcggtggggatgattagcgcgaaggagttggcggtagcgttattcgttgatttcgaaagcgtcgcgatatgtggcgaaggcggatttgatttttgggaggtcgtttttgttcgttagtcgtcgttatcgtcgttaggtggagattttgttatcgcgttggggttggcgtttgggaaggcgtat

SEQ ID NO: 6110 - DNA, 672 bp, Artificial Sequence
  chemically treated genomic DNA (Homo sapiens) CpG-island No: 6110
atacgccttcccaaacgccaaccccaacgcgataacaaaatctccacctaacgacgataacgacgactaacgaacaaaaacgacctcccaaaaatcaaatccgccttcgccacatatcgcgacgctttcgaaatcaacgaataacgctaccgccaactccttcgcgctaatcatccccaccgccaatttacgcccccaactataacgcgtcgccacaaccactattcgttatcacgccaaaccaaacattactaataaaaaaataaaaaaaacaaaaatcgctataatacactaacatccgaaataatcgcgctcacataaacacgcaacctttctaccaaaataaacaacgttaccaactctttactttacgcgacaatcacgttataaacgaaactaaataaatcttcgctataatcgaaacgcaaaaaatccgaatccatatccaactcgcgaaccatcgtccctaacaaccaaaccgtttactcccgctcaccaaaaaacatcgacgaacgcgaaaataaccgctataatatacgactaacgaaaaacgccaacataatataataacgctacgacaattcgcgactccacgataacaacgttttaaccaactactacgcatcaacaatccgcccatctttaataatatcgttctccaacgacaaccgc

SEQ ID NO: 6111 - DNA, 672 bp, Artificial Sequence
  chemically treated genomic DNA (Homo sapiens) CpG-island No: 6111
gtacgtttttttaagcgttagttttagcgcgatggtaaagtttttatttggcggcggtagcggcggttgacgaatagaaacggttttttagggattaaattcgttttcgttatatatcgcgacgttttcgggattaacggataacgttgtcgttagttttttcgcgttagttatttttatcgttagtttgcgtttttagttatagcgcgtcgttatagttattgttcgttattacgttaggttagatattgttgatgagaaggtaaaaaaggtaggaatcgttgtaatgtattggtattcggggtgatcgcgtttatatgaatacgtaatttttttgttagagtaagtagcgttgttagttttttgttttgcgcggtagttacgttataggcgggattgagtgagttttcgttgtaatcgaagcgtagggagttcggatttatatttagttcgcgggttatcgtttttgatagttaggtcgtttgttttcgtttattaagggatatcgacgggcgcggaaatgatcgttgtaatgtgcgattggcgggaaacgttaatataatgtgatgacgttgcggtagttcgcgattttacggtaataacgttttagttagttgttgcgtattaataattcgtttatttttgataatgtcgttttttagcggtaatcgt

SEQ ID NO: 6112 - DNA, 672 bp, Artificial Sequence
  chemically treated genomic DNA (Homo sapiens) CpG-island No: 6112
acgattaccgctaaaaaacgacattatcaaaaataaacgaattattaatacgcaacaactaactaaaacgttattaccgtaaaatcgcgaactaccgcaacgtcatcacattatattaacgtttcccgccaatcgcacattacaacgatcatttccgcgcccgtcgatatcccttaataaacgaaaacaaacgacctaactatcaaaaacgataacccgcgaactaaatataaatccgaactccctacgcttcgattacaacgaaaactcactcaatcccgcctataacgtaactaccgcgcaaaacaaaaaactaacaacgctacttactctaacaaaaaaattacgtattcatataaacgcgatcaccccgaataccaatacattacaacgattcctaccttttttaccttctcatcaacaatatctaacctaacgtaataacgaacaataactataacgacgcgctataactaaaaacgcaaactaacgataaaaataactaacgcgaaaaaactaacgacaacgttatccgttaatcccgaaaacgtcgcgatatataacgaaaacgaatttaatccctaaaaaaccgtttctattcgtcaaccgccgctaccgccgccaaataaaaactttaccatcgcgctaaaactaacgcttaaaaaaacgtac

SEQ ID NO: 6113 - DNA, 503 bp, Artificial Sequence
  chemically treated genomic DNA (Homo sapiens) CpG-island No: 6113
  misc_feature (185)..(185): n is either a, c, g or t
  misc_feature (254)..(254): n is either a, c, g or t
  misc_feature (261)..(261): n is either a, c, g or t
  misc_feature (267)..(268): n is either a, c, g or t
  misc_feature (270)..(270): n is either a, c, g or t
  misc_feature (306)..(306): n is either a, c, g or t
  misc_feature (410)..(410): n is either a, c, g or t
cgtttgatcgtgggtggtgtcggcggttacgttttatgttagaagagagttttttcgtgggtaggagcggcgtgggatttttaaaatttatttttcgcgttgagtttgggcgtttatttcgtttatcgtttttttttagttattttatttagtttatattcgagaaagtagtggggggatcgtangttggagttttcggggcgtgaattttacgcgagaagttcgggttcggatgtttttgttgtcgggttttntgttagnttttanntnttacgttttttttcgttaaggggtacgtcggattgntagtaagcgggattttcgggttttaatttttcggttgggattataggcgtcggtttttcggtttcggtttgcgagattgaaggtcgcgattttggcggcggtanagggagaattataattcggggtggatagtttcgtttacgtcggtgaaaaggaattgagtgtatcggtggttttgagtaaagagtttttttttt

SEQ ID NO: 6114 - DNA, 503 bp, Artificial Sequence
  chemically treated genomic DNA (Homo sapiens) CpG-island No: 6114
  misc_feature (94)..(94): n is either a, c, g or t
  misc_feature (198)..(198): n is either a, c, g or t
  misc_feature (234)..(234): n is either a, c, g or t
  misc_feature (236)..(237): n is either a, c, g or t
  misc_feature (243)..(243): n is either a, c, g or t
  misc_feature (250)..(250): n is either a, c, g or t
  misc_feature (319)..(319): n is either a, c, g or t
aaaaaaaaaactctttactcaaaaccaccgatacactcaattccttttcaccgacgtaaacgaaactatccaccccgaattataattctccctntaccgccgccaaaatcgcgaccttcaatctcgcaaaccgaaaccgaaaaaccgacgcctataatcccaaccgaaaaattaaaacccgaaaatcccgcttactancaatccgacgtaccccttaacgaaaaaaaacgtaananntaaaanctaacanaaaacccgacaacaaaaacatccgaacccgaacttctcgcgtaaaattcacgccccgaaaactccaacntacgatccccccactactttctcgaatataaactaaataaaataactaaaaaaaaacgataaacgaaataaacgcccaaactcaacgcgaaaaataaattttaaaaatcccacgccgctcctacccacgaaaaaactctcttctaacataaaacgtaaccgccgacaccacccacgatcaaacg

SEQ ID NO: 6115 - DNA, 503 bp, Artificial Sequence
  chemically treated genomic DNA (Homo sapiens) CpG-island No: 6115
  misc_feature (94)..(94): n is either a, c, g or t
  misc_feature (198)..(198): n is either a, c, g or t
  misc_feature (234)..(234): n is either a, c, g or t
  misc_feature (236)..(237): n is either a, c, g or t
  misc_feature (243)..(243): n is either a, c, g or t
  misc_feature (250)..(250): n is either a, c, g or t
  misc_feature (319)..(319): n is either a, c, g or t
aaaggagaaattttttgtttagagttatcgatatatttaatttttttttatcggcgtgggcgggattatttatttcgggttgtaattttttttntatcgtcgttaaggtcgcggtttttagtttcgtaggtcgagatcgaggggtcggcgtttatgattttagtcgggggattaggattcggaagtttcgtttgttgntagttcggcgtgttttttagcggggaagggcgtggngnntggganttggtangaggttcggtagtaagagtattcgggttcgaatttttcgcgtggggtttacgtttcgggggttttagtntgcggtttttttattgttttttcgagtataggttagatggaatggttgaaagggagcgatgggcggggtgggcgtttaggtttagcgcgaagagtgagttttgaaggttttacgtcgtttttgtttacgaaggggtttttttttgatatgaggcgtggtcgtcgatattatttacgattagacg

SEQ ID NO: 6116 - DNA, 503 bp, Artificial Sequence
  chemically treated genomic DNA (Homo sapiens) CpG-island No: 6116
  misc_feature (185)..(185): n is either a, c, g or t
  misc_feature (254)..(254): n is either a, c, g or t
  misc_feature (261)..(261): n is either a, c, g or t
  misc_feature (267)..(268): n is either a, c, g or t
  misc_feature (270)..(270): n is either a, c, g or t
  misc_feature (306)..(306): n is either a, c, g or t
  misc_feature (410)..(410): n is either a, c, g or t
cgtctaatcgtaaataatatcgacgaccacgcctcatatcaaaaaaaaaccccttcgtaaacaaaaacgacgtaaaaccttcaaaactcactcttcgcgctaaacctaaacgcccaccccgcccatcgctccctttcaaccattccatctaacctatactcgaaaaaacaataaaaaaaccgcanactaaaacccccgaaacgtaaaccccacgcgaaaaattcgaacccgaatactcttactaccgaacctcntaccaantcccanncnccacgcccttccccgctaaaaaacacgccgaactancaacaaacgaaacttccgaatcctaatcccccgactaaaatcataaacgccgacccctcgatctcgacctacgaaactaaaaaccgcgaccttaacgacgatanaaaaaaaattacaacccgaaataaataatcccgcccacgccgataaaaaaaaattaaatatatcgataactctaaacaaaaaatttctccttt

SEQ ID NO: 6117 - DNA, 687 bp, Artificial Sequence
  chemically treated genomic DNA (Homo sapiens) CpG-island No: 6117
  misc_feature (654)..(654): n is either a, c, g or t
tttcgatcgatattttcgacgtttaggatgaggaatatcgggagtcggtgttgttttttaacgttgcggttcgcgtggcggtggaagtaggtattgtcgattattggtataagtatgttggtttgaaaggggtaattgtcgggatgacgggttacggggaatttgtttcggcggataagttgttttcgttttttggttttatcgtcgagaatattgtggtaaaagcgtataaggtgttgggagtgaaaggtgtttgatggtgattgtcggatgttgattgtcggatgcgacgttgacgcgttttattcggtttatagcgttttattcggtttatatgtttcgttattttgttaaacgggtgatttataacgtgggtttagcgtttggtttatgttagttatcgtaggggggttcgaggcgtaagtattagggaaaagttgaacgttaaaggttaggcgttggatgtataacggtaatcgcgttttcggtaggatagtttcgtattttttagtgcgtttatttagattcgatcgataagttatgaagatcgatcgggaaatgggtttataacgagtagggagcgttagaattcggataaagagatattagtaggtatatatatcgtgtggttttcgcgcggaaatatatttgtgngggagtagacgtatagatatatataaggggata

SEQ ID NO: 6118 - DNA, 687 bp, Artificial Sequence
  chemically treated genomic DNA (Homo sapiens) CpG-island No: 6118
  misc_feature (34)..(34): n is either a, c, g or t
tatccccttatatatatctatacgtctactcccncacaaatatatttccgcgcgaaaaccacacgatatatatacctactaatatctctttatccgaattctaacgctccctactcgttataaacccatttcccgatcgatcttcataacttatcgatcgaatctaaataaacgcactaaaaaatacgaaactatcctaccgaaaacgcgattaccgttatacatccaacgcctaacctttaacgttcaacttttccctaatacttacgcctcgaacccccctacgataactaacataaaccaaacgctaaacccacgttataaatcacccgtttaacaaaataacgaaacatataaaccgaataaaacgctataaaccgaataaaacgcgtcaacgtcgcatccgacaatcaacatccgacaatcaccatcaaacacctttcactcccaacaccttatacgcttttaccacaatattctcgacgataaaaccaaaaaacgaaaacaacttatccgccgaaacaaattccccgtaacccgtcatcccgacaattacccctttcaaaccaacatacttataccaataatcgacaatacctacttccaccgccacgcgaaccgcaacgttaaaaaacaacaccgactcccgatattcctcatcctaaacgtcgaaaatatcgatcgaaa

SEQ ID NO: 6119 - DNA, 687 bp, Artificial Sequence
  chemically treated genomic DNA (Homo sapiens) CpG-island No: 6119
  misc_feature (34)..(34): n is either a, c, g or t
tgtttttttgtgtgtgtttgtgcgtttgtttttntataagtgtattttcgcgcgagagttatacggtgtgtgtgtttattgatgtttttttattcgggttttggcgttttttgttcgttgtgaatttatttttcggtcggtttttataatttgtcggtcgagtttggatgagcgtattggggagtgcgggattgttttatcgaaggcgcgattatcgttgtgtatttagcgtttggtttttgacgtttagtttttttttggtgtttacgtttcggatttttttgcgataattggtatgggttagacgttgggtttacgttgtggattattcgtttaataaaatggcgggatatgtaggtcggataagacgttgtaggtcggataagacgcgttagcgtcgtattcggtaattagtattcggtaattattattaggtattttttatttttagtattttatgcgtttttgttataatattttcggcggtaaagttaaagaacgggaatagtttattcgtcggagtagatttttcgtaattcgttatttcgataattgttttttttagattaatatatttgtattagtaatcggtaatatttgtttttatcgttacgcgagtcgtaacgttagaaggtaatatcgattttcgatattttttattttgggcgtcgaaaatatcggtcgagg

SEQ ID NO: 6120 - DNA, 687 bp, Artificial Sequence
  chemically treated genomic DNA (Homo sapiens) CpG-island No: 6120
  misc_feature (654)..(654): n is either a, c, g or t
cctcgaccgatattttcgacgcccaaaataaaaaatatcgaaaatcgatattaccttctaacgttacgactcgcgtaacgataaaaacaaatattaccgattactaatacaaatatattaatctaaaaaaaacaattatcgaaataacgaattacgaaaaatctactccgacgaataaactattcccgttctttaactttaccgccgaaaatattataacaaaaacgcataaaatactaaaaataaaaaatacctaataataattaccgaatactaattaccgaatacgacgctaacgcgtcttatccgacctacaacgtcttatccgacctacatatcccgccattttattaaacgaataatccacaacgtaaacccaacgtctaacccataccaattatcgcaaaaaaatccgaaacgtaaacaccaaaaaaaaactaaacgtcaaaaaccaaacgctaaatacacaacgataatcgcgccttcgataaaacaatcccgcactccccaatacgctcatccaaactcgaccgacaaattataaaaaccgaccgaaaaataaattcacaacgaacaaaaaacgccaaaacccgaataaaaaaacatcaataaacacacacaccgtataactctcgcgcgaaaatacacttatanaaaaacaaacgcacaaacacacacaaaaaaaca

SEQ ID NO: 6121 - DNA, 961 bp, Artificial Sequence
  chemically treated genomic DNA (Homo sapiens) CpG-island No: 6121
  misc_feature (14)..(14): n is either a, c, g or t
  misc_feature (92)..(92): n is either a, c, g or t
ggaaaatcgtattncggtcgcgcggtgttggaggtgtagcggtgttagtagatgtcgatgatgatatcgtataatttacgttagcgtgcgtntgtttatgatgtttatcgaggagtgcgcggggttttggattatgtttatcgtattggttttaaagattgttggatgtgtagagttttgatagttatgttgcgtaatcgttggttcgtaattttaattatatcgaaattagcgttaattagtacgttaattggggttcgaaaggcgtatcggttgatcgtttcgacgtggtggtattgagcgcgttggaaattgatatttagtttaacgttaacgtgttgatcggttttgacggcgtattgcgtggtgttttcggtggttattgcgatatcgcgattgtttttgcgttttttattatcgtcgcgtcgttggtacgcggtcgtatttcgattttggtggataacgtattgatttgtattattttaggttttagtgtcgatattttggttatagattacggtatcgtagttaattcggtacgttcggaattggtagaacgtttgtaggaagcgggtattaaagtggtttttattgagtggttgcgcgaacgtgcgcgtttgttgatcggtgaattatagtcgattgaatttatagatcgcgtcgttgtcgttgtgcgttatcgcgatggttcggtgatcgatgttgtgtattaagtgaaggaataagttatgtatttgttttttgaattcgttagttattatgcggtattaattttcgagttgttcgttagatcggatgaaaagtaagtacggtaatacgtttggtttaagcgttattttgttttattgtttttttttatcgtgggtgcgtttgggtcgattaaagatagcgaggttatacgtcgaatttttattatgcgtgatagtttgcgtgttttatcgaaaaatttattattagtata

SEQ ID NO: 6122 - DNA, 961 bp, Artificial Sequence
  chemically treated genomic DNA (Homo sapiens) CpG-island No: 6122
  misc_feature (870)..(870): n is either a, c, g or t
  misc_feature (948)..(948): n is either a, c, g or t
tatactaataataaatttttcgataaaacacgcaaactatcacgcataataaaaattcgacgtataacctcgctatctttaatcgacccaaacgcacccacgataaaaaaaaacaataaaacaaaataacgcttaaaccaaacgtattaccgtacttacttttcatccgatctaacgaacaactcgaaaattaataccgcataataactaacgaattcaaaaaacaaatacataacttattccttcacttaatacacaacatcgatcaccgaaccatcgcgataacgcacaacgacaacgacgcgatctataaattcaatcgactataattcaccgatcaacaaacgcgcacgttcgcgcaaccactcaataaaaaccactttaatacccgcttcctacaaacgttctaccaattccgaacgtaccgaattaactacgataccgtaatctataaccaaaatatcgacactaaaacctaaaataatacaaatcaatacgttatccaccaaaatcgaaatacgaccgcgtaccaacgacgcgacgataataaaaaacgcaaaaacaatcgcgatatcgcaataaccaccgaaaacaccacgcaatacgccgtcaaaaccgatcaacacgttaacgttaaactaaatatcaatttccaacgcgctcaataccaccacgtcgaaacgatcaaccgatacgcctttcgaaccccaattaacgtactaattaacgctaatttcgatataattaaaattacgaaccaacgattacgcaacataactatcaaaactctacacatccaacaatctttaaaaccaatacgataaacataatccaaaaccccgcgcactcctcgataaacatcataaacanacgcacgctaacgtaaattatacgatatcatcatcgacatctactaacaccgctacacctccaacaccgcgcgaccgnaatacgattttcc

SEQ ID NO: 6123 - DNA, 961 bp, Artificial Sequence
  chemically treated genomic DNA (Homo sapiens) CpG-island No: 6123
  misc_feature (870)..(870): n is either a, c, g or t
  misc_feature (948)..(948): n is either a, c, g or t
tatgttagtagtagatttttcggtaaggtacgtaagttgttacgtatgataaaaattcggcgtgtgatttcgttgtttttaatcggtttaggcgtatttacggtaaagaagagtagtggaataggatggcgtttgagttagacgtgttgtcgtgtttgttttttattcggtttgacgagtagttcggaaattgatatcgtatggtggttggcgagtttaggaagtaggtgtatggtttatttttttatttgatgtataatatcgattatcgagttatcgcggtaacgtataacggtaacgacgcggtttgtgaatttaatcggttgtggtttatcggttagtagacgcgtacgttcgcgtagttatttaatggaaattattttaatgttcgttttttgtagacgttttgttagtttcggacgtgtcgggttaattgcgatatcgtggtttgtgattagaatatcgatattggagtttggggtgatgtaggttagtacgttatttattagagtcggaatacgatcgcgtattagcggcgcgacgatgatggaaagcgtagaggtaatcgcggtatcgtagtgattatcggaagtattacgtagtacgtcgttagagtcggttagtacgttaacgttgaattgggtgttaatttttagcgcgtttagtattattacgtcgagacgattaatcgatgcgtttttcgaattttagttagcgtattggttggcgttgatttcgatgtgattggggttacgggttagcgattgcgtagtatggttgttaaagttttgtatatttagtagtttttagagttagtgcgatgaatataatttaaaatttcgcgtatttttcggtgaatattatgggtanacgtacgttgacgtgggttatgcgatattattatcgatatttgttggtatcgttatatttttaatatcgcgcgatcgnggtacggtttttt

SEQ ID NO: 6124 - DNA, 961 bp, Artificial Sequence
  chemically treated genomic DNA (Homo sapiens) CpG-island No: 6124
  misc_feature (14)..(14): n is either a, c, g or t
  misc_feature (92)..(92): n is either a, c, g or t
aaaaaaccgtaccncgatcgcgcgatattaaaaatataacgataccaacaaatatcgataataatatcgcataacccacgtcaacgtacgtntacccataatattcaccgaaaaatacgcgaaattttaaattatattcatcgcactaactctaaaaactactaaatatacaaaactttaacaaccatactacgcaatcgctaacccgtaaccccaatcacatcgaaatcaacgccaaccaatacgctaactaaaattcgaaaaacgcatcgattaatcgtctcgacgtaataatactaaacgcgctaaaaattaacacccaattcaacgttaacgtactaaccgactctaacgacgtactacgtaatacttccgataatcactacgataccgcgattacctctacgctttccatcatcgtcgcgccgctaatacgcgatcgtattccgactctaataaataacgtactaacctacatcaccccaaactccaatatcgatattctaatcacaaaccacgatatcgcaattaacccgacacgtccgaaactaacaaaacgtctacaaaaaacgaacattaaaataatttccattaaataactacgcgaacgtacgcgtctactaaccgataaaccacaaccgattaaattcacaaaccgcgtcgttaccgttatacgttaccgcgataactcgataatcgatattatacatcaaataaaaaaataaaccatacacctacttcctaaactcgccaaccaccatacgatatcaatttccgaactactcgtcaaaccgaataaaaaacaaacacgacaacacgtctaactcaaacgccatcctattccactactcttctttaccgtaaatacgcctaaaccgattaaaaacaacgaaatcacacgccgaatttttatcatacgtaacaacttacgtaccttaccgaaaaatctactactaacata

SEQ ID NO: 6125 - DNA, 839 bp, Artificial Sequence
  chemically treated genomic DNA (Homo sapiens) CpG-island No: 6125
  misc_feature (201)..(201): n is either a, c, g or t
  misc_feature (211)..(211): n is either a, c, g or t
agtaacgattataattattaaattaataagtatcggtatcggagtgcgttttacgattttaatagcgagattttcgttattcggttatcgtaacgattacgttagaacggcgaaagggtttcgttaaggtttgacgtttgtattatcgggatagttaaaagtttagaggttcgttttgattcgatagtattttataggttnaaagggtcgnaattcgtagttggtagaagttggggatgatattgttacgttcgtaagcgattgtggtggtttcggtttattggtttattcgtggaataggagtgatcgcgatggagacgtcgtttacgatttatgattttggtggtttttcgtaggcgttgtacgatacgtattattttgtttcgggttcgtttgcgttggtatagcgtttggttgagttgttagcgtcgatttcggtgacgttggataaagaagtttggggttttgattacggttcgtggggcgtgttgattaagatgtattttgacgttgatatttcgatggtgtagttgagtatcgatagtagtaaatttgtcgtttggtatttcgaaatggggcgtaaattggtagcgttgcgagatgaaggaataatgttggtcgttagcggtaacgtggtgtataatttgcgtatagcgaagtggtacggtgatagtttatcgtattcgggggcgacgtcgtttaatgagtatgtgaaagcgaatttgacgtggcgagggttagtggaataatattttttggtgaattatttcgattatgagaggggtacgttatcgaatttaacggttagatattatttgtcggtgttgtatgtgttacgg

SEQ ID NO: 6126 - DNA, 839 bp, Artificial Sequence
  chemically treated genomic DNA (Homo sapiens) CpG-island No: 6126
  misc_feature (629)..(629): n is either a, c, g or t
  misc_feature (639)..(639): n is either a, c, g or t
ccgtaacacatacaacaccgacaaataatatctaaccgttaaattcgataacgtacccctctcataatcgaaataattcaccaaaaaatattattccactaaccctcgccacgtcaaattcgctttcacatactcattaaacgacgtcgcccccgaatacgataaactatcaccgtaccacttcgctatacgcaaattatacaccacgttaccgctaacgaccaacattattccttcatctcgcaacgctaccaatttacgccccatttcgaaataccaaacgacaaatttactactatcgatactcaactacaccatcgaaatatcaacgtcaaaatacatcttaatcaacacgccccacgaaccgtaatcaaaaccccaaacttctttatccaacgtcaccgaaatcgacgctaacaactcaaccaaacgctataccaacgcaaacgaacccgaaacaaaataatacgtatcgtacaacgcctacgaaaaaccaccaaaatcataaatcgtaaacgacgtctccatcgcgatcactcctattccacgaataaaccaataaaccgaaaccaccacaatcgcttacgaacgtaacaatatcatccccaacttctaccaactacgaattncgaccctttnaacctataaaatactatcgaatcaaaacgaacctctaaacttttaactatcccgataatacaaacgtcaaaccttaacgaaaccctttcgccgttctaacgtaatcgttacgataaccgaataacgaaaatctcgctattaaaatcgtaaaacgcactccgataccgatacttattaatttaataattataatcgttact

SEQ ID NO: 6127 - DNA, 839 bp, Artificial Sequence
  chemically treated genomic DNA (Homo sapiens) CpG-island No: 6127
  misc_feature (629)..(629): n is either a, c, g or t
  misc_feature (639)..(639): n is either a, c, g or t
tcgtaatatatataatatcggtaaataatgtttggtcgttgggttcgataacgtgttttttttatggtcgaggtaatttattagaggatgttgttttattggttttcgttacgttagattcgtttttatatatttattaaacgacgtcgttttcggatacggtgaattattatcgtgttatttcgttgtgcgtaggttatgtattacgttatcgttggcgattaatattatttttttatttcgtagcgttgttagtttgcgttttatttcgaaatgttaggcggtaggtttgttattgtcgatatttaattgtattatcgggatattagcgttaggatatattttaattagtacgttttacgagtcgtggttaaagttttaggtttttttatttagcgttatcgggatcggcgttaatagtttaattagacgttgtgttagcgtaggcgaattcggagtaggataatgcgtatcgtatagcgtttgcgggaagttattaaagttatgaatcgtgggcggcgtttttatcgcggttatttttgttttacgggtaaattagtgagtcgaaattattataatcgtttgcgggcgtggtaatgttatttttaatttttgttagttgcgggttncggttttttnggtttgtgggatgttgtcgagttaggacgagtttttgaatttttgattatttcgatggtgtaggcgttaaattttgacgggattttttcgtcgttttggcgtagtcgttgcggtggtcggatggcgaagatttcgttgttgaagtcgtaaaacgtatttcggtatcggtgtttgttggtttggtgattgtaatcgttgtt

SEQ ID NO: 6128 - DNA, 839 bp, Artificial Sequence
  chemically treated genomic DNA (Homo sapiens) CpG-island No: 6128
  misc_feature (201)..(201): n is either a, c, g or t
  misc_feature (211)..(211): n is either a, c, g or t
aacaacgattacaatcaccaaaccaacaaacaccgataccgaaatacgttttacgacttcaacaacgaaatcttcgccatccgaccaccgcaacgactacgccaaaacgacgaaaaaatcccgtcaaaatttaacgcctacaccatcgaaataatcaaaaattcaaaaactcgtcctaactcgacaacatcccacaaaccnaaaaaaccgnaacccgcaactaacaaaaattaaaaataacattaccacgcccgcaaacgattataataatttcgactcactaatttacccgtaaaacaaaaataaccgcgataaaaacgccgcccacgattcataactttaataacttcccgcaaacgctatacgatacgcattatcctactccgaattcgcctacgctaacacaacgtctaattaaactattaacgccgatcccgataacgctaaataaaaaaacctaaaactttaaccacgactcgtaaaacgtactaattaaaatatatcctaacgctaatatcccgataatacaattaaatatcgacaataacaaacctaccgcctaacatttcgaaataaaacgcaaactaacaacgctacgaaataaaaaaataatattaatcgccaacgataacgtaatacataacctacgcacaacgaaataacacgataataattcaccgtatccgaaaacgacgtcgtttaataaatatataaaaacgaatctaacgtaacgaaaaccaataaaacaacatcctctaataaattacctcgaccataaaaaaaacacgttatcgaacccaacgaccaaacattatttaccgatattatatatattacga

SEQ ID NO: 6129 - DNA, 632 bp, Artificial Sequence
  chemically treated genomic DNA (Homo sapiens) CpG-island No: 6129
aatttcggcggcgaaagttcggatggcgtaatttgatagtcgtgagtgtcgtaagttgtttaattaggtaatggtttgtcgtatttcgttggaagtagaatatttgttggcgtaatttcgtatgatttaataagacgtatcgttggttatcgtcgagtgtattatattggaaagcgattggcgtagtaaagaagaagtgtttaaaggtatgatcgataatttgttgttggcgggtcgttgtcgttattcgcgtaaattggaagtcgatttgtgggcgcgcgaggtcgttttttttatcggtttgggttttagttttgttattttatatagtaaattagaatatattgagtaatttattattagcgtggcgcgtttgtaagcgtcggtgcgttggggcgatgatgaagcgtaatttattattatgttaattttgaataaatacgttgcgggcgattagtatatgcgtattttttcgcgtttcgttcgtcgtattatgtacgaagaatttcgtaacgcgttggttaacgtcgtttttgtcgacgttatcgttagtttgttgaatatgaattggattgtaaaggaatattatgaattgttttgatatcgtaacgtgtaaaatcgacgtttgtcgt

SEQ ID NO: 6130 - DNA, 632 bp, Artificial Sequence
  chemically treated genomic DNA (Homo sapiens) CpG-island No: 6130
acgacaaacgtcgattttacacgttacgatatcaaaacaattcataatattcctttacaatccaattcatattcaacaaactaacgataacgtcgacaaaaacgacgttaaccaacgcgttacgaaattcttcgtacataatacgacgaacgaaacgcgaaaaaatacgcatatactaatcgcccgcaacgtatttattcaaaattaacataataataaattacgcttcatcatcgccccaacgcaccgacgcttacaaacgcgccacgctaataataaattactcaatatattctaatttactatataaaataacaaaactaaaacccaaaccgataaaaaaaacgacctcgcgcgcccacaaatcgacttccaatttacgcgaataacgacaacgacccgccaacaacaaattatcgatcatacctttaaacacttcttctttactacgccaatcgctttccaatataatacactcgacgataaccaacgatacgtcttattaaatcatacgaaattacgccaacaaatattctacttccaacgaaatacgacaaaccattacctaattaaacaacttacgacactcacgactatcaaattacgccatccgaactttcgccgccgaaatt

SEQ ID NO: 6131 - DNA, 632 bp, Artificial Sequence
  chemically treated genomic DNA (Homo sapiens) CpG-island No: 6131
gcggtagacgtcgattttgtacgttacggtgttagaatagtttatgatgtttttttatagtttagtttatgtttagtaggttggcgatagcgtcggtagaggcggcgttaattagcgcgttacggaatttttcgtgtatgatgcggcgagcgaggcgcgagaaaatgcgtatatgttgatcgttcgtagcgtgtttgtttagggttaatataatgatgaattgcgttttattatcgttttagcgtatcggcgtttgtagacgcgttacgttgatggtggattgtttaatgtgttttgatttgttgtgtggaatggtaaaattaaagtttagatcggtagagaaaacggtttcgcgcgtttataagtcggtttttagtttacgcggatagcggtagcggttcgttagtagtaggttatcggttatgtttttgagtattttttttttgttgcgttagtcgttttttagtgtgatgtattcggcggtgattagcggtgcgttttgttgggttatgcggaattgcgttagtaggtgttttatttttagcgaagtacggtaggttattgtttggttgagtaatttgcggtatttacggttattaagttgcgttattcgagttttcgtcgtcggaatt

SEQ ID NO: 6132 - DNA, 632 bp, Artificial Sequence
  chemically treated genomic DNA (Homo sapiens) CpG-island No: 6132
aattccgacgacgaaaactcgaataacgcaacttaataaccgtaaataccgcaaattactcaaccaaacaataacctaccgtacttcgctaaaaataaaacacctactaacgcaattccgcataacccaacaaaacgcaccgctaatcaccgccgaatacatcacactaaaaaacgactaacgcaacaaaaaaaaaatactcaaaaacataaccgataacctactactaacgaaccgctaccgctatccgcgtaaactaaaaaccgacttataaacgcgcgaaaccgttttctctaccgatctaaactttaattttaccattccacacaacaaatcaaaacacattaaacaatccaccatcaacgtaacgcgtctacaaacgccgatacgctaaaacgataataaaacgcaattcatcattatattaaccctaaacaaacacgctacgaacgatcaacatatacgcattttctcgcgcctcgctcgccgcatcatacacgaaaaattccgtaacgcgctaattaacgccgcctctaccgacgctatcgccaacctactaaacataaactaaactataaaaaaacatcataaactattctaacaccgtaacgtacaaaatcgacgtctaccgc

SEQ ID NO: 6133 - DNA, 516 bp, Artificial Sequence
  chemically treated genomic DNA (Homo sapiens) CpG-island No: 6133
tttggcgatcgcgattcgttgcgcgcgtttggttataaatttttcgtgaggcggtttttagcggtattggtatatgtagttggttggcgatattaagggcgatgttaagatttttatgggtaagatcgattatgaaggcgggagaaagattttcgttgaggattttgtttggttaggaagtggtgaagtgatttttatcggcggcggtatcgtttattattttgacggtaatatcgaagggaagatttagggtttcgtataaaacggcggtttttgtcgaaagcgtattgagcgcgatgtttatgtagttgttgatgagtttaacgcggatttttatgttcggatcgttagcgttgattaatttattgtttatcgttattaggatcggtgtggtacgtttaatttgtttagcggtgtcgttagttagtagtaatagagtatcggtaatggtatttgtagaagtacggtttatcggaatatttattatgttgaagtttttggtttgtatatcggtaa

SEQ ID NO: 6134 - DNA, 516 bp, Artificial Sequence
  chemically treated genomic DNA (Homo sapiens) CpG-island No: 6134
ttaccgatatacaaaccaaaaacttcaacataataaatattccgataaaccgtacttctacaaataccattaccgatactctattactactaactaacgacaccgctaaacaaattaaacgtaccacaccgatcctaataacgataaacaataaattaatcaacgctaacgatccgaacataaaaatccgcgttaaactcatcaacaactacataaacatcgcgctcaatacgctttcgacaaaaaccgccgttttatacgaaaccctaaatcttcccttcgatattaccgtcaaaataataaacgataccgccgccgataaaaatcacttcaccacttcctaaccaaacaaaatcctcaacgaaaatctttctcccgccttcataatcgatcttacccataaaaatcttaacatcgcccttaatatcgccaaccaactacatataccaataccgctaaaaaccgcctcacgaaaaatttataaccaaacgcgcgcaacgaatcgcgatcgccaaa

SEQ ID NO: 6135 - DNA, 516 bp, Artificial Sequence
  chemically treated genomic DNA (Homo sapiens) CpG-island No: 6135
ttgtcgatatgtaagttaaaggttttagtatgatggatgtttcggtaggtcgtatttttgtaaatgttattatcggtattttgttattgttggttggcggtatcgttgaataagttgaacgtgttatatcgattttgatggcgatgggtagtgagttgattaacgttggcggttcgggtatggggattcgcgttaagtttattaataattatatgagtatcgcgtttaatgcgttttcggtagaagtcgtcgttttgtgcgaagttttgaatttttttttcgatgttgtcgttaaagtgatgagcggtatcgtcgtcggtaaaggttattttattattttttggttaaataaagtttttagcggagatttttttttcgtttttatgatcgattttgtttataaggattttggtatcgtttttgatgtcgttaattagttgtatgtgttaatgtcgttgggggtcgttttacgggaggtttatagttaggcgcgcgtagcgggtcgcggtcgttagg

SEQ ID NO: 6136 - DNA, 516 bp, Artificial Sequence
  chemically treated genomic DNA (Homo sapiens) CpG-island No: 6136
cctaacgaccgcgacccgctacgcgcgcctaactataaacctcccgtaaaacgacccccaacgacattaacacatacaactaattaacgacatcaaaaacgataccaaaatccttataaacaaaatcgatcataaaaacgaaaaaaaaatctccgctaaaaactttatttaaccaaaaaataataaaataacctttaccgacgacgataccgctcatcactttaacgacaacatcgaaaaaaaaattcaaaacttcgcacaaaacgacgacttctaccgaaaacgcattaaacgcgatactcatataattattaataaacttaacgcgaatccccatacccgaaccgccaacgttaatcaactcactacccatcgccatcaaaatcgatataacacgttcaacttattcaacgataccgccaaccaacaataacaaaataccgataataacatttacaaaaatacgacctaccgaaacatccatcatactaaaacctttaacttacatatcgacaa

SEQ ID NO: 6137 - DNA, 672 bp, Artificial Sequence
  chemically treated genomic DNA (Homo sapiens) CpG-island No: 6137
ttcgcgcgttttttattagcgtagggattttcgggttatagtttagagaatcggaaggtttttttttttttttcgagcgttgttattggggtcgaggtttttagtaagaattcgcgtgtttttgcgtacgtatatacggtgtatacgttagttcggcgttttttcgtgtttcgatttacgtaggttttttcgcgcgttcgtaatacgttcgtaggtttttgtgtttgttgtcggggtagcggggttcggaagggtaagaacgcggttcgttagcgggatggggattttggttcggtttggacgttgtttcgggcggggtttgggggcggagcgcgtcgggtcgggcgcgtagtagggatgttggttcgcgtttgcgtcgttcgcgtcgtttcgttttttgttttagcgttcggttcgtttcgttttttgttcggttttttttttcgcgtgtattttcggcgtatcgtttcgattcggcgtatatttcgtagtagcgtagcgaaagatttcgttttttcgttttgacgttgggtttgttttgggatttgaggatgtttaggagatcggtagggtttcgtttttgttttgatggtatttatcgttatcgttttttgatcggcgtatgaattttttcgtgttttagaattattagaaaaaaggatattagtaggt

SEQ ID NO: 6138 - DNA, 672 bp, Artificial Sequence
  chemically treated genomic DNA (Homo sapiens) CpG-island No: 6138
acctactaatatccttttttctaataattctaaaacacgaaaaaattcatacgccgatcaaaaaacgataacgataaataccatcaaaacaaaaacgaaaccctaccgatctcctaaacatcctcaaatcccaaaacaaacccaacgtcaaaacgaaaaaacgaaatctttcgctacgctactacgaaatatacgccgaatcgaaacgatacgccgaaaatacacgcgaaaaaaaaaaccgaacaaaaaacgaaacgaaccgaacgctaaaacaaaaaacgaaacgacgcgaacgacgcaaacgcgaaccaacatccctactacgcgcccgacccgacgcgctccgcccccaaaccccgcccgaaacaacgtccaaaccgaaccaaaatccccatcccgctaacgaaccgcgttcttacccttccgaaccccgctaccccgacaacaaacacaaaaacctacgaacgtattacgaacgcgcgaaaaaacctacgtaaatcgaaacacgaaaaaacgccgaactaacgtatacaccgtatatacgtacgcaaaaacacgcgaattcttactaaaaacctcgaccccaataacaacgctcgaaaaaaaaaaaaaaaccttccgattctctaaactataacccgaaaatccctacgctaataaaaaacgcgcgaa

SEQ ID NO: 6139 - DNA, 672 bp, Artificial Sequence
  chemically treated genomic DNA (Homo sapiens) CpG-island No: 6139
atttattaatgtttttttttttggtggttttagagtacggggggatttatacgtcggttaaagagcgatagcgatagatattattaaggtaggagcgaggttttgtcggttttttaggtatttttaagttttagggtaggtttagcgttagagcgaagaagcggggtttttcgttgcgttattacgagatgtgcgtcgggtcgaggcggtacgtcgggggtgtacgcgaaggagggagtcgagtagggagcggagcgaatcgagcgttagggtaaaggacggggcggcgcgaacggcgtaggcgcggattagtatttttattgcgcgttcggttcggcgcgtttcgtttttaggtttcgttcgggatagcgtttaggtcgggttagggtttttatttcgttagcgagtcgcgtttttattttttcgggtttcgttgtttcggtagtagatataggagtttgcgggcgtgttgcgggcgcgcgggaggatttgcgtgagtcggggtacggggaggcgtcggattgacgtgtgtatcgtgtgtgcgtgcgtagggatacgcgggtttttgttggaaatttcggttttagtggtagcgttcgggaagggggaggaggtttttcgattttttgagttgtggttcggaggtttttgcgttaatggaagacgcgcggg

SEQ ID NO: 6140 - DNA, 672 bp, Artificial Sequence
  chemically treated genomic DNA (Homo sapiens) CpG-island No: 6140
cccgcgcgtcttccattaacgcaaaaacctccgaaccacaactcaaaaaatcgaaaaacctcctcccccttcccgaacgctaccactaaaaccgaaatttccaacaaaaacccgcgtatccctacgcacgcacacacgatacacacgtcaatccgacgcctccccgtaccccgactcacgcaaatcctcccgcgcgcccgcaacacgcccgcaaactcctatatctactaccgaaacaacgaaacccgaaaaaataaaaacgcgactcgctaacgaaataaaaaccctaacccgacctaaacgctatcccgaacgaaacctaaaaacgaaacgcgccgaaccgaacgcgcaataaaaatactaatccgcgcctacgccgttcgcgccgccccgtcctttaccctaacgctcgattcgctccgctccctactcgactccctccttcgcgtacacccccgacgtaccgcctcgacccgacgcacatctcgtaataacgcaacgaaaaaccccgcttcttcgctctaacgctaaacctaccctaaaacttaaaaatacctaaaaaaccgacaaaacctcgctcctaccttaataatatctatcgctatcgctctttaaccgacgtataaatccccccgtactctaaaaccaccaaaaaaaaaaacattaataaat

SEQ ID NO: 6141 - DNA, 583 bp, Artificial Sequence
  chemically treated genomic DNA (Homo sapiens) CpG-island No: 6141
  misc_feature (348)..(348): n is either a, c, g or t
  misc_feature (446)..(446): n is either a, c, g or t
  misc_feature (484)..(484): n is either a, c, g or t
tttaagtcgattttcggtcggcgcgtttcgttttagaaggttttggtataggcgggcggtgtcgggcgttagtttttgcgggcgtgggtcggttagggcgcgtgggtttggggattcggggttacggtcgttacgtgagtttattttcgaggcggtagcgtggtcggtattcgttcgttggtttggttcggcgagcgtgggcggcgaacgggttttcgtcggatgtacgttggtgggatttagggttagagggcgtcgtcggggaaggttatttagacgcgcggttcgtcgggtttttacgcggtttgttttgattttcgttcgtaagttcgggttcgttttcgtcgntaggcggaggcgtatttggatttttgggttcgcgcgttttagattaaatttgttcgggatttcgttgtgttgatttttttggtcggtcgtttattaantaaggtcgcgttcggcggtcgcgattttttttcgcggncggtttgcgggggtttttttcgtttttttttagggtttttttttagtttttagggcgagaattttgacgtatataatagagaaaaatagagaataatat

SEQ ID NO: 6142 - DNA, 583 bp, Artificial Sequence
  chemically treated genomic DNA (Homo sapiens) CpG-island No: 6142
  misc_feature (100)..(100): n is either a, c, g or t
  misc_feature (138)..(138): n is either a, c, g or t
  misc_feature (236)..(236): n is either a, c, g or t
atattattctctatttttctctattatatacgtcaaaattctcgccctaaaaactaaaaaaaaaccctaaaaaaaaacgaaaaaaacccccgcaaaccgnccgcgaaaaaaaatcgcgaccgccgaacgcgaccttanttaataaacgaccgaccaaaaaaatcaacacaacgaaatcccgaacaaatttaatctaaaacgcgcgaacccaaaaatccaaatacgcctccgcctancgacgaaaacgaacccgaacttacgaacgaaaatcaaaacaaaccgcgtaaaaacccgacgaaccgcgcgtctaaataaccttccccgacgacgccctctaaccctaaatcccaccaacgtacatccgacgaaaacccgttcgccgcccacgctcgccgaaccaaaccaacgaacgaataccgaccacgctaccgcctcgaaaataaactcacgtaacgaccgtaaccccgaatccccaaacccacgcgccctaaccgacccacgcccgcaaaaactaacgcccgacaccgcccgcctataccaaaaccttctaaaacgaaacgcgccgaccgaaaatcgacttaaa

SEQ ID NO: 6143 - DNA, 583 bp, Artificial Sequence
  chemically treated genomic DNA (Homo sapiens) CpG-island No: 6143
  misc_feature (100)..(100): n is either a, c, g or t
  misc_feature (138)..(138): n is either a, c, g or t
  misc_feature (236)..(236): n is either a, c, g or t
gtattgttttttatttttttttattatatacgttaaagttttcgttttgggaattagaaggaggttttaaggaagagcggggagggttttcgtaagtcgntcgcggggagggatcgcgatcgtcgggcgcggttttgnttggtgagcggtcggttagaaaagttagtatagcggggtttcgaataggtttggtttgggacgcgcgagtttaagggtttagatacgttttcgtttgncggcgagagcgggttcgggtttgcgggcgaaagttaaggtaggtcgcgtggaggttcggcgggtcgcgcgtttaggtgatttttttcggcggcgttttttggttttggattttattagcgtgtattcggcggggattcgttcgtcgtttacgttcgtcggattaggttagcgggcgggtgtcggttacgttgtcgtttcggggatgagtttacgtgacgatcgtggtttcgagtttttaggtttacgcgttttggtcggtttacgttcgtagaagttggcgttcggtatcgttcgtttgtgttagagttttttagagcggaacgcgtcggtcgagagtcgatttagg

SEQ ID NO: 6144 - DNA, 583 bp, Artificial Sequence
  chemically treated genomic DNA (Homo sapiens) CpG-island No: 6144
  misc_feature (348)..(348): n is either a, c, g or t
  misc_feature (446)..(446): n is either a, c, g or t
  misc_feature (484)..(484): n is either a, c, g or t
cctaaatcgactctcgaccgacgcgttccgctctaaaaaactctaacacaaacgaacgataccgaacgccaacttctacgaacgtaaaccgaccaaaacgcgtaaacctaaaaactcgaaaccacgatcgtcacgtaaactcatccccgaaacgacaacgtaaccgacacccgcccgctaacctaatccgacgaacgtaaacgacgaacgaatccccgccgaatacacgctaataaaatccaaaaccaaaaaacgccgccgaaaaaaatcacctaaacgcgcgacccgccgaacctccacgcgacctaccttaactttcgcccgcaaacccgaacccgctctcgccgncaaacgaaaacgtatctaaacccttaaactcgcgcgtcccaaaccaaacctattcgaaaccccgctatactaacttttctaaccgaccgctcaccaancaaaaccgcgcccgacgatcgcgatccctccccgcgancgacttacgaaaaccctccccgctcttccttaaaacctccttctaattcccaaaacgaaaactttaacgtatataataaaaaaaaataaaaaacaatac

SEQ ID NO: 6145 - DNA, 507 bp, Artificial Sequence
  chemically treated genomic DNA (Homo sapiens) CpG-island No: 6145
gtttcgggtcgcggtcgttttttttacggtttcgtagttacgcgggatagcgcgggagcgtcgcgggaatcggacgttcggtttcgtttttcgtttcggattttttttcgtggtttcgggtcgaggttcgggtagtgattgtttttttttcgcgtaaagaggcggtaacgcggtagcgatttttttagggattagacgtttttttggggtcgcgaggaggacgcgtaggttttgtttgaggtattgacgtagcgggggcgatcgggcgggttgcggggacggcggggcggggtcgtttttttttttttcggtgggcgcggcgggttgagtcgggatgggcgtttcgtattcgggatgcgtcggtttgcgcgtggtcgtttttgtgggcgattgggagacgtggaggagagcgatttcggtcggtatgggggtggggatttttttgttacggggtttaggtcggatcggattaggtttttttttttcgtggggatcgggtttcggttt

SEQ ID NO: 6146 - DNA, 507 bp, Artificial Sequence
  chemically treated genomic DNA (Homo sapiens) CpG-island No: 6146
aaaccgaaacccgatccccacgaaaaaaaaaaacctaatccgatccgacctaaaccccgtaacaaaaaaatccccacccccataccgaccgaaatcgctctcctccacgtctcccaatcgcccacaaaaacgaccacgcgcaaaccgacgcatcccgaatacgaaacgcccatcccgactcaacccgccgcgcccaccgaaaaaaaaaaaaacgaccccgccccgccgtccccgcaacccgcccgatcgcccccgctacgtcaatacctcaaacaaaacctacgcgtcctcctcgcgaccccaaaaaaacgtctaatccctaaaaaaatcgctaccgcgttaccgcctctttacgcgaaaaaaaaacaatcactacccgaacctcgacccgaaaccacgaaaaaaaatccgaaacgaaaaacgaaaccgaacgtccgattcccgcgacgctcccgcgctatcccgcgtaactacgaaaccgtaaaaaaaacgaccgcgacccgaaac

SEQ ID NO: 6147 - DNA, 507 bp, Artificial Sequence
  chemically treated genomic DNA (Homo sapiens) CpG-island No: 6147
ggatcgaggttcggtttttacggaggggagggatttggttcggttcggtttggatttcgtaatagaggggtttttatttttatgtcgatcgaggtcgtttttttttacgttttttagtcgtttataaaggcggttacgcgtaggtcggcgtatttcgagtgcggggcgtttatttcgatttagttcgtcgcgtttatcgaggagaggagaggcgatttcgtttcgtcgttttcgtagttcgttcggtcgttttcgttgcgttagtgttttaggtagggtttgcgcgtttttttcgcgattttaaaggaacgtttggtttttagaagggtcgttgtcgcgttatcgtttttttgcgcggggaagaggtagttattgttcgaatttcggttcgaagttacgagagggagttcggggcggggagcggggtcgggcgttcgattttcgcggcgttttcgcgttgtttcgcgtggttgcgggatcgtggggagggcggtcgcggttcggagt

SEQ ID NO: 6148 - DNA, 507 bp, Artificial Sequence
  chemically treated genomic DNA (Homo sapiens) CpG-island No: 6148
actccgaaccgcgaccgccctccccacgatcccgcaaccacgcgaaacaacgcgaaaacgccgcgaaaatcgaacgcccgaccccgctccccgccccgaactccctctcgtaacttcgaaccgaaattcgaacaataactacctcttccccgcgcaaaaaaacgataacgcgacaacgacccttctaaaaaccaaacgttcctttaaaatcgcgaaaaaaacgcgcaaaccctacctaaaacactaacgcaacgaaaacgaccgaacgaactacgaaaacgacgaaacgaaatcgcctctcctctcctcgataaacgcgacgaactaaatcgaaataaacgccccgcactcgaaatacgccgacctacgcgtaaccgcctttataaacgactaaaaaacgtaaaaaaaaacgacctcgatcgacataaaaataaaaacccctctattacgaaatccaaaccgaaccgaaccaaatccctcccctccgtaaaaaccgaacctcgatcc

SEQ ID NO: 6149 - DNA, 565 bp, Artificial Sequence
  chemically treated genomic DNA (Homo sapiens) CpG-island No: 6149
ggttcggtcgacgatagtttttcggtaggggttcggggtagatcggcgtttttagtttaggttttcggacgtttgtttgcgggcggaggcgcggagaggttgcggcgtcgggattcgcggacggcgttgaggaggcggttcgggcgggcgcggtatttatcgttatatcgttggttgtttttcggagtttttttcgtcggtttcgagtggggttttgttcgttcggacgttggggttttttcgtgggttttttcgtgggtttcgtgggtttcgttggcgtttcgcggcgttttacgttttcgttcgttcggtttttagtttttataattcgtagtttttcgagaggtggcggggaaggtggcggggaaggggtcggtgttttttttcgtttcgatttgtttttatgtggttttacggattgttcgtttgtattatacgtacgaggtatttcgagatattttcgaatgttagattttaggggttagtgtgagggggttcgtatgggtgttcggtttttttacggttttcgtgtgtcgggcgttgtatacgttggggttttcgggcg

SEQ ID NO: 6150 - DNA, 565 bp, Artificial Sequence
  chemically treated genomic DNA (Homo sapiens) CpG-island No: 6150
cgcccgaaaaccccaacgtatacaacgcccgacacacgaaaaccgtaaaaaaaccgaacacccatacgaaccccctcacactaacccctaaaatctaacattcgaaaatatctcgaaatacctcgtacgtataatacaaacgaacaatccgtaaaaccacataaaaacaaatcgaaacgaaaaaaaacaccgaccccttccccgccaccttccccgccacctctcgaaaaactacgaattataaaaactaaaaaccgaacgaacgaaaacgtaaaacgccgcgaaacgccaacgaaacccacgaaacccacgaaaaaacccacgaaaaaaccccaacgtccgaacgaacaaaaccccactcgaaaccgacgaaaaaaactccgaaaaacaaccaacgatataacgataaataccgcgcccgcccgaaccgcctcctcaacgccgtccgcgaatcccgacgccgcaacctctccgcgcctccgcccgcaaacaaacgtccgaaaacctaaactaaaaacgccgatctaccccgaacccctaccgaaaaactatcgtcgaccgaacc

SEQ ID NO: 6151 - DNA, 565 bp, Artificial Sequence
  chemically treated genomic DNA (Homo sapiens) CpG-island No: 6151
cgttcgggagttttagcgtatataacgttcgatatacgggaatcgtgggaagatcgaatatttatacgggtttttttatattggtttttggggtttaatattcgagggtgtttcgggatgtttcgtacgtgtggtatagacgaataattcgtggggttatatgggagtagatcgggacgggaggaagtatcgatttttttttcgttatttttttcgttatttttcggagggttacgggttataagggttggaggtcgagcggacgggagcgtggagcgtcgcggagcgttaacggagtttacggagtttacggaggagtttacggaggagttttagcgttcgaacgggtagaattttattcgaggtcgacgaagagagtttcgagaagtagttaacgatgtgacggtgagtgtcgcgttcgttcgagtcgtttttttaacgtcgttcgcgggtttcggcgtcgtagttttttcgcgttttcgttcgtaagtaggcgttcgaggatttggattgggggcgtcgatttgtttcgggtttttatcgaggggttgtcgtcggtcgggtt

SEQ ID NO: 6152 - DNA, 565 bp, Artificial Sequence
  chemically treated genomic DNA (Homo sapiens) CpG-island No: 6152
aacccgaccgacgacaacccctcgataaaaacccgaaacaaatcgacgcccccaatccaaatcctcgaacgcctacttacgaacgaaaacgcgaaaaaactacgacgccgaaacccgcgaacgacgttaaaaaaacgactcgaacgaacgcgacactcaccgtcacatcgttaactacttctcgaaactctcttcgtcgacctcgaataaaattctacccgttcgaacgctaaaactcctccgtaaactcctccgtaaactccgtaaactccgttaacgctccgcgacgctccacgctcccgtccgctcgacctccaacccttataacccgtaaccctccgaaaaataacgaaaaaaataacgaaaaaaaaatcgatacttcctcccgtcccgatctactcccatataaccccacgaattattcgtctataccacacgtacgaaacatcccgaaacaccctcgaatattaaaccccaaaaaccaatataaaaaaacccgtataaatattcgatcttcccacgattcccgtatatcgaacgttatatacgctaaaactcccgaacg

SEQ ID NO: 6153 - DNA, 568 bp, Artificial Sequence
  chemically treated genomic DNA (Homo sapiens) CpG-island No: 6153
tagagcgagggttcgtattatcgcgttttcggaattcgcgtgatttttgtttttgtcgcgtttttatttgagtgataggtttgttttagagtttcgtagatttttaagtttggtttttattttgcgtggagagaacgttcgggtttggcggagagacgagaaaatcgaggttttcggaggtagataaggattttgttaaaatcggacgtcgcggcggtggtagaattcgattttgggatttgtcgcggagttcgagtttgaaggcgagggtttcgtaggttgtgaacgaagttggaggcgttttaggaagtttcgattttattcgcgtcgagttgttttttttttagatttgtttcgcgttgtaggttcgcgagggattcgggggtttttacgtttggggtcggaattcgattttttagtgaggtattaaggttcgcgttttttcgttttggttttcggtcgtttttttcgttttttttgtattttgggtttttcgtttttcgaggaaggttacgagaatcggtttaacgtttgcgtattttgaagttttttttttttttaaaaaaat

SEQ ID NO: 6154 - DNA, 568 bp, Artificial Sequence
  chemically treated genomic DNA (Homo sapiens) CpG-island No: 6154
atttttttaaaaaaaaaaaaaacttcaaaatacgcaaacgttaaaccgattctcgtaaccttcctcgaaaaacgaaaaacccaaaatacaaaaaaaacgaaaaaaacgaccgaaaaccaaaacgaaaaaacgcgaaccttaatacctcactaaaaaatcgaattccgaccccaaacgtaaaaacccccgaatccctcgcgaacctacaacgcgaaacaaatctaaaaaaaaaacaactcgacgcgaataaaatcgaaacttcctaaaacgcctccaacttcgttcacaacctacgaaaccctcgccttcaaactcgaactccgcgacaaatcccaaaatcgaattctaccaccgccgcgacgtccgattttaacaaaatccttatctacctccgaaaacctcgattttctcgtctctccgccaaacccgaacgttctctccacgcaaaataaaaaccaaacttaaaaatctacgaaactctaaaacaaacctatcactcaaataaaaacgcgacaaaaacaaaaatcacgcgaattccgaaaacgcgataatacgaaccctcgctcta

SEQ ID NO: 6155 - DNA, 568 bp, Artificial Sequence
  chemically treated genomic DNA (Homo sapiens) CpG-island No: 6155
atttttttaagaaaaaaaaaaattttaaagtgcgtaaacgttgggtcggttttcgtgatttttttcgggagacgaggggtttagagtgtagggggaacgggagggacggtcgggaattagggcggagaaacgcgggttttggtgttttattggggggtcggatttcgattttaggcgtaggaattttcgggtttttcgcgggtttgtagcgcgaggtagatttggggagggggtagttcggcgcgggtggggtcggggttttttggggcgtttttagtttcgtttataatttgcggaattttcgtttttaagttcgggtttcgcggtaaattttagggtcgaattttgttatcgtcgcggcgttcggttttggtagagtttttgtttgttttcgggagtttcggttttttcgttttttcgttaagttcgggcgttttttttacgtagggtgagggttaggtttagaggtttgcggagttttgaaataagtttgttatttagataggagcgcggtaggaataggggttacgcgggtttcggaagcgcgatgatgcggattttcgttttg

SEQ ID NO: 6156 - DNA, 568 bp, Artificial Sequence
  chemically treated genomic DNA (Homo sapiens) CpG-island No: 6156
caaaacgaaaatccgcatcatcgcgcttccgaaacccgcgtaacccctattcctaccgcgctcctatctaaataacaaacttatttcaaaactccgcaaacctctaaacctaaccctcaccctacgtaaaaaaaacgcccgaacttaacgaaaaaacgaaaaaaccgaaactcccgaaaacaaacaaaaactctaccaaaaccgaacgccgcgacgataacaaaattcgaccctaaaatttaccgcgaaacccgaacttaaaaacgaaaattccgcaaattataaacgaaactaaaaacgccccaaaaaaccccgaccccacccgcgccgaactaccccctccccaaatctacctcgcgctacaaacccgcgaaaaacccgaaaattcctacgcctaaaatcgaaatccgaccccccaataaaacaccaaaacccgcgtttctccgccctaattcccgaccgtccctcccgttccccctacactctaaacccctcgtctcccgaaaaaaatcacgaaaaccgacccaacgtttacgcactttaaaatttttttttttcttaaaaaaat

SEQ ID NO: 6157 - DNA, 694 bp, Artificial Sequence
  chemically treated genomic DNA (Homo sapiens) CpG-island No: 6157
  misc_feature (569)..(569): n is either a, c, g or t
aatttgggggtgaaaacggttatcgttacgcgcggatcgttgatttttgtttagagtttttcggcgaatgttagttataacgagtattagtatgttattgtgtaggttcgcgttgtcgggtttatcgataaggtgtattcgtttatcgtgggcgataaagtataaaagggtatatcgtttttcgatttgattatttttgattgggtggaagcgtagagtgagtatttattgttgcgcgaaatcggcggtacggcgatttagattgaaggtatttttgagcggttgcgattggcgggaatgtcggaggcggatattcgtcgtttgatcgttacgtaaaaaatttagattcgttttacgtttaaagcgtttattgatggcgtgattatcgcgtttgatttgcgcgcgggaatgaatatcgttaaagataacgtggtagcgaaaatttagggtatggattcggtgtgggttattgttgcgatttcggagtttatcgtttggttggtgaaagatgtttcgtagtttatttttatcgttttcgcgcgatcggataaaatatttattattcgtanatggacgttgttatttggcgtggatgtcgcgatcgtacgttgtattgcgtttggagtcgataacgcgacgagcgttaaaatcggtatgagtttatgtgttttaaagaatattttttgtattttat

SEQ ID NO: 6158 - DNA, 694 bp, Artificial Sequence
  chemically treated genomic DNA (Homo sapiens) CpG-island No: 6158
  misc_feature (126)..(126): n is either a, c, g or t
ataaaatacaaaaaatattctttaaaacacataaactcataccgattttaacgctcgtcgcgttatcgactccaaacgcaatacaacgtacgatcgcgacatccacgccaaataacaacgtccatntacgaataataaatattttatccgatcgcgcgaaaacgataaaaataaactacgaaacatctttcaccaaccaaacgataaactccgaaatcgcaacaataacccacaccgaatccataccctaaattttcgctaccacgttatctttaacgatattcattcccgcgcgcaaatcaaacgcgataatcacgccatcaataaacgctttaaacgtaaaacgaatctaaattttttacgtaacgatcaaacgacgaatatccgcctccgacattcccgccaatcgcaaccgctcaaaaataccttcaatctaaatcgccgtaccgccgatttcgcgcaacaataaatactcactctacgcttccacccaatcaaaaataatcaaatcgaaaaacgatatacccttttatactttatcgcccacgataaacgaatacaccttatcgataaacccgacaacgcgaacctacacaataacatactaatactcgttataactaacattcgccgaaaaactctaaacaaaaatcaacgatccgcgcgtaacgataaccgttttcacccccaaatt

SEQ ID NO: 6159 - DNA, 694 bp, Artificial Sequence
  chemically treated genomic DNA (Homo sapiens) CpG-island No: 6159
  misc_feature (126)..(126): n is either a, c, g or t
gtgaggtatagaggatgttttttagagtatatgggtttatgtcggttttagcgttcgtcgcgttgtcgattttagacgtagtgtagcgtgcggtcgcggtatttacgttaggtagtagcgtttatntgcggatggtgagtgttttattcggtcgcgcgggagcggtgagggtaaattgcgaggtattttttattagttaggcgatagatttcgggatcgtagtagtgatttatatcgggtttatattttgaattttcgttattacgttatttttggcgatatttattttcgcgcgtagattaaacgcggtgattacgttattaatgggcgttttgagcgtaaagcgagtttggattttttgcgtggcgattaggcggcgaatattcgttttcggtattttcgttagtcgtagtcgtttaagaatgtttttagtttgggtcgtcgtatcgtcggtttcgcgtagtagtaaatatttattttgcgtttttatttagttaggaatggttaggtcgagaagcggtgtgtttttttgtattttatcgtttacggtaagcggatatattttgtcgataaattcggtagcgcgagtttgtataatggtatattgatattcgttgtaattgatattcgtcgggaaattttgggtaaaagttagcggttcgcgcgtgacggtagtcgtttttatttttagatt

SEQ ID NO: 6160 - DNA, 694 bp, Artificial Sequence
  chemically treated genomic DNA (Homo sapiens) CpG-island No: 6160
  misc_feature (569)..(569): n is either a, c, g or t
aatctaaaaataaaaacgactaccgtcacgcgcgaaccgctaacttttacccaaaatttcccgacgaatatcaattacaacgaatatcaatataccattatacaaactcgcgctaccgaatttatcgacaaaatatatccgcttaccgtaaacgataaaatacaaaaaaacacaccgcttctcgacctaaccattcctaactaaataaaaacgcaaaataaatatttactactacgcgaaaccgacgatacgacgacccaaactaaaaacattcttaaacgactacgactaacgaaaataccgaaaacgaatattcgccgcctaatcgccacgcaaaaaatccaaactcgctttacgctcaaaacgcccattaataacgtaatcaccgcgtttaatctacgcgcgaaaataaatatcgccaaaaataacgtaataacgaaaattcaaaatataaacccgatataaatcactactacgatcccgaaatctatcgcctaactaataaaaaatacctcgcaatttaccctcaccgctcccgcgcgaccgaataaaacactcaccatccgcanataaacgctactacctaacgtaaataccgcgaccgcacgctacactacgtctaaaatcgacaacgcgacgaacgctaaaaccgacataaacccatatactctaaaaaacatcctctatacctcac

SEQ ID NO: 6161 - DNA, 882 bp, Artificial Sequence
  chemically treated genomic DNA (Homo sapiens) CpG-island No: 6161
  misc_feature (206)..(206): n is either a, c, g or t
agggttgagttagtatcgcgtatacgatagtcgtggatagttaattgtcgtgaaagatacgtagggttatgaaacgcggtatgaatataatatcgtcggtgatttgatcgtcgttattgtttcggacggtagtagaaacgggatatagtacgatgcgtggggaaaggtcgttcgtattacgtagggcggttttgacgcgtagtatnggaatacgattgttgtcggacgggttattcgtttgattagtgaaaacggtagttatattatttttcgttacgatgtatttgatcggttgatataggaaatcggttttgacggtcgtatatagcgttattattacgatttgatcggtaaatttattcgtagcgaggatgagggtttggttatttattggtattatgacgaagtagatcgttttacgtatcgtatcgtgaagggtgaaatcgtagagcggtggtagtatgacgaacgtggttggttgatagatattagttatattagcgaagggtatcgggtggcggtgtattataggtatgatgagaaaggtcggttgatcggtgagcgttagacggtgtattattcgtagacggaagtattgttttggtagtatgagattagatatgcgtataacgcgtaggggttggcgaatcgttgtatatcggatagtttgttcgtcgtggaatggttgatttacggtagcggttatttggtaggtatgaaattcggcgatatatcgttggtggagtatattcgcgatcgtttgtatcgggaaacgttgcgtagtttcggtcgttatgaatttattatcgtttatatttttgtcgggtagttatagagttagtatttgaatagtttgttgatttataggtatgtaaatttcgt

SEQ ID NO: 6162 - DNA, 882 bp, Artificial Sequence
  chemically treated genomic DNA (Homo sapiens) CpG-island No: 6162
  misc_feature (677)..(677): n is either a, c, g or t
acgaaatttacatacctataaatcaacaaactattcaaatactaactctataactacccgacaaaaatataaacgataataaattcataacgaccgaaactacgcaacgtttcccgatacaaacgatcgcgaatatactccaccaacgatatatcgccgaatttcatacctaccaaataaccgctaccgtaaatcaaccattccacgacgaacaaactatccgatatacaacgattcgccaacccctacgcgttatacgcatatctaatctcatactaccaaaacaatacttccgtctacgaataatacaccgtctaacgctcaccgatcaaccgacctttctcatcatacctataatacaccgccacccgatacccttcgctaatataactaatatctatcaaccaaccacgttcgtcatactaccaccgctctacgatttcacccttcacgatacgatacgtaaaacgatctacttcgtcataataccaataaataaccaaaccctcatcctcgctacgaataaatttaccgatcaaatcgtaataataacgctatatacgaccgtcaaaaccgatttcctatatcaaccgatcaaatacatcgtaacgaaaaataatataactaccgttttcactaatcaaacgaataacccgtccgacaacaatcgtattccnatactacgcgtcaaaaccgccctacgtaatacgaacgacctttccccacgcatcgtactatatcccgtttctactaccgtccgaaacaataacgacgatcaaatcaccgacgatattatattcataccgcgtttcataaccctacgtatctttcacgacaattaactatccacgactatcgtatacgcgatactaactcaaccct

SEQ ID NO: 6163 - DNA, 882 bp, Artificial Sequence
  chemically treated genomic DNA (Homo sapiens) CpG-island No: 6163
  misc_feature (677)..(677): n is either a, c, g or t
gcgaagtttgtatgtttgtaggttagtaggttgtttaggtgttggttttgtaattgttcggtaggggtataagcggtggtgagtttataacggtcgaagttgcgtagcgtttttcggtgtaggcggtcgcgggtgtattttattagcggtgtgtcgtcgagttttatgtttgttaggtaatcgttgtcgtaggttagttattttacggcgggtaggttgttcggtatatagcggttcgttagtttttgcgcgttgtacgtatgtttggttttatgttgttagagtagtgttttcgtttgcgggtgatgtatcgtttgacgtttatcggttagtcggttttttttattatatttgtaatgtatcgttattcggtgtttttcgttgatatggttgatgtttgttagttagttacgttcgttatattgttatcgttttgcggttttattttttacggtgcggtgcgtgaggcggtttgtttcgttatagtgttagtgggtgattagatttttattttcgttgcggataagtttgtcggttaggtcgtggtgataacgttgtgtgcggtcgttaaagtcggttttttgtattagtcggttaagtatatcgtaacggaaggtggtgtggttgtcgtttttattggttaggcggatgattcgttcggtagtagtcgtattttnatattgcgcgttagggtcgttttgcgtggtacggacggtttttttttacgtatcgtattgtgtttcgtttttgttgtcgttcggggtaatgacggcggttaggttatcggcgatgttgtatttatatcgcgttttatggttttgcgtgttttttacggtaattaattgtttacggttgtcgtatgcgcggtattgatttagtttt

SEQ ID NO: 6164 - DNA, 882 bp, Artificial Sequence
  chemically treated genomic DNA (Homo sapiens) CpG-island No: 6164
  misc_feature (206)..(206): n is either a, c, g or t
aaaactaaatcaataccgcgcatacgacaaccgtaaacaattaattaccgtaaaaaacacgcaaaaccataaaacgcgatataaatacaacatcgccgataacctaaccgccgtcattaccccgaacgacaacaaaaacgaaacacaatacgatacgtaaaaaaaaaccgtccgtaccacgcaaaacgaccctaacgcgcaatatnaaaatacgactactaccgaacgaatcatccgcctaaccaataaaaacgacaaccacaccaccttccgttacgatatacttaaccgactaatacaaaaaaccgactttaacgaccgcacacaacgttatcaccacgacctaaccgacaaacttatccgcaacgaaaataaaaatctaatcacccactaacactataacgaaacaaaccgcctcacgcaccgcaccgtaaaaaataaaaccgcaaaacgataacaatataacgaacgtaactaactaacaaacatcaaccatatcaacgaaaaacaccgaataacgatacattacaaatataataaaaaaaaccgactaaccgataaacgtcaaacgatacatcacccgcaaacgaaaacactactctaacaacataaaaccaaacatacgtacaacgcgcaaaaactaacgaaccgctatataccgaacaacctacccgccgtaaaataactaacctacgacaacgattacctaacaaacataaaactcgacgacacaccgctaataaaatacacccgcgaccgcctacaccgaaaaacgctacgcaacttcgaccgttataaactcaccaccgcttatacccctaccgaacaattacaaaaccaacacctaaacaacctactaacctacaaacatacaaacttcgc

SEQ ID NO: 6165 - DNA, 726 bp, Artificial Sequence
  chemically treated genomic DNA (Homo sapiens) CpG-island No: 6165
tggtggcgcgtatgtcgtatgttgtaagtagatcgtgttagaaatgatcgttatgttagatatttgtttttgtgaatatattttttacggttattgcggtgtgttgtgcgagtatggttcgataacgatcgattttggaaaatttaggtaagtaagtcgtggttgtagttgttgtaggtgtagattttatcgtttttttcgtcgcgatggacggttaggtataggcgattcgttaggcgttggacgttgcgggatttaaagatacggcgattatgtcgtattcgattaagttcgttttttttttttatggttcgtttcgtgaagttgtcggaagcgtattaaaaggcgatcgtaaaagttattagatgaatttaatgaatcgtcgtgaggcgattcgtgaattattgttggatgaagtttagggcgtagattgtttgatggttagatttgttggagcgtatttcgatatcgtgcgtgattggcgtggacgtattggattgttcgtggcgtatattaggtgaatcgtgggtatgcggtgatttagttttcgcgttgttttcgtgtttgtaggtttttatttttgtcgaatcgcgatttgtgttggcgatagtgagtgttcggcggtatgggttcgtaatttgcggtgattttggcggtaattttgttggtggtgtcgcgcgagttgatgcgtgattttaacgaatatagtatgttaatgttcggtgg

SEQ ID NO: 6166 - DNA, 726 bp, Artificial Sequence
  chemically treated genomic DNA (Homo sapiens) CpG-island No: 6166
ccaccgaacattaacatactatattcgttaaaatcacgcatcaactcgcgcgacaccaccaacaaaattaccgccaaaatcaccgcaaattacgaacccataccgccgaacactcactatcgccaacacaaatcgcgattcgacaaaaataaaaacctacaaacacgaaaacaacgcgaaaactaaatcaccgcatacccacgattcacctaatatacgccacgaacaatccaatacgtccacgccaatcacgcacgatatcgaaatacgctccaacaaatctaaccatcaaacaatctacgccctaaacttcatccaacaataattcacgaatcgcctcacgacgattcattaaattcatctaataacttttacgatcgccttttaatacgcttccgacaacttcacgaaacgaaccataaaaaaaaaaaacgaacttaatcgaatacgacataatcgccgtatctttaaatcccgcaacgtccaacgcctaacgaatcgcctatacctaaccgtccatcgcgacgaaaaaaacgataaaatctacacctacaacaactacaaccacgacttacttacctaaattttccaaaatcgatcgttatcgaaccatactcgcacaacacaccgcaataaccgtaaaaaatatattcacaaaaacaaatatctaacataacgatcatttctaacacgatctacttacaacatacgacatacgcgccacca

SEQ ID NO: 6167 - DNA, 726 bp, Artificial Sequence
  chemically treated genomic DNA (Homo sapiens) CpG-island No: 6167
ttatcgagtattaatatgttgtattcgttgaaattacgtattaattcgcgcgatattattagtaaaattgtcgttagaattatcgtaaattgcgagtttatatcgtcgagtatttattatcgttagtataaatcgcgattcggtaaaggtgaagatttgtaaatacgagagtagcgcgggaattaaattatcgtatatttacggtttatttgatatgcgttacgggtaatttagtacgtttacgttagttacgtacgatgtcgaggtacgttttagtaggtttaattattaggtagtttgcgttttgggttttatttagtagtgatttacgaatcgttttacgacggtttattgggtttatttgatagtttttgcggtcgttttttaatgcgttttcggtagttttacggaacgggttataaaaggaggaggcgaatttggtcgaatacgatataatcgtcgtatttttaaatttcgtagcgtttagcgtttgacgaatcgtttgtatttggtcgtttatcgcggcggaaggggcgatgaagtttgtatttgtagtagttgtaattacggtttgtttgtttaaattttttagagtcggtcgttgtcgagttatgttcgtatagtatatcgtagtgatcgtgagaagtgtatttatagaagtaggtgtttgatataacgattatttttggtacggtttgtttgtagtatgcgatatacgcgttatta

SEQ ID NO: 6168 - DNA, 726 bp, Artificial Sequence
  chemically treated genomic DNA (Homo sapiens) CpG-island No: 6168
taataacgcgtatatcgcatactacaaacaaaccgtaccaaaaataatcgttatatcaaacacctacttctataaatacacttctcacgatcactacgatatactatacgaacataactcgacaacgaccgactctaaaaaatttaaacaaacaaaccgtaattacaactactacaaatacaaacttcatcgccccttccgccgcgataaacgaccaaatacaaacgattcgtcaaacgctaaacgctacgaaatttaaaaatacgacgattatatcgtattcgaccaaattcgcctcctccttttataacccgttccgtaaaactaccgaaaacgcattaaaaaacgaccgcaaaaactatcaaataaacccaataaaccgtcgtaaaacgattcgtaaatcactactaaataaaacccaaaacgcaaactacctaataattaaacctactaaaacgtacctcgacatcgtacgtaactaacgtaaacgtactaaattacccgtaacgcatatcaaataaaccgtaaatatacgataatttaattcccgcgctactctcgtatttacaaatcttcacctttaccgaatcgcgatttatactaacgataataaatactcgacgatataaactcgcaatttacgataattctaacgacaattttactaataatatcgcgcgaattaatacgtaatttcaacgaatacaacatattaatactcgataa

SEQ ID NO: 6169 - DNA, 607 bp, Artificial Sequence
  chemically treated genomic DNA (Homo sapiens) CpG-island No: 6169
acgttgttgttcgggacgcggttcggggttggtgggaataggggcgtttttttgcgcgtttttttttttagcgttttatttttcggcggcggcggggaaagttttttcgaaagcgtgaagggggattggaggaggtttttatttttttttgtgcgggtggttggggtcggatcgaggcggcgggggtcgcgggattgggggtttttcgttgagtcgagaggagcgcgataaaggatgcgtttcgtcggggttatagttttcgcggtttaattttgcgcgcggcgttcgcgtttttggggagttcgttcgttgcgttgagaatttaggcgttcgggttgggagaggggtcgggagcgttcgtaggtggcgttggttcggatttttcgattttaggaagggatttcggagttttttggaggcggcgggcggtcgtgtcgttttagggaatcgcgttgttcgcggaaatttcgcgcgttttcgcggatgtttttcgttttagtttttagcgcgcggggttcggggttttgcgaggtttttttttttttcgcggtgttttttaagttgggttaaggcgggttttttttttttttttttttgtcgttttttt

SEQ ID NO: 6170 - DNA, 607 bp, Artificial Sequence
  chemically treated genomic DNA (Homo sapiens) CpG-island No: 6170
aaaaaaacgacaaaaaaaaaaaaaaaaaaaacccgccttaacccaacttaaaaaacaccgcgaaaaaaaaaaaaacctcgcaaaaccccgaaccccgcgcgctaaaaactaaaacgaaaaacatccgcgaaaacgcgcgaaatttccgcgaacaacgcgattccctaaaacgacacgaccgcccgccgcctccaaaaaactccgaaatcccttcctaaaatcgaaaaatccgaaccaacgccacctacgaacgctcccgacccctctcccaacccgaacgcctaaattctcaacgcaacgaacgaactccccaaaaacgcgaacgccgcgcgcaaaattaaaccgcgaaaactataaccccgacgaaacgcatcctttatcgcgctcctctcgactcaacgaaaaacccccaatcccgcgacccccgccgcctcgatccgaccccaaccacccgcacaaaaaaaaataaaaacctcctccaatcccccttcacgctttcgaaaaaactttccccgccgccgccgaaaaataaaacgctaaaaaaaaaaacgcgcaaaaaaacgcccctattcccaccaaccccgaaccgcgtcccgaacaacaacgt

SEQ ID NO: 6171 - DNA, 607 bp, Artificial Sequence
  chemically treated genomic DNA (Homo sapiens) CpG-island No: 6171
aaggaggcgatagaggagggaggaagagaagttcgttttagtttagtttgggaagtatcgcgggggaaggggggatttcgtagggtttcgaatttcgcgcgttgggggttagggcgaggggtattcgcggaggcgcgcggagttttcgcgggtagcgcggttttttggagcgatacggtcgttcgtcgtttttaggaagtttcgggatttttttttggggtcgggagattcgggttagcgttatttgcggacgttttcggttttttttttagttcggacgtttgggtttttagcgtagcgggcgggttttttaggggcgcgggcgtcgcgcgtaaagttgggtcgcggagattgtgatttcggcgggacgtattttttgtcgcgtttttttcggtttagcggggagtttttagtttcgcggttttcgtcgtttcgattcggttttagttattcgtataaagggaaataaaaattttttttaatttttttttacgttttcggagagatttttttcgtcgtcgtcgggaggtgggacgttggggaggggggcgcgtaggaggacgtttttgtttttattagtttcgggtcgcgtttcgggtagtagcgt

SEQ ID NO: 6172 - DNA, 607 bp, Artificial Sequence
  chemically treated genomic DNA (Homo sapiens) CpG-island No: 6172
acgctactacccgaaacgcgacccgaaactaataaaaacaaaaacgtcctcctacgcgcccccctccccaacgtcccacctcccgacgacgacgaaaaaaatctctccgaaaacgtaaaaaaaaattaaaaaaaatttttatttccctttatacgaataactaaaaccgaatcgaaacgacgaaaaccgcgaaactaaaaactccccgctaaaccgaaaaaaacgcgacaaaaaatacgtcccgccgaaatcacaatctccgcgacccaactttacgcgcgacgcccgcgcccctaaaaaacccgcccgctacgctaaaaacccaaacgtccgaactaaaaaaaaaaccgaaaacgtccgcaaataacgctaacccgaatctcccgaccccaaaaaaaaatcccgaaacttcctaaaaacgacgaacgaccgtatcgctccaaaaaaccgcgctacccgcgaaaactccgcgcgcctccgcgaatacccctcgccctaacccccaacgcgcgaaattcgaaaccctacgaaatccccccttcccccgcgatacttcccaaactaaactaaaacgaacttctcttcctccctcctctatcgcctcctt

SEQ ID NO: 6173 - DNA, 557 bp, Artificial Sequence
  chemically treated genomic DNA (Homo sapiens) CpG-island No: 6173
gatgaatcgatttcggtaacggcgttcgtgttcgttagcgtgttagtcgataagaatcgaaagttagcgtattcgcgaaattattattgtttagttgtcggaaggttagtttatcgaaagtttggtcgtatagttgatggaaaaagtgatgaaggaaaaatagtcgttggagtagggcgtaatgtagtcgagttttaaatcggtgatcggtaaaggcggtattaaagtgattgatggtagtagcgttaagtttggtcgtttcgacggcgtagagtcgtattgcgtgggtttgattgattttgtgatcggagacgacggtagtagtatggtcgtcggttttatgtagtgggagaacgtatttttttcgtggattttgaattacgacgaaatcgatatggtgttggaaggggagttgtatgttcgttacgaaggttaaattatgatcgttaaagtaggcgacgtgatgtttatttcgaaaggttttagtatcgaatttggtacgatatttagcgtgaaatttttgtatgtcgtttggttcgttaattggtaatttttat

SEQ ID NO: 6174 - DNA, 557 bp, Artificial Sequence
  chemically treated genomic DNA (Homo sapiens) CpG-island No: 6174
ataaaaattaccaattaacgaaccaaacgacatacaaaaatttcacgctaaatatcgtaccaaattcgatactaaaacctttcgaaataaacatcacgtcgcctactttaacgatcataatttaaccttcgtaacgaacatacaactccccttccaacaccatatcgatttcgtcgtaattcaaaatccacgaaaaaaatacgttctcccactacataaaaccgacgaccatactactaccgtcgtctccgatcacaaaatcaatcaaacccacgcaatacgactctacgccgtcgaaacgaccaaacttaacgctactaccatcaatcactttaataccgcctttaccgatcaccgatttaaaactcgactacattacgccctactccaacgactatttttccttcatcactttttccatcaactatacgaccaaactttcgataaactaaccttccgacaactaaacaataataatttcgcgaatacgctaactttcgattcttatcgactaacacgctaacgaacacgaacgccgttaccgaaatcgattcatc

SEQ ID NO: 6175 - DNA, 557 bp, Artificial Sequence
  chemically treated genomic DNA (Homo sapiens) CpG-island No: 6175
atagggattgttagttagcgggttaggcgatatataggaattttacgttggatgtcgtattaaattcgatgttggagtttttcgggataaatattacgtcgtttgttttggcgattatggtttggttttcgtggcgaatatgtagttttttttttagtattatgtcgatttcgtcgtagtttagggtttacgggaagaatgcgtttttttattgtataaaatcggcggttatgttgttgtcgtcgttttcggttataagattagttaagtttacgtaatgcggttttgcgtcgtcgaaacgattaaatttgacgttattgttattaattattttgatgtcgtttttgtcggttatcgatttgaagttcggttgtattgcgttttgttttagcgattgttttttttttattattttttttattagttgtgcgattaggttttcggtaaattggtttttcggtagttgggtaatgatggtttcgcggatgcgttggttttcggtttttgtcggttggtacgttggcgggtacggacgtcgttatcgggatcgatttatt

SEQ ID NO: 6176 - DNA, 557 bp, Artificial Sequence
  chemically treated genomic DNA (Homo sapiens) CpG-island No: 6176
aataaatcgatcccgataacgacgtccgtacccgccaacgtaccaaccgacaaaaaccgaaaaccaacgcatccgcgaaaccatcattacccaactaccgaaaaaccaatttaccgaaaacctaatcgcacaactaataaaaaaaataataaaaaaaaaacaatcgctaaaacaaaacgcaatacaaccgaacttcaaatcgataaccgacaaaaacgacatcaaaataattaataacaataacgtcaaatttaatcgtttcgacgacgcaaaaccgcattacgtaaacttaactaatcttataaccgaaaacgacgacaacaacataaccgccgattttatacaataaaaaaacgcattcttcccgtaaaccctaaactacgacgaaatcgacataatactaaaaaaaaaactacatattcgccacgaaaaccaaaccataatcgccaaaacaaacgacgtaatatttatcccgaaaaactccaacatcgaatttaatacgacatccaacgtaaaattcctatatatcgcctaacccgctaactaacaatccctat

SEQ ID NO: 6177 - DNA, 1044 bp, Artificial Sequence
  chemically treated genomic DNA (Homo sapiens) CpG-island No: 6177
ggtttacgtgtaagtggttgttttcgttgtattgtacgcggaaaaagtgttttcgatcgtttttttttatacgaagtcgcgtttatttattatcgagcggtttttgtttttcgtagttgttcgtagttgtttacgttttttaagtaatgtttaggtttacgtcgtagttttatgggatgatgttttcgtggcgggggtttttagtagtgagtcgttttcgagttagtagcgtacgttcgtagttttagtacgtttattatatagcgggcggtttcgcgtagcgcgcgtaggtataggggggcgtttagcgtttttcgtagaggtaggcgggcgtgtcgtttatacggtttcgaagtagcgcgtggtttttttgttgtagtcgaattatttcgtcgttcgtttttttagtttattaggcggatgtttagcgcgcggagtaggtcgttcgtcgagcgcgtttttcgcgtttagttttttagcgcgcgtgggcgtggttagcgggggttggcgcgtcgcggcgaaggttaagtttagtagcgtatcgtttagtcgcgaagggcggtttgtagaaagaggttggtgtttacggtcgggttaggggcgtcgagaggttgaagaggtcgcgggcgcgtaggatattatagtattttcgtttagggcgtcgtagcggggcgcggcgggggttcgttatagcgggcggtttattttcgtaagttgacgtttagggttaggtattggtagggttggtcgtggtaatcggggcggttattagacgtgcgtttatgcgcggagcgtttttattatgcgttttagtaaggtatgtgttttagtcgcgttttattaagtattaaggttataaattcggtggttatcgtagtttcgggcgcgaggttgcgggtggtcggtttatggtcggtttggagtagcgtcgacgtacgttaggggatgcgggggtaggtgatatgattacgatatcgattttcggtatttagggtgaaagttatttcgttatggttggttaagattttgatagtttagtatttt

SEQ ID NO: 6178 - DNA, 1044 bp, Artificial Sequence
  chemically treated genomic DNA (Homo sapiens) CpG-island No: 6178
aaaatactaaactatcaaaatcttaaccaaccataacgaaataactttcaccctaaataccgaaaatcgatatcgtaatcatatcacctacccccgcatcccctaacgtacgtcgacgctactccaaaccgaccataaaccgaccacccgcaacctcgcgcccgaaactacgataaccaccgaatttataaccttaatacttaataaaacgcgactaaaacacataccttactaaaacgcataataaaaacgctccgcgcataaacgcacgtctaataaccgccccgattaccacgaccaaccctaccaatacctaaccctaaacgtcaacttacgaaaataaaccgcccgctataacgaacccccgccgcgccccgctacgacgccctaaacgaaaatactataatatcctacgcgcccgcgacctcttcaacctctcgacgcccctaacccgaccgtaaacaccaacctctttctacaaaccgcccttcgcgactaaacgatacgctactaaacttaaccttcgccgcgacgcgccaacccccgctaaccacgcccacgcgcgctaaaaaactaaacgcgaaaaacgcgctcgacgaacgacctactccgcgcgctaaacatccgcctaataaactaaaaaaacgaacgacgaaataattcgactacaacaaaaaaaccacgcgctacttcgaaaccgtataaacgacacgcccgcctacctctacgaaaaacgctaaacgcccccctatacctacgcgcgctacgcgaaaccgcccgctatataataaacgtactaaaactacgaacgtacgctactaactcgaaaacgactcactactaaaaacccccgccacgaaaacatcatcccataaaactacgacgtaaacctaaacattacttaaaaaacgtaaacaactacgaacaactacgaaaaacaaaaaccgctcgataataaataaacgcgacttcgtataaaaaaaaacgatcgaaaacactttttccgcgtacaatacaacgaaaacaaccacttacacgtaaacc

SEQ ID NO: 6179 - DNA, 1044 bp, Artificial Sequence
  chemically treated genomic DNA (Homo sapiens) CpG-island No: 6179
gggatgttgaattattaggattttagttagttatggcggaatggtttttattttgggtatcgagaatcgatgtcgtaattatgttatttgttttcgtattttttaacgtgcgtcggcgttgttttaggtcggttatggatcggttattcgtagtttcgcgttcgagattacggtggttatcgagtttgtggttttagtatttgatggggcgcggttgaggtatatgttttgttggagcgtatggtggaggcgtttcgcgtataagcgtacgtttggtggtcgtttcggttgttacggttaattttgttagtgtttggttttgaacgttagtttgcgagagtggatcgttcgttatggcgagttttcgtcgcgtttcgttgcgacgttttggacggagatgttgtggtgttttgcgcgttcgcgatttttttaatttttcggcgtttttggttcggtcgtgggtattagtttttttttgtagatcgtttttcgcggttgggcggtgcgttgttggatttgattttcgtcgcggcgcgttagttttcgttggttacgtttacgcgcgttggaaggttgagcgcgagggacgcgttcggcgggcggtttgtttcgcgcgttgggtattcgtttagtgagttgggaaggcgggcggcggagtggttcggttgtaataaggagattacgcgttgtttcggaatcgtgtgggcgatacgttcgtttatttttacgaggagcgttggacgtttttttgtgtttgcgcgcgttgcgcgagatcgttcgttatgtggtgggcgtgttggggttgcgggcgtgcgttattggttcgagggcggtttattgttgggggttttcgttacggggatattattttatgggattacgacgtggatttgggtattatttggaggacgtgggtaattgcgagtagttgcggggggtagaggtcgttcggtggtggatgagcgcggtttcgtatgggagaaggcggtcgagggtatttttttcgcgtgtagtatagcgaaagtaattatttgtacgtggatt

SEQ ID NO: 6180 - DNA, 1044 bp, Artificial Sequence
  chemically treated genomic DNA (Homo sapiens) CpG-island No: 6180
aatccacgtacaaataattactttcgctatactacacgcgaaaaaaataccctcgaccgccttctcccatacgaaaccgcgctcatccaccaccgaacgacctctaccccccgcaactactcgcaattacccacgtcctccaaataatacccaaatccacgtcgtaatcccataaaataatatccccgtaacgaaaacccccaacaataaaccgccctcgaaccaataacgcacgcccgcaaccccaacacgcccaccacataacgaacgatctcgcgcaacgcgcgcaaacacaaaaaaacgtccaacgctcctcgtaaaaataaacgaacgtatcgcccacacgattccgaaacaacgcgtaatctccttattacaaccgaaccactccgccgcccgccttcccaactcactaaacgaatacccaacgcgcgaaacaaaccgcccgccgaacgcgtccctcgcgctcaaccttccaacgcgcgtaaacgtaaccaacgaaaactaacgcgccgcgacgaaaatcaaatccaacaacgcaccgcccaaccgcgaaaaacgatctacaaaaaaaaactaatacccacgaccgaaccaaaaacgccgaaaaattaaaaaaatcgcgaacgcgcaaaacaccacaacatctccgtccaaaacgtcgcaacgaaacgcgacgaaaactcgccataacgaacgatccactctcgcaaactaacgttcaaaaccaaacactaacaaaattaaccgtaacaaccgaaacgaccaccaaacgtacgcttatacgcgaaacgcctccaccatacgctccaacaaaacatatacctcaaccgcgccccatcaaatactaaaaccacaaactcgataaccaccgtaatctcgaacgcgaaactacgaataaccgatccataaccgacctaaaacaacgccgacgcacgttaaaaaatacgaaaacaaataacataattacgacatcgattctcgatacccaaaataaaaaccattccgccataactaactaaaatcctaataattcaacatccc

SEQ ID NO: 6181 - DNA, 833 bp, Artificial Sequence
  chemically treated genomic DNA (Homo sapiens) CpG-island No: 6181
tcgggtttttcggtttcgttttatttcggagtgtttttaggatatttttcggacgttttttattcgtttttcgggatcgtcgcggttttttttcgttttttcgtcgtcgtttcggcggttattgttttaagatggcgtgttgtgcgtgttgtgcgcgggtgacggtcgggtcggtgtcgggtttgggttggggtgtcggaggttcgggatagcgtttatttgtaattcggcgcgttcggttttttagcgggtttttcggtttcgaagcgcgtttattcgtgttggataaagggtaggatttcggtaggtttaggggtttcgggttcgtcgtgggttcggggttgttttcgcgtcgttttttttatttgtcgggttcggttcgggggtaggggcggagacggggtcgttttagtggggttagggttcgcgtttgagtcgagcggacggcggaggaggcggcggttgcgatcgcggtagtcgttcgtttttttattatgaggtttcggggtcggtttgcgcgttcgttgtgtttcgcgcgtttgtacgtcgcgttaatatttttttttttttttcgtcgtaattatcgcgcgcgcgtcggcgggggatagtaggaaggggggtcggcggcgagcgcgagtttcgttattcgggtttatatcgaagggtagcgtgttcgcgcgggggtcggcgggtggagatcgcgtttcgaggagggcgagggagatttaggtttcgcgcgacgtttttttcgttggagtgagattgaggaaggggtcgttttttgttttttttttttatttcgttttagagaaagagttttattttttatatat

SEQ ID NO: 6182 - DNA, 833 bp, Artificial Sequence
  chemically treated genomic DNA (Homo sapiens) CpG-island No: 6182
atatataaaaaataaaactctttctctaaaacgaaataaaaaaaaaaaacaaaaaacgaccccttcctcaatctcactccaacgaaaaaaacgtcgcgcgaaacctaaatctccctcgccctcctcgaaacgcgatctccacccgccgacccccgcgcgaacacgctacccttcgatataaacccgaataacgaaactcgcgctcgccgccgaccccccttcctactatcccccgccgacgcgcgcgcgataattacgacgaaaaaaaaaaaaaaatattaacgcgacgtacaaacgcgcgaaacacaacgaacgcgcaaaccgaccccgaaacctcataataaaaaaacgaacgactaccgcgatcgcaaccgccgcctcctccgccgtccgctcgactcaaacgcgaaccctaaccccactaaaacgaccccgtctccgcccctacccccgaaccgaacccgacaaataaaaaaaacgacgcgaaaacaaccccgaacccacgacgaacccgaaacccctaaacctaccgaaatcctaccctttatccaacacgaataaacgcgcttcgaaaccgaaaaacccgctaaaaaaccgaacgcgccgaattacaaataaacgctatcccgaacctccgacaccccaacccaaacccgacaccgacccgaccgtcacccgcgcacaacacgcacaacacgccatcttaaaacaataaccgccgaaacgacgacgaaaaaacgaaaaaaaaccgcgacgatcccgaaaaacgaataaaaaacgtccgaaaaatatcctaaaaacactccgaaataaaacgaaaccgaaaaacccga

SEQ ID NO: 6183 - DNA, 833 bp, Artificial Sequence
  chemically treated genomic DNA (Homo sapiens) CpG-island No: 6183
gtgtataaagaataaggttttttttttggggcgaagtgggagaggggggtagaaagcggttttttttttagttttattttagcgagggggacgtcgcgcggggtttgggtttttttcgtttttttcggggcgcgatttttattcgtcggttttcgcgcgggtacgttatttttcggtgtagattcgggtggcgaggttcgcgttcgtcgtcggtttttttttttattgtttttcgtcggcgcgcgcgcggtggttgcggcgggggaggggggggggtgttggcgcggcgtgtaggcgcgcgaggtatagcgggcgcgtaggtcggtttcggggttttatgatggaggagcgagcggttgtcgcggtcgtagtcgtcgtttttttcgtcgttcgttcggtttaggcgcgggttttggttttattggggcggtttcgttttcgtttttgttttcgggtcgggttcggtaggtaagggaggcggcgcggaggtagtttcgggtttacggcgggttcggagtttttgagtttgtcgggattttgttttttatttagtacgagtgggcgcgtttcgaagtcgagaagttcgttgggaggtcgagcgcgtcgagttataggtgagcgttgtttcggattttcgatattttaatttaggttcggtatcggttcggtcgttattcgcgtatagtacgtatagtacgttattttggagtaatggtcgtcgggacgacggcgggggggcgggaggggatcgcgacggtttcggagggcgagtgagggacgttcgaggggtgttttgagggtatttcggggtgggacgggatcgggaggttcga

SEQ ID NO: 6184 - DNA, 833 bp, Artificial Sequence
  chemically treated genomic DNA (Homo sapiens) CpG-island No: 6184
tcgaacctcccgatcccgtcccaccccgaaataccctcaaaacacccctcgaacgtccctcactcgccctccgaaaccgtcgcgatcccctcccgcccccccgccgtcgtcccgacgaccattactccaaaataacgtactatacgtactatacgcgaataacgaccgaaccgataccgaacctaaattaaaatatcgaaaatccgaaacaacgctcacctataactcgacgcgctcgacctcccaacgaacttctcgacttcgaaacgcgcccactcgtactaaataaaaaacaaaatcccgacaaactcaaaaactccgaacccgccgtaaacccgaaactacctccgcgccgcctcccttacctaccgaacccgacccgaaaacaaaaacgaaaacgaaaccgccccaataaaaccaaaacccgcgcctaaaccgaacgaacgacgaaaaaaacgacgactacgaccgcgacaaccgctcgctcctccatcataaaaccccgaaaccgacctacgcgcccgctatacctcgcgcgcctacacgccgcgccaacacccccccccctcccccgccgcaaccaccgcgcgcgcgccgacgaaaaacaataaaaaaaaaaaccgacgacgaacgcgaacctcgccacccgaatctacaccgaaaaataacgtacccgcgcgaaaaccgacgaataaaaatcgcgccccgaaaaaaacgaaaaaaacccaaaccccgcgcgacgtccccctcgctaaaataaaactaaaaaaaaaaccgctttctacccccctctcccacttcgccccaaaaaaaaaaccttattctttatacac

SEQ ID NO: 6185 - DNA, 615 bp, Artificial Sequence
  chemically treated genomic DNA (Homo sapiens) CpG-island No: 6185
cgtagcggcggagttttcgttaacgggggtttggcgttggtttttatcgaggattaaggcgcggcgtaggcggttattgcggttttcgggattaggtgcgtcgttgttttcgagtaatttgtttgtgttgttgatagtggtggtcgtggtggtcggcgtggcgtgggattgggggtgtcgggggtcgggggtgcgttggcgttgggttcggacgtttgagcgttttcgttttttcgggcgagttgttgttgcgtttgttgcgatgattattttgtcgttggtggtgtgtagtttgatcggcggcgtcgtcgtttggatttcggcgcgttcggtcgtttgggcgtttgggcgttgttttttttttggttattacgttgttggcgtcggcgttcggagtgggtttggcgcggttttgtagtcgggcgtcgttttcgtcgttattaacgttttcgtgggatcgcgggtagtgtcgaaaatgtttttagtaaggaggtgttcgattcgttttggattttgcgaggttagttttcgttttttcgggaggtggggaagagtttacggatggcgggagtggttacgtggataggacggggttttggggttttggagtagaga

SEQ ID NO: 6186 - DNA, 615 bp, Artificial Sequence
  chemically treated genomic DNA (Homo sapiens) CpG-island No: 6186
tctctactccaaaaccccaaaaccccgtcctatccacgtaaccactcccgccatccgtaaactcttccccacctcccgaaaaaacgaaaactaacctcgcaaaatccaaaacgaatcgaacacctccttactaaaaacattttcgacactacccgcgatcccacgaaaacgttaataacgacgaaaacgacgcccgactacaaaaccgcgccaaacccactccgaacgccgacgccaacaacgtaataaccaaaaaaaaaacaacgcccaaacgcccaaacgaccgaacgcgccgaaatccaaacgacgacgccgccgatcaaactacacaccaccaacgacaaaataatcatcgcaacaaacgcaacaacaactcgcccgaaaaaacgaaaacgctcaaacgtccgaacccaacgccaacgcacccccgacccccgacacccccaatcccacgccacgccgaccaccacgaccaccactatcaacaacacaaacaaattactcgaaaacaacgacgcacctaatcccgaaaaccgcaataaccgcctacgccgcgccttaatcctcgataaaaaccaacgccaaacccccgttaacgaaaactccgccgctacg

SEQ ID NO: 6187 - DNA, 615 bp, Artificial Sequence
  chemically treated genomic DNA (Homo sapiens) CpG-island No: 6187
tttttgttttagggttttaaagtttcgttttgtttacgtgattattttcgttattcgtaaatttttttttatttttcgggggagcgggagttgatttcgtaagatttagaacgaatcgagtatttttttgttgggggtattttcggtattgttcgcggttttacggaggcgttgatggcggcggaggcggcgttcggttgtagagtcgcgttaagtttatttcgagcgtcgacgttagtagcgtggtgattaggaaaagagtagcgtttaggcgtttagacggtcgagcgcgtcggggtttaggcggcggcgtcgtcgattaagttgtatattattagcggtaagatgattatcgtagtagacgtagtagtagttcgttcgggaagacgaaggcgtttaagcgttcgggtttaacgttagcgtattttcggttttcgatatttttagttttacgttacgtcggttattacggttattattgttagtagtataagtaggttgttcgaaggtagcggcgtatttggtttcgggaatcgtagtagtcgtttgcgtcgcgttttggttttcgatggaggttagcgttaggttttcgttggcgggggtttcgtcgttgcg

SEQ ID NO: 6188 - DNA, 615 bp, Artificial Sequence
  chemically treated genomic DNA (Homo sapiens) CpG-island No: 6188
cgcaacgacgaaacccccgccaacgaaaacctaacgctaacctccatcgaaaaccaaaacgcgacgcaaacgactactacgattcccgaaaccaaatacgccgctaccttcgaacaacctacttatactactaacaataataaccgtaataaccgacgtaacgtaaaactaaaaatatcgaaaaccgaaaatacgctaacgttaaacccgaacgcttaaacgccttcgtcttcccgaacgaactactactacgtctactacgataatcatcttaccgctaataatatacaacttaatcgacgacgccgccgcctaaaccccgacgcgctcgaccgtctaaacgcctaaacgctactcttttcctaatcaccacgctactaacgtcgacgctcgaaataaacttaacgcgactctacaaccgaacgccgcctccgccgccatcaacgcctccgtaaaaccgcgaacaataccgaaaatacccccaacaaaaaaatactcgattcgttctaaatcttacgaaatcaactcccgctcccccgaaaaataaaaaaaaatttacgaataacgaaaataatcacgtaaacaaaacgaaactttaaaaccctaaaacaaaaa

SEQ ID NO: 6189 - DNA, 517 bp, Artificial Sequence
  chemically treated genomic DNA (Homo sapiens) CpG-island No: 6189
aacgcgtcgcgcgaagatcgagttaagcgtatagtcggagatagtaatataaaggcgtaatcgataaattcgggggttcgacgttttcggtaggttcgagttttttatattagacgcggggggacgagggaatatatagttcgggggaaaacgtagaggcggtcgcggggggatttcgaattttaaaaagtcggaaacgtataaaattcgtagagtcggcgttttttaagcgttaatacgtacgacgggaggaatagggggagttagggtaaggcgggggcgggaaatcggaggaataattaggaaggggggcggttttcggaaacgacgagaagggaatttcgacgcgagggggtttattagttcggtatatcgcgttagatcgaaggggacgtaataatttcggggggagggaggtatttcgaaaggaacgatttcgggggaggtcgggaacgcgttcgtcggcgtaacgagttacgtatatagtttattttttagggtagaagatgtagttttt

SEQ ID NO: 6190 - DNA, 517 bp, Artificial Sequence
  chemically treated genomic DNA (Homo sapiens) CpG-island No: 6190
aaaaactacatcttctaccctaaaaaataaactatatacgtaactcgttacgccgacgaacgcgttcccgacctcccccgaaatcgttcctttcgaaatacctccctccccccgaaattattacgtccccttcgatctaacgcgatataccgaactaataaaccccctcgcgtcgaaattcccttctcgtcgtttccgaaaaccgccccccttcctaattattcctccgatttcccgcccccgccttaccctaactccccctattcctcccgtcgtacgtattaacgcttaaaaaacgccgactctacgaattttatacgtttccgactttttaaaattcgaaatccccccgcgaccgcctctacgttttcccccgaactatatattccctcgtccccccgcgtctaatataaaaaactcgaacctaccgaaaacgtcgaacccccgaatttatcgattacgcctttatattactatctccgactatacgcttaactcgatcttcgcgcgacgcgtt

SEQ ID NO: 6191 - DNA, 517 bp, Artificial Sequence
  chemically treated genomic DNA (Homo sapiens) CpG-island No: 6191
ggaggttgtattttttattttggggaatgggttgtgtgcgtggttcgttgcgtcggcgggcgcgttttcggtttttttcggggtcgtttttttcggggtgttttttttttttcggggttgttgcgtttttttcggtttggcgcggtgtgtcgggttggtgggttttttcgcgtcggggtttttttttcgtcgttttcgggggtcgtttttttttttggttgttttttcggtttttcgttttcgttttgttttggttttttttgtttttttcgtcgtgcgtgttggcgtttggggggcgtcggttttgcgggttttgtgcgttttcggttttttggggttcggggttttttcgcggtcgtttttgcgttttttttcgggttgtgtgttttttcgttttttcgcgtttggtgtggggggttcgggtttgtcgggggcgtcgggttttcgggtttgtcggttgcgtttttgtgttgttgttttcggttgtgcgtttggttcggttttcgcgcggcgcgtt

SEQ ID NO: 6192 - DNA, 517 bp, Artificial Sequence
  chemically treated genomic DNA (Homo sapiens) CpG-island No: 6192
aacgcgccgcgcgaaaaccgaaccaaacgcacaaccgaaaacaacaacacaaaaacgcaaccgacaaacccgaaaacccgacgcccccgacaaacccgaaccccccacaccaaacgcgaaaaaacgaaaaaacacacaacccgaaaaaaaacgcaaaaacgaccgcgaaaaaaccccgaaccccaaaaaaccgaaaacgcacaaaacccgcaaaaccgacgccccccaaacgccaacacgcacgacgaaaaaaacaaaaaaaaccaaaacaaaacgaaaacgaaaaaccgaaaaaacaaccaaaaaaaaaaacgacccccgaaaacgacgaaaaaaaaaccccgacgcgaaaaaacccaccaacccgacacaccgcgccaaaccgaaaaaaacgcaacaaccccgaaaaaaaaaaaacaccccgaaaaaaacgaccccgaaaaaaaccgaaaacgcgcccgccgacgcaacgaaccacgcacacaacccattccccaaaataaaaaatacaacctcc

SEQ ID NO: 6193 - DNA, 713 bp, Artificial Sequence
  chemically treated genomic DNA (Homo sapiens) CpG-island No: 6193
tttatttattattttttcgtgttttttattttttaattttttgtcgatattttttttttttttcgtatttttttttttttttttttttttttttttttcgttttttttatttattttttttatcgattttttttttttcgtcgcgtatttttttttcgttgtcgtttttagttttttttattttttttttttttttattttttttttttttattttttcgttttttcgttttttatatttcgatggttttattttacgtttatttttttttttttttcggttttgttttttttttttttcgtattatttttttgttttttttattttattttattttttttatttttttttattttttttatcgcgattttttatcggtcgttttttttgttttcgtattttttttttttattttttatcgtttttcgtgtttggcgattatttattcgcgttttttttgttacgttttatttttttttttttttttcgggtggggtgtttaaaagtcgtaatcgcggcgtttatagggttttgggggggttcgtttcggcgttgtttcgaaggtttttgttcggatgattttatttcgaacggagtaggttacgtttcgacgtcggatattttatacgtgttgtaaaagtttttttggtttacgtttttgtttttaggtaacgtagtagtagatattttggtttttttttattcgtttttcg

SEQ ID NO: 6194 - DNA, 713 bp, Artificial Sequence
  chemically treated genomic DNA (Homo sapiens) CpG-island No: 6194
cgaaaaacgaataaaaaaaaaccaaaatatctactactacgttacctaaaaacaaaaacgtaaaccaaaaaaacttttacaacacgtataaaatatccgacgtcgaaacgtaacctactccgttcgaaataaaatcatccgaacaaaaaccttcgaaacaacgccgaaacgaacccccccaaaaccctataaacgccgcgattacgacttttaaacaccccacccgaaaaaaaaaaaaaaaaataaaacgtaacaaaaaaaacgcgaataaataatcgccaaacacgaaaaacgataaaaaataaaaaaaaaaaatacgaaaacaaaaaaaacgaccgataaaaaatcgcgataaaaaaaataaaaaaaaataaaaaaaataaaataaaataaaaaaaacaaaaaaataatacgaaaaaaaaaaaaaacaaaaccgaaaaaaaaaaaaaaataaacgtaaaataaaaccatcgaaatataaaaaacgaaaaaacgaaaaaataaaaaaaaaaaaaataaaaaaaaaaaaaaaataaaaaaaactaaaaacgacaacgaaaaaaaaatacgcgacgaaaaaaaaaaaatcgataaaaaaaataaataaaaaaaacgaaaaaaaaaaaaaaaaaaaaaaaaaaaaaaatacgaaaaaaaaaaaaaatatcgacaaaaaattaaaaaataaaaaacacgaaaaaataataaataaa

SEQ ID NO: 6195 - DNA, 713 bp, Artificial Sequence
  chemically treated genomic DNA (Homo sapiens) CpG-island No: 6195
cggggagcgggtgagggggggttagggtgtttgttgttgcgttgtttgggggtaaggacgtgggttaagaaagtttttgtaatacgtgtgggatgttcggcgtcggggcgtgatttgtttcgttcggggtgagattattcgggtaaaagttttcggggtagcgtcgaagcgggtttttttaggattttatgggcgtcgcgattacggtttttggatattttattcgaggagggggagggagagtggggcgtaataaagagagcgcgggtgggtggtcgttaagtacgaggggcggtgaaggatggggggggggggtgcggggataaaaagagcggtcggtggggggtcgcggtaagaaaggtaggaggaaatagggagagtggggtgaggtaggggggataaagaggtggtgcggagagagaggggggtagggtcggaggggagggaagggtgggcgtggggtggggttatcgaggtatgggggacggaggggcgggagggtaagaggagggggggtagaaaagagaggggggtgggggggattaagggcggtagcggggaggaggtgcgcggcggggggggaggagtcgatagagggggtgggtgaagggaacgggaggggaggggaaggaaagggaggggaaagtgcgaagggagagggaggtgtcggtaggaggttagagaatggggggtacgggaggatagtaaatgga

SEQ ID NO: 6196 - DNA, 713 bp, Artificial Sequence
  chemically treated genomic DNA (Homo sapiens) CpG-island No: 6196
tccatttactatcctcccgtaccccccattctctaacctcctaccgacacctccctctcccttcgcactttcccctccctttccttcccctcccctcccgttcccttcacccaccccctctatcgactcctccccccccgccgcgcacctcctccccgctaccgcccttaatcccccccacccccctctcttttctaccccccctcctcttaccctcccgcccctccgtcccccatacctcgataaccccaccccacgcccacccttccctcccctccgaccctacccccctctctctccgcaccacctctttatcccccctacctcaccccactctccctatttcctcctacctttcttaccgcgaccccccaccgaccgctctttttatccccgcaccccccccccccatccttcaccgcccctcgtacttaacgaccacccacccgcgctctctttattacgccccactctccctccccctcctcgaataaaatatccaaaaaccgtaatcgcgacgcccataaaatcctaaaaaaacccgcttcgacgctaccccgaaaacttttacccgaataatctcaccccgaacgaaacaaatcacgccccgacgccgaacatcccacacgtattacaaaaactttcttaacccacgtccttacccccaaacaacgcaacaacaaacaccctaaccccccctcacccgctccccg

SEQ ID NO: 6197 - DNA, 590 bp, Artificial Sequence
  chemically treated genomic DNA (Homo sapiens) CpG-island No: 6197
gtacgttagtttcgcggatgtgttgttagtcgcggtcgtagcgtcggtcgtcgtcgttttcggtttgttgggtttcgtcgggttggttggcgtgggggtttttttcgtcgcgttgttcgttttttttggtttcgttttgttggttttttgttcggcgtttttttcgttggtttgtttcggttttttttttttttttttgggtttgggttttttttcggtcgttgttttcggcgttttggtcgtcgtggtcgtcggggttttttttgttgtcgtcgtcgtcgttttttttttggtatttttcgcgggcgtggtcggggtcgggtttgtcggtggggtcgtttcgtcgtcgttttcgtttttcggagttttggggttttttgcgttggtcgttgtcgttttcggttatttcggggtcggggcgggcggcggggcgggcggtgggggcggttcgttggtggtcgttgttgtcgcggtcggggcggtcgggggttttttgtcggcggtgttgttggcggttgtgtgtgttttggtgttggtggtgtttgcggtgtttgtgtttttagtaaatatttttttaaaattaaaaaatt

SEQ ID NO: 6198 - DNA, 590 bp, Artificial Sequence
  chemically treated genomic DNA (Homo sapiens) CpG-island No: 6198
aattttttaattttaaaaaaatatttactaaaaacacaaacaccgcaaacaccaccaacaccaaaacacacacaaccgccaacaacaccgccgacaaaaaacccccgaccgccccgaccgcgacaacaacgaccaccaacgaaccgcccccaccgcccgccccgccgcccgccccgaccccgaaataaccgaaaacgacaacgaccaacgcaaaaaaccccaaaactccgaaaaacgaaaacgacgacgaaacgaccccaccgacaaacccgaccccgaccacgcccgcgaaaaataccaaaaaaaaaacgacgacgacgacaacaaaaaaaaccccgacgaccacgacgaccaaaacgccgaaaacaacgaccgaaaaaaaacccaaacccaaaaaaaaaaaaaaaaaaccgaaacaaaccaacgaaaaaaacgccgaacaaaaaaccaacaaaacgaaaccaaaaaaaacgaacaacgcgacgaaaaaaacccccacgccaaccaacccgacgaaacccaacaaaccgaaaacgacgacgaccgacgctacgaccgcgactaacaacacatccgcgaaactaacgtac

SEQ ID NO: 6199 - DNA, 590 bp, Artificial Sequence
  chemically treated genomic DNA (Homo sapiens) CpG-island No: 6199
agttttttaattttaggaaggtatttattaggaatataggtatcgtaaatattattagtattaaggtatatatagtcgttagtaatatcgtcgataggaagttttcggtcgtttcggtcgcggtagtagcggttattagcgggtcgtttttatcgttcgtttcgtcgttcgtttcggtttcgaggtagtcgaaggcggtagcggttaacgtaaaggattttagggtttcgggaggcgggggcggcggcggggcggttttatcggtaggttcggtttcggttacgttcgcgaaggatgttaggaggaaggcggcggcggcggtagtagggaaggtttcggcggttacggcggttaggacgtcggaagtagcggtcgagaagaggtttaggtttagggagaaggagaagaagtcgaaataagttagcgagaaaagcgtcgagtagaaggttagtaggacggagttagaaaaggcgggtagcgcggcgggaaaggtttttacgttagttagttcggcggggtttagtaggtcggaggcggcggcggtcgacgttgcggtcgcggttggtagtatattcgcggggttggcgtat

SEQ ID NO: 6200 - DNA, 590 bp, Artificial Sequence
  chemically treated genomic DNA (Homo sapiens) CpG-island No: 6200
atacgccaaccccgcgaatatactaccaaccgcgaccgcaacgtcgaccgccgccgcctccgacctactaaaccccgccgaactaactaacgtaaaaacctttcccgccgcgctacccgccttttctaactccgtcctactaaccttctactcgacgcttttctcgctaacttatttcgacttcttctccttctccctaaacctaaacctcttctcgaccgctacttccgacgtcctaaccgccgtaaccgccgaaaccttccctactaccgccgccgccgccttcctcctaacatccttcgcgaacgtaaccgaaaccgaacctaccgataaaaccgccccgccgccgcccccgcctcccgaaaccctaaaatcctttacgttaaccgctaccgccttcgactacctcgaaaccgaaacgaacgacgaaacgaacgataaaaacgacccgctaataaccgctactaccgcgaccgaaacgaccgaaaacttcctatcgacgatattactaacgactatatataccttaatactaataatatttacgatacctatattcctaataaataccttcctaaaattaaaaaact

SEQ ID NO: 6201 - DNA, 717 bp, Artificial Sequence
  chemically treated genomic DNA (Homo sapiens) CpG-island No: 6201
agtgtcgttgttgttgtttttcggtggttatttttttagtcgtttcgtttttcggttcgggggatgttttgcgacggcgcggcgtgggcgttaggtttcgggatggggttcgcgggggtgggttatagagagtcgtaggggtcggttttgggtattgttggggtagggttttcgcgggagttggttcgcggaagttgcggacgtcgtcggtaagtagttcgtttagttgtcgttatttttttgatttatgtcggcgtttatattcgaggtatttgaagttcgaagaagttagtgttttgttcggttttcgtagagtatcgtggaatatttggcgagttattgttaggacgtcggcgtatatattgtcggaattataggggtattcggtgaagagttttagttcgaattcgtattttggaggacgggtagtagtatcgaaggcgaatattcgttttattagttcgtgattttttttgaagcgtatattgaacggggcgtaggcggatagcgttagtagttgttttcgtattgttttggggcgttcgtgttatttttttgttcggtttcgtatggtttcgtttagttttgttagatagttcgtatttttttgttgtttttttttttcgaaatcggagtcgaagaggggacgggtaggatttaagtcgggtgttagcgttaggtttcggttttttaggttagatattgtagttgttagta

SEQ ID NO: 6202 - DNA, 717 bp, Artificial Sequence
  chemically treated genomic DNA (Homo sapiens) CpG-island No: 6202
tactaacaactacaatatctaacctaaaaaaccgaaacctaacgctaacacccgacttaaatcctacccgtcccctcttcgactccgatttcgaaaaaaaaaaacaacaaaaaaatacgaactatctaacaaaactaaacgaaaccatacgaaaccgaacaaaaaaataacacgaacgccccaaaacaatacgaaaacaactactaacgctatccgcctacgccccgttcaatatacgcttcaaaaaaaatcacgaactaataaaacgaatattcgccttcgatactactacccgtcctccaaaatacgaattcgaactaaaactcttcaccgaatacccctataattccgacaatatatacgccgacgtcctaacaataactcgccaaatattccacgatactctacgaaaaccgaacaaaacactaacttcttcgaacttcaaatacctcgaatataaacgccgacataaatcaaaaaaataacgacaactaaacgaactacttaccgacgacgtccgcaacttccgcgaaccaactcccgcgaaaaccctaccccaacaatacccaaaaccgacccctacgactctctataacccacccccgcgaaccccatcccgaaacctaacgcccacgccgcgccgtcgcaaaacatcccccgaaccgaaaaacgaaacgactaaaaaaataaccaccgaaaaacaacaacaacgacact

SEQ ID NO: 6203 - DNA, 717 bp, Artificial Sequence
  chemically treated genomic DNA (Homo sapiens) CpG-island No: 6203
tgttggtagttgtagtgtttggtttgggaagtcgaggtttgacgttggtattcggtttgagttttgttcgtttttttttcggtttcgatttcgagaaagagaagtagtagaggaatgcggattgtttggtagaattgaacgaggttatgcgaggtcgggtagaggaatggtacgggcgttttaaagtagtgcgggaatagttattggcgttgttcgtttgcgtttcgtttaatgtgcgttttaagaaggattacgggttggtggggcgagtgttcgttttcgatgttattgttcgttttttaggatacgagttcgagttgaagttttttatcgaatatttttgtggtttcggtaatgtgtacgtcggcgttttggtagtggttcgttagatgttttacgatgttttgcgggagtcgggtaaggtattggttttttcgggttttaagtatttcgaatatgaacgtcggtatggattaggagaatggcggtagttgggcgagttgtttatcgacggcgttcgtagttttcgcgagttagttttcgcggaggttttgttttagtagtatttagagtcggtttttgcggttttttgtggtttattttcgcgagttttatttcggaatttggcgtttacgtcgcgtcgtcgtaaggtatttttcgagtcggagggcgaggcggttgggaagatgattatcgaggagtagtagtaacggtatt

SEQ ID NO: 6204 - DNA, 717 bp, Artificial Sequence
  chemically treated genomic DNA (Homo sapiens) CpG-island No: 6204
aataccgttactactactcctcgataatcatcttcccaaccgcctcgccctccgactcgaaaaataccttacgacgacgcgacgtaaacgccaaattccgaaataaaactcgcgaaaataaaccacaaaaaaccgcaaaaaccgactctaaatactactaaaacaaaacctccgcgaaaactaactcgcgaaaactacgaacgccgtcgataaacaactcgcccaactaccgccattctcctaatccataccgacgttcatattcgaaatacttaaaacccgaaaaaaccaataccttacccgactcccgcaaaacatcgtaaaacatctaacgaaccactaccaaaacgccgacgtacacattaccgaaaccacaaaaatattcgataaaaaacttcaactcgaactcgtatcctaaaaaacgaacaataacatcgaaaacgaacactcgccccaccaacccgtaatccttcttaaaacgcacattaaacgaaacgcaaacgaacaacgccaataactattcccgcactactttaaaacgcccgtaccattcctctacccgacctcgcataacctcgttcaattctaccaaacaatccgcattcctctactacttctctttctcgaaatcgaaaccgaaaaaaaaacgaacaaaactcaaaccgaataccaacgtcaaacctcgacttcccaaaccaaacactacaactaccaaca

SEQ ID NO: 6205 - DNA, 834 bp, Artificial Sequence
  chemically treated genomic DNA (Homo sapiens) CpG-island No: 6205
ggcgagcggttttcggggagtacgtggttgcgtttgagttggcgggcggtatcgatgagtagttcgatgcggttcgcgttttcgaagtttacgtagtcgcgatatacggtttcgttgaagttttatattatggtttacggtattttgggtaggtcgtataggtagtattattggcggcgggacgtttgtatagacgttatggttttagttcgcgcgtcgtttagttttcgcgttttatcggtcgtcgacgtgcgattcgcgtcgttaacgttcgattcgcgtttcggggatagcgcgagttacggttcggttttcggttcggttttttcgtcggatttaggttcggtttttttttttcgttttttgggttttaagtttttttgtttattttcgtttttttcgcgaaggtaggttgaggtacgtcggcgttttcgttcggttcgggtttcgagtcgaggcgtatagttcgggttttacgatgggtcgcgagcgtcgtcgtttcgggttttcgtcgttttcgtcgtcgtcgttgtaacggtcgtcgtcgtttttattttttttttttgttttagaggtcgtttcgtagggaaagttatataatacgtttgtaaagttttttgggaaacgtagtttcgtcggggtcggtttttaaagggaacggcgggtagacgcgggttgggggggttgtcgtttttgtcggcgtaaattttataatttttttcgtggggtcggagtttagcgcgtcgtaagatgttgggatataaaggtggtaggcgaggatgtaatataaatgattagagttatttcggatttagaaattgtgggggtgggtgg

SEQ ID NO: 6206 - DNA, 834 bp, Artificial Sequence
  chemically treated genomic DNA (Homo sapiens) CpG-island No: 6206
ccacccacccccacaatttctaaatccgaaataactctaatcatttatattacatcctcgcctaccacctttatatcccaacatcttacgacgcgctaaactccgaccccacgaaaaaaattataaaatttacgccgacaaaaacgacaacccccccaacccgcgtctacccgccgttccctttaaaaaccgaccccgacgaaactacgtttcccaaaaaactttacaaacgtattatataactttccctacgaaacgacctctaaaacaaaaaaaaaaaataaaaacgacgacgaccgttacaacgacgacgacgaaaacgacgaaaacccgaaacgacgacgctcgcgacccatcgtaaaacccgaactatacgcctcgactcgaaacccgaaccgaacgaaaacgccgacgtacctcaacctaccttcgcgaaaaaaacgaaaataaacaaaaaaacttaaaacccaaaaaacgaaaaaaaaaaaccgaacctaaatccgacgaaaaaaccgaaccgaaaaccgaaccgtaactcgcgctatccccgaaacgcgaatcgaacgttaacgacgcgaatcgcacgtcgacgaccgataaaacgcgaaaactaaacgacgcgcgaactaaaaccataacgtctatacaaacgtcccgccgccaataatactacctatacgacctacccaaaataccgtaaaccataatataaaacttcaacgaaaccgtatatcgcgactacgtaaacttcgaaaacgcgaaccgcatcgaactactcatcgataccgcccgccaactcaaacgcaaccacgtactccccgaaaaccgctcgcc

SEQ ID NO: 6207 - DNA, 834 bp, Artificial Sequence
  chemically treated genomic DNA (Homo sapiens) CpG-island No: 6207
ttatttatttttataatttttgaattcggagtagttttgattatttgtattgtattttcgtttattatttttgtgttttagtattttgcggcgcgttgaatttcggttttacggagaaggttgtaaggtttgcgtcggtagaggcgataatttttttagttcgcgtttgttcgtcgttttttttaagagtcggtttcggcgggattacgttttttagaaggttttgtaggcgtgttatgtaattttttttgcgaagcggtttttggggtagaagaaggaggtggaggcggcggcggtcgttgtagcggcggcggcgagagcggcgggagttcgaggcggcggcgttcgcggtttatcgtggggttcgagttgtgcgtttcggttcggagttcggatcgggcgggggcgtcgacgtgttttagtttgttttcgcgagggaggcgggagtgagtagaaaggtttagggtttagggggcggggaaggggggtcgggtttggattcggcggggaggtcgagtcggaggtcggatcgtggttcgcgttgttttcgggacgcggatcgaacgttggcggcgcggatcgtacgtcggcggtcggtggaacgcgggagttgggcggcgcgcggattggggttatggcgtttgtgtaggcgtttcgtcgttagtggtgttatttgtgcgatttgtttaagatgtcgtgggttatggtgtgggattttagcgaggtcgtgtgtcgcggttgcgtgaatttcgagggcgcggatcgtatcgaattgtttatcgatgtcgttcgttagtttaagcgtagttacgtgtttttcgagggtcgttcgtt

SEQ ID NO: 6208 - DNA, 834 bp, Artificial Sequence
  chemically treated genomic DNA (Homo sapiens) CpG-island No: 6208
aacgaacgaccctcgaaaaacacgtaactacgcttaaactaacgaacgacatcgataaacaattcgatacgatccgcgccctcgaaattcacgcaaccgcgacacacgacctcgctaaaatcccacaccataacccacgacatcttaaacaaatcgcacaaataacaccactaacgacgaaacgcctacacaaacgccataaccccaatccgcgcgccgcccaactcccgcgttccaccgaccgccgacgtacgatccgcgccgccaacgttcgatccgcgtcccgaaaacaacgcgaaccacgatccgacctccgactcgacctccccgccgaatccaaacccgaccccccttccccgccccctaaaccctaaacctttctactcactcccgcctccctcgcgaaaacaaactaaaacacgtcgacgcccccgcccgatccgaactccgaaccgaaacgcacaactcgaaccccacgataaaccgcgaacgccgccgcctcgaactcccgccgctctcgccgccgccgctacaacgaccgccgccgcctccacctccttcttctaccccaaaaaccgcttcgcaaaaaaaattacataacacgcctacaaaaccttctaaaaaacgtaatcccgccgaaaccgactcttaaaaaaaacgacgaacaaacgcgaactaaaaaaattatcgcctctaccgacgcaaaccttacaaccttctccgtaaaaccgaaattcaacgcgccgcaaaatactaaaacacaaaaataataaacgaaaatacaatacaaataatcaaaactactccgaattcaaaaattataaaaataaataa

SEQ ID NO: 6209 - DNA, 531 bp, Artificial Sequence
  chemically treated genomic DNA (Homo sapiens) CpG-island No: 6209
ttgcgtcgagattcggtatcgggtataattcgaggtacgcgtatgcgcgcgatggagtttttgcgcgtgcgtcgttgtggttttaggaagttggggtattcgcgcggcgttaacgttgcggttgcgtagttgcggtttgttggtggggttcggcggagcgtagttttgcgtttgcgttgtgttggggtaggtgggaatgaaattttggcggtaagggtattggggtcgattggttttgggcgcgtttgcgttttggtatgcggggcggtcggaggcggggtcgaaagaggggagggagggaggcggggggtgggaataggtcgtagaagttcgagttttgatttatcggcggttgcggcggagtcggtgagtgattcgtggttcgattcggtttttatttttcgcgattttcgttttttttgtcgtttttcgtagttttcgttgtttttttgtgatacgggattttcgttatttttagagttttttttaatttttggtaatttttagagtttttataattttcgtagattt

SEQ ID NO: 6210 - DNA, 531 bp, Artificial Sequence
  chemically treated genomic DNA (Homo sapiens) CpG-island No: 6210
aaatctacgaaaattataaaaactctaaaaattaccaaaaattaaaaaaaactctaaaaataacgaaaatcccgtatcacaaaaaaacaacgaaaactacgaaaaacgacaaaaaaaacgaaaatcgcgaaaaataaaaaccgaatcgaaccacgaatcactcaccgactccgccgcaaccgccgataaatcaaaactcgaacttctacgacctattcccaccccccgcctccctccctcccctctttcgaccccgcctccgaccgccccgcataccaaaacgcaaacgcgcccaaaaccaatcgaccccaatacccttaccgccaaaatttcattcccacctaccccaacacaacgcaaacgcaaaactacgctccgccgaaccccaccaacaaaccgcaactacgcaaccgcaacgttaacgccgcgcgaataccccaacttcctaaaaccacaacgacgcacgcgcaaaaactccatcgcgcgcatacgcgtacctcgaattatacccgataccgaatctcgacgcaa

SEQ ID NO: 6211 - DNA, 531 bp, Artificial Sequence
  chemically treated genomic DNA (Homo sapiens) CpG-island No: 6211
gggtttgcgaggattgtgggggttttggggattgttagaaattaaggggagttttggaaataacgggggtttcgtattataaggagataacggaggttacgggggacggtagggagagcgaaggtcgcggagggtggggatcgagtcgggttacgggttatttatcggtttcgtcgtagtcgtcggtgggttagggttcgggtttttgcggtttgtttttatttttcgttttttttttttttttttttcggtttcgttttcggtcgtttcgtatgttaaggcgtaggcgcgtttagggttagtcggttttaatgtttttatcgttagggttttatttttatttattttagtatagcgtaggcgtagaattgcgtttcgtcgagttttattagtaggtcgtaattgcgtagtcgtaacgttagcgtcgcgcgggtattttagttttttggggttataacggcgtacgcgtaaaaattttatcgcgcgtatgcgcgtgtttcgggttgtattcggtatcgggtttcggcgtag

SEQ ID NO: 6212 - DNA, 531 bp, Artificial Sequence
  chemically treated genomic DNA (Homo sapiens) CpG-island No: 6212
ctacgccgaaacccgataccgaatacaacccgaaacacgcgcatacgcgcgataaaatttttacgcgtacgccgttataaccccaaaaaactaaaatacccgcgcgacgctaacgttacgactacgcaattacgacctactaataaaactcgacgaaacgcaattctacgcctacgctatactaaaataaataaaaataaaaccctaacgataaaaacattaaaaccgactaaccctaaacgcgcctacgccttaacatacgaaacgaccgaaaacgaaaccgaaaaaaaaaaaaaaaaaaaacgaaaaataaaaacaaaccgcaaaaacccgaaccctaacccaccgacgactacgacgaaaccgataaataacccgtaacccgactcgatccccaccctccgcgaccttcgctctccctaccgtcccccgtaacctccgttatctccttataatacgaaacccccgttatttccaaaactccccttaatttctaacaatccccaaaacccccacaatcctcgcaaaccc

SEQ ID NO: 6213 - DNA, 531 bp, Artificial Sequence
  chemically treated genomic DNA (Homo sapiens) CpG-island No: 6213
gtcggtcggtttcggtcggtttgtagcgtatgttagcgggtttatcgtttcgcgtcgcgtcgtcgttcgtttcggtttcgagggtagtcgtttcggtttgcggttaacgaagaggattttagggtttcgggaggcgggtgcggcggcgggggtggtttttagggttggtcggtgtttcggttgggcggcgttagttagttaggggtcgtgtcgtcgggggttggtcgttggttttgttttcggcgcgtggcgttaggtagcgggagttggcgggtttgttcggttcgcgttcgcgtttgttggtcgggtttagcgtcgcggcggtaggttttgtgcgcgcgttggggggggtttttaaaggggttcggcggcggttggtgttatgtgatgggtgttcggcgggcgcgggtcgggggtgtcgtgtggcgcgtggcggtcgtggcgtcgcgtgttgagcggtgtttttttgttggggtcgttattttttattttcggtgtttttataagaagaggagatatattagggaagat

SEQ ID NO: 6214 - DNA, 531 bp, Artificial Sequence
  chemically treated genomic DNA (Homo sapiens) CpG-island No: 6214
atcttccctaatatatctcctcttcttataaaaacaccgaaaataaaaaataacgaccccaacaaaaaaacaccgctcaacacgcgacgccacgaccgccacgcgccacacgacacccccgacccgcgcccgccgaacacccatcacataacaccaaccgccgccgaacccctttaaaaaccccccccaacgcgcgcacaaaacctaccgccgcgacgctaaacccgaccaacaaacgcgaacgcgaaccgaacaaacccgccaactcccgctacctaacgccacgcgccgaaaacaaaaccaacgaccaacccccgacgacacgacccctaactaactaacgccgcccaaccgaaacaccgaccaaccctaaaaaccacccccgccgccgcacccgcctcccgaaaccctaaaatcctcttcgttaaccgcaaaccgaaacgactaccctcgaaaccgaaacgaacgacgacgcgacgcgaaacgataaacccgctaacatacgctacaaaccgaccgaaaccgaccgac

SEQ ID NO: 6215 - DNA, 531 bp, Artificial Sequence
  chemically treated genomic DNA (Homo sapiens) CpG-island No: 6215
gttttttttggtgtgttttttttttttataaagatatcgggaatgaggaatgacggttttagtagaggggtatcgtttagtacgcggcgttacggtcgttacgcgttatacgatattttcgattcgcgttcgtcgggtatttattatatggtattagtcgtcgtcgggtttttttggaagttttttttagcgcgcgtataaggtttatcgtcgcggcgttggattcgattagtaggcgcggacgcgggtcgaataaattcgttagttttcgttgtttggcgttacgcgtcgggggtaaaattagcgattagttttcgacggtacgatttttagttggttaacgtcgtttaatcggggtatcggttaattttgagggttattttcgtcgtcgtattcgtttttcggagttttggggtttttttcgttggtcgtaagtcgaaacggttattttcgggatcgggacgggcggcggcgcggcgcggagcggtgggttcgttggtatgcgttgtaggtcggtcggggtcggtcggt

SEQ ID NO: 6216 - DNA, 531 bp, Artificial Sequence
  chemically treated genomic DNA (Homo sapiens) CpG-island No: 6216
accgaccgaccccgaccgacctacaacgcataccaacgaacccaccgctccgcgccgcgccgccgcccgtcccgatcccgaaaataaccgtttcgacttacgaccaacgaaaaaaaccccaaaactccgaaaaacgaatacgacgacgaaaataaccctcaaaattaaccgataccccgattaaacgacgttaaccaactaaaaatcgtaccgtcgaaaactaatcgctaattttacccccgacgcgtaacgccaaacaacgaaaactaacgaatttattcgacccgcgtccgcgcctactaatcgaatccaacgccgcgacgataaaccttatacgcgcgctaaaaaaaacttccaaaaaaacccgacgacgactaataccatataataaatacccgacgaacgcgaatcgaaaatatcgtataacgcgtaacgaccgtaacgccgcgtactaaacgatacccctctactaaaaccgtcattcctcattcccgatatctttataaaaaaaaaaaacacaccaaaaaaaac

SEQ ID NO: 6217 - DNA, 724 bp, Artificial Sequence
  chemically treated genomic DNA (Homo sapiens) CpG-island No: 6217
tttcggttttttcggcgttttttttttcgtttaggtttttcgcgggtattttaggtttcggttcgagttttggtaggtcgttgtttgtcgttattatttgttcggggattagtttttttcgtcgtcgttggttattcgggttttgttcgttttttttaaagggaaatcgttgtttttatcgtcgttcgggtcgttttgtttcgtttgcggtcgtatagtttttttatgtttcgcgttttaaaggaatgaattcggtcgcgttgttcgttacgtttcgttattcgagttgtttttcgtttttcgtcggttcggacgtgtagcggttgtcgcgtttgttgcgacggtatggtgtattgggttgcgagtcgggggtcggataagtttggagcgttatattattgattgtgtcgttacgttattgggtcgggggagggcggcggtcgcggttagtaacgagtttagggcgcgggcgcgggatagtcgcggtcggggttggggcgacggggagggggcgggggtttgaattattgggaggacgtgtttgcgtgtaatcgcgttgggggggcggggcgttgcgagggggcggatttgtgtttatcgaagcggttcgaggtagttcgagttttgagatttcgttggttttttttttttcggattttcggggtgtttttttagggaatttttcggttttattttagagatttttagaagggaagtgtattag

SEQ ID NO: 6218 - DNA, 724 bp, Artificial Sequence
  chemically treated genomic DNA (Homo sapiens) CpG-island No: 6218
ctaatacacttcccttctaaaaatctctaaaataaaaccgaaaaattccctaaaaaaacaccccgaaaatccgaaaaaaaaaaaaccaacgaaatctcaaaactcgaactacctcgaaccgcttcgataaacacaaatccgccccctcgcaacgccccgcccccccaacgcgattacacgcaaacacgtcctcccaataattcaaacccccgccccctccccgtcgccccaaccccgaccgcgactatcccgcgcccgcgccctaaactcgttactaaccgcgaccgccgccctcccccgacccaataacgtaacgacacaatcaataatataacgctccaaacttatccgacccccgactcgcaacccaatacaccataccgtcgcaacaaacgcgacaaccgctacacgtccgaaccgacgaaaaacgaaaaacaactcgaataacgaaacgtaacgaacaacgcgaccgaattcattcctttaaaacgcgaaacataaaaaaactatacgaccgcaaacgaaacaaaacgacccgaacgacgataaaaacaacgatttccctttaaaaaaaacgaacaaaacccgaataaccaacgacgacgaaaaaaactaatccccgaacaaataataacgacaaacaacgacctaccaaaactcgaaccgaaacctaaaatacccgcgaaaaacctaaacgaaaaaaaaaacgccgaaaaaaccgaaa

SEQ ID NO: 6219 - DNA, 724 bp, Artificial Sequence
  chemically treated genomic DNA (Homo sapiens) CpG-island No: 6219
ttaatatattttttttttgggggtttttgagatgggatcgaaagattttttaagggagtatttcgaaaattcgagaggagaagagttagcgagattttagaattcgagttgtttcgggtcgtttcgatgggtatagattcgttttttcgtagcgtttcgtttttttagcgcgattgtacgtaggtacgtttttttagtagtttaggttttcgtttttttttcgtcgttttagtttcggtcgcgattgtttcgcgttcgcgttttaggttcgttgttggtcgcggtcgtcgttttttttcggtttaatggcgtggcggtatagttagtgatgtgacgttttaggtttgttcggttttcggttcgtagtttagtatattatgtcgtcgtagtaggcgcggtagtcgttgtacgttcgagtcgacgaagggcgggaggtagttcgggtggcggggcgtggcgaatagcgcggtcggatttatttttttggggcgcggagtatggaggagttgtgcggtcgtaggcggagtagggcggttcgggcggcggtggggataacggtttttttttgaaggggacggataaagttcgagtgattagcggcggcggggaggattagttttcgggtaggtagtggcggtaggtagcggtttgttagggttcgggtcggggtttgaggtgttcgcggaaggtttgggcgggaaggagggcgtcgggggagtcgaag

SEQ ID NO: 6220 - DNA, 724 bp, Artificial Sequence
  chemically treated genomic DNA (Homo sapiens) CpG-island No: 6220
cttcgactcccccgacgccctccttcccgcccaaaccttccgcgaacacctcaaaccccgacccgaaccctaacaaaccgctacctaccgccactacctacccgaaaactaatcctccccgccgccgctaatcactcgaactttatccgtccccttcaaaaaaaaaccgttatccccaccgccgcccgaaccgccctactccgcctacgaccgcacaactcctccatactccgcgccccaaaaaaataaatccgaccgcgctattcgccacgccccgccacccgaactacctcccgcccttcgtcgactcgaacgtacaacgactaccgcgcctactacgacgacataatatactaaactacgaaccgaaaaccgaacaaacctaaaacgtcacatcactaactataccgccacgccattaaaccgaaaaaaaacgacgaccgcgaccaacaacgaacctaaaacgcgaacgcgaaacaatcgcgaccgaaactaaaacgacgaaaaaaaaacgaaaacctaaactactaaaaaaacgtacctacgtacaatcgcgctaaaaaaacgaaacgctacgaaaaaacgaatctatacccatcgaaacgacccgaaacaactcgaattctaaaatctcgctaactcttctcctctcgaattttcgaaatactcccttaaaaaatctttcgatcccatctcaaaaacccccaaaaaaaaaatatattaa

SEQ ID NO: 6221 - DNA, 1281 bp, Artificial Sequence
  chemically treated genomic DNA (Homo sapiens) CpG-island No: 6221
  misc_feature (1094)..(1094): n is either a, c, g or t
  misc_feature (1117)..(1117): n is either a, c, g or t
ggaatcgttcgttttttttgatattttgtcgggttatatcgaatatggtcgggataacggtattcgtttgtttgtcgtgtggttgacgtacgattcggaatattcggagaatttatttgtcgcgtcgttggtgcgttatggttggacgttacgcggcgaattggcggtggtgtatgatcgtagtggtaaataggtgcgtagttttatttacgatgataaatatcggggtcggatggtggcgtatcgttatacgggtcggtcggaaattcgttatcgttacgatagcgacgggcgggtgatagaatagttaaattcggtaggtttaagttatacgtattagtatgagaaagatcgtattattattatcgatagtttggatcgtcgtgaagtgttgtatacgtagggcgaagtcgggttgaagcgggtggtgaaaaaggaatacgcggacggtagcgttacgtagagttagtttgacgtcgtgggtaggtttagggtatagacggatgtcgtaggtaggataatagagtatagttcggatgtggtgacgggttttattacgcgtataattacgtcggatggtagggtatcggcgttttattataattattataattagttaacgttagttatcgggtttgacgggttggaattgcgtcgggaatatgatgaattgggtcgtttgatttaggaaattgtttttgacggcgatattattcgttatcgttatgataatttatatagtgatttattttgcgtaacggaagatgttatcggtagtcggaaaattatgacgtggagtcgttacggttagttgttgagttttatcgattgtttcggttatgtaattcgttatgattatgatcgtttcgggtagatgacggcggtgtatcgcgaggaaaggttgagttagtatcgcgtattcgataggcgtgggatagttattgtcgtgaaagaaacgtaggggtttgaaacggggtttgaatattatttttcggtatttgacggcgttattgtttcgaaaggaatcgaaacgggaatagttaattcgtgggaaagcgtcgttttatagagggtgatcgtattgataattacgngggtattttatttgacgatatangcgtttatcggtatagatatacgaggataaatacgttggcgcggatatatagtagatcggagggtcgttaaaatatacgcgagagtggagtgatattttcgggttaggtcgcgagtttgtgtttttttttttttaaaataatgcgaacgatacgataattagat

SEQ ID NO: 6222 - DNA, 1281 bp, Artificial Sequence
  chemically treated genomic DNA (Homo sapiens) CpG-island No: 6222
  misc_feature (165)..(165): n is either a, c, g or t
  misc_feature (188)..(188): n is either a, c, g or t
atctaattatcgtatcgttcgcattattttaaaaaaaaaaaaacacaaactcgcgacctaacccgaaaatatcactccactctcgcgtatattttaacgaccctccgatctactatatatccgcgccaacgtatttatcctcgtatatctataccgataaacgcntatatcgtcaaataaaatacccncgtaattatcaatacgatcaccctctataaaacgacgctttcccacgaattaactattcccgtttcgattcctttcgaaacaataacgccgtcaaataccgaaaaataatattcaaaccccgtttcaaacccctacgtttctttcacgacaataactatcccacgcctatcgaatacgcgatactaactcaacctttcctcgcgatacaccgccgtcatctacccgaaacgatcataatcataacgaattacataaccgaaacaatcgataaaactcaacaactaaccgtaacgactccacgtcataattttccgactaccgataacatcttccgttacgcaaaataaatcactatataaattatcataacgataacgaataatatcgccgtcaaaaacaatttcctaaatcaaacgacccaattcatcatattcccgacgcaattccaacccgtcaaacccgataactaacgttaactaattataataattataataaaacgccgataccctaccatccgacgtaattatacgcgtaataaaacccgtcaccacatccgaactatactctattatcctacctacgacatccgtctataccctaaacctacccacgacgtcaaactaactctacgtaacgctaccgtccgcgtattcctttttcaccacccgcttcaacccgacttcgccctacgtatacaacacttcacgacgatccaaactatcgataataataatacgatctttctcatactaatacgtataacttaaacctaccgaatttaactattctatcacccgcccgtcgctatcgtaacgataacgaatttccgaccgacccgtataacgatacgccaccatccgaccccgatatttatcatcgtaaataaaactacgcacctatttaccactacgatcatacaccaccgccaattcgccgcgtaacgtccaaccataacgcaccaacgacgcgacaaataaattctccgaatattccgaatcgtacgtcaaccacacgacaaacaaacgaataccgttatcccgaccatattcgatataacccgacaaaatatcaaaaaaaacgaacgattcc

SEQ ID NO: 6223 - DNA, 1281 bp, Artificial Sequence
  chemically treated genomic DNA (Homo sapiens) CpG-island No: 6223
  misc_feature (165)..(165): n is either a, c, g or t
  misc_feature (188)..(188): n is either a, c, g or t
atttagttatcgtgtcgttcgtattgttttgggaaaaagagagtataaattcgcggtttagttcgaaggtgttattttattttcgcgtgtgttttagcggtttttcgatttgttgtgtattcgcgttagcgtgtttattttcgtatatttgtgtcggtgggcgtntgtgtcgttagatgggatgtttncgtgattattaatgcggttattttttgtggagcggcgtttttttacggattgattgttttcgtttcggtttttttcggggtaataacgtcgttaggtatcgggaagtggtatttaaatttcgttttaagtttttgcgttttttttacggtaataattgttttacgtttgtcgaatgcgcggtattgatttagttttttttcgcggtgtatcgtcgttatttgttcgaagcggttatggttataacgggttatataatcggaatagtcggtgaagtttagtaattgatcgtaacggttttacgttatggtttttcggttgtcggtggtatttttcgttgcgtagggtaagttattgtgtggattattataacggtagcgggtgatatcgtcgttaggggtagttttttgaattagacggtttaatttattatattttcggcgtaattttagttcgttaggttcggtggttgacgttaattggttgtggtggttatagtaaaacgtcgatgttttgttattcggcgtggttatgcgcgtgatgaggttcgttattatattcgggttgtattttgttgttttgtttgcggtattcgtttgtgttttgagtttgtttacggcgttaaattgattttgcgtgacgttgtcgttcgcgtgttttttttttattattcgttttagttcggtttcgttttgcgtgtgtagtattttacggcggtttaggttgtcggtgatggtgatgcggttttttttatattgatacgtgtagtttaagtttgtcgggtttagttgttttgttattcgttcgtcgttgtcgtaacggtaacggattttcggtcggttcgtgtgacggtgcgttattattcggtttcggtatttattatcgtaagtaaagttgcgtatttgtttgttattacggttatatattatcgttagttcgtcgcgtggcgtttagttatagcgtattagcggcgcggtaggtaaatttttcgggtatttcgggtcgtgcgttagttatacggtagatagacggatgtcgttgtttcggttatattcggtgtaattcggtagggtattaggaaaagcggacggtttt

SEQ ID NO: 6224 - DNA, 1281 bp, Artificial Sequence
  chemically treated genomic DNA (Homo sapiens) CpG-island No: 6224
  misc_feature (1094)..(1094): n is either a, c, g or t
  misc_feature (1117)..(1117): n is either a, c, g or t
aaaaccgtccgcttttcctaataccctaccgaattacaccgaatataaccgaaacaacgacatccgtctatctaccgtataactaacgcacgacccgaaatacccgaaaaatttacctaccgcgccgctaatacgctataactaaacgccacgcgacgaactaacgataatatataaccgtaataacaaacaaatacgcaactttacttacgataataaataccgaaaccgaataataacgcaccgtcacacgaaccgaccgaaaatccgttaccgttacgacaacgacgaacgaataacaaaacaactaaacccgacaaacttaaactacacgtatcaatataaaaaaaaccgcatcaccatcaccgacaacctaaaccgccgtaaaatactacacacgcaaaacgaaaccgaactaaaacgaataataaaaaaaaaacacgcgaacgacaacgtcacgcaaaatcaatttaacgccgtaaacaaactcaaaacacaaacgaataccgcaaacaaaacaacaaaatacaacccgaatataataacgaacctcatcacgcgcataaccacgccgaataacaaaacatcgacgttttactataaccaccacaaccaattaacgtcaaccaccgaacctaacgaactaaaattacgccgaaaatataataaattaaaccgtctaattcaaaaaactacccctaacgacgatatcacccgctaccgttataataatccacacaataacttaccctacgcaacgaaaaataccaccgacaaccgaaaaaccataacgtaaaaccgttacgatcaattactaaacttcaccgactattccgattatataacccgttataaccataaccgcttcgaacaaataacgacgatacaccgcgaaaaaaaactaaatcaataccgcgcattcgacaaacgtaaaacaattattaccgtaaaaaaaacgcaaaaacttaaaacgaaatttaaataccacttcccgatacctaacgacgttattaccccgaaaaaaaccgaaacgaaaacaatcaatccgtaaaaaaacgccgctccacaaaaaataaccgcattaataatcacgnaaacatcccatctaacgacacanacgcccaccgacacaaatatacgaaaataaacacgctaacgcgaatacacaacaaatcgaaaaaccgctaaaacacacgcgaaaataaaataacaccttcgaactaaaccgcgaatttatactctctttttcccaaaacaatacgaacgacacgataactaaat

SEQ ID NO: 6225 - DNA, 857 bp, Artificial Sequence
  chemically treated genomic DNA (Homo sapiens) CpG-island No: 6225
ttattcgattttcgttgatcgcgcggaaaattgtcgggtgtgggacgttgaaggtcgtgagtattttgatttcgcgggcgggattgcggtgtttaatatcgggtatttgtattcgaaggtggtggtcgcggtggaagcgtagttgaaaaaattgtcgtatatttgtttttaggtgttggtttacgagtcgtatttggagttgtgcgagattatgaattagaaggtgtcgggcgatttcgttaagaaaacgttgttggttacgatcggtttcgaagcggtggaaaacgcggtaaaaatcgttcgcgtcgttattaaacgtagcggtattatcgtttttagcggcgcgtattacgggcgtacgtattatacgttggcgttgatcggtaaggtgaattcgtattttgcgggtatggggttgatgtcgggttatgtttatcgcgcgttttatttttgttcgttgtacggtataagcgaggatgacgttatcgttagtatttattcgggatttttaaaatgatgtcgcgtcggaagatatcggcggtaatcgtgattgagtcggattaggataaagtcggtttatagttttcgtgttagttttatgtagggttaagcgttcgtgtgataagttcgggattatgtaatgtcgataatgtagagggcgggagtatcgtatttgtgcgatgatataggtgttgttttttttattttggaaaatacggagggtattcggaggtatacgtcgcgaatgaatgcgtattagtgggattagaaaataatacgtcgcgatagtgtgaaaattataaaggtgagaagtcgtatacgttcgtgtcgttattgttttttatttttttttatat

SEQ ID NO: 6226 - DNA, 857 bp, Artificial Sequence
  chemically treated genomic DNA (Homo sapiens) CpG-island No: 6226
atataaaaaaaaataaaaaacaataacgacacgaacgtatacgacttctcacctttataattttcacactatcgcgacgtattattttctaatcccactaatacgcattcattcgcgacgtatacctccgaataccctccgtattttccaaaataaaaaaaacaacacctatatcatcgcacaaatacgatactcccgccctctacattatcgacattacataatcccgaacttatcacacgaacgcttaaccctacataaaactaacacgaaaactataaaccgactttatcctaatccgactcaatcacgattaccgccgatatcttccgacgcgacatcattttaaaaatcccgaataaatactaacgataacgtcatcctcgcttataccgtacaacgaacaaaaataaaacgcgcgataaacataacccgacatcaaccccatacccgcaaaatacgaattcaccttaccgatcaacgccaacgtataatacgtacgcccgtaatacgcgccgctaaaaacgataataccgctacgtttaataacgacgcgaacgatttttaccgcgttttccaccgcttcgaaaccgatcgtaaccaacaacgttttcttaacgaaatcgcccgacaccttctaattcataatctcgcacaactccaaatacgactcgtaaaccaacacctaaaaacaaatatacgacaattttttcaactacgcttccaccgcgaccaccaccttcgaatacaaatacccgatattaaacaccgcaatcccgcccgcgaaatcaaaatactcacgaccttcaacgtcccacacccgacaattttccgcgcgatcaacgaaaatcgaataa

SEQ ID NO: 6227 - DNA, 857 bp, Artificial Sequence
  chemically treated genomic DNA (Homo sapiens) CpG-island No: 6227
atgtgaggagaggtggagggtagtagcgatacgaacgtgtacgattttttatttttgtggtttttatattatcgcgacgtattgttttttggttttattggtgcgtatttattcgcggcgtgtattttcgggtatttttcgtgttttttaaggtgaaaggggtaatatttgtgttatcgtataggtgcggtattttcgttttttgtattatcggtattatatgatttcgggtttgttatacgggcgtttaattttgtataaagttggtacgagggttatgaatcggttttgttttgattcggtttaattacgattgtcgtcgatatttttcggcgcggtattattttgaagatttcgggtggatgttggcgatagcgttattttcgtttatgtcgtgtagcgggtaaggataaagcgcgcgataaatatgattcggtattagttttatgttcgtagagtacggatttattttgtcggttagcgttagcgtgtaatgcgtgcgttcgtgatacgcgtcgttaaaagcgatggtgtcgttacgtttggtggcggcgcgggcgatttttatcgcgttttttatcgtttcggaatcggtcgtaattagtagcgtttttttggcgaaatcgttcggtattttttgatttataatttcgtatagttttagatacggttcgtaagttagtatttggaagtaggtgtgcgatagtttttttaattgcgtttttatcgcggttattattttcggatgtaggtgttcggtattgagtatcgtaatttcgttcgcgaaattaagatatttacggtttttaacgttttatattcggtagtttttcgcgcggttagcgaaaatcgggtga

SEQ ID NO: 6228 - DNA, 857 bp, Artificial Sequence
  chemically treated genomic DNA (Homo sapiens) CpG-island No: 6228
tcacccgattttcgctaaccgcgcgaaaaactaccgaatataaaacgttaaaaaccgtaaatatcttaatttcgcgaacgaaattacgatactcaataccgaacacctacatccgaaaataataaccgcgataaaaacgcaattaaaaaaactatcgcacacctacttccaaatactaacttacgaaccgtatctaaaactatacgaaattataaatcaaaaaataccgaacgatttcgccaaaaaaacgctactaattacgaccgattccgaaacgataaaaaacgcgataaaaatcgcccgcgccgccaccaaacgtaacgacaccatcgcttttaacgacgcgtatcacgaacgcacgcattacacgctaacgctaaccgacaaaataaatccgtactctacgaacataaaactaataccgaatcatatttatcgcgcgctttatccttacccgctacacgacataaacgaaaataacgctatcgccaacatccacccgaaatcttcaaaataataccgcgccgaaaaatatcgacgacaatcgtaattaaaccgaatcaaaacaaaaccgattcataaccctcgtaccaactttatacaaaattaaacgcccgtataacaaacccgaaatcatataataccgataatacaaaaaacgaaaataccgcacctatacgataacacaaatattacccctttcaccttaaaaaacacgaaaaatacccgaaaatacacgccgcgaataaatacgcaccaataaaaccaaaaaacaatacgtcgcgataatataaaaaccacaaaaataaaaaatcgtacacgttcgtatcgctactaccctccacctctcctcacat

SEQ ID NO: 6229 - DNA, 833 bp, Artificial Sequence
  chemically treated genomic DNA (Homo sapiens) CpG-island No: 6229
taggtcgcgatggtcgtagtggtataggtggatttttcgcgtcggcgtgtatatcgggtttatttggttttgtatttgttttatcgttaggtcgtattgcgtaagttacgttcggtttttattgtttacgcggtttgttcggatttttttttttagtcggtttagtatttgtattagtttagtcgggaatattacgtcgtggtcgtttttattttttttttgttgaagcgtattcgttaggttgcggcgttgcgttttcgttagtttatcggtggcggttttaattttgatgagtggcgtgaagtttttcggttgataaatcgtttggatgcgggttttgtcgttttgtattgtggttagtcggtcgtcgttttagtcgtattaggttatttgcggttttcgtgatagcgatatttagttcgttaggtttcgtttacgtcgttatattcgttttgttattttgcggtttagcgggtcgtaaagatagcgattttcgattagcggttttttatattgtgttcgcgtgtagtgtattagtcggtgttgattgtcgtaatggtatcggtgagttcgtttattattcgtgcggataatttttttcgggatgaggtcggttttttttgttagtttgtcgtgacggttatatcggtaaagatagtgcgcgttacgggcgatacggttattcggtatatatgttgagggtgttgttcgggtgtagtttcgggtcgggtaggcggttatttgtcgggtttgtggtatacgggatgcggatatttagattcgttgcggtggtgtgaacgtcggttagtttgtcggtggtgttgtattgtaat

SEQ ID NO: 6230 - DNA, 833 bp, Artificial Sequence
  chemically treated genomic DNA (Homo sapiens) CpG-island No: 6230
attacaatacaacaccaccgacaaactaaccgacgttcacaccaccgcaacgaatctaaatatccgcatcccgtataccacaaacccgacaaataaccgcctacccgacccgaaactacacccgaacaacaccctcaacatatataccgaataaccgtatcgcccgtaacgcgcactatctttaccgatataaccgtcacgacaaactaacaaaaaaaaccgacctcatcccgaaaaaaattatccgcacgaataataaacgaactcaccgataccattacgacaatcaacaccgactaatacactacacgcgaacacaatataaaaaaccgctaatcgaaaatcgctatctttacgacccgctaaaccgcaaaataacaaaacgaatataacgacgtaaacgaaacctaacgaactaaatatcgctatcacgaaaaccgcaaataacctaatacgactaaaacgacgaccgactaaccacaatacaaaacgacaaaacccgcatccaaacgatttatcaaccgaaaaacttcacgccactcatcaaaattaaaaccgccaccgataaactaacgaaaacgcaacgccgcaacctaacgaatacgcttcaacaaaaaaaaaataaaaacgaccacgacgtaatattcccgactaaactaatacaaatactaaaccgactaaaaaaaaaaatccgaacaaaccgcgtaaacaataaaaaccgaacgtaacttacgcaatacgacctaacgataaaacaaatacaaaaccaaataaacccgatatacacgccgacgcgaaaaatccacctataccactacgaccatcgcgaccta

SEQ ID NO: 6231 - DNA, 833 bp, Artificial Sequence
  chemically treated genomic DNA (Homo sapiens) CpG-island No: 6231
gttatagtatagtattatcggtaggttgatcggcgtttatattatcgtagcgaatttggatattcgtatttcgtatgttatagattcggtaggtaatcgtttgttcgattcggagttgtattcggatagtatttttagtatgtgtgtcggataatcgtatcgttcgtgacgcgtattatttttatcggtatgatcgttacggtaggttgatagagaaaatcgattttatttcggaaggggttattcgtacggatgatgagcggatttatcggtattattacgatagttagtatcggttggtgtattatacgcggatataatatgaagagtcgttggtcgaaagtcgttatttttacgattcgttgggtcgtagggtggtaaaacgggtgtggcggcgtgaacgggatttgacgggttggatgtcgttgttacggaaatcgtaagtgatttggtacggttgggacggcgatcggttgattataatatagaacgatagaattcgtatttagacgatttattagtcggggagttttacgttatttattagagttgaaatcgttatcggtgagttggcgaaaacgtagcgtcgtagtttggcggatgcgttttagtaggaagggagtgagaacggttacggcgtggtgttttcggttgaattggtgtagatgttggatcggttggaggaagaaattcgggtagatcgcgtgagtagtgaaagtcgggcgtggtttgcgtagtgcggtttgacggtggagtagatgtaaaattagatggattcggtgtatacgtcggcgcgaaaaatttatttgtattattgcgattatcgcggtttg

SEQ ID NO: 6232 - DNA, 833 bp, Artificial Sequence
  chemically treated genomic DNA (Homo sapiens) CpG-island No: 6232
caaaccgcgataatcgcaataatacaaataaatttttcgcgccgacgtatacaccgaatccatctaattttacatctactccaccgtcaaaccgcactacgcaaaccacgcccgactttcactactcacgcgatctacccgaatttcttcctccaaccgatccaacatctacaccaattcaaccgaaaacaccacgccgtaaccgttctcactcccttcctactaaaacgcatccgccaaactacgacgctacgttttcgccaactcaccgataacgatttcaactctaataaataacgtaaaactccccgactaataaatcgtctaaatacgaattctatcgttctatattataatcaaccgatcgccgtcccaaccgtaccaaatcacttacgatttccgtaacaacgacatccaacccgtcaaatcccgttcacgccgccacacccgttttaccaccctacgacccaacgaatcgtaaaaataacgactttcgaccaacgactcttcatattatatccgcgtataatacaccaaccgatactaactatcgtaataataccgataaatccgctcatcatccgtacgaataaccccttccgaaataaaatcgattttctctatcaacctaccgtaacgatcataccgataaaaataatacgcgtcacgaacgatacgattatccgacacacatactaaaaatactatccgaatacaactccgaatcgaacaaacgattacctaccgaatctataacatacgaaatacgaatatccaaattcgctacgataatataaacgccgatcaacctaccgataatactatactataac

SEQ ID NO: 6233 - DNA, 566 bp, Artificial Sequence
  chemically treated genomic DNA (Homo sapiens) CpG-island No: 6233
gatgcgtagaaacgtgggattgttaacggcgatatggtgcgggtgtttaattatcgtggcgaagttcggttattagttaaagtaatattacgtattttttttggagttagcgttatgggttagtgagtttggtacgaggttaatatgtttggcgataaaatcgattatggcggttgtgtgaatacgtttaatattttgtgggtttttaatattggggaagggaattcgtagtaattatcggtttagatcggaaaatatattacgatacgtattcgggtgatttcggcgaagttatatggtacgcggaatttttcgagggttagaaggaatatagaattgaaattcgttggatgtcgtagagatacgacggatataggcggggatcgaaataggggatttagtatcggattgtaatcgggcgaggtaattgagtttaaaaatcggagatatagagttgttacggtcgtatacgatacgtagtattcgtttattagttttttttttttcgtatcggttcgtaattttttttatcgcgtgcgatcgtttattattttattatttttacg

SEQ ID NO: 6234 - DNA, 566 bp, Artificial Sequence
  chemically treated genomic DNA (Homo sapiens) CpG-island No: 6234
cgtaaaaataataaaataataaacgatcgcacgcgataaaaaaaattacgaaccgatacgaaaaaaaaaaaactaataaacgaatactacgtatcgtatacgaccgtaacaactctatatctccgatttttaaactcaattacctcgcccgattacaatccgatactaaatcccctatttcgatccccgcctatatccgtcgtatctctacgacatccaacgaatttcaattctatattccttctaaccctcgaaaaattccgcgtaccatataacttcgccgaaatcacccgaatacgtatcgtaatatattttccgatctaaaccgataattactacgaattcccttccccaatattaaaaacccacaaaatattaaacgtattcacacaaccgccataatcgattttatcgccaaacatattaacctcgtaccaaactcactaacccataacgctaactccaaaaaaaatacgtaatattactttaactaataaccgaacttcgccacgataattaaacacccgcaccatatcgccgttaacaatcccacgtttctacgcatc

SEQ ID NO: 6235 - DNA, 566 bp, Artificial Sequence
  chemically treated genomic DNA (Homo sapiens) CpG-island No: 6235
cgtgggggtggtggggtggtgggcggtcgtacgcggtgaggggggttgcgagtcggtgcggggaggggggggttggtgggcgggtgttgcgtgtcgtgtacggtcgtgataattttatattttcgatttttggatttagttgtttcgttcggttgtagttcggtgttgggttttttgtttcggttttcgtttgtattcgtcgtgtttttgcggtatttagcgagttttagttttgtgttttttttggttttcgggaggtttcgcgtgttatgtggtttcgtcgaggttattcgaatacgtgtcgtggtatatttttcgatttggatcgatagttgttgcgggtttttttttttaatgttaaaggtttatagagtgttgagcgtatttatatagtcgttatggtcgattttatcgttagatatattggtttcgtgttaggtttattggtttatagcgttaattttagggagaatacgtggtgttattttggttggtagtcgaatttcgttacgatggttaaatattcgtattatatcgtcgttggtaattttacgtttttgcgtatt

SEQ ID NO: 6236 - DNA, 566 bp, Artificial Sequence
  chemically treated genomic DNA (Homo sapiens) CpG-island No: 6236
aatacgcaaaaacgtaaaattaccaacgacgatataatacgaatatttaaccatcgtaacgaaattcgactaccaaccaaaataacaccacgtattctccctaaaattaacgctataaaccaataaacctaacacgaaaccaatatatctaacgataaaatcgaccataacgactatataaatacgctcaacactctataaacctttaacattaaaaaaaaaaacccgcaacaactatcgatccaaatcgaaaaatataccacgacacgtattcgaataacctcgacgaaaccacataacacgcgaaacctcccgaaaaccaaaaaaaacacaaaactaaaactcgctaaataccgcaaaaacacgacgaatacaaacgaaaaccgaaacaaaaaacccaacaccgaactacaaccgaacgaaacaactaaatccaaaaatcgaaaatataaaattatcacgaccgtacacgacacgcaacacccgcccaccaacccccccctccccgcaccgactcgcaacccccctcaccgcgtacgaccgcccaccaccccaccacccccacg

SEQ ID NO: 6237 - DNA, 533 bp, Artificial Sequence
  chemically treated genomic DNA (Homo sapiens) CpG-island No: 6237
gtcgttttaatcgtagagttgttcgagtcgtcgatttttcggtagggggcgtcgtattttttttcgaaggtcgttgtcggttgtagttttcgtttttagtttcgcggttatttgtagcgggtgtatttaggttttcgttcggtcggttttatcggtagtttttatagttcgttcgtattgtcgtcgttcgtttttgcgtttagggtagtcgtcgtcggtattgcgtcgttttttcgtcgttttttgtcgttcggcgtttgagagtttgaggttttagaaggtcgcgtaacgggtttttggagtgttcgtgtttttttttgcgattttatggcggatatttcggttaggtcgtggtattgaagttcggttgtcgtcggggggcgttacgcgttgtagaaatcggttcgcgtcgcgtagcgtaatgttcgtacgttacgtacggggggcgggttttcgaagtttaggttggaggttttattttgtcgttgggaaggaacgagtttattggttcgtgtttagtgggatcgtttatt

SEQ ID NO: 6238 - DNA, 533 bp, Artificial Sequence
  chemically treated genomic DNA (Homo sapiens) CpG-island No: 6238
aataaacgatcccactaaacacgaaccaataaactcgttccttcccaacgacaaaataaaacctccaacctaaacttcgaaaacccgccccccgtacgtaacgtacgaacattacgctacgcgacgcgaaccgatttctacaacgcgtaacgccccccgacgacaaccgaacttcaataccacgacctaaccgaaatatccgccataaaatcgcaaaaaaaaacacgaacactccaaaaacccgttacgcgaccttctaaaacctcaaactctcaaacgccgaacgacaaaaaacgacgaaaaaacgacgcaataccgacgacgactaccctaaacgcaaaaacgaacgacgacaatacgaacgaactataaaaactaccgataaaaccgaccgaacgaaaacctaaatacacccgctacaaataaccgcgaaactaaaaacgaaaactacaaccgacaacgaccttcgaaaaaaaatacgacgccccctaccgaaaaatcgacgactcgaacaactctacgattaaaacgac

SEQ ID NO: 6239 - DNA, 533 bp, Artificial Sequence
  chemically treated genomic DNA (Homo sapiens) CpG-island No: 6239
ggtgaacggttttattgggtacggattaatgggttcgtttttttttagcggtagggtgggatttttagtttgggtttcggagattcgtttttcgtacgtggcgtgcgggtattgcgttacgcggcgcgggtcggtttttatagcgcgtggcgtttttcggcggtagtcgggttttaatgttacggtttgatcggagtgttcgttatggagtcgtagaaagaggtacgaatattttaggagttcgttgcgcggttttttggggttttaagtttttagacgtcgaacgataaggagcggcgggagggcggcgtagtgtcggcggcggttgttttgggcgtagaggcggacgacgatagtgcggacgggttgtgggagttgtcggtggagtcggtcgagcggaggtttgagtgtattcgttgtaggtgatcgcggggttgggggcggggattgtagtcggtagcggttttcggaggagggtgcggcgttttttgtcggggagtcggcggttcgggtagttttgcgattagggcggt

SEQ ID NO: 6240 - DNA, 533 bp, Artificial Sequence
  chemically treated genomic DNA (Homo sapiens) CpG-island No: 6240
accgccctaatcgcaaaactacccgaaccgccgactccccgacaaaaaacgccgcaccctcctccgaaaaccgctaccgactacaatccccgcccccaaccccgcgatcacctacaacgaatacactcaaacctccgctcgaccgactccaccgacaactcccacaacccgtccgcactatcgtcgtccgcctctacgcccaaaacaaccgccgccgacactacgccgccctcccgccgctccttatcgttcgacgtctaaaaacttaaaaccccaaaaaaccgcgcaacgaactcctaaaatattcgtacctctttctacgactccataacgaacactccgatcaaaccgtaacattaaaacccgactaccgccgaaaaacgccacgcgctataaaaaccgacccgcgccgcgtaacgcaatacccgcacgccacgtacgaaaaacgaatctccgaaacccaaactaaaaatcccaccctaccgctaaaaaaaaacgaacccattaatccgtacccaataaaaccgttcacc

SEQ ID NO: 6241 - DNA, 588 bp, Artificial Sequence
  chemically treated genomic DNA (Homo sapiens) CpG-island No: 6241
tcgtagcgttgtgggttaataatgttaaattgcgaatgtcgcgtagtcgtattcgtattatgtaggttattattggcggtattatcgtcggttttggcgcgcgtttggtaatgggttgtaatttggcggcgttttttatcggtattttttagttttcgttgtatgtttggttttttgttatcgttattgttattggtttatggtttggcgcgcgttttattttgttgtttatttttcgtattttcgtgaaaatgtagaaagtttttgtcgttttatcgttgacgtaaaaatcggattaggcgcggcgtcgttttcgtttcgggatgttggtttttttcggtatgttgggttgggcgttgtttatagcgatgaattaatttaaattggggttggtaatgttgtttggcgtcggttttggtttattgattgaacgtgcgtaaatttgttttattttagcgtttcgcgatatgtggattatcggacgtatttatatggcgtaatgtcgttgttggagtcgattaagaagatgtttaagtttgacgataatcgtaataacgttatcggtttgttggaagattcgaaatcggt

SEQ ID NO: 6242 - DNA, 588 bp, Artificial Sequence
  chemically treated genomic DNA (Homo sapiens) CpG-island No: 6242
accgatttcgaatcttccaacaaaccgataacgttattacgattatcgtcaaacttaaacatcttcttaatcgactccaacaacgacattacgccatataaatacgtccgataatccacatatcgcgaaacgctaaaataaaacaaatttacgcacgttcaatcaataaaccaaaaccgacgccaaacaacattaccaaccccaatttaaattaattcatcgctataaacaacgcccaacccaacataccgaaaaaaaccaacatcccgaaacgaaaacgacgccgcgcctaatccgatttttacgtcaacgataaaacgacaaaaactttctacattttcacgaaaatacgaaaaataaacaacaaaataaaacgcgcgccaaaccataaaccaataacaataacgataacaaaaaaccaaacatacaacgaaaactaaaaaataccgataaaaaacgccgccaaattacaacccattaccaaacgcgcgccaaaaccgacgataataccgccaataataacctacataatacgaatacgactacgcgacattcgcaatttaacattattaacccacaacgctacga

SEQ ID NO: 6243 - DNA, 588 bp, Artificial Sequence
  chemically treated genomic DNA (Homo sapiens) CpG-island No: 6243
atcgatttcggattttttagtaggtcgataacgttattgcgattatcgttagatttggatatttttttggtcggttttagtagcgatattacgttatatgggtacgttcggtgatttatatatcgcggaacgttgaagtaaagtagatttgcgtacgtttaattagtaaattaaagtcgacgttaaatagtattgttagttttagtttgggttggtttatcgttgtgagtagcgtttagtttagtatgtcgaaaaagattagtatttcgagacgaaaacgacgtcgcgtttgattcggtttttgcgttagcggtgaggcggtagaaattttttgtatttttacgggaatacggaagatgggtagtagggtaaagcgcgcgttaaattatgaattaatggtagtggcgatggtaaagaattaggtatgtagcgagaattgaggaatatcggtaaagaacgtcgttaggttatagtttattgttagacgcgcgttaaaatcggcgataatgtcgttaatgatggtttgtataatgcggatacggttgcgcggtattcgtagtttgatattgttggtttatagcgttgcgg

SEQ ID NO: 6244 - DNA, 588 bp, Artificial Sequence
  chemically treated genomic DNA (Homo sapiens) CpG-island No: 6244
ccgcaacgctataaaccaacaatatcaaactacgaataccgcgcaaccgtatccgcattatacaaaccatcattaacgacattatcgccgattttaacgcgcgtctaacaataaactataacctaacgacgttctttaccgatattcctcaattctcgctacatacctaattctttaccatcgccactaccattaattcataatttaacgcgcgctttaccctactacccatcttccgtattcccgtaaaaatacaaaaaatttctaccgcctcaccgctaacgcaaaaaccgaatcaaacgcgacgtcgttttcgtctcgaaatactaatctttttcgacatactaaactaaacgctactcacaacgataaaccaacccaaactaaaactaacaatactatttaacgtcgactttaatttactaattaaacgtacgcaaatctactttacttcaacgttccgcgatatataaatcaccgaacgtacccatataacgtaatatcgctactaaaaccgaccaaaaaaatatccaaatctaacgataatcgcaataacgttatcgacctactaaaaaatccgaaatcgat

SEQ ID NO: 6245 - DNA, 520 bp, Artificial Sequence
  chemically treated genomic DNA (Homo sapiens) CpG-island No: 6245
gcgggcgtaaaaggggtagttcggtttatttacgtgatttcgtaattatttatgggtattttaatcgattgcgtttacgtcgattcggtttatagttttattcgggaaggcgaaagtaaagggtaattgttgttggatggtcgtaacgtcgggttggttgtcgttatcggttcgattatttttgtggatgtggattcgaatgcgtttttaagtcgcgaagagattttcggttcggtgttggtggttacgcgttttatattagaagaataggcgttatagtttgttaacgatagttagtacggttttggcgcggcggtatggacgcgcgatttttttcgcgcgtatcgtatgagtcgacgtttgaaagtcggtttcgttttcgttaataattataacgacggcgatatgatcgtgtcgtttggcggttataagtagagcggtaacggtcgcgataaatttttgtatgtttttgaaaaatttattgaattgaaaattatttggataagtttggaggtttgaa

SEQ ID NO: 6246 - DNA, 520 bp, Artificial Sequence
  chemically treated genomic DNA (Homo sapiens) CpG-island No: 6246
ttcaaacctccaaacttatccaaataattttcaattcaataaatttttcaaaaacatacaaaaatttatcgcgaccgttaccgctctacttataaccgccaaacgacacgatcatatcgccgtcgttataattattaacgaaaacgaaaccgactttcaaacgtcgactcatacgatacgcgcgaaaaaaatcgcgcgtccataccgccgcgccaaaaccgtactaactatcgttaacaaactataacgcctattcttctaatataaaacgcgtaaccaccaacaccgaaccgaaaatctcttcgcgacttaaaaacgcattcgaatccacatccacaaaaataatcgaaccgataacgacaaccaacccgacgttacgaccatccaacaacaattaccctttactttcgccttcccgaataaaactataaaccgaatcgacgtaaacgcaatcgattaaaatacccataaataattacgaaatcacgtaaataaaccgaactaccccttttacgcccgc

SEQ ID NO: 6247 - DNA, 520 bp, Artificial Sequence
  chemically treated genomic DNA (Homo sapiens) CpG-island No: 6247
tttaggtttttaggtttatttagatggtttttagtttagtgaattttttaagggtatgtagggatttgtcgcgatcgttgtcgttttgtttatagtcgttaaacggtacggttatatcgtcgtcgttgtagttattgacgaagacggaatcggtttttaggcgtcggtttatgcggtgcgcgcgggagaggtcgcgcgtttatatcgtcgcgttaaggtcgtattggttgtcgttggtaagttgtagcgtttgtttttttgatgtgaaacgcgtgattattagtatcggatcgaaaattttttcgcgatttaaggacgtattcgggtttatatttataaagatggtcgggtcgatggcggtagttagttcggcgttacggttatttaataatagttgttttttgttttcgttttttcgaataaagttatggatcgagtcggcgtgggcgtagtcgattaaggtgtttatgggtggttgcgggattacgtggatgggtcgagttgttttttttgcgttcgt

SEQ ID NO: 6248 - DNA, 520 bp, Artificial Sequence
  chemically treated genomic DNA (Homo sapiens) CpG-island No: 6248
acgaacgcaaaaaaaacaactcgacccatccacgtaatcccgcaaccacccataaacaccttaatcgactacgcccacgccgactcgatccataactttattcgaaaaaacgaaaacaaaaaacaactattattaaataaccgtaacgccgaactaactaccgccatcgacccgaccatctttataaatataaacccgaatacgtccttaaatcgcgaaaaaattttcgatccgatactaataatcacgcgtttcacatcaaaaaaacaaacgctacaacttaccaacgacaaccaatacgaccttaacgcgacgatataaacgcgcgacctctcccgcgcgcaccgcataaaccgacgcctaaaaaccgattccgtcttcgtcaataactacaacgacgacgatataaccgtaccgtttaacgactataaacaaaacgacaacgatcgcgacaaatccctacatacccttaaaaaattcactaaactaaaaaccatctaaataaacctaaaaacctaaa

SEQ ID NO: 6249 - DNA, 595 bp, Artificial Sequence
  chemically treated genomic DNA (Homo sapiens) CpG-island No: 6249
  misc_feature (459)..(459): n is either a, c, g or t
gtattcggtatcggtttaattttgtaaaatcgatgatattagtagttgtgtatacggatgatgcgggtcgtcgagtacgcggtcggttaatttattttttattatttgtttttgttttattattagtaaacggttcgttagtaggcgggcgacgtttaaattatgggtgataattattatcgcgaggtttagttttattattaggtcgcgtagtaggtcgagtaggcgggtttgtatcgatatatttagttcgtcggtcggtttatttataaatattagtttcggatgcgttattaggttgcgggtaatttgtaaacgttgttgtatatcgtcggaaaaggtggtcggtaggtcgtcgattcggttggcgggaatttttattttttttagttatttttgcgcggtggtacgaatatcgtcgtaatgacgtgtttcggtcgttattagtcgttcgtcgantttgtcgtttgtcgatatttggcggcgtaggtcgtcgagtggatgttgatgtattacgttttattcggtacgtagttagcggacggcggtcgggttcgtttttttggttataagggacgggtttttttgtgggttt

SEQ ID NO: 6250 - DNA, 595 bp, Artificial Sequence
  chemically treated genomic DNA (Homo sapiens) CpG-island No: 6250
  misc_feature (137)..(137): n is either a, c, g or t
aaacccacaaaaaaacccgtcccttataaccaaaaaaacgaacccgaccgccgtccgctaactacgtaccgaataaaacgtaatacatcaacatccactcgacgacctacgccgccaaatatcgacaaacgacaaantcgacgaacgactaataacgaccgaaacacgtcattacgacgatattcgtaccaccgcgcaaaaataactaaaaaaaataaaaattcccgccaaccgaatcgacgacctaccgaccaccttttccgacgatatacaacaacgtttacaaattacccgcaacctaataacgcatccgaaactaatatttataaataaaccgaccgacgaactaaatatatcgatacaaacccgcctactcgacctactacgcgacctaataataaaactaaacctcgcgataataattatcacccataatttaaacgtcgcccgcctactaacgaaccgtttactaataataaaacaaaaacaaataataaaaaataaattaaccgaccgcgtactcgacgacccgcatcatccgtatacacaactactaatatcatcgattttacaaaattaaaccgataccgaatac

SEQ ID NO: 6251 - DNA, 595 bp, Artificial Sequence
  chemically treated genomic DNA (Homo sapiens) CpG-island No: 6251
  misc_feature (137)..(137): n is either a, c, g or t
aaatttatagagagattcgttttttgtagttaaaggagcgagttcgatcgtcgttcgttggttgcgtatcgaatggggcgtggtgtattagtatttattcgacggtttgcgtcgttaggtgtcggtaggcggtaaantcggcgagcggttgatggcgatcggggtacgttattacggcgatattcgtgttatcgcgtagaagtggttggaagaggtggagattttcgttaatcggatcgacgatttgtcgattatttttttcggcggtatgtagtagcgtttgtagattgttcgtaatttggtgacgtattcgaagttggtgtttatggatgaatcgatcggcgggttggatgtgtcggtgtaggttcgtttgttcgatttgttgcgcggtttggtggtggagttgaatttcgcggtggtgattgttatttatgatttaggcgtcgttcgtttgttggcggatcgtttgttggtgatgaagtaggggtaagtggtggagagtgggttaatcgatcgcgtgttcgacgattcgtattattcgtatatatagttgttggtgttatcggttttgtagaattgagtcggtgtcggatgt

SEQ ID NO: 6252 - DNA, 595 bp, Artificial Sequence
  chemically treated genomic DNA (Homo sapiens) CpG-island No: 6252
  misc_feature (459)..(459): n is either a, c, g or t
acatccgacaccgactcaattctacaaaaccgataacaccaacaactatatatacgaataatacgaatcgtcgaacacgcgatcgattaacccactctccaccacttacccctacttcatcaccaacaaacgatccgccaacaaacgaacgacgcctaaatcataaataacaatcaccaccgcgaaattcaactccaccaccaaaccgcgcaacaaatcgaacaaacgaacctacaccgacacatccaacccgccgatcgattcatccataaacaccaacttcgaatacgtcaccaaattacgaacaatctacaaacgctactacataccgccgaaaaaaataatcgacaaatcgtcgatccgattaacgaaaatctccacctcttccaaccacttctacgcgataacacgaatatcgccgtaataacgtaccccgatcgccatcaaccgctcgccgantttaccgcctaccgacacctaacgacgcaaaccgtcgaataaatactaatacaccacgccccattcgatacgcaaccaacgaacgacgatcgaactcgctcctttaactacaaaaaacgaatctctctataaattt

SEQ ID NO: 6253 - DNA, 527 bp, Artificial Sequence
  chemically treated genomic DNA (Homo sapiens) CpG-island No: 6253
ggtcggacgtgggggtcggcgtgagaatttcgtttatttgtgagtcggttttacgtcgttagatttaatttatttcgtcgttaaagttttatagttatttgttcgagtggaacggtttttagcgttggttttatcgggttttttagttagcgcggggatgttttttaatacgatagtatcgtttcgttaaagtaaggagggggtgtagggggaggcggtagagcgcggtgcgcggggttggtaggtagttttttttcgcgagcgagtcgattttgaattttaagcgattgattaggaagtttaggtcgtttttattattttgagtagttaaatgcgacggcgtagggattttaaggggtttttgcggaggcggtaatgaggttatcgttattgcgttagttcgcgggcgggagggggcgaaggtttgcggatacgtgtgaatatagtttgtgaatcgagttatatttgtatttacgtgattttcggggttttagtattgatttaggaaaattcggtatttggatttg

SEQ ID NO: 6254 - DNA, 527 bp, Artificial Sequence
  chemically treated genomic DNA (Homo sapiens) CpG-island No: 6254
caaatccaaataccgaattttcctaaatcaatactaaaaccccgaaaatcacgtaaatacaaatataactcgattcacaaactatattcacacgtatccgcaaaccttcgccccctcccgcccgcgaactaacgcaataacgataacctcattaccgcctccgcaaaaaccccttaaaatccctacgccgtcgcatttaactactcaaaataataaaaacgacctaaacttcctaatcaatcgcttaaaattcaaaatcgactcgctcgcgaaaaaaaactacctaccaaccccgcgcaccgcgctctaccgcctccccctacaccccctccttactttaacgaaacgatactatcgtattaaaaaacatccccgcgctaactaaaaaacccgataaaaccaacgctaaaaaccgttccactcgaacaaataactataaaactttaacgacgaaataaattaaatctaacgacgtaaaaccgactcacaaataaacgaaattctcacgccgacccccacgtccgacc

SEQ ID NO: 6255 - DNA, 527 bp, Artificial Sequence
  chemically treated genomic DNA (Homo sapiens) CpG-island No: 6255
tagatttaaatgtcgagtttttttgggttagtgttggggtttcgggggttacgtgaatatagatgtggttcggtttataggttgtgtttatacgtgttcgtagattttcgttttttttcgttcgcgggttggcgtagtgacggtgattttattatcgttttcgtaaaggttttttgaaatttttgcgtcgtcgtatttggttgtttaaagtgatgggaacggtttgagttttttgattaatcgtttaaaatttagggtcggttcgttcgcgggagagggttgtttgttagtttcgcgtatcgcgttttgtcgtttttttttatattttttttttgttttggcggggcgatgttgtcgtattggaaaatattttcgcgttggttggggggttcggtggggttagcgttggaagtcgttttattcgagtagatggttgtgaaattttggcggcgagataaattgggtttgacggcgtgaggtcggtttatagatgggcgggatttttacgtcggtttttacgttcggtt

SEQ ID NO: 6256 - DNA, 527 bp, Artificial Sequence
  chemically treated genomic DNA (Homo sapiens) CpG-island No: 6256
aaccgaacgtaaaaaccgacgtaaaaatcccgcccatctataaaccgacctcacgccgtcaaacccaatttatctcgccgccaaaatttcacaaccatctactcgaataaaacgacttccaacgctaaccccaccgaaccccccaaccaacgcgaaaatattttccaatacgacaacatcgccccgccaaaacaaaaaaaaaatataaaaaaaaacgacaaaacgcgatacgcgaaactaacaaacaaccctctcccgcgaacgaaccgaccctaaattttaaacgattaatcaaaaaactcaaaccgttcccatcactttaaacaaccaaatacgacgacgcaaaaatttcaaaaaacctttacgaaaacgataataaaatcaccgtcactacgccaacccgcgaacgaaaaaaaacgaaaatctacgaacacgtataaacacaacctataaaccgaaccacatctatattcacgtaacccccgaaaccccaacactaacccaaaaaaactcgacatttaaatcta

SEQ ID NO: 6257 - DNA, 546 bp, Artificial Sequence
  chemically treated genomic DNA (Homo sapiens) CpG-island No: 6257
gtttgataagacgcggtagcgtcgtattaggcgtttaatatacggtattatgaaacggatttagcgttaggattatcgtttggtgatagacgttggcgcgagtgagtttttcggcggtaaatacgtcgatcgttttttttttacgattaattttattaatatcggtataacgcgatattacgggattaagcgttttatttttacgtattttttttagaattatcgtaggtaacggtaaagtagtcgaacgcgtttcgtcgcgttggttggcgtttttaattattatttaattgaaagtgttgttattatcgatgttagttttaatcgttatttaaaaattagtttttggaagtaaacggcgggtattggttattcgatttcgtgcgttagcgcgcgtttttttattgttaaagggttgtttcggtatatcgttttcgacggtaacggatgtaatatggtaggatttttcgtcgaagatttcgtgaaatgtttgtagaatggtttgaattttagcgggattggtggtcgtatagataatttggtgta

SEQ ID NO: 6258 - DNA, 546 bp, Artificial Sequence
  chemically treated genomic DNA (Homo sapiens) CpG-island No: 6258
tacaccaaattatctatacgaccaccaatcccgctaaaattcaaaccattctacaaacatttcacgaaatcttcgacgaaaaatcctaccatattacatccgttaccgtcgaaaacgatataccgaaacaaccctttaacaataaaaaaacgcgcgctaacgcacgaaatcgaataaccaatacccgccgtttacttccaaaaactaatttttaaataacgattaaaactaacatcgataataacaacactttcaattaaataataattaaaaacgccaaccaacgcgacgaaacgcgttcgactactttaccgttacctacgataattctaaaaaaaatacgtaaaaataaaacgcttaatcccgtaatatcgcgttataccgatattaataaaattaatcgtaaaaaaaaaacgatcgacgtatttaccgccgaaaaactcactcgcgccaacgtctatcaccaaacgataatcctaacgctaaatccgtttcataataccgtatattaaacgcctaatacgacgctaccgcgtcttatcaaac

SEQ ID NO: 6259 - DNA, 546 bp, Artificial Sequence
  chemically treated genomic DNA (Homo sapiens) CpG-island No: 6259
tgtattaagttgtttgtgcgattattaatttcgttaaaatttaggttattttgtaggtattttacgagattttcggcgaaggattttgttatattgtattcgttgtcgtcgagagcggtgtatcggaatagttttttggtagtgaggaaacgcgcgttggcgtacgaaatcgggtagttaatgttcgtcgtttatttttagaggttgatttttgggtggcgattgaagttggtatcgatggtgatagtatttttagttgggtggtgattgaaaacgttagttagcgcggcgaggcgcgttcggttattttgtcgttgtttgcggtgattttggaaaaagtgcgtgaaggtgaggcgtttggtttcgtgatgtcgcgttatatcggtattgatgagattggtcgtaaggaaggggcgatcggcgtgtttatcgtcgggaaatttattcgcgttagcgtttattattaggcggtgattttggcgttgagttcgttttataatgtcgtgtattaagcgtttgatgcgacgttgtcgcgttttattaggt

SEQ ID NO: 6260 - DNA, 546 bp, Artificial Sequence
  chemically treated genomic DNA (Homo sapiens) CpG-island No: 6260
acctaataaaacgcgacaacgtcgcatcaaacgcttaatacacgacattataaaacgaactcaacgccaaaatcaccgcctaataataaacgctaacgcgaataaatttcccgacgataaacacgccgatcgccccttccttacgaccaatctcatcaataccgatataacgcgacatcacgaaaccaaacgcctcaccttcacgcactttttccaaaatcaccgcaaacaacgacaaaataaccgaacgcgcctcgccgcgctaactaacgttttcaatcaccacccaactaaaaatactatcaccatcgataccaacttcaatcgccacccaaaaatcaacctctaaaaataaacgacgaacattaactacccgatttcgtacgccaacgcgcgtttcctcactaccaaaaaactattccgatacaccgctctcgacgacaacgaatacaatataacaaaatccttcgccgaaaatctcgtaaaatacctacaaaataacctaaattttaacgaaattaataatcgcacaaacaacttaataca

SEQ ID NO: 6261 - DNA, 795 bp, Artificial Sequence
  chemically treated genomic DNA (Homo sapiens) CpG-island No: 6261
aggcgggcggcggggagaatggttagtgtcgcgttcgaggattgtagttcgttcgggaggagagggttggatttcgaggggttaggggcgttcgtagtcgtcgtgttcgggaggggcgttcgtttttttgataatcgcgttaagggcgtagttttttttttgggtcgggggaggggagagaaaacgaggggattttttgcgttaaggcggcggcggttaagggtgttttttgggcgtagtagtcgtaggtttggttcgcggggttttgttcgttcgcggttcgcgtttatcgtgtattttcgttttaggtcgttttttttatagcgaaaggacgggatgtagatttttatggtcgcgtcggttagtcggttgagggcgagttgggggtaggtttacggtcgcggtcgtcgtttcgtttacggtcgggtcgtttcgtttttcgtttcgttgcgttcgcggggtttcgaggttgcgggtcggatttaggtttgcgggttgattcggtcgttttcgcgttttgggcgtgtcgggggtcggaagtagagggcgtagggttttaggcgtttgggtttcgggtttaacgggcggtggagattagttgggttcgaaagaggcggggttagaaaatttgagtttgtagaaacggggtgtgcgcgttaacgcgttgggcgcggggattgggtcgtattcggcgttttttgttttgcggatttcggttggagtttgatttgtagtttgttagacgttattattaagagattgttagatagtaaagaatagaaagagtggcgtttt

SEQ ID NO: 6262 - DNA, 795 bp, Artificial Sequence
  chemically treated genomic DNA (Homo sapiens) CpG-island No: 6262
aaaacgccactctttctattctttactatctaacaatctcttaataataacgtctaacaaactacaaatcaaactccaaccgaaatccgcaaaacaaaaaacgccgaatacgacccaatccccgcgcccaacgcgttaacgcgcacaccccgtttctacaaactcaaattttctaaccccgcctctttcgaacccaactaatctccaccgcccgttaaacccgaaacccaaacgcctaaaaccctacgccctctacttccgacccccgacacgcccaaaacgcgaaaacgaccgaatcaacccgcaaacctaaatccgacccgcaacctcgaaaccccgcgaacgcaacgaaacgaaaaacgaaacgacccgaccgtaaacgaaacgacgaccgcgaccgtaaacctacccccaactcgccctcaaccgactaaccgacgcgaccataaaaatctacatcccgtcctttcgctataaaaaaaacgacctaaaacgaaaatacacgataaacgcgaaccgcgaacgaacaaaaccccgcgaaccaaacctacgactactacgcccaaaaaacacccttaaccgccgccgccttaacgcaaaaaatcccctcgttttctctcccctcccccgacccaaaaaaaaaactacgcccttaacgcgattatcaaaaaaacgaacgcccctcccgaacacgacgactacgaacgcccctaacccctcgaaatccaaccctctcctcccgaacgaactacaatcctcgaacgcgacactaaccattctccccgccgcccgcct

SEQ ID NO: 6263 - DNA, 795 bp, Artificial Sequence
  chemically treated genomic DNA (Homo sapiens) CpG-island No: 6263
aaagcgttattttttttattttttgttgtttggtaattttttaatggtggcgtttagtaaattgtaaattaagttttagtcggagttcgtagggtagggagcgtcgggtgcggtttagttttcgcgtttagcgcgttggcgcgtatatttcgtttttgtagatttaggttttttggtttcgtttttttcgggtttagttgatttttatcgttcgttaggttcgaaatttaggcgtttggagttttgcgttttttgttttcggttttcggtacgtttagggcgcgggagcggtcgggttagttcgtagatttgagttcggttcgtagtttcggggtttcgcgggcgtagcggggcgggaggcggggcggttcggtcgtgggcggagcggcggtcgcggtcgtgagtttgtttttaattcgtttttagtcggttggtcggcgcggttatggaggtttatatttcgttttttcgttatgaagagagcgatttggagcggggatatacggtaggcgcgggtcgcgggcggatagggtttcgcgagttaggtttgcggttgttgcgtttaggaaatatttttggtcgtcgtcgttttggcgtagggggttttttcgtttttttttttttttttcggtttagaggaagggttgcgtttttggcgcggttgttaaggaaacgggcgtttttttcgggtacggcggttgcgggcgtttttagtttttcggggtttaatttttttttttcggacgagttgtagttttcggacgcggtattagttatttttttcgtcgttcgttt

SEQ ID NO: 6264 - DNA, 795 bp, Artificial Sequence
  chemically treated genomic DNA (Homo sapiens) CpG-island No: 6264
aaacgaacgacgaaaaaaataactaataccgcgtccgaaaactacaactcgtccgaaaaaaaaaaattaaaccccgaaaaactaaaaacgcccgcaaccgccgtacccgaaaaaaacgcccgtttccttaacaaccgcgccaaaaacgcaacccttcctctaaaccgaaaaaaaaaaaaaaaaacgaaaaaaccccctacgccaaaacgacgacgaccaaaaatatttcctaaacgcaacaaccgcaaacctaactcgcgaaaccctatccgcccgcgacccgcgcctaccgtatatccccgctccaaatcgctctcttcataacgaaaaaacgaaatataaacctccataaccgcgccgaccaaccgactaaaaacgaattaaaaacaaactcacgaccgcgaccgccgctccgcccacgaccgaaccgccccgcctcccgccccgctacgcccgcgaaaccccgaaactacgaaccgaactcaaatctacgaactaacccgaccgctcccgcgccctaaacgtaccgaaaaccgaaaacaaaaaacgcaaaactccaaacgcctaaatttcgaacctaacgaacgataaaaatcaactaaacccgaaaaaaacgaaaccaaaaaacctaaatctacaaaaacgaaatatacgcgccaacgcgctaaacgcgaaaactaaaccgcacccgacgctccctaccctacgaactccgactaaaacttaatttacaatttactaaacgccaccattaaaaaattaccaaacaacaaaaaataaaaaaaataacgcttt

SEQ ID NO: 6265 - DNA, 584 bp, Artificial Sequence
  chemically treated genomic DNA (Homo sapiens) CpG-island No: 6265
atcgagtacgttattaatcgcgttgattatggaagttaaacgtttgttcgacgtgttggataagtaattggggtagtataagtttgttgcgggcgatgagtatattattgcggatatggcgatttggtcgtggtttggtaacgtggtgttaggtggtgtgtatgatgtcgttgagttttttgatgcgggtaggtataagtatgtataacgttgggcgaacgaagtaggcgaacgttcggcggtgaaacgtgggcgtattgttaatcgtattaacggatcgttgaatgagtagttgtatgagcgttatgacgttagtgatttcgagacgaatacggtagataagcgttaggggtaagggttggtgttcgtcgtatgtaagttatttaggtcggataaggcgtttacgtcggattcggtaatcgtgtataatgtttgatgcgacgttgtcgcgttttattaggtttacggtttacgggcgaagtgtagttcggataaggcgtttaatttcgtattcggttagtcgtgttattattaacggtatattttagtttattggcgtggtagttaatatgttcgttaataaa

SEQ ID NO: 6266 - DNA, 584 bp, Artificial Sequence
  chemically treated genomic DNA (Homo sapiens) CpG-island No: 6266
tttattaacgaacatattaactaccacgccaataaactaaaatataccgttaataataacacgactaaccgaatacgaaattaaacgccttatccgaactacacttcgcccgtaaaccgtaaacctaataaaacgcgacaacgtcgcatcaaacattatacacgattaccgaatccgacgtaaacgccttatccgacctaaataacttacatacgacgaacaccaacccttacccctaacgcttatctaccgtattcgtctcgaaatcactaacgtcataacgctcatacaactactcattcaacgatccgttaatacgattaacaatacgcccacgtttcaccgccgaacgttcgcctacttcgttcgcccaacgttatacatacttatacctacccgcatcaaaaaactcaacgacatcatacacaccacctaacaccacgttaccaaaccacgaccaaatcgccatatccgcaataatatactcatcgcccgcaacaaacttatactaccccaattacttatccaacacgtcgaacaaacgtttaacttccataatcaacgcgattaataacgtactcgat

SEQ ID NO: 6267 - DNA, 584 bp, Artificial Sequence
  chemically treated genomic DNA (Homo sapiens) CpG-island No: 6267
tttattggcgagtatattggttattacgttaataaattggaatatgtcgttgataatagtacgattggtcggatgcggggttgaacgttttattcgggttatatttcgttcgtaagtcgtaggtttgataagacgcggtagcgtcgtattaggtattgtgtacgattgtcggattcggcgtgaacgttttattcggtttggatggtttgtatgcgacgaatattaatttttatttttgacgtttatttgtcgtattcgtttcgaaattattggcgttatggcgtttatgtaattgtttatttagcggttcgttggtgcggttaataatacgtttacgttttatcgtcggacgttcgtttatttcgttcgtttagcgttgtatatgtttatatttgttcgtattaagaaatttagcggtattatatatattatttaatattacgttgttaaattacggttaaatcgttatattcgtaatggtgtatttatcgttcgtaataaatttatgttgttttagttgtttatttagtacgtcgagtagacgtttggtttttatggttaacgcggttgatggcgtattcgat

SEQ ID NO: 6268 - DNA, 584 bp, Artificial Sequence
  chemically treated genomic DNA (Homo sapiens) CpG-island No: 6268
atcgaatacgccatcaaccgcgttaaccataaaaaccaaacgtctactcgacgtactaaataaacaactaaaacaacataaatttattacgaacgataaatacaccattacgaatataacgatttaaccgtaatttaacaacgtaatattaaataatatatataataccgctaaatttcttaatacgaacaaatataaacatatacaacgctaaacgaacgaaataaacgaacgtccgacgataaaacgtaaacgtattattaaccgcaccaacgaaccgctaaataaacaattacataaacgccataacgccaataatttcgaaacgaatacgacaaataaacgtcaaaaataaaaattaatattcgtcgcatacaaaccatccaaaccgaataaaacgttcacgccgaatccgacaatcgtacacaatacctaatacgacgctaccgcgtcttatcaaacctacgacttacgaacgaaatataacccgaataaaacgttcaaccccgcatccgaccaatcgtactattatcaacgacatattccaatttattaacgtaataaccaatatactcgccaataaa

SEQ ID NO: 6269 - DNA, 1045 bp, Artificial Sequence
  chemically treated genomic DNA (Homo sapiens) CpG-island No: 6269
tagtttaagttttgtgattcggttgatacgatggattattgagaaatttttatttcgtaggacgacgcgttttatgcggtgattatttacgcgtcgggttcgtagtgcgttttgtcgttgatttcgtagatgttgatggaattttttagcggtaatttgttcggtatgacgtagaacgtcgggatgggttgggacgttaataagtttatcggtaaagaggtgttgattatcggtatttagggcggtattcgcgtcggagacggacgtttaatcgcgttgggttattatatcgggtattgggagatcggtatgtagatgtaggcggcggcgaaggagattattcgtaatggcgggatttcgttcgcggttttcgttagcgattcgtgcgacgggcgttcgtagggtacgtacggtatgttcgattttttgtcgtatcgtaacgacgcggcgatcgtgtttcgtcgtttgattcgttttttgtcgacgcggcgggcggtgatcggcgtagcgatttgcgataaagggttgttcgttattatgattgcgttggtcgcgatgtacgatttgtcgattattttggtgtcgggcggggcgacgttgtcgtcgatcgtcggggaagacgcgggtaaggtgtagattatcggcgcgcgtttcgttaattacgaattttttttgtaggaggtcgtcgaattgggttgtcgcgtttgcgtttcgtcgggcggcgggtgttagtttttcggtacggcgggtatttcgtaggtggtcgcggaggcgttgggtttggcgttgtcgtatttcgcgttggcgtcgttcgggtaggcggtgtggttggagatcgttcgttagtcggcgcgcgcggttagcgagttggatagtcgcggtattattacgcgggatatttttttcgataaagttatcgaaaacgcgatggtgatttacgcggcgttcggcggttttattaatttattgttgtatatttcggttatcgtttacgcggcgggttgtacgatttcggacgttgagtattggacgcgtattaatcgta

SEQ ID NO: 6270 - DNA, 1045 bp, Artificial Sequence
  chemically treated genomic DNA (Homo sapiens) CpG-island No: 6270
tacgattaatacgcgtccaatactcaacgtccgaaatcgtacaacccgccgcgtaaacgataaccgaaatatacaacaataaattaataaaaccgccgaacgccgcgtaaatcaccatcgcgttttcgataactttatcgaaaaaaatatcccgcgtaataataccgcgactatccaactcgctaaccgcgcgcgccgactaacgaacgatctccaaccacaccgcctacccgaacgacgccaacgcgaaatacgacaacgccaaacccaacgcctccgcgaccacctacgaaatacccgccgtaccgaaaaactaacacccgccgcccgacgaaacgcaaacgcgacaacccaattcgacgacctcctacaaaaaaaattcgtaattaacgaaacgcgcgccgataatctacaccttacccgcgtcttccccgacgatcgacgacaacgtcgccccgcccgacaccaaaataatcgacaaatcgtacatcgcgaccaacgcaatcataataacgaacaaccctttatcgcaaatcgctacgccgatcaccgcccgccgcgtcgacaaaaaacgaatcaaacgacgaaacacgatcgccgcgtcgttacgatacgacaaaaaatcgaacataccgtacgtaccctacgaacgcccgtcgcacgaatcgctaacgaaaaccgcgaacgaaatcccgccattacgaataatctccttcgccgccgcctacatctacataccgatctcccaatacccgatataataacccaacgcgattaaacgtccgtctccgacgcgaataccgccctaaataccgataatcaacacctctttaccgataaacttattaacgtcccaacccatcccgacgttctacgtcataccgaacaaattaccgctaaaaaattccatcaacatctacgaaatcaacgacaaaacgcactacgaacccgacgcgtaaataatcaccgcataaaacgcgtcgtcctacgaaataaaaatttctcaataatccatcgtatcaaccgaatcacaaaacttaaacta

SEQ ID NO: 6271 - DNA, 1045 bp, Artificial Sequence
  chemically treated genomic DNA (Homo sapiens) CpG-island No: 6271
tacggttgatgcgcgtttagtgtttaacgttcgggatcgtgtagttcgtcgcgtgggcgatggtcggaatgtgtagtagtaaattggtggagtcgtcgaacgtcgcgtggattattatcgcgttttcgatggttttatcggagaggatatttcgcgtggtgatgtcgcggttatttagttcgttgatcgcgcgcgtcgattggcgggcgatttttagttatatcgtttgttcggacggcgttagcgcggagtgcggtagcgttagatttagcgttttcgcgattatttgcgaggtgttcgtcgtgtcgaggaattgatattcgtcgttcggcgaggcgtaggcgcgatagtttagttcggcggttttttgtagggagagttcgtggttggcgaaacgcgcgtcgatggtttgtattttgttcgcgtttttttcgacggtcggcggtagcgtcgtttcgttcggtattagaatagtcggtaggtcgtgtatcgcggttagcgtaattatggtggcgggtagttttttatcgtaggtcgttacgtcgattatcgttcgtcgcgtcggtagggagcggattaggcggcgaaatacgatcgtcgcgtcgttgcggtacggtagggaatcgaatatatcgtgcgtgttttgcgagcgttcgtcgtacggatcgttgacgaaggtcgcgaacgggatttcgttattgcgggtgatttttttcgtcgtcgtttgtatttgtatgtcgattttttaatgttcggtgtggtagtttagcgcgattgggcgttcgttttcggcgcggatgtcgttttgagtgtcgataattagtatttttttgtcggtgagtttgttggcgttttagtttatttcggcgttttgcgttatgtcgaataggttgtcgttgggagattttattagtatttgcggggttagcggtagagcgtattgcggattcgacgcgtgggtgattatcgtataaaacgcgtcgttttgcggggtgaaaattttttaatggtttatcgtattagtcgggttataaagtttgagttg

SEQ ID NO: 6272 - DNA, 1045 bp, Artificial Sequence
  chemically treated genomic DNA (Homo sapiens) CpG-island No: 6272
caactcaaactttataacccgactaatacgataaaccattaaaaaattttcaccccgcaaaacgacgcgttttatacgataatcacccacgcgtcgaatccgcaatacgctctaccgctaaccccgcaaatactaataaaatctcccaacgacaacctattcgacataacgcaaaacgccgaaataaactaaaacgccaacaaactcaccgacaaaaaaatactaattatcgacactcaaaacgacatccgcgccgaaaacgaacgcccaatcgcgctaaactaccacaccgaacattaaaaaatcgacatacaaatacaaacgacgacgaaaaaaatcacccgcaataacgaaatcccgttcgcgaccttcgtcaacgatccgtacgacgaacgctcgcaaaacacgcacgatatattcgattccctaccgtaccgcaacgacgcgacgatcgtatttcgccgcctaatccgctccctaccgacgcgacgaacgataatcgacgtaacgacctacgataaaaaactacccgccaccataattacgctaaccgcgatacacgacctaccgactattctaataccgaacgaaacgacgctaccgccgaccgtcgaaaaaaacgcgaacaaaatacaaaccatcgacgcgcgtttcgccaaccacgaactctccctacaaaaaaccgccgaactaaactatcgcgcctacgcctcgccgaacgacgaatatcaattcctcgacacgacgaacacctcgcaaataatcgcgaaaacgctaaatctaacgctaccgcactccgcgctaacgccgtccgaacaaacgatataactaaaaatcgcccgccaatcgacgcgcgcgatcaacgaactaaataaccgcgacatcaccacgcgaaatatcctctccgataaaaccatcgaaaacgcgataataatccacgcgacgttcgacgactccaccaatttactactacacattccgaccatcgcccacgcgacgaactacacgatcccgaacgttaaacactaaacgcgcatcaaccgta

SEQ ID NO: 6273 - DNA, 560 bp, Artificial Sequence
  chemically treated genomic DNA (Homo sapiens) CpG-island No: 6273
gtgtattttggagttcgcggttattgtatcgtgtttgggggtggtgcgattttgaattgttcgcgaagcgttgtcgtgaggattatacggaggaaggagaaatgtaatattaggggtttggacggttggcgattatatatagttagaggggtttacgcggtttttacgtcgttatttataaggtttcgttacggtcgacgtagacgttagtttgtttgcgttcgtcgtatagacgtttcgtatggatttatattacgttggcggtacgtatcggacgttacgtttatcgttttattgttttttataattatgttttgcgtcgtgaatacggtacgatttttattttattgtattcgattatatgggtcgtttgtcgtacggttgttaatgatacgttgcgatatatataattacgtttagtaatgtgaatgcgtatttttgttgttttgattatattattttgttcggtttgatcgtagggtttgtacgttgggtttattgcgtgatttgtcggatacgttttgattatcgatttatggtttatttcgtgagatgtttat

SEQ ID NO: 6274 - DNA, 560 bp, Artificial Sequence
  chemically treated genomic DNA (Homo sapiens) CpG-island No: 6274
ataaacatctcacgaaataaaccataaatcgataatcaaaacgtatccgacaaatcacgcaataaacccaacgtacaaaccctacgatcaaaccgaacaaaataatataatcaaaacaacaaaaatacgcattcacattactaaacgtaattatatatatcgcaacgtatcattaacaaccgtacgacaaacgacccatataatcgaatacaataaaataaaaatcgtaccgtattcacgacgcaaaacataattataaaaaacaataaaacgataaacgtaacgtccgatacgtaccgccaacgtaatataaatccatacgaaacgtctatacgacgaacgcaaacaaactaacgtctacgtcgaccgtaacgaaaccttataaataacgacgtaaaaaccgcgtaaacccctctaactatatataatcgccaaccgtccaaacccctaatattacatttctccttcctccgtataatcctcacgacaacgcttcgcgaacaattcaaaatcgcaccacccccaaacacgatacaataaccgcgaactccaaaatacac

SEQ ID NO: 6275 - DNA, 560 bp, Artificial Sequence
  chemically treated genomic DNA (Homo sapiens) CpG-island No: 6275
atgggtattttacgaaataagttataagtcggtaattagggcgtattcggtaaattacgtaataaatttaacgtataaattttgcggttaagtcgggtagggtagtgtaattagggtaataaggatgcgtatttatattgttgggcgtaattatgtatgtcgtagcgtattattagtagtcgtgcggtaaacggtttatatagtcgggtatagtaaggtgagggtcgtgtcgtatttacggcgtaaggtatggttataggggatagtagggcggtgggcgtggcgttcggtgcgtgtcgttagcgtggtgtgggtttatgcggggcgtttatgcggcgggcgtaggtaagttggcgtttgcgtcggtcgtaacggggttttataggtggcggcgtaaaagtcgcgtgggtttttttggttgtgtgtagtcgttagtcgtttaggtttttggtattatatttttttttttttcgtgtaatttttacggtaacgtttcgcgggtagtttaaagtcgtattatttttaggtacggtatagtggtcgcgggttttaaaatgtat

SEQ ID NO: 6276 - DNA, 560 bp, Artificial Sequence
  chemically treated genomic DNA (Homo sapiens) CpG-island No: 6276
atacattttaaaacccgcgaccactataccgtacctaaaaataatacgactttaaactacccgcgaaacgttaccgtaaaaattacacgaaaaaaaaaaaaatataataccaaaaacctaaacgactaacgactacacacaaccaaaaaaacccacgcgacttttacgccgccacctataaaaccccgttacgaccgacgcaaacgccaacttacctacgcccgccgcataaacgccccgcataaacccacaccacgctaacgacacgcaccgaacgccacgcccaccgccctactatcccctataaccataccttacgccgtaaatacgacacgaccctcaccttactatacccgactatataaaccgtttaccgcacgactactaataatacgctacgacatacataattacgcccaacaatataaatacgcatccttattaccctaattacactaccctacccgacttaaccgcaaaatttatacgttaaatttattacgtaatttaccgaatacgccctaattaccgacttataacttatttcgtaaaatacccat

SEQ ID NO: 6277 - DNA, 915 bp, Artificial Sequence
  chemically treated genomic DNA (Homo sapiens) CpG-island No: 6277
cgttttcgtttatcgtatttgtagtttcgtttcgtttagggagttttcgttataatattttcggttttagttttttaatcggttttcgtcgttttttatttttttttttttagttttttttttttgtttttatcgttttttttaatatagttacgtgagggacgcgcgcgggggtagttgggagtagtattgtcggttggttagggttcggttttaatatggcggtttcggtcgggtagtgattaaggttttgtcgttcgaaggattaagtggtgattgtcggcgtttttatttatcggggtggaatgcgagtacgcggggacgagcgttgagaagcggcggtgacgggaaggggggggttagtggattgtgttttagaaatcgaagcggcggcgtttgtttttttttgtttttaggttttagtgcgttcggggtttcgttcggtcgggttaggtcggcgggcggcggcggtagttgttgtagtcgtaggataatttcgtagggtgggtcggagggcgggcgtcgtcgttgtttgtgttgcggcgatggtttagtgtgtataattagtgtaggagttaatttcggattttttcgttttttgtgtcgttgcgttgtgtagcgacgaagtcgagcggtttattcgttttaattattttagtttcgcggagttgtttaagtttttttttcgttttattttcgagggtatgtggtatttttttttttttagtgggttttcgtaaagtcgtggtcgggagaaggaagttgcgggcgggtagggaagagaagggtagtgtttacgttttggagtcggtatcgtggcgtttggggttgtggtttcgcggtgtttcgggggcggttggaggagggatcgtgaggttgttaagatagcgtagttttaagttttagtttttttgg

SEQ ID NO: 6278 - DNA, 915 bp, Artificial Sequence
  chemically treated genomic DNA (Homo sapiens) CpG-island No: 6278
ccaaaaaaactaaaacttaaaactacgctatcttaacaacctcacgatccctcctccaaccgcccccgaaacaccgcgaaaccacaaccccaaacgccacgataccgactccaaaacgtaaacactacccttctcttccctacccgcccgcaacttccttctcccgaccacgactttacgaaaacccactaaaaaaaaaaaaataccacataccctcgaaaataaaacgaaaaaaaaacttaaacaactccgcgaaactaaaataattaaaacgaataaaccgctcgacttcgtcgctacacaacgcaacgacacaaaaaacgaaaaaatccgaaattaactcctacactaattatacacactaaaccatcgccgcaacacaaacaacgacgacgcccgccctccgacccaccctacgaaattatcctacgactacaacaactaccgccgccgcccgccgacctaacccgaccgaacgaaaccccgaacgcactaaaacctaaaaacaaaaaaaaacaaacgccgccgcttcgatttctaaaacacaatccactaaccccccccttcccgtcaccgccgcttctcaacgctcgtccccgcgtactcgcattccaccccgataaataaaaacgccgacaatcaccacttaatccttcgaacgacaaaaccttaatcactacccgaccgaaaccgccatattaaaaccgaaccctaaccaaccgacaatactactcccaactacccccgcgcgcgtccctcacgtaactatattaaaaaaaacgataaaaacaaaaaaaaaaaactaaaaaaaaaaaaataaaaaacgacgaaaaccgattaaaaaactaaaaccgaaaatattataacgaaaactccctaaacgaaacgaaactacaaatacgataaacgaaaacg

SEQ ID NO: 6279 - DNA, 915 bp, Artificial Sequence
  chemically treated genomic DNA (Homo sapiens) CpG-island No: 6279
ttagagaaattggagtttaggattgcgttgttttgataattttacggttttttttttagtcgttttcggagtatcgcggggttatagttttagacgttacggtatcggttttaggacgtaaatattgttttttttttttttgttcgttcgtaatttttttttttcgattacggttttgcgggagtttattggaaaagggaggatattatatattttcggaagtgaggcgggagaagggtttaagtagtttcgcgaagttgaggtgattgagacgagtgagtcgttcggtttcgtcgttgtatagcgtagcgatataggggacgaaggagttcgggattagtttttgtattgattgtatatattgggttatcgtcgtagtataggtagcggcggcgttcgtttttcggtttattttgcgaggttattttgcggttgtagtagttatcgtcgtcgttcgtcggtttggttcggtcgggcggggtttcgaacgtattggagtttagaaataagaaggaatagacgtcgtcgtttcggtttttggggtataatttattgattttttttttttcgttatcgtcgttttttagcgttcgttttcgcgtgttcgtattttatttcgataggtggagacgtcgatagttattatttagtttttcggacggtaaaattttggttattgttcggtcggaatcgttatgttgaggtcgaattttgattaatcggtagtattatttttagttgttttcgcgcgcgttttttacgtgattgtgttaaaggagacggtaggggtaagggaagagagttgaggagagggaagtgaaaaacgacggaggtcggttgggaggttggagtcggaagtgttgtgacggaagttttttgggcggggcggggttataagtgcggtgggcgggggcg

SEQ ID NO: 6280 - DNA, 915 bp, Artificial Sequence
  chemically treated genomic DNA (Homo sapiens) CpG-island No: 6280
cgcccccgcccaccgcacttataaccccgccccgcccaaaaaacttccgtcacaacacttccgactccaacctcccaaccgacctccgtcgtttttcacttccctctcctcaactctcttcccttacccctaccgtctcctttaacacaatcacgtaaaaaacgcgcgcgaaaacaactaaaaataatactaccgattaatcaaaattcgacctcaacataacgattccgaccgaacaataaccaaaattttaccgtccgaaaaactaaataataactatcgacgtctccacctatcgaaataaaatacgaacacgcgaaaacgaacgctaaaaaacgacgataacgaaaaaaaaaaaatcaataaattataccccaaaaaccgaaacgacgacgtctattccttcttatttctaaactccaatacgttcgaaaccccgcccgaccgaaccaaaccgacgaacgacgacgataactactacaaccgcaaaataacctcgcaaaataaaccgaaaaacgaacgccgccgctacctatactacgacgataacccaatatatacaatcaatacaaaaactaatcccgaactccttcgtcccctatatcgctacgctatacaacgacgaaaccgaacgactcactcgtctcaatcacctcaacttcgcgaaactacttaaacccttctcccgcctcacttccgaaaatatataatatcctcccttttccaataaactcccgcaaaaccgtaatcgaaaaaaaaaaattacgaacgaacaaaaaaaaaaaaaacaatatttacgtcctaaaaccgataccgtaacgtctaaaactataaccccgcgatactccgaaaacgactaaaaaaaaaaccgtaaaattatcaaaacaacgcaatcctaaactccaatttctctaa

SEQ ID NO: 6281 - DNA, 533 bp, Artificial Sequence
  chemically treated genomic DNA (Homo sapiens) CpG-island No: 6281
tttttgtaattggatttggagttgttattttttaacgttcgtcgcggtggagtttagttttttttttcgaaagttaggttggaggcggtttttaagcgtcgcgcgtttttcggaatttaaatattattcggaatcgtttttgtgaattggaaagtttattgaagttttagagaagtcgcgttattgcggaggtacgtaacgttaagtagggattttttgcgttttcgtcgcggtggttattttggtttgtcgggattatttatttatgttgcgtttgtatttttttgttaggatcgagagcgcgcgagaggagtggttgtgtttattgtatataggcggatttgaggtttggcgacgtcgttggtcgcgatttgggataggacgagtataggaatcgtttggtttgcgttttcgttcgcgtatgaagtcgtggcggcggtcgtttaagtgagttttgcgatttttaggttttattcgttatttttatatagattttgagatttttgattgtgaggggcgttttttcgcgtttt

SEQ ID NO: 6282 - DNA, 533 bp, Artificial Sequence
  chemically treated genomic DNA (Homo sapiens) CpG-island No: 6282
aaaacgcgaaaaaacgcccctcacaatcaaaaatctcaaaatctatataaaaataacgaataaaacctaaaaatcgcaaaactcacttaaacgaccgccgccacgacttcatacgcgaacgaaaacgcaaaccaaacgattcctatactcgtcctatcccaaatcgcgaccaacgacgtcgccaaacctcaaatccgcctatatacaataaacacaaccactcctctcgcgcgctctcgatcctaacaaaaaaatacaaacgcaacataaataaataatcccgacaaaccaaaataaccaccgcgacgaaaacgcaaaaaatccctacttaacgttacgtacctccgcaataacgcgacttctctaaaacttcaataaactttccaattcacaaaaacgattccgaataatatttaaattccgaaaaacgcgcgacgcttaaaaaccgcctccaacctaactttcgaaaaaaaaaactaaactccaccgcgacgaacgttaaaaaataacaactccaaatccaattacaaaaa

SEQ ID NO: 6283 - DNA, 533 bp, Artificial Sequence
  chemically treated genomic DNA (Homo sapiens) CpG-island No: 6283
aggacgcgagaaggcgttttttatagttaggggttttagggtttgtgtggggatggcgggtgaggtttggaggtcgtagggtttatttgagcggtcgtcgttacgattttatgcgcgggcggggacgtaggttaggcggtttttgtgttcgttttgttttaggtcgcgattagcggcgtcgttaagttttagattcgtttgtgtgtaatgggtataattatttttttcgcgcgttttcggttttgataaagaggtatagacgtagtataggtggatggtttcgataagttaaaatggttatcgcggcgaggacgtaggaagtttttgtttgacgttacgtgttttcgtaatggcgcggtttttttgaggttttaatgggttttttaatttatagagacgatttcgggtaatatttaagtttcgagagacgcgcggcgtttaaaggtcgtttttaatttgattttcgaaagaaggggttaagttttatcgcgacgggcgttaggaaatggtaattttaggtttagttgtagagg

SEQ ID NO: 6284 - DNA, 533 bp, Artificial Sequence
  chemically treated genomic DNA (Homo sapiens) CpG-island No: 6284
cctctacaactaaacctaaaattaccatttcctaacgcccgtcgcgataaaacttaaccccttctttcgaaaatcaaattaaaaacgacctttaaacgccgcgcgtctctcgaaacttaaatattacccgaaatcgtctctataaattaaaaaacccattaaaacctcaaaaaaaccgcgccattacgaaaacacgtaacgtcaaacaaaaacttcctacgtcctcgccgcgataaccattttaacttatcgaaaccatccacctatactacgtctatacctctttatcaaaaccgaaaacgcgcgaaaaaaataattatacccattacacacaaacgaatctaaaacttaacgacgccgctaatcgcgacctaaaacaaaacgaacacaaaaaccgcctaacctacgtccccgcccgcgcataaaatcgtaacgacgaccgctcaaataaaccctacgacctccaaacctcacccgccatccccacacaaaccctaaaacccctaactataaaaaacgccttctcgcgtcct

SEQ ID NO: 6285 - DNA, 633 bp, Artificial Sequence
  chemically treated genomic DNA (Homo sapiens) CpG-island No: 6285
ttcgttgtattttatggttttttgtgtttttcggttacgattgtttatagtttcgtttttttcgttgcgtgtcggattatggcgtaggggtagcgtaagttttaggcgtataaattcgtaaagagtaagacggtagcggtagtttttgaaaagaatcggggtttaagaaaaggcggtaaggagcggttcggggatttgggggcgaggtggattttcggtttttcggttttacgtgagtatatttttttttaggtcgtgttatcgtttttaagaaggcgcgcgtcgtgtagtagtaaaagtttaagaaggtgtgcgggggcgagagatggagttcggagggcggcgagtagcgaggggtggaattcggaggacggcgaggggggatgggtggagttcggggattagtgaggggagagggtggattttggggacgagttaggagcgaggggatagagttaggggtcgcgttaggagcgaaggatggagttcggggcgtagagaggggtaagaggtggaagttggcgagggataggggttgggggacgtgttagggacgagagatgaaatttggaggtcggcgagggaaggagtatagggatcggtaaagggtaagggatgaggtttggaggattt

SEQ ID NO: 6286 - DNA, 633 bp, Artificial Sequence
  chemically treated genomic DNA (Homo sapiens) CpG-island No: 6286
aaatcctccaaacctcatcccttaccctttaccgatccctatactccttccctcgccgacctccaaatttcatctctcgtccctaacacgtcccccaacccctatccctcgccaacttccacctcttacccctctctacgccccgaactccatccttcgctcctaacgcgacccctaactctatcccctcgctcctaactcgtccccaaaatccaccctctcccctcactaatccccgaactccacccatcccccctcgccgtcctccgaattccacccctcgctactcgccgccctccgaactccatctctcgcccccgcacaccttcttaaacttttactactacacgacgcgcgccttcttaaaaacgataacacgacctaaaaaaaaatatactcacgtaaaaccgaaaaaccgaaaatccacctcgcccccaaatccccgaaccgctccttaccgccttttcttaaaccccgattcttttcaaaaactaccgctaccgtcttactctttacgaatttatacgcctaaaacttacgctacccctacgccataatccgacacgcaacgaaaaaaacgaaactataaacaatcgtaaccgaaaaacacaaaaaaccataaaatacaacgaa

SEQ ID NO: 6287 - DNA, 633 bp, Artificial Sequence
  chemically treated genomic DNA (Homo sapiens) CpG-island No: 6287
gagttttttaggttttattttttgttttttgtcgatttttgtgttttttttttcgtcggtttttagattttatttttcgtttttagtacgttttttagtttttatttttcgttagtttttattttttatttttttttgcgtttcgggttttatttttcgtttttaacgcggtttttggttttattttttcgtttttagttcgtttttaggatttattttttttttttattgattttcgggttttatttattttttttcgtcgtttttcgggttttatttttcgttattcgtcgtttttcgggttttatttttcgttttcgtatatttttttgagtttttgttgttgtacgacgcgcgtttttttgggagcgataatacgatttggggaaagatgtgtttacgtgaggtcgggaagtcgggggtttatttcgtttttaagttttcgggtcgttttttatcgtttttttttgggtttcgattttttttagaggttgtcgttgtcgttttattttttgcgggtttgtgcgtttgaaatttgcgttgtttttgcgttatggttcggtacgtagcggaagaggcgggattgtgagtagtcgtagtcggaaggtatagggaattatgggatatagcggg

SEQ ID NO: 6288 - DNA, 633 bp, Artificial Sequence
  chemically treated genomic DNA (Homo sapiens) CpG-island No: 6288
cccgctatatcccataattccctataccttccgactacgactactcacaatcccgcctcttccgctacgtaccgaaccataacgcaaaaacaacgcaaatttcaaacgcacaaacccgcaaaaaataaaacgacaacgacaacctctaaaaaaaatcgaaacccaaaaaaaaacgataaaaaacgacccgaaaacttaaaaacgaaataaacccccgacttcccgacctcacgtaaacacatctttccccaaatcgtattatcgctcccaaaaaaacgcgcgtcgtacaacaacaaaaactcaaaaaaatatacgaaaacgaaaaataaaacccgaaaaacgacgaataacgaaaaataaaacccgaaaaacgacgaaaaaaaataaataaaacccgaaaatcaataaaaaaaaaaaataaatcctaaaaacgaactaaaaacgaaaaaataaaaccaaaaaccgcgttaaaaacgaaaaataaaacccgaaacgcaaaaaaaaataaaaaataaaaactaacgaaaaataaaaactaaaaaacgtactaaaaacgaaaaataaaatctaaaaaccgacgaaaaaaaaaacacaaaaatcgacaaaaaacaaaaaataaaacctaaaaaactc

SEQ ID NO: 6289 - DNA, 768 bp, Artificial Sequence
  chemically treated genomic DNA (Homo sapiens) CpG-island No: 6289
gagggcgttgtgggaagcgggcgtgggtgtttagagatttcggggttcgggaaagggatgtagaagggatttgtggcggggacgcgggaaaggggtttggtcgcggggaagaggatcgggtttatcgttggggtttttgggtagcggtttcgtatttcgtcgggttatttagttatatttatttatcgcgtagcgtttttttcgttttggcgtttgttcggaggttcgcggcggttgcggtagttttttagtaataataatttttgtttcggtttttatttcgggggcgtttacgttcgtttgatttcgtcgttcgttaagcgagcgtattaggtcgttgtttagttattcgcgcggttttcgatagcgattggagtagggggtgggtttcggtcgtaaattttttcgtcgtttttattgcgtacgcgtcgtgcggtgttaataataatttatatattaggattcggcgttgtcgcgggtatagcgtacgcgcgaggttattatttcgtttttgggtattttgagtattttagtcgcggggggttggtttttgtattgcgcgcgcgcgtttgttttaagtcgtttttttatttttcgtttttcgcgtcgaatcgtttatgttcgcgagattttttttgatgtttcgttttttttcgattatatttttcggatttttcgcgtatgcgttttgcgtagagaattgtaacgtattttttcgtcgtttagtaaagagtttttaggtgaatagtttgattgcgttgatgttta
